(12) United States Patent
Bentwich et al.

(10) Patent No.: US 7,943,754 B2
(45) Date of Patent: May 17, 2011

(54) BIOINFORMATICALLY DETECTABLE GROUP OF NOVEL REGULATORY BACTERIAL AND BACTERIAL ASSOCIATED OLIGONUCLEOTIDES AND USES THEREOF

(75) Inventors: Itzhak Bentwich, Kfar Daniel (IL); Amir Avniel, Rishon leZion (IL)

(73) Assignee: Rosetta-Genomics, Rehovot (IL)

( * ) Notice: Subject to any disclaimer, the term of this patent is extended or adjusted under 35 U.S.C. 154(b) by 1096 days.

(21) Appl. No.: 10/709,691

(22) Filed: May 24, 2004

(65) Prior Publication Data

US 2007/0031843 A1   Feb. 8, 2007

Related U.S. Application Data

(63) Continuation-in-part of application No. 10/708,951, filed on Apr. 2, 2004.

(60) Provisional application No. 60/521,433, filed on Apr. 26, 2004.

(51) Int. Cl.
*C07H 21/02* (2006.01)
*C07H 21/04* (2006.01)
*C12Q 1/68* (2006.01)

(52) U.S. Cl. .............. 536/24.5; 514/44 A; 536/23.1; 536/24.1; 435/320.1

(58) Field of Classification Search ............... None
See application file for complete search history.

(56) References Cited

U.S. PATENT DOCUMENTS

| | | | | |
|---|---|---|---|---|
| 5,541,308 | A * | 7/1996 | Hogan et al. ............... | 536/23.1 |
| 6,582,908 | B2 * | 6/2003 | Fodor et al. ............... | 435/6 |
| 6,812,339 | B1 * | 11/2004 | Venter et al. ............... | 536/24.31 |
| 7,232,806 | B2 * | 6/2007 | Tuschl et al. ............... | 514/44 |
| 7,250,289 | B2 * | 7/2007 | Zhou ............... | 435/287.2 |

OTHER PUBLICATIONS

New England Biolabs 1998/99 Catalog, cover page, p. 121 and 284.*
Bentwich (2005) FEBS Lett. 5904-5910.*
Krutzfeldt et al. (2006) Nature Genetics 38:514-519.*
Hagiwara et al., J Gene Med. Sep. 2003;5(9):784-94.*
Sunamoto et al., Lab Invest., 1998 78:967-72.*
Martin et al. (2007) J. Biosci. 32:1049-1052.*
Maziere et al. (2007) Drug Discovery Today 12:452-458.*
Smalheiser et al. (2006) Methods Mol. Biol. 342:115-127.*
Watanabe et al. (2007) "Computational Prediction of miRNA Targets" Methods Enzymology 427:65-86.*
Cullen (2004) "Derivation and function of small interfering RNAs and microRNAs" Viral Res. 102:3-9.*
Buck et al. (Biotechniques (1999) 27(3): 526-538).*
Bartel et al. (2004) Cell 116:281-297, pp. 285-288.*
Zamore et al. (2004) PLoS Biology 2(4):0465-0475.*
Dunn et al. GenBank Accession No. AZ593982, published online at NCBI on Dec. 13, 2000.*
Birren et al., GenBank Acc. No. AC015918 "*Homo sapiens* chromosome 17 clone CTD-3165O8 map 17", published online by NCBI on Mar. 27, 2003.*
Brown (1998) "In situ hybridization with riboprobes: An overview for veterinary pathologists" Vet. Pathol. 35:159-167.*
Lerat, E. From Gene Trees to Organismal Phylogeny in Prokaryotes: The Case of the gamma-Proteobacteria. PLoS Biology 2003;1(1):101-9.
Olsen, LC. Human uracil-DNA glycosylase complements *E.coli* ung mutants. Nucleic Acids Research 1991;19(16):4473-8.
Venkatesh, J. Importance of Uracil DNA Glycosylase in *Pseudomonas aeruginosa* and *Mycobacterium smegmatis*, G+C-rich Bacteria, in Mutation Prevention, Tolerance to Acidified Nitrite, and Endurance in Mouse Macrophages. The Journal of Biological Chemistry 2003; 278(27):24350-8.
Bartel, D.P., "MicroRNAs: Genomics, Biogenesis, Mechanism, and Function," Cell, 2004;116:281-97.
Zamore, P.D., et al., "RNAi: Double-Stranded RNA Directs the ATP-Dependent Cleavage of mRNA at 21 to 23 Nucleotide Intervals," Cell, 2000;101:25-33.
Elbashir, S.M. et al., "RNA interference is mediated by 21- and 22-nucleotide RNAs", Genes and Development, 2001;15:188-200.
Lim, L.P. et al., "The microRNAs of *Caenorhabditis elegans*," Genes & Dev., 2003;17:991-1008.
Morin, R.D. et al., "Application of massively parallel sequencing to microRNA profiling and discovery of human embryonic stem cells," Genome Res., 2008;18:610-21.
Doench JG and Sharp PA. Specificity of microRNA target selection in translational repression. Genes Dev, 2004;18(5):504-11.
Granovsky M et al. Suppression of tumor growth and metastasis in Mgat5-deficient mice. Nat Med 2000;6(3):306-12. (Abstract).
Partridge EA et al. Regulation of Cytokine Receptors by Golgi N-Glycan Processing and Endocytosis. Science 2004;306(5693):120-4.
Lai EC. Micro RNAs are complementary to 3' UTR sequence motifs that mediate negative post-transcription. Nature Genetics 2002;30:363-4.
Stark A. Identification of *Drosophila* MicroRNA Targets. PLoS Biology 2003;1(3):397-409.
Lai EC. Predicting and validating microRNA targets. Genome Biology 2004;5:115.

(Continued)

*Primary Examiner* — Sean R McGarry
(74) *Attorney, Agent, or Firm* — Teddy C. Scott, Jr.; Ron Galant; Polsinelli Shughart PC

(57) ABSTRACT

The present invention relates to a first group of novel bacterial and human associated oligonucleotides, here identified as "Genomic Address Messenger" or "GAM" oligonucleotide, and a second group of novel operon-like bacterial and human polynucleotides, here identified as "Genomic Record" or "GR" polynucleotide. GAM oligonucleotides selectively inhibit translation of known "target" genes, many of which are known to be involved in various bacterial infections. Nucleic acid molecules are provided respectively encoding 21,916 bacterial and 6,100 human GAM precursor oligonucleotides, and 6,056 bacterial and 430 human GR polynucleotides, as are vectors and probes both comprising the nucleic acid molecules, and methods and systems for detecting GAM oligonucleotides and GR polynucleotides and specific functions and utilities thereof, for detecting expression of GAM oligonucleotides and GR polynucleotides, and for selectively enhancing and selectively inhibiting translation of the respective target genes thereof.

6 Claims, 27 Drawing Sheets

OTHER PUBLICATIONS

Vella MC. Architecture of a Validated MicroRNA::Target Interaction. Chemistry & Biology 2004;11:1619-23.
Brennecke J. Principles of MicroRNA—Target Recognition. PLoS Biology 2005;3(3):e85.
Lewis BP. Prediction of Mammalian MicroRNA Targets. Cell 2003;115:787-98.
Enright AJ. MicroRNA targets in *Drosophila*. Genome Biology 2003;5:R1.

* cited by examiner

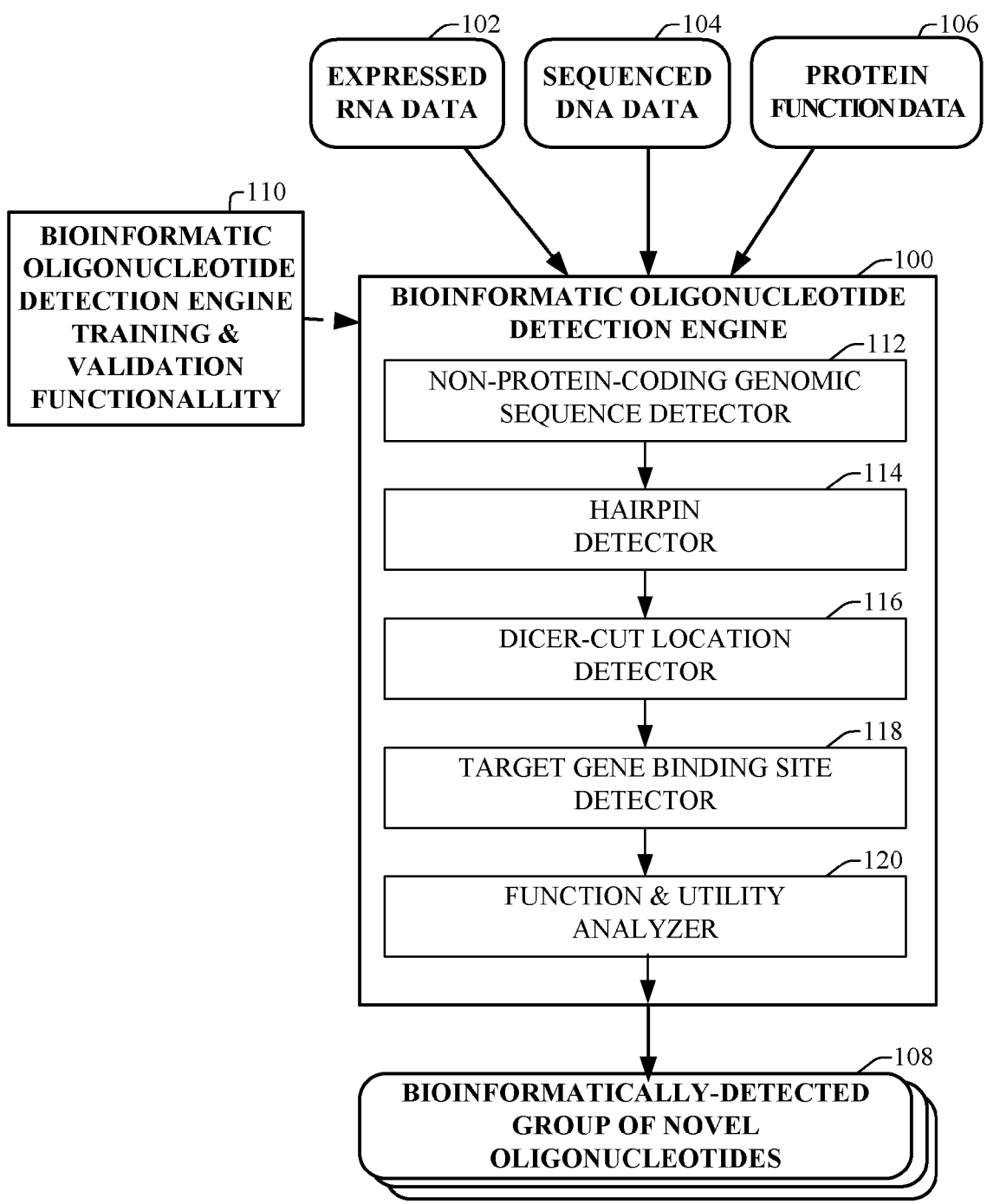

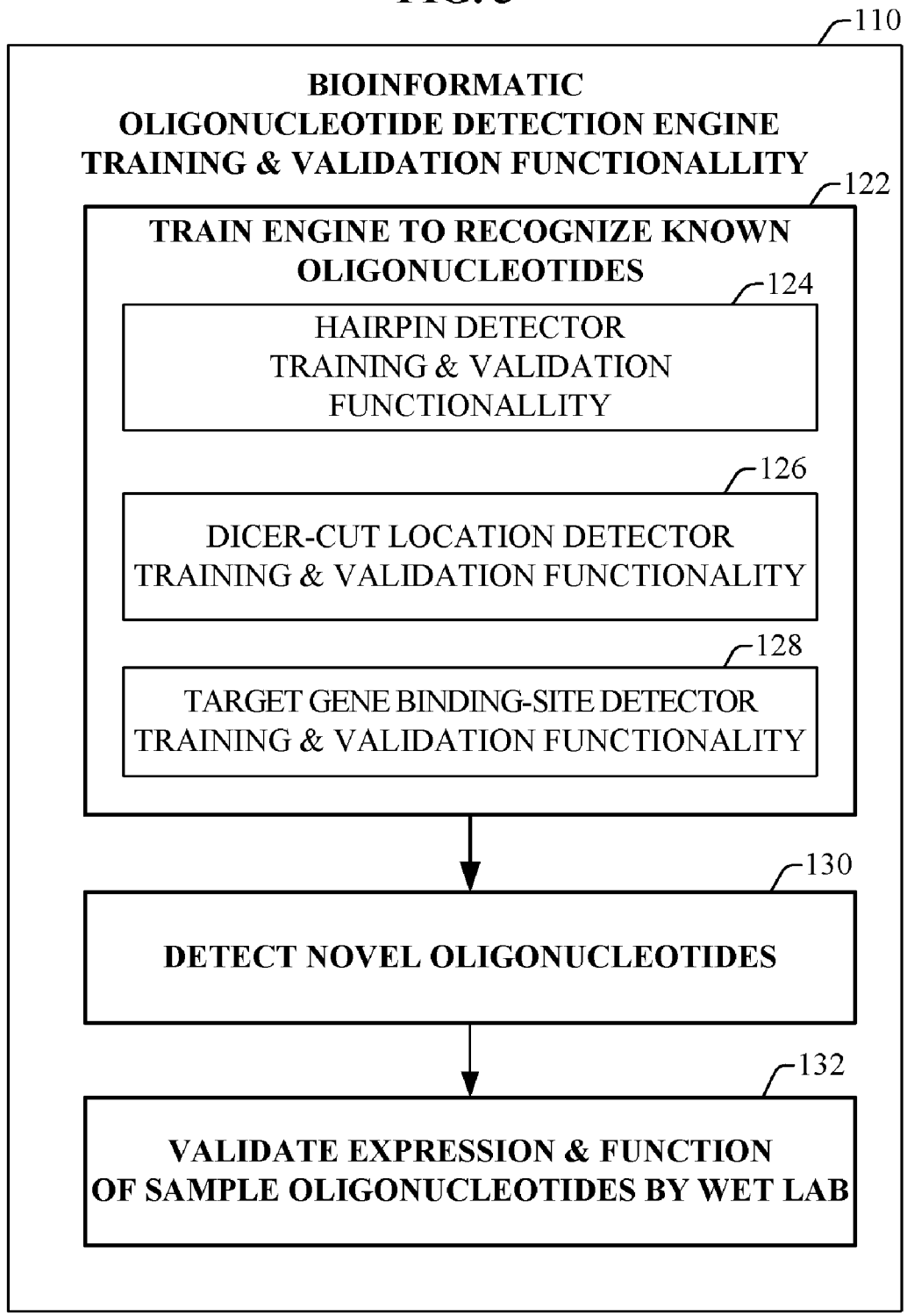

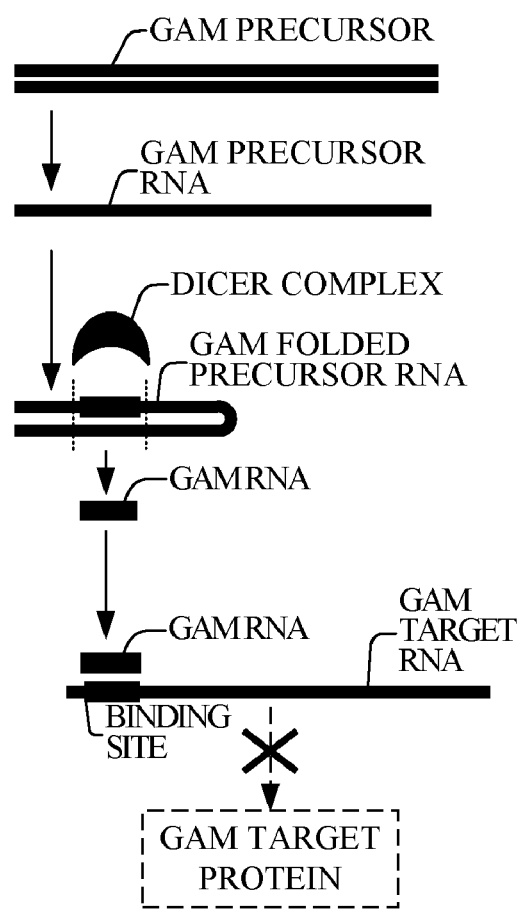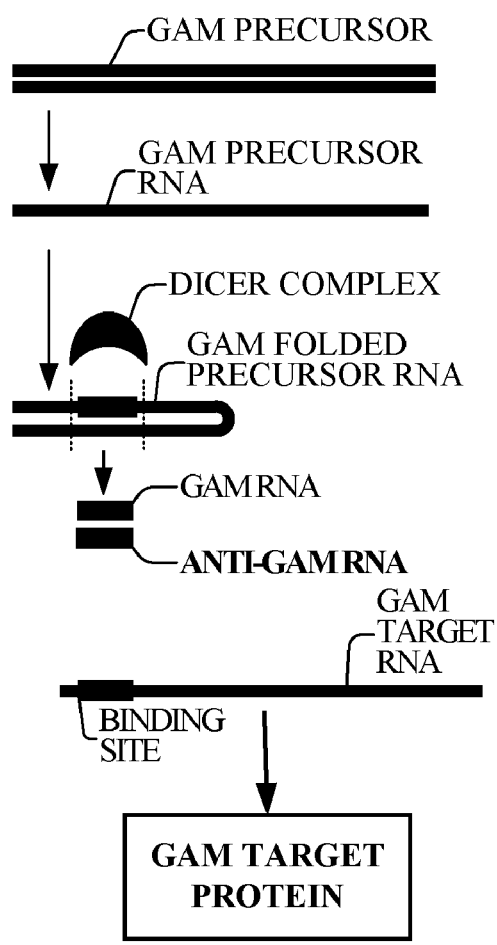

FIG. 13

| ROW | PRIMER SEQUENCE | SEQ ID NO | SEQUENCED SEQENCE | SEQ ID NO | PREDICTED GAM RNA | SEQ ID NO | DIST-ANCE | GAM NAME |
|---|---|---|---|---|---|---|---|---|
| 1* | AATTGCTTGAAC | 4254671 | CCAGGAAGTGGA | 4254700 | AATTGCTTGAACCCAGGAAGTGGA | 4254729 | 0 | 25-A |
| 2* | ACTGCACTCC | 4254672 | AGCCTGGGC | 4254701 | ACTGCACTCCAGCCTGGGCTAC | 4254730 | 0 | 351661-A |
| 3 | CACTGCACTC | 4254673 | CAGCCCGAGCAACA | 4254702 | CACTGCACTCCAGCCCGAGCAA | 4254731 | 0 | 351946-A |
| 4 | CTAGACTGAAG | 4254674 | CTCCTTGAGGAC | 4254703 | CTAGACTGAAGCTCCTTGAGGA | 4254732 | 0 | 352759-A |
| 5 | GAAGTTTGAAG | 4254675 | CCTGTGTTCA | 4254704 | GAAGTTTGAAGCCTGTGTTCA | 4254733 | 0 | 4426-A |
| 6 | TCACTGCAAC | 4254676 | CTCCACCA | 4254705 | (TCACTGCAACCTCCACCACGTG) (TCACTGCAACCTCCACCAGCCT) | 4254734, 4254735 | 0 | (357950-A), (352721-A) |
| 7* | TCTAAGAGAAAG | 4254677 | GAAGTTCAGA | 4254706 | TCTAAGAGAAAGGAAGTTCAGA | 4254736 | 0 | 337950-A |
| 8 | GGGCAGTGGA | 4254678 | GCTGGAA | 4254707 | GGGCGTGGAGCTGGAATGATGT | 4254737 | 1 | 351996-A |
| 9 | AATTGCTTGAAC | 4254679 | CCAAGAAGTGGA | 4254708 | AATCACTTGAACCCAAGAAGTG | 4254738 | 2 | 351874-A |
| 10 | AGCAGCCCA | 4254680 | GGGTTTTGT | 4254709 | AGCAAGACCAGGGTTTTGTGTT | 4254739 | 2 | 352083-A |
| 11 | AGGCAAGACG | 4254681 | GACCAGA | 4254710 | AGGCAGAGAGGACCAGAGACT | 4254740 | 2 | 351944-A |
| 12 | AGGGAAAGAAT | 4254682 | TAATGTAA | 4254711 | GGGAAATAATTAATGTGAAGTC | 4254741 | 2 | 353325-A |
| 13 | AGGGAAAGAAT | 4254683 | TAATGTGAG | 4254712 | AGGAAAAAATTAATGTGAGTC | 4254742 | 2 | 352649-A |
| 14 | ATTCAGTTG | 4254684 | CCCATGTTT | 4254713 | (ATTCATTGCCCATGTTTG), (TATTCATGCCCATGGTGA) | 4254743, 4254744 | 2 | (352957-A, 352960-A) |
| 15 | CTAGACTGAAG | 4254685 | CTCCTTGAGG | 4254714 | CTGGACTGAGCTCCTTGAGGCC | 4254745 | 2 | 352288-A |
| 16 | TTCAGAGTGGT | 4254686 | TAAGTTCTG | 4254715 | TTCTGATGGTTAAGTTCTGTCA | 4254746 | 2 | 353875-A |
| 17 | TTCAGAGTGGT | 4254687 | TAAGTTCTGC | 4254716 | TTCAAGTGTTTAAGTTCTGCTT | 4254747 | 2 | 351940-A |
| 18 | AGCAGCCCA | 4254688 | GAAGGAAGC | 4254717 | AGGCCAAGAAGGAAGCAGAGG | 4254748 | 3 | 352496-A |
| 19 | AGTTTGCCTTG | 4254689 | TAAGAAAAG | 4254718 | AGTTTGTGTAAGAAAAGC | 4254749 | 3 | 352518-A |
| 20 | ATCAGGGGTG | 4254690 | GGTGCTAA | 4254719 | ATTAGGAGAGTTGTCAGTATAG | 4254750 | 3 | 353484-A |
| 21 | ATGGTGGGAG | 4254691 | AGTTTGTCAGT | 4254720 | TGGAGGAGAGTTTGTCAGTATAG | 4254751 | 3 | 351990-A |
| 22 | CCCAGGAAG | 4254692 | TGGAGCCTGGGC | 4254721 | CCCGGGTGGAGCCTGGGCTGTG | 4254752 | 3 | 353880-A |
| 23 | GGGCAGTGGA | 4254693 | GGTCCGT | 4254722 | AGGGCAGGAGGTCCGTCCCCTTC | 4254753 | 3 | 352810-A |
| 24 | GGGCAGTGGA | 4254694 | TCTAGAC | 4254723 | GTGACAGTGAATCTAGACAGAC | 4254754 | 3 | 353184-A |
| 25 | TCAAGCTCATTC | 4254695 | CACTAAA | 4254724 | CTCAGCTCATCCACTAAATCCC | 4254755 | 3 | 353855-A |
| 26 | TGGAAAGTT | 4254696 | GGTTGTATGGTT | 4254725 | GGAATGGTGGTTGTATGGTTG | 4254756 | 3 | 353855-A |
| 27 | TGGAGAGTT | 4254697 | CCATATTTG | 4254726 | TGATAGATCCATATTTTGGTAA | 4254757 | 3 | 352004-A |
| 28 | TGGAGAGTT | 4254698 | GTTTGTACAGT | 4254727 | TGGGTTTTGTTTGTACAGTGTA | 4254758 | 3 | 353160-A |
| 29 | TCACTGCAAC | 4254699 | CTCCACC | 4254728 | TCACTGCAACCTCCACCTTCCG | 4254759 | 0 | 353856-A |

FIG. 15A

EST72223 (705 nt.)

EST72223 sequence:

CCCTTATTAGAGGATTCTGCTCATGCCAGGGTGAGGTAGTAAGTTGTATTG
TTGTGGGGTAGGGATATTAGGCCCCAATTAGAAGATAACTATACAACT MIR98
TACTACTTTCCCTGGTGTGTGGCATATTCACACTTAGTCTTAGCAGTGTTGCC
TCCATCAGACAAAGTTGTAGATGTTCCTTGGATAATTTGGACTGGAAGAAAAGA
GACATGGAAGGGGACAGATGGTGTTTAGGGTGAGGCAGATGTCATTATAAAGT
GACTTGTCTTTCATTAATTGGAGCATATAATTATTTTACCTTTGGGCATGAACTC
ATTTTGCTATTCTTCAACTGTGTAATGATTGCATTTTATTAGTAATAGAACAGGA
ATGTGTGCAAGGGAATGGAAAGCATACTTTAAGAATTTTGGGCCAGGCGCGGT
GGTTCATGCCTGTAATCCCAGCATTTTGGGAGGCCGAGGCGGGTGGATCAC
CTGAGGTCAGGAGTTCGAGACCAACCTGGCCAACACGGCGAAACCCCGCCTC
TACTCAAATACAAAAATTAGCCAGGCTTGGTGACACTCGCCTGTGGTCCCAGC
TACTCAGGAGGCTGAGGCAGGAGAATTGCTTGAACCCAGGAAGTGGAG
GCTTCAGTGAGCTGAGAACACGCCACTGCACTCCAGTCCTGGGCAAC GAM25
AGAGCAAGACTCTGTCTCAGGAAAAAAAAAG

FIG. 15B

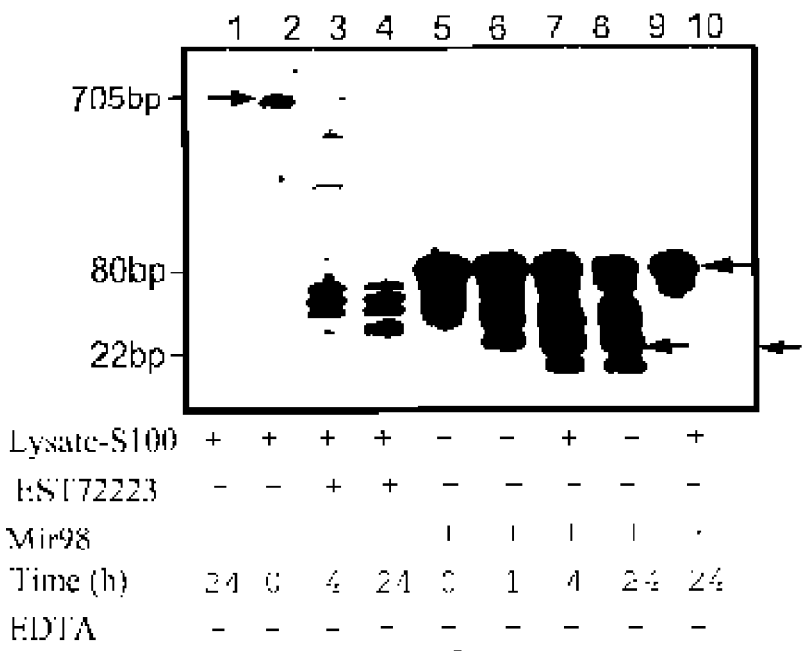

FIG. 18C

| MIRNA NAME | HELA | BRAIN | LIVER | THYMUS | TESTES | PLACENTA | REFERENCE |
|---|---|---|---|---|---|---|---|
| HSA-MIR-124A | 1879 | 65517 | 7025 | 3099 | 2672 | 2498 | 1,3 |
| HSA-MIR-9 | 642 | 42659 | 3504 | 4455 | 4485 | 2313 | 2,3 |
| HSA-MIR-128A | 2015 | 27701 | 4940 | 4876 | 5166 | 2495 | 3 |
| HSA-MIR-129 | 503 | 22573 | 1175 | 2213 | 5364 | 2017 | 3 |
| HSA-MIR-128B | 1168 | 21969 | 3954 | 4819 | 5383 | 2027 | |
| HSA-MIR-122A | 1051 | 447 | 65518 | 2644 | 617 | 570 | 1,3 |
| HSA-MIR-194 | 501 | 910 | 65518 | 4737 | 2342 | 7952 | 3 |
| HSA-MIR-148 | 413 | 620 | 38436 | 5250 | 6204 | 2711 | |
| HSA-MIR-192 | 452 | 606 | 20650 | 1628 | 1263 | 2607 | |
| HSA-MIR-96 | 887 | 3100 | 1477 | 44800 | 2266 | 5466 | |
| HSA-MIR-150 | 648 | 1463 | 5295 | 65518 | 29728 | 5280 | |
| HSA-MIR-205 | 551 | 615 | 1646 | 65518 | 2645 | 39072 | |
| HSA-MIR-182 | 662 | 1944 | 1091 | 25771 | 2034 | 3683 | |
| HSA-MIR-183 | 1026 | 1123 | 1286 | 8754 | 1681 | 2138 | |
| HSA-MIR-204 | 525 | 3898 | 1757 | 6535 | 64859 | 6233 | |
| HSA-MIR-10B | 410 | 433 | 477 | 3871 | 23083 | 738 | |
| HSA-MIR-154 | 438 | 733 | 1914 | 3309 | 14750 | 9637 | |
| HSA-MIR-134 | 448 | 617 | 698 | 763 | 2250 | 997 | |
| HSA-MIR-224 | 3233 | 11061 | 7684 | 32305 | 5377 | 65518 | |
| HSA-MIR-210 | 844 | 2280 | 10703 | 6864 | 15288 | 62452 | |
| HSA-MIR-221 | 625 | 9325 | 3520 | 20212 | 10608 | 54287 | |
| HSA-MIR-141 | 696 | 805 | 1220 | 4063 | 2000 | 46845 | |
| HSA-MIR-23A | 1312 | 3492 | 2990 | 6021 | 11173 | 40076 | |
| HSA-MIR-200C | 556 | 595 | 1027 | 10636 | 1478 | 33532 | |
| HSA-MIR-136 | 465 | 725 | 709 | 776 | 3100 | 8840 | |

1 LAGOS-QUINTANA ET AL., CURRENT BIOLOGY 12:735 (2002)
2 KRICHEVSKY ET AL., RNA 9:1274 (2003)
3 SEMPERE ET AL., GENOME BIOLOGY 5:R13 (2004)

BIOINFORMATICALLY DETECTABLE GROUP OF NOVEL REGULATORY BACTERIAL AND BACTERIAL ASSOCIATED OLIGONUCLEOTIDES AND USES THEREOF

CROSS REFERENCE TO RELATED APPLICATIONS

This application is a continuation in part of U.S. patent application Ser. No. 10/708,951, filed 2 Apr. 2004, entitled "Bioinformatically Detectable Group of Novel Regulatory Bacterial and Bacterial Associated Oligonucleotides and Uses Thereof", the disclosure of which is hereby incorporated by reference and claims priority therefrom; This application also is a continuation in part of U.S. Provisional Patent Application Ser. No. 60/521,433 filed 26 Apr. 2004, entitled "A Microarray for the Detection of MicroRNA Oligonucleotides", the disclosure of which is hereby incorporated by reference and claims priority therefrom.

REFERENCES CITED

Altschul, S. F., Gish, W., Miller, W., Myers, E. W., and Lipman, D. J. (1990). Basic local alignment search tool. J. Mol. Biol. 215, 403-410.

Dan Gusfield, Algorithms on strings, trees, and sequences: computer science and computational biology, Cambridge University Press, 1997.

Elbashir, S. M., Lendeckel, W., and Tuschl, T. (2001). RNA interference is mediated by 21- and 22-nucleotide RNAs. Genes Dev. 15, 188-200.

Gussow, D. and Clackson, T. (1989). Direct clone characterization from plaques and colonies by the polymerase chain reaction. Nucleic Acids Res. 17, 4000.

Hamosh A, Scott A F, Amberger J, Bocchini C, Valle D and McKusick V A. (2002). Online Mendelian Inheritance in Man (OMIM), a knowledgebase of human genes and genetic disorders. Nucleic Acids Res. 30: 52-55.

Jenuth, J. P. (2000). The NCBI. Publicly available tools and resources on the Web. Methods Mol. Biol. 132, 301-312.

Kirkness, E. F. and Kerlavage, A. R. (1997). The TIGR human cDNA database. Methods Mol. Biol. 69, 261-268.

Krichevsky, A. M., King, K. S., Donahue, C. P., Khrapko, K., and Kosik, K. S. (2003). A microRNA array reveals extensive regulation of microRNAs during brain development. RNA. 9, 1274-1281.

Lagos-Quintana, M., Rauhut, R., Lendeckel, W., and Tuschl, T. (2001). Identification of novel genes coding for small expressed RNAs. Science 294, 853-858.

Lau, N. C., Lim, L. P., Weinstein, E. G., and Bartel, D. P. (2001). An abundant class of tiny RNAs with probable regulatory roles in *Caenorhabditis elegans*. Science 294, 858-862.

Lockhart, D. J., Dong, H., Byrne, M. C., Follettie, M. T., Gallo, M. V., Chee, M. S., Mittmann, M., Wang, C., Kobayashi, M., Horton, H., and Brown, E. L. (1996). Expression monitoring by hybridization to high-density oligonucleotide arrays. Nat. Biotechnol. 14, 1675-1680.

Mathews, D. H., Sabina, J., Zuker, M., and Turner, D. H. (1999). Expanded sequence dependence of thermodynamic parameters improves prediction of RNA secondary structure. J. Mol. Biol. 288, 911-940.

Reinhart, B. J., Slack, F. J., Basson, M., Pasquinelli, A. E., Bettinger, J. C., Rougvie, A. E., Horvitz, H. R., and Ruvkun, G. (2000). The 21-nucleotide let-7 RNA regulates developmental timing in *Caenorhabditis elegans*. Nature 403, 901-906.

Southern, E. M. (1992). Detection of specific sequences among DNA fragments separated by gel electrophoresis. 1975. Biotechnology 24, 122-139.

Tom M. Mitchell, Machine Learning, McGraw Hill, 1997.

Wightman, B., Ha, I., and Ruvkun, G. (1993). Posttranscriptional regulation of the heterochronic gene lin-14 by lin-4 mediates temporal pattern formation in *C. elegans*. Cell 75, 855-862.

BACKGROUND OF THE INVENTION

1. Field of the Invention

The present invention relates to a group of bioinformatically detectable novel bacterial oligonucleotides and to a group of bioinformatically detectable novel human oligonucleotides associated with bacterial infections, both are identified here as "Genomic Address Messenger" (GAM) oligonucleotides.

All of abovementioned oligonucleotides are believed to be related to the microRNA (miRNA) group of oligonucleotides.

2. Description of Prior Art miRNA oligonucleotides are short ~22 nucleotide (nt)-long, non-coding, regulatory RNA oligonucleotides that are found in a wide range of species. miRNA oligonucleotides are believed to function as specific gene translation repressors and are sometimes involved in cell differentiation.

The ability to detect novel miRNA oligonucleotides is limited by the methodologies used to detect such oligonucleotides. All miRNA oligonucleotides identified so far either present a visibly discernable whole body phenotype, as do Lin-4 and Let-7 (Wightman, B., Ha, I., and Ruvkun, G., Cell 75: 855-862 (1993); Reinhart et al. Nature 403: 901-906 (2000)), or produce sufficient quantities of RNA so as to be detected by standard molecular biological techniques.

Ninety-three miRNA oligonucleotides have been discovered in several species (Lau et al., Science 294: 858-862 (2001), Lagos-Quintana et al., Science 294: 853-858 (2001)) by sequencing a limited number of clones (300 by Lau and 100 by Lagos-Quintana) of size-fractionated small segments of RNA. miRNAs that were detected in these studies therefore represent the more prevalent among the miRNA oligonucleotide family and cannot be much rarer than 1% of all small ~20 nt-long RNA oligonucleotides.

The aforementioned studies provide no basis for the detection of miRNA oligonucleotides which either do not present a visually discernable whole body phenotype, or are rare (e.g. rarer than 0.1% of all of the size-fractionated, ~20 nt-long RNA segments that were expressed in the tissues examined), and therefore do not produce large enough quantities of RNA to be detected by standard biological techniques.

To date, miRNA oligonucleotides have not been detected in bacteria.

The following U.S. Patents relate to bioinformatic detection of genes: U.S. patent application Ser. No. 10/348,935, entitled "Statistical algorithms for folding and target accessibility prediction and design of nucleic acids", U.S. Pat. No. 6,369,195, entitled "Prostate-specific gene for diagnosis, prognosis and management of prostate cancer", and U.S. Pat. No. 6,291,666 entitled "Spike tissue-specific promoter", each of which is hereby incorporated by reference herein.

BRIEF DESCRIPTION OF SEQUENCE LISTING, TABLES AND COMPUTER PROGRAM LISTING

Reference is made to the appendix submitted on the two compact discs, which contain a replacement sequence listing comprising 4,254,670 genomic sequences contained in files named SEQ LIST.0 (614,454 KB, 16 Feb. 2006) and SEQ LIST.1(105,842 KB, 16 Feb. 2006), and is hereby incorporated by reference herein.

Tables relating to genomic sequences are attached to the present application, appear in the following files (size, creation date) included on CD, incorporated herein: TABLE_1.txt (28.3 MB, 18 May 2004), TABLE_2.txt (350 MB, 18 May 2004), TABLE_3.txt (5.64 MB, 18 May 2004), TABLE_4.txt (17.1 MB, 18 May 2004), TABLE_5.txt (5.04 MB, 18 May 2004), TABLE_6.txt (536 MB, 18 May 2004), TABLE_7_A.txt (619 MB, 18 May 2004), TABLE_7_B.txt (340 MB, 18 May 2004), TABLE_8_A.txt (619 MB, 18 May 2004), TABLE_8_B.txt (619 MB, 18 May 2004), TABLE_8_C.txt (619 MB, 18 May 2004), TABLE_8_D.txt (457 MB, 18 May 2004), TABLE_9.txt (654 MB, 18 May 2004), TABLE_10.txt (49.1 MB, 18 May 2004), and TABLE_11.txt (79.8 MB, 18 May 2004), all of which are incorporated by reference herein. Further, additional tables relating to genomic sequences are attached to the present application, appear in the following files (size, creation date) attached to the application, incorporated herein: TABLE_12.txt (41.1 KB, 18 May 2004) and TABLE_13.txt (46.9 KB, 18 May 2004), are incorporated by reference herein.

host response mechanism, and therefore knowledge of this novel group of human oligonucleotides may be useful in preventing and treating bacterial diseases.

Furthermore, the present invention relates to a novel group of 24,160 bioinformatically detectable bacterial regulatory RNA oligonucleotides, which repress expression of bacterial target genes, by means of complementary hybridization to binding sites in untranslated regions of these bacterial target genes. It is believed that this novel group of bacterial oligonucleotides represents a pervasive novel internal bacterial regulation mechanism, and therefore knowledge of this novel group of bacterial oligonucleotides may be useful in preventing and treating bacterial diseases.

In addition, the present invention relates to a novel group of 6,100 bioinformatically detectable human regulatory RNA oligonucleotides, which repress expression of bacterial target genes, by means of complementary hybridization to binding sites in untranslated regions of these bacterial target genes. It is believed that this novel group of human oligonucleotides represents a pervasive novel antibacterial host defense mechanism, and therefore knowledge of this novel group of human oligonucleotides may be useful in preventing and treating bacterial diseases.

LENGTHY TABLES

The patent contains a lengthy table section. A copy of the table is available in electronic form from the USPTO web site (http://seqdata.uspto.gov/?pageRequest=docDetail&DocID=US07943754B2). An electronic copy of the table will also be available from the USPTO upon request and payment of the fee set forth in 37 CFR 1.19(b)(3).

A computer program listing constructed and operative in accordance with a preferred embodiment of the present invention is enclosed on an electronic medium in computer readable form, and is hereby incorporated by reference herein. The computer program listing is contained in 7 files, the name, sizes and creation date of which are as follows: AUXILARY_FILES.txt (117K, 14 Nov. 2003); EDIT_DISTANCE.txt (144K, 24 Nov. 2003); FIRST-K.txt (96K, 24 Nov. 2003); HAIRPIN_PREDICTION.txt (19K, 25 Mar. 2004); TWO_PHASED_SIDE_SELECTOR.txt (4K, 14 Nov. 2003); TWO_PHASED_PREDICTOR.txt (74K, 14 Nov. 2003), and BS_CODE.txt (118K, 11 May 2004).

SUMMARY OF THE INVENTION

The present invention relates to a novel group of 3,873 bioinformatically detectable bacterial regulatory RNA oligonucleotides, which repress expression of human target genes, by means of complementary hybridization to binding sites in untranslated regions of these target genes. It is believed that this novel group of bacterial oligonucleotides represents a pervasive bacterial mechanism of attacking a host, and therefore knowledge of this novel group of bacterial oligonucleotides may be useful in preventing and treating bacterial diseases.

Additionally, the present invention relates to a novel group of 4,363 bioinformatically detectable human regulatory RNA oligonucleotides, which repress expression of human target genes associated with the bacterial infection, by means of complementary hybridization to binding sites in untranslated regions of these target genes. It is believed that this novel group of human oligonucleotides represents a pervasive novel Also disclosed are 6,056 novel microRNA-cluster like bacterial polynucleotides and 430 novel microRNA-cluster like human polynucleotides, both referred to here as Genomic Record (GR) polynucleotides.

In various preferred embodiments, the present invention seeks to provide improved method and system for detection and prevention of bacterial diseases, which are mediated by this group of novel oligonucleotides.

Accordingly, the invention provides several substantially pure nucleic acids (e.g., genomic DNA, cDNA or synthetic DNA) each comprising a novel GAM oligonucleotide, vectors comprising the DNAs, probes comprising the DNAs, a method and system for selectively modulating translation of known target genes utilizing the vectors, and a method and system utilizing the GAM probes to modulate expression of GAM target genes.

The present invention represents a scientific breakthrough, disclosing novel miRNA-like oligonucleotides the number of which is dramatically larger than previously believed existed. Prior-art studies reporting miRNA oligonucleotides ((Lau et al., Science 294:858-862 (2001), Lagos-Quintana et al., Science 294: 853-858 (2001)) discovered 93 miRNA oligonucleotides in several species, including 21 in human, using conventional molecular biology methods, such as cloning and sequencing.

Molecular biology methodologies employed by these studies are limited in their ability to detect rare miRNA oligonucleotides, since these studies relied on sequencing of a limited number of clones (300 clones by Lau and 100 clones by Lagos-Quintana) of small segments (i.e. size-fractionated) of RNA. miRNA oligonucleotides detected in these studies therefore, represent the more prevalent among the miRNA oligonucleotide family, and are typically not be much rarer than 1% of all small ~20 nt-long RNA oligonucleotides present in the tissue from the RNA was extracted.

Recent studies state the number of miRNA oligonucleotides to be limited, and describe the limited sensitivity of available methods for detection of miRNA oligonucleotides: "The estimate of 255 human miRNA oligonucleotides is an upper bound implying that no more than 40 miRNA oligonucleotides remain to be identified in mammals" (Lim et al., Science, 299:1540 (2003)); "Estimates place the total number of vertebrate miRNA genes at about 200-250" (Ambros et al. Curr. Biol. 13:807-818 (2003)); and "Confirmation of very low abundance miRNAs awaits the application of detection methods more sensitive than Northern blots" (Ambros et al. Curr. Biol. 13:807-818 (2003)).

The oligonucleotides of the present invention represent a revolutionary new dimension of genomics and of biology: a dimension comprising a huge number of non-protein-coding oligonucleotides which modulate expression of thousands of proteins and are associated with numerous major diseases. This new dimension disclosed by the present invention dismantles a central dogma that has dominated life-sciences during the past 50 years, a dogma which has emphasized the importance of protein-coding regions of the genome, holding non-protein-coding regions to be of little consequence, often dubbing them "junk DNA".

Indeed, only in November, 2003 has this long held belief as to the low importance of non-protein-coding regions been vocally challenged. As an example, an article titled "The Unseen Genome-Gems in the Junk" (Gibbs, W. W. Sci. Am. 289:46-53 (2003)) asserts that the failure to recognize the importance of non-protein-coding regions "may well go down as one of the biggest mistakes in the history of molecular biology." Gibbs further asserts that "what was damned as junk because it was not understood, may in fact turn out to be the very basis of human complexity." The present invention provides a dramatic leap in understanding specific important roles of non-protein-coding regions.

An additional scientific breakthrough of the present invention is a novel conceptual model disclosed by the present invention, which conceptual model is preferably used to encode in a genome the determination of cell differentiation, utilizing oligonucleotides and polynucleotides of the present invention.

Using the bioinformatic engine of the present invention, 21,916 bacterial GAM oligonucleotides and their respective precursors and targets have been detected and 6,100 human GAM oligonucleotides and their respective precursors and targets have been detected. These bioinformatic predictions are supported by robust biological studies. Microarray experiments validated expression of 346 of the human GAM oligonucleotides of the present invention. Of these, 311 received an extremely high score: over six standard deviations higher than the background "noise" of the microarray, and over two standard deviations above their individual "mismatch" control probes and 33 received a high score: over four standard deviations higher than the background "noise" of the microarray. Further, 38 GAM oligonucleotides were sequenced.

In various preferred embodiments, the present invention seeks to provide an improved method and system for specific modulation of the expression of specific target genes involved in significant human diseases. It also provides an improved method and system for detection of the expression of novel oligonucleotides of the present invention, which modulate these target genes. In many cases, the target genes may be known and fully characterized, however in alternative embodiments of the present invention, unknown or less well characterized genes may be targeted.

A "Nucleic acid" is defined as a ribonucleic acid (RNA) molecule, or a deoxyribonucleic acid (DNA) molecule, or complementary deoxyribonucleic acid (cDNA), comprising either naturally occurring nucleotides or non-naturally occurring nucleotides.

"Substantially pure nucleic acid", "Isolated Nucleic Acid", "Isolated Oligoucleotide" and "Isolated Polynucleotide" are defined as a nucleic acid that is free of the genome of the organism from which the nucleic acid is derived, and include, for example, a recombinant nucleic acid which is incorporated into a vector, into an autonomously replicating plasmid or virus, or into the genomic nucleic acid of a prokaryote or eukaryote at a site other than its natural site; or which exists as a separate molecule (e.g., a cDNA or a genomic or cDNA fragment produced by PCR or restriction endonuclease digestion) independent of other nucleic acids.

An "Oligonucleotide" is defined as a nucleic acid comprising 2-139 nts, or preferably 16-120 nts. A "Polynucleotide" is defined as a nucleic acid comprising 140-5000 nts, or preferably 140-1000 nts.

A "Complementary" sequence is defined as a first nucleotide sequence which reverses complementary of a second nucleotide sequence: the first nucleotide sequence is reversed relative to a second nucleotide sequence, and wherein each nucleotide in the first nucleotide sequence is complementary to a corresponding nucleotide in the second nucleotide sequence (e.g. ATGGC is the complementary sequence of GCCAT).

"Hybridization", "Binding" and "Annealing" are defined as hybridization, under in vivo physiological conditions, of a first nucleic acid to a second nucleic acid, which second nucleic acid is at least partially complementary to the first nucleic acid.

A "Hairpin Structure" is defined as an oligonucleotide having a nucleotide sequence that is 50-140 nts in length, the first half of which nucleotide sequence is at least partially complementary to the second part thereof, thereby causing the nucleic acid to fold onto itself, forming a secondary hairpin structure.

A "Hairpin-Shaped Precursor" is defined as a Hairpin Structure which is processed by a Dicer enzyme complex, yielding an oligonucleotide which is about 19 to about 24 nts in length.

"Inhibiting translation" is defined as the ability to prevent synthesis of a specific protein encoded by a respective gene by means of inhibiting the translation of the mRNA of this gene. For example, inhibiting translation may include the following steps: (1) a DNA segment encodes an RNA, the first half of whose sequence is partially complementary to the second half thereof; (2) the precursor folds onto itself forming a hairpin-shaped precursor; (3) a Dicer enzyme complex cuts the hairpin-shaped precursor yielding an oligonucleotide that is approximately 22 nt in length; (4) the oligonucleotide binds complementarily to at least one binding site, having a nucleotide sequence that is at least partially complementary to the oligonucleotide, which binding site is located in the mRNA of a target gene, preferably in the untranslated region (UTR) of a target gene, such that the binding inhibits translation of the target protein.

A "Translation inhibitor site" is defined as the minimal nucleotide sequence sufficient to inhibit translation.

The present invention describes novel GAM oligonucleotides, detected using a bioinformatic engine described hereinabove. The ability of this detection engine has been demonstrated using stringent algorithmic criteria, showing that the engine has both high sensitivity, indicated by the high detection rate of published miRNA oligonucleotides and their targets, as well as high specificity, indicated by the low amount of "background" hairpin candidates passing its filters. Laboratory tests, based both on sequencing of predicted GAM oligonucleotides and on microarray experiments, validated 381 of the GAM oligonucleotides in the present invention. Further, almost all of the bacterial target genes (6,141 of the 7,351) and almost all of the human target genes (64 out of 76) described in the present invention are bound by one or more of the 381 human GAM oligonucleotides validated by the microarray experiments.

There is thus provided in accordance with a preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the oligonucleotide has at least 80% sequence identity with a nucleotide sequence selected from the group consisting of SEQ ID NOs: 1-385 and 386-49787.

There is further provided in accordance with another preferred embodiment of the present invention a bioinformatically detectable isolated oligonucleotide having a nucleotide sequence selected from the group consisting of SEQ ID NOs: 1-385 and 386-49787.

There is still further provided in accordance with another preferred embodiment of the present invention a bioinformatically detectable first oligonucleotide which is a portion of a mRNA transcript of a target gene, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 1-385 and 386-49787.

There is additionally provided in accordance with another preferred embodiment of the present invention a bioinformatically detectable oligonucleotide having a nucleotide sequence selected from the group consisting of SEQ ID NOs: 2337129-4223628.

There is additionally provided in accordance with another preferred embodiment of the present invention a method for treatment of a disease involving a tissue in which a protein is pathologically expressed to an undesirable extent, the protein having a messenger RNA, the method including: providing a material which modulates activity of a microRNA oligonucleotide which binds complementarily to a segment of the messenger RNA, and introducing the material into the tissue, causing modulation of the activity of the microRNA oligonucleotide and thereby modulating expression of the protein in a desired manner.

There is moreover provided in accordance with another preferred embodiment of the present invention a method for treatment of a disease involving tissue in which a protein is pathologically expressed to an undesirable extent, the protein having a messenger RNA, the method including: providing a material which at least partially binds a segment of the messenger RNA that is bound complementarily by a microRNA oligonucleotide, thereby modulating expression of the protein, and introducing the material into the tissue, thereby modulating expression of the protein.

There is further provided in accordance with another preferred embodiment of the present invention a method for treatment of a disease involving a tissue in which a protein is pathologically over-expressed, the protein having a messenger RNA, the method including: providing a microRNA oligonucleotide which binds complementarily to a segment of the messenger RNA, and introducing the microRNA oligonucleotide into the tissue, causing the microRNA oligonucleotide to bind complementarily to a segment of the messenger RNA and thereby inhibit expression of the protein.

There is still further provided in accordance with another preferred embodiment of the present invention a method for treatment of a disease involving a tissue in which a protein is pathologically over-expressed, the protein having a messenger RNA, the method including: providing a chemically-modified microRNA oligonucleotide which binds complementarily to a segment of the messenger RNA, and introducing the chemically-modified microRNA oligonucleotide into the tissue, causing the microRNA oligonucleotide to bind complementarily to a segment of the messenger RNA and thereby inhibit expression of the protein.

There is additionally provided in accordance with another preferred embodiment of the present invention a method for treatment of a disease involving a tissue in which a protein is pathologically under-expressed, the protein having a messenger RNA, the method including: providing an oligonucleotide that inhibits activity of a microRNA oligonucleotide which binds complementarily to a segment of the messenger RNA, and introducing the oligonucleotide into the tissue, causing inhibition of the activity of the microRNA oligonucleotide and thereby promotion of translation of the protein.

There is moreover provided in accordance with another preferred embodiment of the present invention a method for treatment of a disease involving a tissue in which a protein is pathologically under-expressed, the protein having a messenger RNA, the method including: providing a chemically-modified oligonucleotide that inhibits activity of a microRNA oligonucleotide which binds complementarily to a segment of the messenger RNA, and introducing the chemically-modified oligonucleotide into the tissue, causing inhibition of the activity of the microRNA oligonucleotide and thereby promotion of translation of the protein.

There is further provided in accordance with another preferred embodiment of the present invention a method for diagnosis of a disease involving a tissue in which a protein is expressed to abnormal extent, the protein having a messenger RNA, the method including: assaying a microRNA oligonucleotide which at least partially binds a segment of the messenger RNA and modulates expression of the protein, thereby providing an indication of at least one parameter of the disease.

There is still further provided in accordance with another preferred embodiment of the present invention a method for detection of expression of an oligonucleotide, the method including: determining a first nucleotide sequence of a first oligonucleotide, which first nucleotide sequence is not complementary to a genome of an organism, receiving a second nucleotide sequence of a second oligonucleotide whose expression is sought to be detected, designing a third nucleotide sequence that is complementary to the second nucleotide sequence of the second oligonucleotide, and a fourth nucleotide sequence that is complementary to a fifth nucleotide sequence which is different from the second nucleotide sequence of the second oligonucleotide by at least one nucleotide, synthesizing a first oligonucleotide probe having a sixth nucleotide sequence including the third nucleotide sequence followed by the first nucleotide sequence of the first oligonucleotide, and a second oligonucleotide probe having a seventh nucleotide sequence including the fourth nucleotide sequence followed by the first nucleotide sequence of the first oligonucleotide, locating the first oligonucleotide probe and the second oligonucleotide probe on a microarray platform, receiving an RNA test sample from at least one tissue of the organism, obtaining size-fractionated RNA from the RNA test sample, amplifying the size-fractionated RNA, hybridizing the adaptor-linked RNA with the first and second oligonucleotide probes on the microarray platform, and determining expression of the first oligonucleotide in the at least one tissue of the organism, based at least in part on the hybridizing.

There is additionally provided in accordance with another preferred embodiment of the present invention a bioinformatically detectable isolated polynucleotide which is endogenously processed into a plurality of hairpin-shaped precursor oligonucleotides, each of which is endogenously processed into a respective oligonucleotide, which in turn anneals to a portion of a mRNA transcript of a target gene, wherein binding of the oligonucleotide to the mRNA transcript represses expression of the target gene.

There is moreover provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the target gene does not encode a protein.

There is further provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein a function of the oligonucleotide includes modulation of cell type.

There is still further provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the oligonucleotide is maternally transferred by a cell to at least one daughter cell of the cell, and a function of the oligonucleotide includes modulation of cell type of the daughter cell.

There is additionally provided in accordance with another preferred embodiment of the present invention a method for bioinformatic detection of microRNA oligonucleotides, the method including: bioinformatically detecting a hairpin-shaped precursor oligonucleotide, bioinformatically detecting an oligonucleotide which is endogenously processed from the hairpin-shaped precursor oligonucleotide, and bioinformatically detecting a target gene of the oligonucleotide wherein the oligonucleotide anneals to at least one portion of a mRNA transcript of the target gene, and wherein the binding represses expression of the target gene, and the target gene is associated with a disease.

BRIEF DESCRIPTION OF DRAWINGS

FIG. 2 is a simplified block diagram illustrating a bioinformatic oligonucleotide detection system capable of detecting oligonucleotides of the novel group of oligonucleotides of the present invention, which system is constructed and operative in accordance with a preferred embodiment of the present invention;

FIG. 3 is a simplified flowchart illustrating operation of a mechanism for training of a computer system to recognize the novel oligonucleotides of the present invention, which mechanism is constructed and operative in accordance with a preferred embodiment of the present invention;

FIGS. 11A and 11B are simplified diagrams which, when taken together, illustrate a mode of oligonucleotide therapy applicable to novel oligonucleotides of the present invention;

FIG. 13 is a summary table of laboratory results validating expression of novel human oligonucleotides detected by a bioinformatic oligonucleotide detection engine constructed and operative in accordance with a preferred embodiment of the present invention, thereby validating its efficacy;

FIG. 15A is an annotated sequence of EST72223 (SEQ ID NO: 4254771) comprising known human microRNA oligonucleotide MIR98 and novel human oligonucleotide GAM25 PRECURSOR detected by the oligonucleotide detection system of the present invention. Additionally annotated in EST72223 are the miRNA-98 hairpin in bold (SEQ ID NO: 4254772), the sequence of the mature miRNA-98 in bold and underline (SEQ ID NO: 4254773), the sequence of the GAM25 hairpin in bold (SEQ ID NO: 4254774), and the sequence of the mature miRNA of GAM25 in bold and underline (SEQ ID NO: 4254775).

FIGS. 15B, 15C and 15D are pictures of laboratory results demonstrating laboratory confirmation of expression of known human oligonucleotide MIR98 and of novel bioinformatically-detected human GAM25 RNA respectively, both of FIG. 15A, thus validating the bioinformatic oligonucleotide detection system of the present invention;

FIG. 18C is a summary table demonstrating detection of known microRNA oligonucleotides using a microarray constructed and operative in accordance with a preferred embodiment of the present invention.

BRIEF DESCRIPTION OF SEQUENCES

A Sequence Listing of genomic sequences of the present invention designated SEQ ID NO:1 through SEQ ID: 4,254,670 is attached to this application, and is hereby incorporated herein. The genomic listing comprises the following nucleotide sequences: nucleotide sequences of 21,916 bacterial and 6,100 human GAM precursors of respective novel oligonucleotides of the present invention; nucleotide sequences of 32,713 bacterial and 11,428 human GAM RNA oligonucleotides of respective novel oligonucleotides of the present invention; and nucleotide sequences of 1,507,219 target gene binding sites of respective novel oligonucleotides of the present invention.

DETAILED DESCRIPTION

Figure 1:
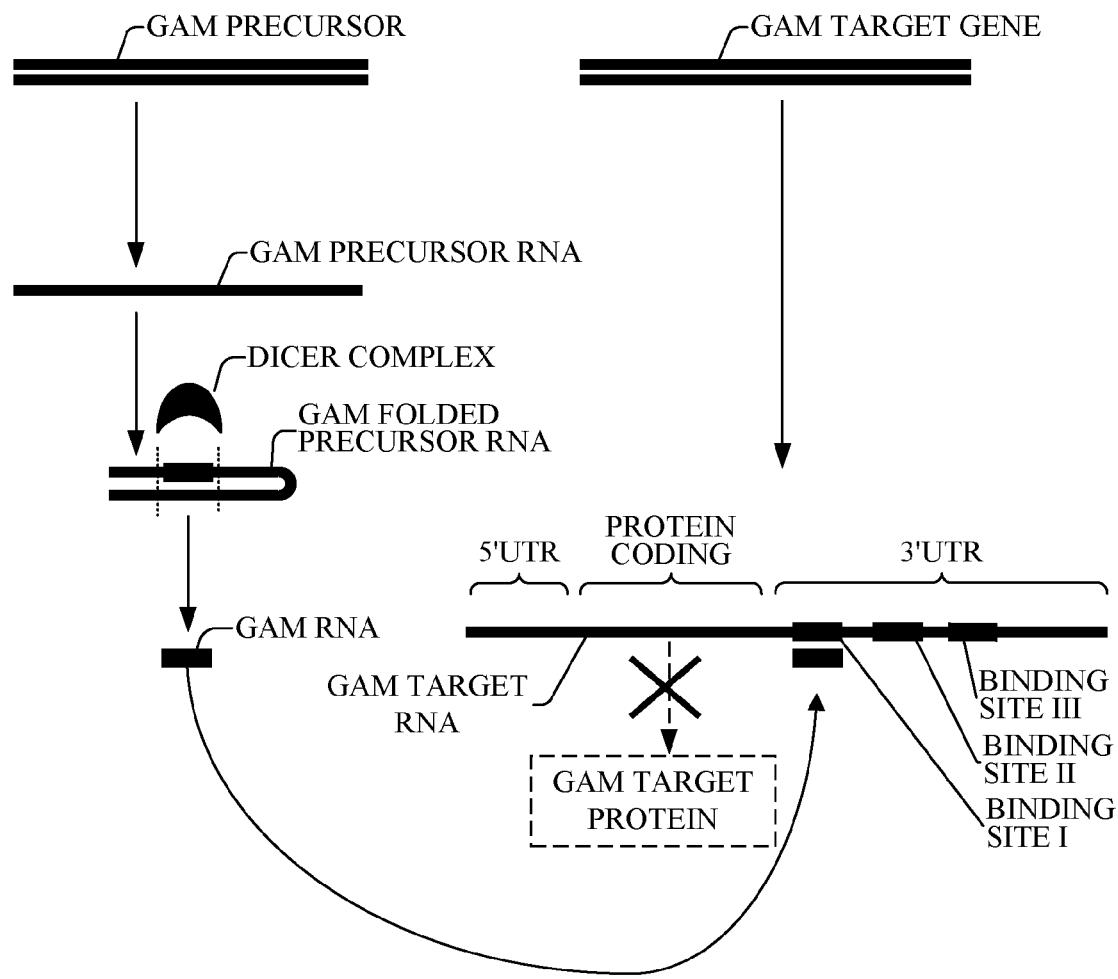
FIG. 1 is a simplified diagram illustrating a mode by which an oligonucleotide of a novel group of oligonucleotides of the present invention modulates expression of known target genes.

Reference is now made to FIG. 1, which is a simplified diagram describing a plurality of novel bioinformatically-detected oligonucleotide of the present invention referred to here as the Genomic Address Messenger (GAM) oligonucleotide, which modulates expression of respective target genes whose function and utility are known in the art.

GAM is a novel bioinformatically detectable regulatory, non-protein-coding, miRNA-like oligonucleotide. The method by which GAM is detected is described with additional reference to FIGS. 1-8.

The GAM PRECURSOR is preferably encoded by a bacterial genome. Alternatively or additionally, the GAM PRECURSOR is preferably encoded by the human genome. The GAM TARGET GENE is a gene encoded by the human genome. Alternatively or additionally, the GAM TARGET GENE is a gene encoded by a bacterial genome.

The GAM PRECURSOR encodes a GAM PRECURSOR RNA. Similar to other miRNA oligonucleotides, the GAM PRECURSOR RNA does not encode a protein.

GAM PRECURSOR RNA folds onto itself, forming GAM FOLDED PRECURSOR RNA, which has a two-dimensional "hairpin" structure. GAM PRECURSOR RNA folds onto itself, forming GAM FOLDED PRECURSOR RNA, which has a two-dimensional "hairpin structure". As is well-known in the art, this "hairpin structure" is typical of RNA encoded by known miRNA precursor oligonucleotides and is due to the full or partial complementarity of the nucleotide sequence of the first half of an miRNA precursor to the RNA that is encoded by a miRNA oligonucleotide to the nucleotide sequence of the second half thereof.

A complementary sequence is a sequence which is reversed and wherein each nucleotide is replaced by a complementary nucleotide, as is well known in the art (e.g. ATGGC is the complementary sequence of GCCAT).

An enzyme complex designated DICER COMPLEX, an enzyme complex composed of Dicer RNaseIII together with other necessary proteins, cuts the GAM FOLDED PRECURSOR RNA yielding a single-stranded ~22 nt-long RNA segment designated GAM RNA.

GAM TARGET GENE encodes a corresponding messenger RNA, designated GAM TARGET RNA. As is typical of mRNA of a protein-coding gene, each GAM TARGET RNAs of the present invention comprises three regions, as is typical of mRNA of a protein-coding gene: a 5' untranslated region, a protein-coding region and a 3' untranslated region, designated 5'UTR, PROTEIN-CODING and 3'UTR, respectively.

GAM RNA binds complementarily to one or more target binding sites located in the untranslated regions of each of the GAM TARGET RNAs of the present invention. This complementary binding is due to the partial or full complementarity between the nucleotide sequence of GAM RNA and the nucleotide sequence of each of the target binding sites. As an illustration, FIG. 1 shows three such target binding sites, designated BINDING SITE I, BINDING SITE II and BINDING SITE III, respectively. It is appreciated that the number of target binding sites shown in FIG. 1 is only illustrative and that any suitable number of target binding sites may be present. It is further appreciated that although FIG. 1 shows target binding sites only in the 3'UTR region, these target binding sites may instead be located in the 5'UTR region or in both the 3'UTR and 5'UTR regions.

The complementary binding of GAM RNA to target binding sites on GAM TARGET RNA, such as BINDING SITE I, BINDING SITE II and BINDING SITE III, inhibits the translation of each of the GAM TARGET RNAs of the present invention into respective GAM TARGET PROTEIN, shown surrounded by a broken line.

It is appreciated that the GAM TARGET GENE in fact represents a plurality of GAM target genes. The mRNA of each one of this plurality of GAM target genes comprises one or more target binding sites, each having a nucleotide sequence which is at least partly complementary to GAM RNA and which when bound by GAM RNA causes inhibition of translation of the GAM target mRNA into a corresponding GAM target protein.

The mechanism of the translational inhibition that is exerted by GAM RNA on one or more GAM TARGET GENEs may be similar or identical to the known mechanism of translational inhibition exerted by known miRNA oligonucleotides.

The nucleotide sequences of each of a plurality of GAM oligonucleotides that are described by FIG. 1 and their respective genomic sources and genomic locations are set forth in Tables 1-3, hereby incorporated herein. Specifically, in Table 1, line 778 describes GAM RNA (miRNA) as set forth in SEQ ID NO: 348 is shown as predicted from human.

TABLE 1

| GAM SEQ-ID | GAM NAME | GAM RNA SEQUENCE | GAM ORGANISM | GAM POS |
|---|---|---|---|---|
| 348 | GAM353678 | CAGCAGCACACTGTGGTTTGTA | Human | A |

In Table 2, lines 42112-42207, describes GAM PRECURSOR RNA (hairpin) as set forth in SEQ ID NO: 4233864 and as it relates to FIGS. 1-8.

TABLE 2

| GAM NAME | GAM ORGA-NISM | PRECUR SEQ-ID | PRECURSOR SEQUENCE | GAM DESCRIPTION |
|---|---|---|---|---|
| GAM 353678 | Human | 4233864 | CCTGCTCCCG CCCCAGCAGC ACACTGTGGT TTGTACGGCA CTGTGGCCAC GTCCAAACCA CACTGTGGTG TTAGAGCGAG GGTGGGGGAGG | FIG. 1 further provides a conceptual description of another novel bioinformatically-detected human oligonucleotide of the present invention referred to here as the Genomic Address Messenger 353678 (GAM353678) oligonucleotide, which modulates expression of respective target genes whose function and utility are known in the art. GAM353678 is a novel bioinformatically detectable regulatory, non-protein-coding, miRNA-like oligonucleotide. The method by which GAM353678 is detected is described with additional reference to FIGS. 1-8. The GAM353678 precursor, herein designated GAM PRECURSOR, is encoded by the Human genome. GAM353678 target gene, herein designated GAM TARGET GENE, is a target gene encoded by the target organism as specified in Tables 6-7. The GAM353678 precursor, herein designated GAM PRECURSOR, encodes a GAM353678 precursor RNA, herein designated GAM PRECURSOR RNA. Similar to other miRNA oligonucleotides, the GAM353678 precursor RNA does not encode a protein. GAM353678 precursor RNA folds onto itself, forming GAM353678 folded precursor RNA, |

TABLE 2-continued

| GAM NAME | GAM ORGA- NISM | PRECUR SEQ- ID | PRECURSOR SEQUENCE | GAM DESCRIPTION |
|---|---|---|---|---|
| | | | | herein designated GAM FOLDED PRECURSOR RNA, which has a two-dimensional "hairpin" structure. GAM PRECURSOR RNA folds onto itself, forming GAM FOLDED PRECURSOR RNA, which has a two-dimensional "hairpin structure". As is well-known in the art, this "hairpin structure" is typical of RNA encoded by known miRNA precursor oligonucleotides and is due to the full or partial complementarity of the nucleotide sequence of the first half of an miRNA precursor to the RNA that is encoded by a miRNA oligonucleotide to the nucleotide sequence of the second half thereof. A nucleotide sequence that is identical or highly similar to the nucleotide sequence of the GAM353678 precursor RNA is designated SEQ ID NO: 4233864, and is provided hereinbelow with reference to the sequence listing section. The nucleotide sequence designated SEQ ID NO: 4233864 is located from position 7121806 to position 7121896 relative to chromosome 17 on the "-" strand, and overlaps an intergenic region (UCSC.h16.refGene database). Furthermore, the nucleotide sequence designated SEQ ID NO: 4233864 is positioned in a region that is conserved between human, mouse and rat (UCSC.hg16.humorMm3Rn3). A schematic representation of a predicted secondary folding of GAM353678 folded precursor RNA, herein designated GAM FOLDED PRECURSOR RNA is set forth in Table 4 incorporated herein. An enzyme complex designated DICER COMPLEX, an enzyme complex composed of Dicer RNaseIII together with other necessary proteins, cuts the GAM353678 folded precursor RNA yielding a single-stranded ~22 nt-long RNA segment designated GAM353678 RNA, herein designated GAM RNA. Table 5 provides a nucleotide sequence that is highly likely to be identical or extremely similar to the nucleotide sequence of GAM353678 RNA, hereby incorporated herein. GAM353678 target gene, herein designated GAM TARGET GENE, encodes a corresponding messenger RNA, designated GAM353678 target RNA, herein designated GAM TARGET RNA. As is typical of mRNA of a protein-coding gene, GAM353678 target RNA comprises three regions, as is typical of mRNA of a protein-coding gene: a 5' untranslated region, a protein-coding region and a 3' |

TABLE 2-continued

| GAM NAME | GAM ORGA- NISM | PRECUR SEQ- ID | PRECURSOR SEQUENCE | GAM DESCRIPTION |
|---|---|---|---|---|
| | | | | untranslated region, designated 5'UTR, PROTEIN-CODING and 3'UTR, respectively. GAM353678 RNA, herein designated GAM RNA, binds complementarily to one or more target binding sites located in the untranslated regions of GAM353678 target RNA. This complementary binding is due to the partial or full complementarity between the nucleotide sequence of GAM353678 RNA and the nucleotide sequence of each of the target binding sites. As an illustration, FIG. 1 shows three such target binding sites, designated BINDING SITE I, BINDING SITE II and BINDING SITE III, respectively. It is appreciated that the number of target binding sites shown in FIG. 1 is only illustrative and that any suitable number of target binding sites may be present. It is further appreciated that although FIG. 1 shows target binding sites only in the 3'UTR region, these target binding sites may instead be located in the 5'UTR region or in both the 3'UTR and 5'UTR regions. The complementary binding of GAM353678 RNA, herein designated GAM RNA, to target binding sites on GAM353678 target RNA, herein designated GAM TARGET RNA, such as BINDING SITE I, BINDING SITE II and BINDING SITE III, inhibits the translation of GAM353678 target RNA into respective GAM353678 target protein, herein designated GAM TARGET PROTEIN, shown surrounded by a broken line. It is appreciated that the GAM353678 target gene, herein designated GAM TARGET GENE, in fact represents a plurality of GAM353678 target genes. The mRNA of each one of this plurality of GAM353678 target genes comprises one or more target binding sites, each having a nucleotide sequence which is at least partly complementary to GAM353678 RNA, herein designated GAM RNA, and which when bound by GAM353678 RNA causes inhibition of translation of the GAM353678 target mRNA into a corresponding GAM353678 target protein. The mechanism of the translational inhibition that is exerted by GAM353678 RNA, herein designated GAM RNA, on one or more GAM353678 target genes, herein collectively designated GAM TARGET GENE, may be similar or identical to the known mechanism of translational inhibition exerted by known miRNA |

TABLE 2-continued

| GAM NAME | GAM ORGA-NISM | PRECUR SEQ-ID | PRECURSOR SEQUENCE | GAM DESCRIPTION |
|---|---|---|---|---|
| | | | | oligonucleotides. The nucleotide sequence of GAM353678 precursor RNA, herein designated GAM PRECURSOR RNA, its respective genomic source and genomic location and a schematic representation of a predicted secondary folding of GAM353678 folded precursor RNA, herein designated GAM FOLDED PRECURSOR RNA are set forth in Tables 3-4, hereby incorporated herein. The nucleotide sequences of a "diced" GAM353678 RNA, herein designated GAM RNA, from GAM353678 folded precursor RNA are set forth in Table 5, hereby incorporated herein. The nucleotide sequences of target binding sites, such as BINDING SITE I, BINDING SITE II and BINDING SITE III of FIG. 1, found on GAM353678 target RNA, herein designated GAM TARGET RNA, and a schematic representation of the complementarity of each of these target binding sites to GAM353678 RNA, herein designated GAM RNA, are set forth in Tables 6-7, hereby incorporated herein. It is appreciated that the specific functions and accordingly the utilities of GAM353678 RNA are correlated with and may be deduced from the identity of the GAM353678 target gene inhibited thereby, and whose functions are set forth in Table 8, hereby incorporated herein. |

Table 3, lines 1279-1280, shows data relating to the source and location of the GAM oligonucleotide, specificaly the GAM PRECRSOR (hairpin) and its position in the genomic sequence of human.

TABLE 3

| GAM NAME | PRECURSOR SEQ-ID | GAM ORGANISM | SOURCE | STR AND | SRC-START OFFSET | SRC-END OFFSET |
|---|---|---|---|---|---|---|
| GAM353678 | 4233864 | Human | 17 | | 7121806 | 7121896 |

The nucleotide sequences of GAM PRECURSOR RNAs, and a schematic representation of a predicted secondary folding of GAM FOLDED PRECURSOR RNAs, of each of a plurality of GAM oligonucleotides described by FIG. 1 are set forth in Table 4, hereby incorporated herein. Table 4 lines 2384-2388, shows a schematic representation of the GAM folder precursor as set forth in SEQ ID NO:348, beginning at the 5' end (beginning of upper row) to the 3' end (beginning of lower row), where the hairpin loop is positioned at the right part of the drawing.

TABLE 4

| GAM NAME | PRE CUR SEQ-ID | GAM ORGANISM | GAM PRECURSOR SEQUENCE | GAM FOLDED PRECURSOR RNA | | | | | |
|---|---|---|---|---|---|---|---|---|---|
| GAM 353 678 | 423 386 4 | Human | CCTGCTCCCGCCCAGCAGC ACACTGTGGTTTGTACGGCACCT CTGTGGCCACGTCCAAACCAGGA CACTGTGGTGTTAGAGCGAG GGTGGGGGAGG | G CTCCCGCCC GTTTG AC GGGGGTGGG CAAAC TG - C | C------ AGCA GGC T CCG G CA | G CACA TTGT AGCGAGA GT | C TGTG- GTGT G | T -- ACAC- C- | AC |

The nucleotide sequences of "diced" GAM RNAs of each of a plurality of GAM oligonucleotides described by FIG. 1 are set forth in Table 5, hereby incorporated herein. Table 5, line 1276 shows the mature GAM RNA as set forth in SEQ ID NO: 348 as sliced by DICER from the GAM PRECURSOR sequence (hairpin) as set forth in SEQ ID NO: 4233864.

GAM RNAs that are described by FIG. 1 are set forth in Tables 6-7, hereby incorporated herein. Table 6 shows data relating to the SEQ ID NO of the GAM target binding site sequence of the target gene name as bound by the GAM RNA as set forth in SEQ ID NO: 348. Table 6, lines 3688165, 767082, 762322 and 763042 related to target binding site SEQ ID NO: 1810388, 673420, 671402 respectively.

| GAM NAME | GAM ORGAN-ISM | GAM RNA SEQUENCE | PRECUR SEQ-ID | GAM POS |
|---|---|---|---|---|
| GAM353678 | Human | CAGCAGCACACTGTG-GTTTGTA | 4233864 | A |

The nucleotide sequences of target binding sites, such as BINDING SITE I, BINDING SITE II and BINDING SITE III that are found on GAM TARGET RNAs of each of a plurality of GAM oligonucleotides that are described by FIG. 1, and a schematic representation of the complementarity of each of these Target binding sites to each of a plurality of

TABLE 6

| TARGET BINDING SITE SEQ-ID | TARGET ORGANISM | TARGET | TARGET BINDING SITE SEQUENCE |
|---|---|---|---|
| 1810388 | Human | MGAT5 | CACCATGCTGCTG |
| 673420 | Human | SERPINH1 | AAACTAGGTGCTGCAG |
| 671402 | Human | SERPINH1 | ATACCATGATGCTG |
| 671042 | Human | SERPINH1 | CTATAAAACTAGGTGCTGCAG |

Table 7, lines 312839-313773 shows data relating to target genes and binding site of GAM oligonucleotides.

TABLE 7

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET;LOWER:GAM) | | | | | GAM POS |
|---|---|---|---|---|---|---|---|---|---|---|---|---|
| GAM35 3678 | Human | CAGCAGCA CACTGTGG TTTGTA | AAACCAAA CTTATGCA GCTG | nup C | NC_004431 from 2795390 2796631 (+) | Escherichia  coli CFT073 | 3 --- AAACCA TTTGGT ATG | A T T G | A TGC A C C- | A ACG A | A GCTG CGAC | A |
| GAM35 3678 | Human | CAGCAGCA CACTGTGG TTTGTA | AAACCAAA CTTATGCA GCTG | nup C | NC_004741 from 2494019 2495221 (+) | Shingella  flexneri 2a str. 2457T | 3 --- AAACCA TTTGGT ATG | A T T G | A TGC A C C- | A ACG A | A GCTG CGAC | A |
| GAM35 3678 | Human | CAGCAGCA CACTGTGG TTTGTA | AAACCCTG CTGCG | rel A | NC_000962 from 2907824 2910196 (-) | Mycobacterium  tuberculos is H37Rv | 3 --- AAACC TTTGG ATG | C TGCTAC | ----- TGCTGC ACGACG TGTCAC | - G C A | A | |
| GAM35 3673 | Human | CAGCAGCA CACTGTGG TTTGTA | AAACCCTG CTGCG | rel A | NC_002945 from 2875274 2877646 (-) | Mycobacterium  bovis subs p bovis AF21 22/97 | 3 --- AAACC TTTGG ATG | C TGTCAC | ----- TGCTGC ACGACG | - G C | A A | |
| GAM35 3678 | Human | CAGCAGCA CACTGTGG TTTGTA | AAACCCTT TCTGCTGC TT | yab O | NC_004431 from 61489 to 62148 (-) | Escherichia  coli CFT073 | 3 --- AAACC TTTGG ATG | C T G T | TTC- TGCT TCAC TCAC | GCT GCA C | T A | |
| GAM35 3678 | Human | CAGCAGCA CACTGTGG TTTGTA | AAACCGAT GCAGTGCG GCTG | amt B | NC_004337 from 408059 to 409345 (+) | Shigella  flexneri 2a str. 301 | 3 --- AAACCG TTTGGT ATG | AT G GT | CAG TGC AC- | G CGT A A | A CGAC | A |
| GAM35 3678 | Human | CAGCAGCA CACTGTGG TTTGTA | AAACCGAT GCAGTGCG | amt B | NC_004741 from 407860 to | Shigella  flexneri | 3 --- AAACCG | AT G | CAG TGC | G CGT | A CTG | |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET;LOWER:GAM) | GAM POS |
|---|---|---|---|---|---|---|---|---|
| | | | TTTGTA | GCTG | 409146 (+) | 2a str. 2457T | TTTGGT  C   ACG CGAC<br>ATG    GT AC-   A | |
| GAM35 3678 | Human | CAGCAGCA CACTGTGG TTTGTA | AAACCGAT GCCGTGCG GCTG | amt B | NC_004431 from 547616 to 548902 (+) | Escherichia coli CFT073 | 3 ---  AT CCG   G    A<br>AAACCG  G   TGC GCTG<br>TTTGGT  C   ACG CGAC<br>ATG    GT AC-   A | 3 |
| GAM35 3678 | Human | CAGCAGCA CACTGTGG TTTGTA | AAACCGCC CCCAGTCT GCTG | dsd A | NC_003197 from 4004453 to 40057 (+) T2 | Salmonella typhimurium LT2 | 3 ---  CCCCAG -    A<br>AAACCGC   T<br>CTGCTG    TTTGGTG<br>  A GACGAC ATG<br>     TCAC - C | 3 |
| GAM35 3678 | Human | CAGCAGCA CACTGTGG TTTGTA | AAACCGGC CTTGCCGC TG | gad | NC_002947 from 4871625 to 4872929 (+) | Pseudomonas putida KT244 0 | 3 ---    GCC -   C    A<br>AAACCG  T TGC GCTG<br>TTTGGT  A ACG CGAC<br>ATG    GTC C   A | 3 |
| GAM35 3678 | Human | CAGCAGCA CACTGTGG TTTGTA | AAACGAAT TGAATCAT GCCGCTG | aro A | NC_003116 from 1557502 to 1558803 (+) | Neisseria meningitidis Z 2491 | 3 --- G ATTGAATCA   C A<br>AAAC A           TGC<br>GCTG    TTTG T<br>    ACG CGAC ATG<br>  G GTCAC----   A | 3 |
| GAM35 3678 | Human | CAGCAGCA CACTGTGG TTTGTA | AAACGACG GGCTGCTG | ruv B | NC_003143 from 2336449 to 2337453 (+) | Yersinia pestis | 3 --- G ---G    AAAC A<br>ACG   GCTGCTG    TTTG<br>TGT  CGACGAC ATG    G<br>CACA | 3 |
| GAM35 3678 | Human | CAGCAGCA CACTGTGG TTTGTA | AAACGACG GGCTGCTG | ruv B | NC_004088 from 2482031 to 2433035 (-) | Yersinia pestis KIM | 3 --- G ---G    AAAC A<br>ACG   GCTGCTG    TTTG<br>TGT  CGACGAC ATG    G<br>CACA | 3 |
| GAM35 3678 | Human | CAGCAGCA CACTGTGG TTTGTA | AAACGATA TCCTGCTG | yci E | NC_004431 from 1558641 to 1559147 (-) | Escherichia coli CFT073 | 3 ---  G   --- C   A<br>AAAC ATA    T CTGCTG<br>TTTG TGT    A GACGAC<br>ATG    G   CAC C | 3 |
| GAM35 3678 | Human | CAGCAGCA CACTGTGG TTTGTA | AAACGCAT GTTCATGC GCTG | van B | NC_002516 from 5504120 to 5505073 (+) | Pseudomonas aeruginosa PA01 | 3 --- G  T CA  -    A<br>AAAC CATG T TGC<br>GCTG    TTTG GTGT A<br>  ACG CGAC ATG   -   C<br>C-    A | 3 |
| GAM35 3678 | Human | CAGCAGCA CACTGTGG TTTGTA | AAACGCTC CGTATACT GCTGCTA | fts Y | NC_000922 from 1115427 to 1116299 (-) | Chlamydophila pneumoniae CWL029 | 3 --- GC CCGTATAC    A<br>  A      AAAC T<br>TGCTGCT    TTTG<br>G    ACGA ATG<br>GT TCAC----   C | 3 |
| GAM35 3678 | Human | CAGCAGCA CACTGTGG TTTGTA | AAACGCTC CGTATACT GCTGCTA | fts Y | NC_002491 from 1113127 to 1113999 (-) | Chlamydophila pneumoniae J138 | 3 --- GC CCGTATAC    A<br>  A      AAAC T<br>TGCTGCT    TTTG<br>G    ACGACGA ATG<br>GT TCAC----   C | 3 |
| GAM35 3678 | Human | CAGCAGCA CACTGTGG TTTGTA | AAACTAAT CGACAGTT GCTGCG | rbs R | NC_004337 from 3947708 to 3948700 (+) | Shigella flexneri 2a str. 301 | 3 ---   ATCGACAGT    A<br>  -     AAACTA<br>    TGCTGC G<br>    TTTGGT<br>  ACGACG C ATG<br>    GTCAC----    A | 3 |
| GAM35 3678 | Human | CAGCAGCA CACTGTGG TTTGTA | AAACTAAT CGACAGTT GCTGCG | rbs R | NC_004741 from 3824594 to 3825577 (-) | Shigella flexneri 2a str. 2457T | 3 ---   ATCGACAGT    A<br>  -     AAACTA<br>    TGCTGC G<br>    TTTGGT<br>  ACGACG C ATG<br>    GTCAC----    A | 3 |
| GAM35 3678 | Human | CAGCAGCA CACTGTGG TTTGTA | AAACTAGG TGCTGCAG | SER PIN H 1 | NM_001235 | Human | 3 ---  G  ---    A   A<br>AAACTA G  TGCTGC G<br>TTTGGT T  ACGACG C<br>ATG    G  CAC    A | 3 |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET;LOWER:GAM) | GAM POS |
|---|---|---|---|---|---|---|---|---|
| GAM35 3678 | Human | CAGCAGCA ACTGTGG TTTGTA | AAACTCAG GCTGGCAA GCTGCTG | aro H | NC_004337 from 1557527 1558573 (-) | Shigella flexneri 2a str. 301 | 3 ---     T  G C  GCAA    A<br>AAAC CA G TG<br>GCTGCTG    TTTG GT T<br>AC  CGACGAC ATG   -<br>G C   ---A | 3 |
| GAM35 3678 | Human | CAGCAGCA CACTGTGG TTTGTA | AAAGCTGC TGCTT | zra P | NC_003197 from 4387727 4338182 (-) | Salmonella typhimurium LT2 | 3 ---    G ------    T A<br>AAA C    TGCTGCT<br>TTT G    ACGACGA<br>ATG   G TGTCAC   C | 3 |
| GAM35 3678 | Human | CAGCAGCA CACTGTGG TTTGTA | AAATCAGT TGTACTTG TTGCTG | cys M | NC_003197 from 2551651 2552562 (-) | Salmonella typhimurium LT2 | 3 ---   GTTGTACT  T    A<br>AAATCA    TG<br>TGCTG   TTTGGT<br>AC ACGAC ATG<br>GTCAC---  G | 3 |
| GAM35 3678 | Human | CAGCAGCA CACTGTGG TTTGTA | AACATTGC TGCTG | rbs R | NC_004431 from 4439260 4440252 (+) | Escherichia coli CFT073 | 3 --- - ----   AA C A<br>AT   TGCTGCTG  TT G<br>TG  ACGACGAC ATG T G<br>TCAC | 3 |
| GAM35 3678 | Human | CAGCAGCA CACTGTGG TTTGTA | AACTGCTG CTC | oxy R | NC_003197 from 4343080 4343997 (+) | Salmonella typhimurium | 3 --- - -------   C A<br>AA C     TGCTGCT<br>TT G    ACGACGA<br>ATG  T GTGTCAC   C | 3 |
| GAM35 3678 | Human | CAGCAGCA CACTGTGG TTTGTA | AACT- GCTG CTC | oxy R | NC_003198 from 3607204 3608121 (-) | Salmonella enterica serovar Typhi | 3 --- - -------   C A<br>AA C     TGCTGCT<br>TT G    ACGACGA<br>ATG  T GTGTCAC   C | 3 |
| GAM35 3678 | Human | CAGCAGCA CACTGTGG TTTGTA | AACT- GCTG CTC | oxy R | NC_004631 from 3592864 3593781 (-) | Salmonella enterica enterica serovar Typhi Ty2 | 3 --- - -------   C A<br>AA C     TGCTGCT<br>TT G    ACGACGA<br>ATG  T GTGTCAC   C | 3 |
| GAM35 3678 | Human | CAGCAGCA CACTGTGG TTTGTA | AAGCCGGT TGCGGTGC TGCTG | aro A | NC_003116 from 1557502 1558803 (+) | Neisseria meningitidis Z 2491 | 3 ---     GTTGCGG    A<br>AAGCCG<br>TGCTGCTG<br>TTTGGT<br>ACGACGAC ATG<br>GTCAC-- | 3 |
| GAM35 3678 | Human | CAGCAGCA CACTGTGG TTTGTA | AATCCACT CCGTGTTG CTG | gig P | NC_003193 from 4144568 4147015 (+) | Salmonella enterica enterica serovar Typhi | 3 --- T  TCC  T    AAA<br>CCAG  GTG TGCTG   TT<br>GGTG  CAC ACGAC ATG  T<br>TCA   G | 3 |
| GAM35 3678 | Human | CAGCAGCA CACTGTGG TTTGTA | AATCCACT CCGTGTTG CTG | gig P | NC_004631 from 4129215 4131662 (+) | Salmonella enterica enterica serovar Typhi Ty2 | 3 --- T  TCC  T    AAA<br>CCAG  GTG TGCTG   TT<br>GGTG  CAC ACGAC ATG  T<br>TCA   G | 3 |
| GAM35 3678 | Human | CAGCAGCA CACTGTGG TTTGTA | ACATGCTG CTT | nup C | NC_004431 from 2795390 2796631 (+) | Escherichia coli CFT073 | 3 --- -- - -----    T A<br>A   C A    TGCTGCT<br>T  G T    ACGACGA<br>ATG TT G GTCAC   C | 3 |
| GAM35 3678 | Human | CAGCAGCA CACTGTGG TTTGTA | ACATGCTG CTT | nup C | NC_004741 from 2494019 2495221 (+) | Shigella flexneri 2a str. 2457T | 3 --- -- - -----    T A<br>A   C A    TGCTGCT<br>T  G T    ACGACGA<br>ATG TT G GTCAC   C | 3 |
| GAM35 3678 | Human | CAGCAGCA CACTGTGG TTTGTA | ACGATGGT GTACTGCT GCTT | pho Y2 | NC_000962 from 913556 to 914197 (-) | Mycobacterium tuberculosis H37Rv | 3 --- -- G     TAC    A<br>T  A   C ATGGTG<br>TGCTGCT   T  G<br>TGTCAC   ACGACGA ATG TT<br>G    ---    C | 3 |
| GAM35 3678 | Human | CAGCAGCA CACTGTGG TTTGTA | ACGATGGT GTACTGCT GCTT | pho Y2 | NC_002945 from 914388 to 915029 (-) | Mycobacterium bovis subs p bovis AF21 | 3 --- -- G     TAC    A<br>T  A   C ATGGTG<br>TGCTGCT   T  G | 3 |

TABLE 7-continued

| GAM NAME | GAM ORGANISM | GAM RNA SEQUENCE | TARGET BS-SEQ TARGET | TARG REF-ID | TARGET ORGANISM | BINDING SITE DRAW (UPPER:TARGET;LOWER:GAM) | GAM POS |
|---|---|---|---|---|---|---|---|
| | | | | 22/97 | | TGTCAC  ACGACGA ATG TT<br>G         ---         C | |
| GAM35 3678 | Human | CAGCAGCA CACTGTGG TTTGTA | ACTGCTGC TC | glg P<br>NC_003193<br>from 4144568 to 4147015 (+) | Salmonella enterica enterica serovar Typhi | 3 --- -- -------    C A<br>     A  C    TGCTGCT<br>     T  G    ACGACGA<br>ATG TT GTGTCAC    C | |
| GAM35 3678 | Human | CAGCAGCA CACTGTGG TTTGTA | ACTGCTGC TC | glg P<br>NC_004631<br>from 4129215 to 4131662 (+) | Salmonella enterica enterica serovar Typhi Ty2 | 3 --- -- -------    C A<br>     A  C    TGCTGCT<br>     T  G    ACGACGA<br>ATG TT GTGTCAC    C | |
| GAM35 3678 | Human | CAGCAGCA CACTGTGG TTTGTA | AGAATGTT GTTAGTGC TGCTG | rec G<br>NC_00677<br>from 2014723 to 2016954 (-) | Mycobacterium leprae | 3 ---    -- T TTAG    A<br>      AGA ATG TG<br>   TGCTGCTG  TTT  TGT<br>AC   ACGACGAC ATG  GG<br>C    ---- | |
| GAM35 3678 | Human | CAGCAGCA CACTGTGG TTTGTA | AGACCATG AAGAACTG GCTGCTG | rel A<br>NC_000962<br>from 2907824 to 2910196 (-) | Mycobacterium tuberculosis is H37Rv | 3 ---      AA AACTG     A<br>      AGACCATG  G<br>       GCTGCTG    TTTGGTGT<br>C      CGACGAC ATG<br>         CA ----A | |
| GAM35 3678 | Human | CAGCAGCA CACTGTGG TTTGTA | AGACCATG AAGAACTG GCTGCTG<br>46 (-) | rel A<br>NC_002945<br>from 2875274 to 2877646 (-) | Mycobacterium bovis subs p bovis AF21 22/97 | 3 ---      AA AACTG     A<br>      AGACCATG  G<br>       GCTGCTG    TTTGGTGT<br>C      CGACGAC ATG<br>         CA ----A | |
| GAM35 3678 | Human | CAGCAGCA CACTGTGG TTTGTA | AGCTTGCT GCTG | glp C<br>NC_003143<br>from 4289650 to 4290897 (-) | Yersinia pestis | 3 ---   -  ------    AG CTA<br>         TGCTGCTG    T-<br>T GG<br>         ACGACGAC ATG T<br>   TGTCAC | |
| GAM35 3678 | Human | CAGCAGCA CACTGTGG TTTGTA | AGCTTGCT GCTG | glp C<br>NC_004088<br>from 454677 to 456047 (+) | Yersinia pestis KIM | 3 ---   -  ------    AG CTA<br>         TGCTGCTG    T-<br>T GG<br>         ACGACGAC ATG T<br>   TGTCAC | |
| GAM35 3678 | Human | CAGCAGCA CACTGTGG TTTCTA | ATACCAAG GCTGCTG | fts Y<br>NC_000922<br>from 1115427 to 1116299 (-) | Chlamydophila pneumoniae CWL029 | 3 --- T  A----G    A    A<br>   ACCA    GCTGCTG    T<br>   TGGT    CGACGAC ATG T<br>          GTCACA | |
| GAM35 3678 | Human | CAGCAGCA CACTGTGG TTTCTA | ATACCAAG GCTGCTG | fts Y<br>NC_002491<br>from 1113127 to 1113999 (-) | Chlamydophila pneumoniae J138 | 3 --- T  A----G    A    A<br>   ACCA    GCTGCTG    T<br>   TGGT    CGACGAC ATG T<br>          GTCACA | |
| GAM35 3678 | Human | CAGCAGCA CACTGTGG TTTGTA | ATACCATG ATGCTG | SER PIN H 1<br>NM_001235 | Human | 3 --- T  -----  A    A A<br>   ACCA    TG TGCTG    T<br>   TGGT    AC ACGAC ATG T<br>          GTCAC  G | |
| GAM35 3678 | Human | CAGCAGCA CACTGTGG TTTGTA | ATTTCTGC TGCTT | aro D<br>NC_004342<br>from 48128 to 48832 (-) | Leptospira interrogans serovarlai str. 56601 | 3 --- TT ------    T A<br>     A TC    TGCTGCT<br>     T GG    ACGACGA<br>ATG TT TGTCAC    C | |
| GAM35 3678 | Human | CAGCAGCA CACTGTGG TTTGTA | CAAAAACG GTCTGCCG CTG | acc C<br>NC_002929<br>from 926407 to 927777 (+) | Bordetella pertussis | 3 -- A-   C    C     A<br>   CAAA  ACGGT TGC GCTG<br>   GTTT  TGTCA ACG CGAC<br>   AT    GG    C    A | |
| GAM35 3678 | Human | CAGCAGCA CACTGTGG TTTGTA | CAAAAGCT TTTCGCTT GCGGCTG | zra P<br>NC_003197<br>from 4387727 to 4388182 (-) | Salmonella typhimurium LT2 | 3 --   -- GCT TTCGCT   GA<br>   CAAA A  T          TGC<br>   GCTG GTTT T       A<br>      ACG CGAC AT    GG<br>      GTC C----- A | |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET;LOWER:GAM) | GAM POS |
|---|---|---|---|---|---|---|---|---|
| GAM35 3678 | Human | CAGCAGCA CACTGTGG TTTGTA | CAAAAGTC GTCCTGTG CGGCTG | glp D | NC_004310 from 210763 to 212274 (+) | *Brucella suis* 1330 | 3 --    -- GTCGTCCTG  G   A<br>     CAAA   A            TGC<br>     GCTG   GTTT    T<br>        ACG CGAC   AT<br>     GG GTCAC----    A | |
| GAM35 3678 | Human | CAGCAGCA CACTGTGG TTTGTA | CAAACAGG CTGCTGCT G | avt A | NC_004337 from 3721175 to 3722533 (+) | *Shigella flexneri* 2a str. 301 | 3 --      - G C--      CAAAC A<br>     A G     TGCTGCTG     GTTTG<br>     T T     ACGACGAC AT       G<br>     G CAC | |
| GAM35 3678 | Human | CAGCAGCA CACTGTGG TTTGTA | CAAACAGG CTGCTGCT G | avt A | NC_004741 from 4052685 to 4053938 (-) | *Shigella flexneri* 2a str. 2457T | 3 --      - G C--      CAAAC A<br>     A G     TGCTGCTG     GTTTG<br>     T T     ACGACGAC AT       G<br>     G CAC | |
| GAM35 3678 | Human | CAGCAGCA CACTGTGG TTTGTA | CAAACATC ATGGTTGC | mia A | NC_000117 from 899276 to 900295 (+) | *Chlamydia trachomatis* | 3 --      - CA GT    T  A<br>     TG    GTTTG TG   AC<br>     ACGAC AC AT   G  TC<br>     --    G | |
| GAM35 3678 | Human | CAGCAGCA CACTGTGG TTTGTA | CAAACCAG CGGTCTGC TG | sel B | NC_002947 from 582133 to 584055 (+) | *Pseudomonas putida* KT2440 | 3 --         GC G- -         A<br>     CAAACCA    G   T CTGCTG<br>     GTTTGGT    C   A GACGAC<br>     AT        GT AC C | |
| GAM35 3678 | Human | CAGCAGCA CACTGTGG TTTGTA | CAAACCAT GATGCTG | mia A | NC_000117 from 899276 to 900295 (+) | *Chlamydia trachomatis* | 3 --      ----- A       A<br>     CAAACCA      TG TGCTG<br>     GTTTGG       AC ACGAC<br>     AT        GTCAC G | |
| GAM35 3678 | Human | CAGCAGCA CACTGTGG TTTGTA | CAAACCGA CCCTGCTG CTG | min E | NC_002947 from 1932680 to 1932934 (-) | *Pseudomonas putida* KT2440 | 3 --       ACCC-         A<br>     CAAACCA      TGCTGCTG<br>     GTTTGGT      ACGACGAC<br>     AT        GTCAC | |
| GAM35 3678 | Human | CAGCAGCA CACTGTGG TTTGTA | CAAACCGC AGTACTGG TGCTG | dna E | NC_002677 from 1423014 to 1426547 (+) | *Mycobacterium leptae* | 3 --         AC  G        A<br>     CAAACCGCAGT  TG TGCTG<br>     GTTTGGTGTCA  AC ACGAC<br>     AT        C- G | |
| GAM35 3678 | Human | CAGCAGCA CACTGTGG TTTGTA | CAAACTCT TTTTCTTC TGCTG | aro D | NC_004342 from 48128 to 48832 (-) | *Leptospira interrogans serovarlai* str. 56601 | 3 --     C TT TC T     A<br>     CAAACT T  T  T CTGCTG<br>     GTTTGG G  A  A GACGAC<br>     AT      T TC C- C | |
| GAM35 3678 | Human | CAGCAGCA CACTGTGG TTTGTA | CAAAGCAC TGCTGCTG | pts H | NC_003198 from 2505403 to 2505660 (+) | *Salmonella enterica enterica serovar* Typhi | 3 --     G ----     CAAA  A<br>     CAC    TGCTGCTG    GTTT<br>     GTG    ACGACGAC AT    G<br>     TCAC | |
| GAM35 3678 | Human | CAGCAGCA CACTGTGG TTTGTA | CAAAGCCG CGTGCGCT G | amt B | NC_004337 from 408059 to 409345 (+) | *Shigella flexneri* 2a str. 301 | 3 --      G CGC --    -       A<br>     CAAA  C     G   TGC GCTG<br>     GTTT  G     C   ACG CGAC<br>     AT    G TGT AC    A | |
| GAM35 3678 | Human | CAGCAGCA CACTGTGG TTTGTA | CAAAGCCG CGTGCGCT G | amt B | NC_004431 from 547616 to 548902 (+) | *Escherichia coli* CFT073 | 3 --      G CGC --    -       A<br>     CAAA  C     G   TGC GCTG<br>     GTTT  G     C   ACG CGAC<br>     AT    G TGT AC    A | |
| GAM35 3678 | Human | CAGCAGCA CACTGTGG TTTGTA | CAAAGCCG CGTGCGCT G | amt B | NC_004741 from 407860 to 409146 (+) | *Shigella flexneri* 2a str. 2457T | 3 --      G CGC --    -       A<br>     CAAA  C     G   TGC GCTG<br>     GTTT  G     C   ACG CGAC<br>     AT    G TGT AC    A | |
| GAM35 3678 | Human | CAGCAGCA CACTGTGG TTTGTA | CAAAGCCT TTTTTCGG GCTGCTG | pil T | NC_002947 from 5816934 to 5817944 (-) | *Pseudomonas putida* KT2440 | 3 --     G C TT TTCGG      A<br>     CAAA  C T    T<br>         GCTGCTG    GTTT G G<br>     A     CGACGAC AT      G<br>     T TC C---A | |
| GAM35 3678 | Human | CAGCAGCA CACTGTGG TTTGTA | CAAAGCGT CATGTAAT GCTTGCTG | cys M | NC_003197 from 2551651 to 2552562 (-) | *Salmonella typhimurium* LT2 | 3 --     G  CA TAA     T A<br>     CAAA  CGT TG    TGCT<br>     GCTG     GTTT GTG   AC<br>     ACGA CGAC  AT      G<br>     TC  ---     - | |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET; LOWER:GAM) | GAM POS |
|---|---|---|---|---|---|---|---|---|
| GAM35 3678 | Human | CAGCAGCACACTGTGGTTTGTA | CAAATCCCCAGTTGTGCTG | glc C | NC_004431 from 3542871 to 3543695 (+) | Escherichia coli CFT073 | 3 -- C CAGT - A<br>CAAATC C TG TGCTG<br>GTTTGG G AC ACGAC<br>AT T TCAC G | 3 |
| GAM35 3678 | Human | CAGCAGCACACTGTGGTTTGTA | CAACACATTACTGCTTGCTCTG | aro H | NC_004337 from 1557527 to 1558573 (-) | Shigella flexneri 2a str. 301 | 3 -- CA TACTGCT - A<br>CAA CAT TGCT<br>CTG GTT GTG<br>ACGA GAC AT TG<br>TCAC--- C | 3 |
| GAM35 3678 | Human | CAGCAGCACACTGTGGTTTGTA | CAACACTTTGCGCTG | spe D | NC_003197 from 194201 to 194995 (-) | Salmonella typhimurium LT2 | 3 -- - TT-- - A<br>CAA C AC TGC GCTG<br>GTT G TG ACG CGAC<br>AT T G TCAC A | 3 |
| GAM35 3678 | Human | CAGCAGCACACTGTGGTTTGTA | CAACACTTTGCGCTG | spe D | NC_003198 from 196389 to 197183 (-) | Salmonella enterica enterica serovar Typhi | 3 -- - TT-- - A<br>CAA C AC TGC GCTG<br>GTT G TG ACG CGAC<br>AT T G TCAC A | 3 |
| GAM35 3678 | Human | CAGCAGCACACTGTGGTTTGTA | CAACACTTTGCGCTG | spe D | NC_004631 from 196380 to 197174 (-) | Salmonella enterica enterica serovar Typhi Ty2 | 3 -- - TT-- - A<br>CAA C AC TGC GCTG<br>GTT G TG ACG CGAC<br>AT T G TCAC A | 3 |
| GAM35 3678 | Human | CAGCAGCACACTGTGGTTTGTA | CAACAGCAGTTGCTGCTG | ace K | NC_002947 from 5184742 to 5186457 (-) | Pseudomonas putida KT2440 | 3 -- - GCAGT CAA C A<br>A TGCTGCTG GTT G<br>T ACGACGAC AT T G<br>GTCAC | 3 |
| GAM35 3678 | Human | CAGCAGCACACTGTGGTTTGTA | CAACAGTTTCTTGGTC (mrp)TGCTG | fmt B | NC_002745 from 2218145 to 2225590 (-) | Staphylococcus aureus u bsp. aureus N315 | 3 -- - GTT CTTGG - A<br>CAA C A T T<br>CTGCTG GTT G T A<br>A GACGAC AT T G<br>GTC C---- C | 3 |
| GAM35 3678 | Human | CAGCAGCACACTGTGGTTTGTA | CAACAGTTTCTTGGTC (mrp)TGCTG | fmt B | NC_002758 from 2287935 to 2295380 (-) | Staphylococcus aureus u bsp. aureus Mu50 | 3 -- - GTT CTTGG - A<br>CAA C A T T<br>CTGCTG GTT G T A<br>A GACGAC AT T G<br>GTC C---- C | 3 |
| GAM35 3678 | Human | CAGCAGCACACTGTGGTTTGTA | CAACAGTTTCTTGGTCTGCTG | tru ncated fmt | NC_003923 from 2238083 to 2240143 (-) | Staphylococcus aureus u bsp. aureus MW2 | 3 -- - GTT CTTGG - A<br>CAA C A T T<br>CTGCTG GTT G T A<br>A GACGAC AT T G<br>GTC C---- C | 3 |
| GAM35 3678 | Human | CAGCAGCACACTGTGGTTTGTA | CAACCCACCAGCACTGCTGCG | cys Q | NC_002947 from 315184 to 315984 (+) | Pseudomonas putida KT2440 | 3 -- C CAGCAC -A<br>CAA CCAC TGCTGC<br>G GTT GGTG<br>ACGACG C AT T<br>TCAC-- A | 3 |
| GAM35 3678 | Human | CAGCAGCACACTGTGGTTTGTA | CAACCGCTGCTGCTG | pho Y2 | NC_000962 from 913556 to 914197 (-) | Mycobacterium tuberculosis H37Rv | 3 -- - ---- CAA A<br>CCGC TGCTGCTG GTT<br>GGTG ACGACGAC AT T<br>TCAC | 3 |
| GAM35 3678 | Human | CAGCAGCACACTGTGGTTTGTA | CAACCGCTGCTGCTG | pho Y2 | NC_002945 from 914388 to 915029 (-) | Mycobacterium bovis subs p bovis AF21 22/97 | 3 -- - ---- CAA A<br>CCGC TGCTGCTG GTT<br>GGTG ACGACGAC AT T<br>TCAC | 3 |
| GAM35 3678 | Human | CAGCAGCACACTGTGGTTTGTA | CAACCGGTGCTGCTG | dad X | NC_004431 from 1476306 to 1477376 (+) | Escherichia coli CFT073 | 3 -- - G---- - A<br>CAA CCG TGCTGC G<br>GTT GGT ACGACG C<br>AT T GTCAC A | 3 |
| GAM35 3678 | Human | CAGCAGCACACTGTGGTTTGTA | CAACCGTCGGTGATGCTCTG | fha L | NC_002929 from 3085865 to 3098455 (+) | Bordetella pertussis | 3 -- - C GTGA - A<br>CAA CCGT G TGCT<br>CTG GTT GGTG C<br>ACGA GAC AT T T<br>AC-- C | 3 |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET;LOWER:GAM) | GAM POS |
|---|---|---|---|---|---|---|---|---|
| GAM35 3678 | Human | CAGCAGCA CACTGTGG TTTGTA | CAACCTGC GCTG | speD | NC_003197 from 194201 to 194995 (-) | Salmonella typhimurium LT2 | 3 -- - ------ - A<br>CAA CC TGC GCTG<br>GTT GG ACG CGAC<br>AT T TGTCAC A | |
| GAM35 3678 | Human | CAGCAGCA CACTGTGG TTTGTA | CAACCTGC GCTG | speD | NC_003198 from 196389 to 197183 (-) | Salmonella enterica enterica serovar Typhi | 3 -- - ------ - A<br>CAA CC TGC GCTG<br>GTT GG ACG CGAC<br>AT T TGTCAC A | |
| GAM35 3678 | Human | CAGCAGCA CACTGTGG TTTGTA | CAACCTGC GCTG | speD | NC_004631 from 196380 to 197174 (-) | Salmonella enterica enterica serovar Typhi Ty2 | 3 -- - ------ - A<br>CAA CC TGC GCTG<br>GTT GG ACG CGAC<br>AT T TGTCAC A | |
| GAM35 3678 | Human | CAGCAGCA CACTGTGG TTTGTA | CAACGCCA AGCTGCTG | flhB | NC_002929 from 1441767 to 1442921 (+) | Bordetella pertussis | 3 -- CG -----A CAA A<br>CCA GCTGCTG GTT<br>GGT CGACGAC AT<br>T- GTCACA | |
| GAM35 3678 | Human | CAGCAGCA CACTGTGG TTTGTA | CAAGCCAA TCTGCTG | sseB | NC_004431 from 2922456 to 2923241 (-) | Escherichia coli CFT073 | 3 -- A---- - A<br>CAAGCCA T CTGCTG<br>GTTTGGT A GACGAC<br>AT GTCAC C | |
| GAM35 3678 | Human | CAGCAGCA CACTGTGG TTTGTA | CAAGCCCG CTTGCTGT G | aer-2 | NC_002947 from 2406996 to 2408561 (-) | Pseudomonas putida KT2440 | 3 -- CGCT-- - A<br>CAAGCC TGCTG TG<br>GTTTGG ACGAC AC<br>AT TGTCAC G | |
| GAM35 3678 | Human | CAGCAGCA CACTGTGG TTTGTA | CAAGCCTG CGCTG | lppI | NC_000962 from 2291267 to 2291923 (+) | Mycobacterium tuberculosis H37Rv | 3 -- ------ - A<br>CAAGCC TGC GCTG<br>GTTTGG ACG CGAC<br>AT TGTCAC A | |
| GAM35 3678 | Human | CAGCAGCA CACTGTGG TTTCTA | CAAGCCTG CGCTG | lppI | NC_002945 from 2275182 to 2275838 (+) | Mycobacterium bovis subs p bovis AF21 22/97 | 3 -- ------ - A<br>CAAGCC TGC GCTG<br>GTTTGG ACG CGAC<br>AT TGTCAC A | |
| GAM35 3678 | Human | CAGCAGCA CACTGTGG TTTGTA | CAAGCTGC TGCTG | risA | NC_002929 from 3765257 to 3765991 (-) | Bordetella pertussis | 3 CAAGC A<br>TGCTGCTG GTTTG<br>ACGACGAC AT<br>GTGTCAC | |
| GAM35 3678 | Human | CAGCAGCA CACTGTGG TTTGTA | CAAGGACC ATGCGCTG | accC | NC_002929 from 926407 to 927777 (+) | Bordetella pertussis | 3 -- GG ----- - A<br>CAA ACCA TGC<br>GCTG GTT TGGT<br>ACG CGAC AT --<br>GTCAC A | |
| GAM35 3678 | Human | CAGCAGCA CACTGTGG TTTGTA | CAAGGCAA AGGTCTGC TG | rpsT | NC_002947 from 707068 to 707346 (-) | Pseudomonas putida KT2440 | 3 -- G A G- - CAAGA<br>CA AG T CTGCTG GTTT<br>GT TC A GACGAC AT G<br>G AC C | |
| GAM35 3678 | Human | CAGCAGCA CACTGTGG TTTGTA | CAATAACA ATGCAGCT G | fmtB (mrp) | NC_002745 from 2218145 to 2225590 (-) | Staphylococcus aureussu bsp. aureus N315 | 3 -- T A A---- A A<br>CAA A CA TGC GCTG<br>GTT T GT ACG CGAC<br>AT - G GTCAC A | |
| GAM35 3678 | Human | CAGCAGCA CACTGTGG TTTGTA | CAATAACA ATGCAGCT G | fmtB (mrp) | NC_002758 from 2287935 to 2295380 (-) | Staphylococcus aureussu bsp. aureus Mu50 | 3 -- T A A---- A A<br>CAA A CA TGC GCTG<br>GTT T GT ACG CGAC<br>AT - G GTCAC A | |
| GAM35 3678 | Human | CAGCAGCA CACTGTGG TTTGTA | CAATAACA ATGCAGCT G | truncated fmtB | NC_003923 from 2238083 to 2240143 (-) | Staphylococcus aureussu bsp. aureus MW2 | 3 -- T A A---- A A<br>CAA A CA TGC GCTG<br>GTT T GT ACG CGAC<br>AT - G GTCAC A | |
| GAM35 3678 | Human | CAGCAGCA CACTGTGG TTTGTA | CAATAGCG CCTGCTGC TG | nupC | NC_004337 from 2515842 to 2517083 (+) | Shigella flexneri 2a str. 301 | 3 -- T-- GC CC CAA A<br>A G TGCTGCTG GTT<br>T C ACGACGAC AT<br>TGG GT AC | |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET;LOWER:GAM) | GAM POS |
|---|---|---|---|---|---|---|---|---|
| GAM35 3678 | Human | CAGCAGCA CACTGTGG TTTGTA | CAATAGCG CCTGCTGC TG | nupC | NC_004431 from 2795390 to 2796631 (+) | Escherichia coli CFT073 | ``` 3 --    T-- GC CC    CAA   A      A  G   TGCTGCTG   GTT      T  C   ACGACGAC   AT    TGG      GT      AC ``` | |
| GAM35 3678 | Human | CAGCAGCA CACTGTGG TTTGTA | CAATAGCG CCTGCTGC TG | nupC | NC_004741 from 2494019 to 2495221 (+) | Shigella flexneri 2a str. 2457T | ``` 3 --    T-- GC CC    CAA   A      A  G   TGCTGCTG   GTT      T  C   ACGACGAC   AT    TGG      GT      AC ``` | |
| GAM35 3678 | Human | CAGCAGCA CACTGTGG TTTCTA | CAATATAG AAGCTGCT GCTA | def | NC_000922 from 1221735 to 1222295 (+) | Chlamydophila pneumoniae CWL029 | ``` 3 --    TA  G AGC     A  A    CAA   TA A    TGCTGCT    GTT   GT T    ACGACGA     AT    TG  G   CAC          C ``` | |
| GAM35 3678 | Human | CAGCAGCA CACTGTGG TTTCTA | CAATATAG AAGCTGCT CCTA | def | NC_002491 from 1218069 to 1218629 (+) | Chlamydophila pneumoniae J138 | ``` 3 --    TA  G AGC     A  A    CAA   TA A    TGCTGCT    GTT   GT T    ACGACGA     AT    TG  G   CAC          C ``` | |
| GAM35 3678 | Human | CAGCAGCA CACTGTGG TTTGTA | CAATCACC GGGCCGAT GCGGCTG | glcC | NC_004431 from 3542871 to 3543695 (+) | Escherichia coli CFT073 | ``` 3 --    T - C G CCGA   G A    CAA C AC G G      TGC   GCTG   GTT G TG C  C     ACG   CGAC AT    T G  T    A ----         A ``` | |
| GAM35 3678 | Human | CAGCAGCA CACTGTGG TTTGTA | CAATCAGG GATACTGC TG | pta | NC_002947 from 891625 to 893712 (-) | Pseudomonas putida KT2440 | ``` 3 --    T - G A- A   CAA A    C A GG  T  CTGCTG   GTT    G T TC  A  GACGAC AT   T    G G   AC          C ``` | |
| GAM35 3678 | Human | CAGCAGCA CACTGTGG TTTGTA | CAATCCCC GCTTCCTG CTG | tcfA | NC_002929 from 1264436 to 1266379 (+) | Bordetella pertussis | ``` 3 --    T  C  C - C    CAA A    CC CG T  T  CTGCTG   GTT    GG GT A  A  GACGAC AT    T     T  C  C  C ``` | |
| GAM35 3678 | Human | CAGCAGCA CACTGTGG TTTGTA | CAATCCCG GCCATTTG CTCTG | ruvB | NC_003142 from 2336449 to 2337453 (+) | Yersinia pestis | ``` 3 --    T CG CCATT    - A    CAA CC  G        TGCT   CTG    GTT GG  T       ACGA    GAC AT    T   TG    CAC--             C ``` | |
| GAM35 3678 | Human | CAGCAGCA CACTGTGG TTTGTA | CAATCCCG GCCATTTG CTCTG | ruvB | NC_004088 from 2482031 to 2483035 (-) | Yersinia pestis KIM | ``` 3 --    T CG CCATT    - A    CAA CC  G        TGCT   CTG    GTT GG  T       ACGA    GAC AT    T   TG    CAC--             C ``` | |
| GAM35 3678 | Human | CAGCAGCA CACTGTGG TTTGTA | CAATCGCA GCACTGGT GCTG | nupC | NC_004337 from 2515842 to 2517083 (+) | Shigella flexneri 2a str. 301 | ``` 3 --    T G GCAC-  G    A    CAA  C CA    TG TGCTG    GTT  G GT    AC ACGAC     AT    T -     GTCAC  G ``` | |
| GAM35 3678 | Human | CAGCAGCA CACTGTGG TTTGTA | CAATCGCA CTTTCTGC GCTG | rpsT | NC_002947 from 707068 to 707346 (-) | Pseudomonas putida KT2440 | ``` 3 --    T T TT C   -      A    CAA C CAC  T TGC GCTG    GTT G GTG  A ACG CGAC     AT    T - TC C       A ``` | |
| GAM35 3678 | Human | CAGCAGCA CACTGTGG TTTGTA | CACACAGG TCATCCTT GCGCTG | prcA | NC_002677 from 1576553 to 1577350 (+) | Mycobacterium leprae | ``` 3 --    C  - G TCATCCT    - A    CA AC A G         TGC   GCTG   GT TG T  T     ACG   CGAC AT    T  G    G CAC----         A ``` | |
| GAM35 3678 | Human | CAGCAGCA CACTGTGG TTTGTA | CACATGTT GTACATGC TGCTT | nupC | NC_004337 from 2515842 to 2517083 (+) | Shingella flexneri 2a str. 301 | ``` 3 --    -- -   T TACA      A      T  CA  C ATG TG    TGCTGCT    GT  G TGT    AC    ACGACGA  AT TT  G     C ----             C ``` | |
| GAM35 3678 | Human | CAGCAGCA CACTGTGG TTTGTA | CACCAATG CTCCTG | lppI | NC_000962 from 2291267 to 2291923 (+) | Mycobacterium tuberculosis H37Rv | ``` 3 --    -- A---- C    A    CA  CCA    TGCT CTG    GT  GGT    ACGA GAC    AT TT    GTCAC    C ``` | |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET;LOWER:GAM) | GAM POS |
|---|---|---|---|---|---|---|---|---|
| GAM35 3678 | Human | CAGCAGCA CACTGTGG TTTGTA | CACCAATG CTCCTG | lpp I | NC_002945 from 2275182 to 2275838 (+) | Mycobacterium bovis subsp bovis AF21 22/97 | 3 -- -- A---- C A<br>CA CCA TGCT CTG<br>GT GGT ACGA GAC<br>AT TT GTCAC C | |
| GAM35 3678 | Human | CAGCAGCA CACTGTGG TTTGTA | CACCACCG CTAACTGC TGCG | omp G | NC_004431 from 1624577 to 1625533 (+) | Escherichia coli CFT073 | 3 -- -- C CTAAC A<br>- CA CCAC G<br>TGCTGC G GT GGTG<br>C ACGACG C AT TT<br>T AC--- A | |
| GAM35 3678 | Human | CAGCAGCA CACTGTGG TTTGTA | CACCACCT CCTGCTG | phn V | NC_003198 from 471575 to 472366 (-) | Salmonella enterica enterica serovar Typhi | 3 -- -- C--- C CA A<br>CCAC T CTGCTG GT<br>GGTG A GACGAC AT<br>TT TCAC C | |
| GAM35 3678 | Human | CAGCAGCA CACTGTGG TTTGTA | CACCACCT CCTGCTG | phn V | NC_004631 from 2508735 to 2509526 (-) | Salmonella enterica serovar Typhi Ty2 | 3 -- -- C--- C CA A<br>CCAC T CTGCTG GT<br>GGTG A GACGAC AT<br>TT TCAC C | |
| GAM35 3678 | Human | CAGCAGCA CACTGTGG TTTGTA | CACCACGT AGTGCTTC TG | pil T | NC_002947 from 5816934 to 5817944 (-) | Pseudomonas putida KT2440 | 3 -- -- TA T A<br>CA CCACG GTGCT CTG<br>GT GGTGT CACGA GAC<br>AT TT CA C | |
| GAM35 3678 | Human | CAGCAGCA CACTGTGG TTTGTA | CACCAGCG CCTGCGCT G | oxy R | NC_003197 from 4343080 to 4343997 (+) | Salmonella typhimurium LT2 | 3 -- -- GC CC - CAA<br>CCA G TGC GCTG GT<br>GGT C ACG CGAC AT<br>TT GT AC A | |
| GAM35 3678 | Human | CAGCAGCA CACTGTGG TTTGTA | CACCAGCG CCTGCGCT G | oxy R | NC_003198 from 3607204 to 3608121 (-) | Salmonella enterica enterica serovar Typhi | 3 -- -- GC CC - CAA<br>CCA G TGC GCTG GT<br>GGT C ACG CGAC AT<br>TT GT AC A | |
| GAM35 3678 | Human | CAGCAGCA CACTGTGG TTTGTA | CACCAGCG CCTGCGCT G | oxy R | NC_004631 from 3592864 to 3593781 (-) | Salmonella enterica serovar Typhi Ty2 | 3 -- -- GC CC - CAA<br>CCA G TGC GCTG GT<br>GGT C ACG CGAC AT<br>TT GT AC A | |
| GAM35 3678 | Human | CAGCAGCA CACTGTGG TTTGTA | CACCATGC TGCTG | MGA T5 | NM_002410 | Human | 3 -- -- ----- CA A<br>CCA TGCTGCTG GT<br>GGT ACGACGAC AT<br>TT GTCAC | |
| GAM35 3678 | Human | CAGCAGCA CACTGTGG TTTGTA | CACCATTG CTGCCG | ipa H_5 | NC_004741 from 2023205 to 2024848 (+) | Shingella flexneri 2a str. 2457T | 3 -- -- ---- C A<br>CA CCAT TGCTGC G<br>GT GGTG ACGACG C<br>AT TT TCAC A | |
| GAM35 3678 | Human | CAGCAGCA CACTGTGG TTTGTA | CACCATTG CTGCCG | ipa H9.8 | NC_004337 from 1422064 to 1423779 (-) | Shingella flexneri 2a str. 301 | 3 -- -- ---- C A<br>CA CCAT TGCTGC G<br>GT GGTG ACGACG C<br>AT TT TCAC A | |
| GAM35 3678 | Human | CAGCAGCA CACTGTGG TTTGTA | CACCATTG CTGCCG | sit D | NC_004337 from 1405360 to 1406217 (-) | Shingella flexneri 2a str. 301 | 3 -- -- ---- C A<br>CA CCAT TGCTGC G<br>GT GGTG ACGACG C<br>AT TT TCAC A | |
| GAM35 3678 | Human | CAGCAGCA CACTGTGG TTTGTA | CACCATTG CTGCCG | sit D | NC_004741 from 1904666 to 1905523 (+) | Shingella flexneri 2a str. 2457T | 3 -- -- ---- C A<br>CA CCAT TGCTGC G<br>GT GGTG ACGACG C<br>AT TT TCAC A | |
| GAM35 3678 | Human | CAGCAGCA CACTGTGG TTTGTA | CACCATTT CTGCCGCT G | dna E | NC_002677 from 1423014 to 1426547 (+) | Mycobacterium leprae | 3 -- -- TTC- C CA A<br>CCAT TGC GCTG GT<br>GGTG ACG CGAC AT<br>TT TCAC A | |
| GAM35 3678 | Human | CAGCAGCA CACTGTGG TTTGTA | CACCATTT CTGCCGCT G | pcn A | NC_002677 from 3248268 to 3249728 (-) | Mycobacterium leprae | 3 -- -- TTC- C CA A<br>CCAT TGC GCTG GT<br>GGTG ACG CGAC AT<br>TT TCAC A | |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET;LOWER:GAM) | GAM POS |
|---|---|---|---|---|---|---|---|---|
| GAM35 3678 | Human | CAGCAGCA CACTGTGG TTTGTA | CACCATTT CTGCCGCT G | pol A | NC_002677 from 1648220 1650955 (-) | Mycobacterium leprae | 3 -- -- TTC- C CA A<br>  CCAT  TGC GCTG  GT<br>  GGTG  ACG CGAC AT<br>  TT   TCAC  A | |
| GAM35 3678 | Human | CAGCAGCA CACTGTGG TTTGTA | CACCATTT CTGCCGCT G | tru A | NC_002677 from 2343329 2344078 (-) | Mycobacterium leprae | 3 -- -- TTC- C CA A<br>  CCAT  TGC GCTG  GT<br>  GGTG  ACG CGAC AT<br>  TT   TCAC  A | |
| GAM35 3678 | Human | CAGCAGCA CACTGTGG TTTGTA | CACCCAGC GTTTGCTG CTT | dad X | NC_004431 from 1476306 1477376 (+) | Escherichia coli CFT073 | 3 -- C- GC T  T A<br>  CA CCA GT TGCTGCT<br>  GT GGT CA ACGACGA<br>  AT TT  GT C   C | |
| GAM35 3678 | Human | CAGCAGCA CACTGTGG TTTGTA | CACCCAGG TGTCGCTG CTG | nic T | NC_000962 from 3166681 3167799 (+) | Mycobacterium tuberculosis H37Rv | 3 -- C- G TGTC CA A<br>  CCA G  GCTGCTG  GT<br>  GGT T  CGACGAC AT<br>  TT  G CACA | |
| GAM35 3678 | Human | CAGCAGCA CACTGTGG TTTGTA | CACCCAGG TGTCGCTG CTG | nic T | NC_002945 from 3123200 3124318 (+) | Mycobacterium bovis subs p bovis AF21 22/97 | 3 -- C- G TGTC CA A<br>  CCA G  GCTGCTG  GT<br>  GGT T  CGACGAC AT<br>  TT  G CACA | |
| GAM35 3678 | Human | CAGCAGCA CACTGTGG TTTGTA | CACCTTTC TGCTGCTC | ris A | NC_002929 from 3765257 3765991 (-) | Bordetella pertussis | 3 -- -- T TC-- C A<br>  CA  CC T  TGCTGCT<br>  GT  GG G  ACGACGA<br>  AT  TT  T TCAC   C | |
| GAM35 3678 | Human | CAGCAGCA CACTGTGG TTTGTA | CACGCCAT ATGTGTTT GTGCTG | ipa H_5 | NC_004741 from 2023205 2024848 (+) | Shingella flexneri 2a str. 2457T | 3 -- C  TGTGTT - A<br>  CA GCCATA   TG<br>  TGCTG  GT TGGTGT<br>  AC ACGAC AT  T<br>  CAC--- G | |
| GAM35 3678 | Human | CAGCAGCA CACTGTGG TTTGTA | CACGCCAT ATGTGTTT GTGCTG | ipa H9.8 | NC_004337 from 1422064 1423779 (-) | Shingella flexneri 2a str. 301 | 3 -- C  TGTGTT - A<br>  CA GCCATA   TG<br>  TGCTG  GT TGGTGT<br>  AC ACGAC AT  T<br>  CAC--- G | |
| GAM35 3678 | Human | CAGCAGCA CACTGTGG TTTGTA | CACGCCAT ATGTGTTT GTGCTG | sit D | NC_004337 from 1405360 1406217 (-) | Shingella flexneri 2a str. 301 | 3 -- C  TGTGTT - A<br>  CA GCCATA   TG<br>  TGCTG  GT TGGTGT<br>  AC ACGAC AT  T<br>  CAC--- G | |
| GAM35 3678 | Human | CAGCAGCA CACTGTGG TTTGTA | CACGCCAT ATGTGTTT GTGCTG | sit D | NC_004741 from 1904666 1905523 (+) | Shingella flexneri 2a str. 2457T | 3 -- C  TGTGTT - A<br>  CA GCCATA   TG<br>  TGCTG  GT TGGTGT<br>  AC ACGAC AT  T<br>  CAC--- G | |
| GAM35 3678 | Human | CAGCAGCA CACTGTGG TTTGTA | CACGCCAT ATGTGTTT CTGCTG | rbs R | NC_004337 from 3947708 3948700 (+) | Shingella flexneri 2a str. 301 | 3 --  A  T TACC  A<br>  CAGA CAC GT<br>    GCTGCTG  GTTT GTG<br>  CA  CGACGAC AT   G<br>  T  C--A | |
| GAM35 3678 | Human | CAGCAGCA CACTGTGG TTTGTA | CACGCCAT ATGTGTTT CTGCTG | rbs R | NC_004431 from 4439260 4440252 (+) | Escherichia coli CFT073 | 3 --  A  T TACC  A<br>  CAGA CAC GT<br>    GCTGCTG  GTTT GTG<br>  CA  CGACGAC AT   G<br>  T  C--A | |
| GAM35 3678 | Human | CAGCAGCA CACTGTGG TTTGTA | CACGCCAT ATGTGTTT CTGCTG | rbs R | NC_004741 from 3824594 3825577 (-) | Shingella flexneri 2a str. 2457T | 3 --  A  T TACC  A<br>  CAGA CAC GT<br>    GCTGCTG  GTTT GTG<br>  CA  CGACGAC AT   G<br>  T  C--A | |
| GAM35 3678 | Human | CAGCAGCA CACTGTGG TTTGTA | CAGAAGCA TGAACATT GCTGCTG | rbs R | NC_004337 from 3947708 3948700 (+) | Shingella flexneri 2a str. 301 | 3 --  G G  AACAT  CA A<br>  AA CATG   TGCTGCTG<br>  GT TT  GTGT<br>  ACGACGAC AT - G<br>  CAC-- | |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET; LOWER:GAM) | GAM POS |
|---|---|---|---|---|---|---|---|---|
| GAM35 3678 | Human | CAGCAGCA CACTGTGG TTTGTA | CAGAAGCA TGAACATT GCTGCTG | rbs R | NC_004741 from 3824594 to 3825577 (-) | Shingella flexneri 2a str. 2457T | 3 -- G G AACAT CA A<br>AA CATG TGCTGCTG<br>GT TT GTGT<br>ACGACGAC AT - G<br>CAC-- | |
| GAM35 3678 | Human | CAGCAGCA CACTGTGG TTTGTA | CAGACGAT CTCCTGCT G | fep C | NC_002516 from 4653508 to 4654305 (-) | Pseudomonas aeruginosa PA01 | 3 -- G C--- C A<br>CAGAC AT T CTGCTG<br>GTTTG TG A GACGAC<br>AT G TCAC C | |
| GAM35 3678 | Human | CAGCAGCA CACTGTGG TTTGTA | CAGACTCA GCTGCTGC TC | pil T | NC_002947 from 5816934 to 5817944 (-) | Pseudomonas putida KT2440 | 3 -- T GC--- CA<br>CAGAC CA TGCTGCT<br>GTTTG GT ACGACGA<br>AT - GTCAC C | |
| GAM35 3678 | Human | CAGCAGCA CACTGTGG TTTGTA | CAGCAGGC TTTGCTGC TG | cII | NC_003198 from 4537312 to 4537533 (+) | Salmonella enterica enterica serovar Typhi | 3 -- - G C T CAG C A<br>A G T TGCTGCTG GTT G<br>T T A ACGACGAC AT T G<br>G C C | |
| GAM35 3678 | Human | CAGCAGCA CACTGTGG TTTGTA | CAGCAGGC TTTGCTGC TG | cII | NC_004631 from 4520121 to 4520342 (+) | Salmonella enterica enterica serovar Typhi Ty2 | 3 -- - G C T CAG C A<br>A G T TGCTGCTG GTT G<br>T T A ACGACGAC AT T G<br>G C C | |
| GAM35 3678 | Human | CAGCAGCA CACTGTGG TTTGTA | CAGCCACA GCTGCTG | gad | NC_002947 from 4871625 to 4872929 (+) | Pseudomonas putida KT2440 | 3 -- - ----A CAG A<br>GGTG CGACGAC AT T<br>TCACA | |
| GAM35 3678 | Human | CAGCAGCA CACTGTGG TTTGTA | CAGCCAGG TTTTGCTC TG | phn V | NC_003198 from 471575 to 472366 (-) | Salmonella enterica serovar Typhi | 3 -- - G T T - A<br>CAG CCA G T TGCT CTG<br>GTT GGT T A ACGA GAC<br>AT T G CC C | |
| GAM35 3678 | Human | CAGCAGCA CACTGTGG TTTGTA | CAGCCAGG TTTTGCTC TG | phn V | NC_004631 from 2508735 to 2509526 (+) | Salmonella enterica serovar Typhi Ty2 | 3 -- - G T T - A<br>CAG CCA G T TGCT CTG<br>GTT GGT T A ACGA GAC<br>AT T G CC C | |
| GAM35 3678 | Human | CAGCAGCA CACTGTGG TTTGTA | CAGCGAGG CCTCGTGC TGCTG | tcf A | NC_002929 from 1264436 to 1266379 (+) | Bordetella pertussis | 3 -- - G G CCTCG CAG A<br>C A G TGCTGCTG<br>GTT G T T<br>ACGACGAC AT T G G<br>CAC-- | |
| GAM35 3678 | Human | CAGCAGCA CACTGTGG TTTGTA | CAGCGCTT GGTGATGC TGCTG | uhp A | NC_003143 from 4522790 to 4523380 (-) | Yersinia pestis | 3 -- CG T A CAG A<br>C TGGTG TGCTGCTG GTT<br>G GTCAC ACGACGAC AT<br>TG T - | |
| GAM35 3678 | Human | CAGCAGCA CACTGTGG TTTGTA | CAGCGCTT GGTGATGC TGCTG | cys Q | NC_002947 from 315184 to 315984 (+) | Pseudomonas putida KT2440 | 3 -- G G CAGGC CA A<br>GGTGTGCTGCTG GTTTG GT<br>TCACACGACGAC AT -<br>G | |
| GAM35 3678 | Human | CAGCAGCA CACTGTGG TTTGTA | CATACCTC CCGCACTG CTGCCG | pbp G | NC_002947 from 4323707 to 4324633 (+) | Pseudomonas putida KT2440 | 3 -- T T CCGCAC CA<br>CA ACC C TGCTGC<br>G GT TGG G<br>ACGACG C AT T T<br>TCAC-- A | |
| GAM35 3678 | Human | CAGCAGCA CACTGTGG TTTGTA | CATATCTG CTGCTG | ung | NC_000907 from 18676 to 19335 (+) | Haemophilus influenzae R d | 3 -- T ------ CA ATCA<br>TGCTGCTG GT TGG<br>ACGACGAC AT T<br>TGTCAC | |
| GAM35 3678 | Human | CAGCAGCA CACTGTGG TTTGTA | CATCCACA CGCTGCTG | ssb | NC_002947 from 571027 to 571572 (+) | Pseudomonas putida KT2440 | 3 -- T- ---C CA A<br>CCACA GCTGCTG GT<br>GGTGT CGACGAC AT<br>TT CACA | |
| GAM35 3678 | Human | CAGCAGCA CACTGTGG TTTGTA | CATCCATA TCGCCATT | rbs R | NC_004431 from 4439260 to | Escherichia coli CFT073 | 3 -- T- TC CCAT A<br>G CA CCATA G | |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET;LOWER:GAM) | GAM POS |
|---|---|---|---|---|---|---|---|---|
| | | | TTTGTA | GCTGGTG | 4440252 (+) | | TGCTG TG GT GGTGT<br>ACGAC AC AT TT<br>CA ---- G | |
| GAM35 3678 | Human | CAGCAGCA CACTGTGG TTTGTA | CATCGCGG GCGCGCTG CTGCTC | glp C | NC_003143 from 4289650 to 4290897 (-) | Yersinia pestis | 3 -- TCG G CGCGC A<br>C CA CG G<br>TGCTGCT GT GT T<br>ACGACGA AT TTG G<br>CAC-- C | |
| GAM35 3678 | Human | CAGCAGCA CACTGTGG TTTGTA | CATCGCGG GCGCGCTG CTGCTC | glp C | NC_004088 from 454677 to 456047 (+) | Yersinia pestis KIM | 3 -- TCG G CGCGC A<br>C CA CG G<br>TGCTGCT GT GT T<br>ACGACGA AT TTG G<br>CAC-- C | |
| GAM35 3678 | Human | CAGCAGCA CACTGTGG TTTGTA | CATCGCGG TGGTGGAT GCTGCTT | dna E | NC_002677 from 1423014 to 1426547 (-) | Yersinia pestis | 3 -- T GT GTGGA A<br>T CA GTCG G<br>TGCTGCT GT TGGT<br>C ACGACGA AT T<br>GT AC--- C | |
| GAM35 3678 | Human | CAGCAGCA CACTGTGG TTTGTA | CATCGCGG TGGTGGAT GCTGCTT | pcn A | NC_002677 from 3248268 to 3249728 (-) | Mycobacterium leprae | 3 -- T GT GTGGA A<br>T CA GTCG G<br>TGCTGCT GT TGGT<br>C ACGACGA AT T<br>GT AC--- C | |
| GAM35 3678 | Human | CAGCAGCA CACTGTGG TTTGTA | CATCGCGG TGGTGGAT GCTGCTT | pol A | NC_002677 from 1648220 to 1650955 (-) | Mycobacterium leprae | 3 -- T GT GTGGA A<br>T CA GTCG G<br>TGCTGCT GT TGGT<br>C ACGACGA AT T<br>GT AC--- C | |
| GAM35 3678 | Human | CAGCAGCA CACTGTGG TTTGTA | CATCGCGG TGGTGGAT GCTGCTT | tru A | NC_002677 from 2343329 to 2344078 (-) | Mycobacterium leprae | 3 -- T GT GTGGA A<br>T CA GTCG G<br>TGCTGCT GT TGGT<br>C ACGACGA AT T<br>GT AC--- C | |
| GAM35 3678 | Human | CAGCAGCA CACTGTGG TTTGTA | CCCGTGCT GCTT | omp G | NC_004431 from 1624577 to 1625533 (+) | Escherichia coli CFT073 | 3 --- ----- T A<br>C CCG TGCTGCT<br>G GGT ACGACGA<br>AT TTT GTCAC C | |
| GAM35 3678 | Human | CAGCAGCA CACTGTGG TTTGTA | CCCTCGGT GCTGCTG | flh B | NC_002929 from 1441767 to 1442921 (+) | Bordetella pertussis | 3 --- T -- C CCA<br>CGG TGCTGCTG G GG<br>GTC ACGACGAC AT TTT T<br>AC | |
| GAM35 3678 | Human | CAGCAGCA CACTGTGG TTTGTA | CGAACCAC CGATGCTG TG | aer-2 | NC_002947 from 2406996 to 2408561 (-) | Pseudomonas putida KT2440 | 3 -- C A- - A<br>CGAACCAC G TGCTG TG<br>GTTTGGTG C ACGAC AC<br>AT T AC G | |
| GAM35 3678 | Human | CAGCAGCA CACTGTGG TTTGTA | CGAACGTG CTGCTG | prc A | NC_002677 from 1576553 to 1577350 (+) | Mycobacterium leprae | 3 -- G------ CGAAC A<br>TGCTGCTG GTTTG<br>ACGACGAC AT<br>GTGTCAC | |
| GAM35 3678 | Human | CAGCAGCA CACTGTGG TTTGTA | CGACCACC GCGTGGTG CTG | van B | NC_002516 from 5504120 to 5505073 (+) | Pseudomonas aeruginosa PA01 | 3 -- - C C G CGAA<br>CCAC G GTG TGCTG GTT<br>GGTG C CAC ACGAC AT T<br>T A G | |
| GAM35 3678 | Human | CAGCAGCA CACTGTGG TTTGTA | CGACTGCT GCTG | pch A | NC_002516 from 4745120 to 4746550 (+) | Pseudomonas aeruginosa PA01 | 3 -- - ------- CGA C A<br>TGCTGCTG GTT G<br>ACGACGAC AT T<br>GTGTCAC | |
| GAM35 3678 | Human | CAGCAGCA CACTGTGG TTTGTA | CGAGCGAT GCTGCTT | dsd A | NC_003197 from 4004453 to 4005775 (+) | Salmonella typhimurium LT2 | 3 -- G ----- T A<br>CGAGC A TGCTGCT<br>GTTTG T ACGACGA<br>AT G GTCAC C | |
| GAM35 3678 | Human | CAGCAGCA CACTGTGG TTTGTA | CGAGGGAT GTAGTGCT | nic T | NC_000962 from 3166681 to | Mycobacterium tuberculosis | 3 -- GG TA C A<br>CGAG ATG GTGCTGCT | |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET; LOWER:GAM) | GAM POS |
|---|---|---|---|---|---|---|---|---|
| | | TTTGTA | GCTC | | 3167799 (+) | H37Rv | `     GTTT   TGT  CACGACGA`<br>`   AT       GG   CA         C` | |
| GAM35 3678 | Human | CAGCAGCA CACTGTGG TTTGTA | CGAGGGAT GTAGTGCT GCTC | nic T | NC_002945 from 3123200 to 3124318 (+) | Mycobacterium bovis subs p bovis AF21 22/97 | `3 --   GG  TA     C  A`<br>`  CGAG  ATG  GTGCTGCT`<br>`  GTTT  TGT  CACGACGA`<br>`  AT       GG   CA        C` | |
| GAM35 3678 | Human | CAGCAGCA CACTGTGG TTTGTA | CGCCAGAT TGCTGCTG | yab O | NC_004431 from 61489 to 62148 (-) | Escherichia coli CFT073 | `3 --   --    G T--    CG      A`<br>`  CCA A    TGCTGCTG   GT`<br>`  GGT  T   ACGACGAC   AT`<br>`  TT    G CAC` | |
| GAM35 3678 | Human | CAGCAGCA CACTGTGG TTTGTA | CGCCGGTT GCTGCTG | pch A | NC_002516 from 4745120 to 4746550 (+) | Pseudomonas aeruginosa PA01 | `3 --   --   GT---   CG     A`<br>`  CCG        TGCTGCTG   GT`<br>`  GGT        ACGACGAC   AT`<br>`  TT     GTCAC` | |
| GAM35 3678 | Human | CAGCAGCA CACTGTGG TTTGTA | CGCCGGTT GCTGCTT | fep C | NC_002516 from 4653508 to 4654305 (-) | Pseudomonas aeruginosa PA01 | `3 --   --   GT---         T A`<br>`  CG    CCG       TGCTGCT`<br>`  GT    GGT       ACGACGA`<br>`  AT    TT    GTCAC          C` | |
| GAM35 3678 | Human | CAGCAGCA CACTGTGG TTTGTA | CGCTGCTG CTG | liv H | NC_002929 from 1144729 to 1145607 (+) | Bordetella pertussis | `3 --   --   -------   CG   C A`<br>`              TGCTGCTG   GT  G`<br>`              ACGACGAC   AT  TT`<br>`  GTGTCAC` | |
| GAM35 3678 | Human | CAGCAGCA CACTGTGG TTTGTA | CGGAATTT GCTGCTG | yci E | NC_004431 from 1558641 to 1559147 (-) | Escherichia coli CFT073 | `3 --    --  T---   CGGA      A`<br>`  AT         TGCTGCTG   GTTT`<br>`  TG         ACGACGAC   AT`<br>`      GG   TCAC` | |
| GAM35 3678 | Human | CAGCAGCA CACTGTGG TTTGTA | CGTCCACG CGGGTGGT GCTGCTC | flh B | NC_002929 from 1441767 to 1442921 (+) | Bordetella pertussis | `3 --   T-         CG  GTGG     A`<br>`       C    CG   CCACG  G`<br>`           TGCTGCT   GT  GGTGT`<br>`  C      ACGACGA   AT   TT`<br>`      CA  ----            C` | |
| GAM35 3678 | Human | CAGCAGCA CACTGTGG TTTGTA | CGTCCATC TTGCTGCT C | pbp G | NC_002947 from 4323707 to 4324633 (+) | Pseudomonas putida KT2440 | `3 --   T-   CT--         C A`<br>`  CG    CCAT       TGCTGCT`<br>`  GT    GGTG       ACGACGA`<br>`  AT    TT    TCAC            C` | |
| GAM35 3678 | Human | CAGCAGCA CACTGTGG TTTGTA | CGTCCTGC TGCTG | aco R | NC_002516 from 4639501 to 4641378 (-) | Pseudomonas aeruginosa PA01 | `3 --   T-   ------    CG  CCA`<br>`              TGCTGCTG   GT  GG`<br>`              ACGACGAC   AT  TT`<br>`  TGTCAC` | |
| GAM35 3678 | Human | CAGCAGCA CACTGTGG TTTGTA | CGTGCCTG CTGCTC | ace K | NC_002947 from 5184742 to 5186457 (-) | Pseudomonas putida KT2440 | `3 --   T    ------         C A`<br>`  CG    GCC       TGCTGCT`<br>`  GT    TGG       ACGACGA`<br>`  AT    T    TGTCAC           C` | |
| GAM35 3678 | Human | CAGCAGCA CACTGTGG TTTGTA | CTAAAGTG CTGCTG | rec G | NC_002677 from 2014723 to 2016954 (-) | Mycobacterium leprae | `3 --   T  --  G----     C AA  A`<br>`  A           TGCTGCTG   G TT`<br>`  T           ACGACGAC   AT T`<br>`  GG  GTCAC` | |
| GAM35 3678 | Human | CAGCAGCA CACTGTGG TTTGTA | CTAACACG CGCTGCTC TG | ung | NC_000907 from 18676 to 19335 (+) | Haemophilus influenzae R d | `3 --   T   -   CGC     -     CA`<br>`  AAC  ACG       TGCT  CTG    G`<br>`  TTG  TGT       ACGA  GAC    AT  T`<br>`     G  CAC             C` | |
| GAM35 3678 | Human | CAGCAGCA CACTGTGG TTTGTA | CAGCAGCA CACTGTGG TTTGTA | cII G | NC_003198 from 4537312 to 4537533 (+) | Salmonella enterica enterica serovar Typhi | `3 --    T    TGTA-- -    C    A`<br>`  AACC       T       CTGCTG    G`<br>`  TTGG       A       GACGAC    AT T`<br>`  TGTCAC  C` | |
| GAM35 3678 | Human | CAGCAGCA CACTGTGG TTTGTA | CAGCAGCA TATCTGCT G | cII G | NC_004631 from 4520121 to 4520342 (+) | Salmonella enterica enterica serovar Typhi Ty2 | `3 --    T    TGTA-- -    C    A`<br>`  AACC       T       CTGCTG    G`<br>`  TTGG       A       GACGAC    AT T`<br>`  TGTCAC  C` | |
| GAM35 3678 | Human | CAGCAGCA CACTGTGG TTTGTA | CTACCTGC CTGCTGCT | uhp A | NC_003143 from 4522790 to | Yersinia pestis | `3 --    T  -  TGCC--        C A CCA`<br>`              TGCTGCTG        G T GG` | |

TABLE 7-continued

| GAM NAME | GAM ORGANISM | GAM RNA SEQUENCE | TARGET BS-SEQ | TARGET | TARG REF-ID | TARGET ORGANISM | BINDING SITE DRAW (UPPER:TARGET;LOWER:GAM) | GAM POS |
|---|---|---|---|---|---|---|---|---|
| | | | TTTGTA | G | 4523380 (−) | | ACGACGAC AT T T<br>TGTCAC | |
| GAM35 3678 | Human | CAGCAGCA CACTGTGG TTTGTA | CTAGCCCT GCTGCTC | aco R | NC_002516 from 4639501 to 4641378 (−) | Pseudomonas aeruginosa PA01 | 3 -- T  C----- C A<br>  C AGCC     TGCTGCT<br>  G TTGG     ACGACGA<br>  AT T   TGTCAC    C | |
| GAM35 3678 | Human | CAGCAGCA CACTGTGG TTTGTA | CTCCTGCT GCTG | ssb | NC_002947 from 571027 to 571572 (+) | Pseudomonas putida KT2440 | 3 -- T--  ------  C  CCA<br>       TGCTGCTG   G   GG<br>       ACGACGAC AT TTT<br>       TGTCAC | |
| GAM35 3678 | Human | CAGCAGCA CACTGTGG TTTGTA | CTCGGGTT TCTTGCTG CTG | fha L | NC_002929 from 3085865 to 3098455 (+) | Bordetella pertussis | 3 -- T-- G GTT CT  C   CA<br>  G   T   TGCTGCTG  G   G<br>  T   A   ACGACGAC AT TTT<br>  G GTC C- | |
| GAM35 3678 | Human | CAGCAGCA CACTGTGG TTTGTA | CTGACCTT GCTGCTC | pta | NC_002947 from 891625 to 893712 (−) | Pseudomonas putida KT2440 | 3 -- T   T-----  C A<br>  C GACC     TGCTGCT<br>  G TTGG     ACGACGA<br>  AT T   TGTCAC    C | |
| GAM35 3678 | Human | CAGCAGCA CACTGTGG TTTGTA | CTGCCTGC TGCTC | orn | NC_003143 from 378331 to 378876 (+) | Yersinia pestis | 3 -- T -  ------  C A<br>  C G CC     TGCTGCT<br>  G T  GG     ACGACGA<br>  AT T T  TGTCAC    C | |
| GAM35 3678 | Human | CAGCAGCA CACTGTGG TTTGTA | CTGCGTGC TGCTT | glp D | NC_004310 from 210763 to 212274 (+) | Brucella suis 1330 | 3 -- T - G------  T A<br>  C G C      TGCTGCT<br>  G T G      ACGACGA<br>  AT T T  GTGTCAC    C | |
| GAM35 3678 | Human | CAGCAGCA CACTGTGG TTTGTA | CTTACTTG CTGCTC | sse B | NC_004431 from 2922456 to 2923241 (−) | Escherichia coli CFT073 | 3 -- TT  ------  C A<br>  C ACT     TGCTGCT<br>  G TGG     ACGACGA<br>  AT TT  TGTCAC    C | |
| GAM35 3678 | Human | CAGCAGCA CACTGTGG TTTGTA | CTTCCTGC TGCTT | def | NC_000922 from 1221735 to 1222295 (+) | Chlamydophila pneumoniae CWL029 | 3 -- TT-  ------  T A<br>  C  CC     TGCTGCT<br>  G  GG     ACGACGA<br>  AT TTT  TGTCAC    C | |
| GAM35 3678 | Human | CAGCAGCA CACTGTGG TTTGTA | CTTCCTGC TGCTT | def | NC_002491 from 1218069 to 1218629 (+) | Chlamydophila pneumoniae J138 | 3 -- TT-  ------  T A<br>  C  CC     TGCTGCT<br>  G  GG     ACGACGA<br>  AT TTT  TGTCAC    C | |

It is appreciated that the specific functions and accordingly the utilities of each of a plurality of GAM oligonucleotides that are described by FIG. 1 are correlated with and may be deduced from the identity of the GAM TARGET GENES inhibited thereby, and whose functions are set forth in Table 8, hereby incorporated herein. Table 8, lines 685695-687709 shows data relating to the function and utilities of GAM RNA as set forth in SEQ ID NO: 348.

TABLE 8

| GAM NAME | GAM RNA SEQUENCE | GAM ORGANISM | TARGET | TARGET ORGANISM | GAM GAM FUNCTION | POS |
|---|---|---|---|---|---|---|
| GAM35 3678 | CAGCAGCA CACTGTGG TTTGTA | Human | ac cC | Bordetella pertussis | GAM353678 is a human miRNA-like oligonucleotide, which targets biotin carboxylase (accC, NC_002929 from 926407 to 927777 (+)), a bacterial target gene encoded by the Bordetella pertussis genome, as part of an anti-bacterial host defense mechanism. accC BINDING SITE 1 and accC BINDING SITE 2 are bacterial target binding sites that are found in the untranslated regions of mRNA encoded by the accC gene, corresponding to target binding sites such as BINDING SITE I, BINDING SITE II or BINDING SITE III of FIG. 1. The nucleotide sequences of accC BINDING SITE 1 and accC BINDING SITE 2, | A |

TABLE 8-continued

| GAM NAME | GAM RNA SEQUENCE | GAM ORGA-NISM | TAR-GET | TARGET ORGANISM | GAM GAM FUNCTION | POS |
|---|---|---|---|---|---|---|
| | | | | | and the complementary secondary structure to the nucleotide sequence of GAM353678 RNA are set forth in Tables 6-7, hereby incorporated herein. A function of GAM353678 is to inhibit accC, a GAM353678 bacterial target gene which is associated with *Bordetella pertussis* infection, as part of an anti-bacterial host defense mechanism. Accordingly, the utilities of GAM353678 include the diagnosis, prevention and treatment of *Bordetella pertussis* infection and associated clinical conditions | |
| GAM353678 | CAGCAGCACACTGTGGTTTGTA | Human | aceK | *Pseudomonas putida* KT2440 | GAM353678 is a human miRNA-like oligonucleotide, which targets isocitrate dehydrogenase kinase/phosphatase (aceK, NC_002947 from 5184742 to 5186457 (−)), a bacterial target gene encoded by the *Pseudomonas putida* KT2440 genome, as part of an anti-bacterial host defense mechanism. aceK BINDING SITE 1 and aceK BINDING SITE 2 are bacterial target binding sites that are found in the untranslated regions of mRNA encoded by the aceK gene, corresponding to target binding sites such as BINDING SITE I, BINDING SITE II or BINDING SITE III of FIG. 1. The nucleotide sequences of aceK BINDING SITE 1 and aceK BINDING SITE 2, and the complementary secondary structure to the nucleotide sequence of GAM353678 RNA are set forth in Tables 6-7, hereby incorporated herein. Another function of GAM353678 is to inhibit aceK, a GAM353678 bacterial target gene which is associated with *Pseudomonas putida* KT2440 infection, as part of an anti-bacterial host defense mechanism. Accordingly, the utilities of GAM353678 include the diagnosis, prevention and treatment of *Pseudomonas putida* KT2440 infection and associated clinical conditions | A |
| GAM353678 | CAGCAGCACACTGTGGTTTGTA | Human | acoR | *Pseudomonas aeruginosa* PA01 | GAM353678 is a human miRNA-like oligonucleotide, which targets transcriptional regulator AcoR (acoR, NC_002516 from 4639501 to 4641378 (−)), a bacterial target gene encoded by the *Pseudomonas aeruginosa* PA01 genome, as part of an anti-bacterial host defense mechanism. acoR BINDING SITE 1 and acoR BINDING SITE 2 are bacterial target binding sites that are found in the untranslated regions of mRNA encoded by the acoR gene, corresponding to target binding sites such as BINDING SITE I, BINDING SITE II or BINDING SITE III of FIG. 1. The nucleotide sequences of acoR BINDING SITE 1 and acoR BINDING SITE 2, and the complementary secondary structure to the nucleotide sequence of GAM353678 RNA are set forth in Tables 6-7, hereby incorporated herein. Another function of GAM353678 is to inhibit acoR, a GAM353678 bacterial target gene which is associated with *Pseudomonas aeruginosa* PA01 infection, as part of an anti-bacterial host defense mechanism. Accordingly, the utilities of GAM353678 include the diagnosis, prevention and treatment of *Pseudomonas aeruginosa* PA01 infection and associated clinical conditions | A |
| GAM353678 | CAGCAGCACACTGTGGTTTGTA | Human | aer-2 | *Pseudomonas putida* KT2440 | GAM353678 is a human miRNA-like oligonucleotide, which targets aerotaxis receptor Aer-2 (aer-2, NC_002947 from 2406996 to 2408561 (−)), a bacterial target gene encoded by the *Pseudomonas* | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | *putida* KT2440 genome, as part of an anti-bacterial host defense mechanism. aer-2 BINDING SITE 1 and aer-2 BINDING SITE 2 are bacterial target binding sites that are found in the untranslated regions of mRNA encoded by the aer-2 gene, corresponding to target binding sites such as BINDING SITE I, BINDING SITE II or BINDING SITE III of FIG. 1. The nucleotide sequences of aer-2 BINDING SITE 1 and aer-2 BINDING SITE 2, and the complementary secondary structure to the nucleotide sequence of GAM353678 RNA are set forth in Tables 6-7, hereby incorporated herein. Another function of GAM353678 is to inhibit aer-2, a GAM353678 bacterial target gene which is associated with *Pseudomonas putida* KT2440 infection, as part of an anti-bacterial host defense mechanism. Accordingly, the utilities of GAM353678 include the diagnosis, prevention and treatment of *Pseudomonas putida* KT2440 infection and associated clinical conditions | |
| GAM35 3678 | CAGCAGCA CACTGTGG TTTGTA | Human | amtB | *Shigella flexneri* 2a str. 3 01 | GAM353678 is a human miRNA-like oligonucleotide, which targets probable ammonium transporter (amtB, NC_004337 from 408059 to 409345 (+)), a bacterial target gene encoded by the *Shigella flexneri* 2a str. 301 genome, as part of an anti-bacteria 1 host defense mechanism. amtB BINDING SITE 1 and amtB BINDING SITE 2 are bacterial target binding sites that are found in the untranslated regions of mRNA encoded by the amtB gene, corresponding to target binding sites such as BINDING SITE I, BINDING SITE II or BINDING SITE III of FIG. 1. The nucleotide sequences of amtB BINDING SITE 1 and amtB BINDING SITE 2, and the complementary secondary structure to the nucleotide sequence of GAM353678 RNA are set forth in Tables 6-7, hereby incorporated herein. Another function of GAM353678 is to inhibit amtB, a GAM353678 bacterial target gene which is associated with *Shigella flexneri* 2a str. 301 infection, as part of an anti-bacterial host defense mechanism. Accordingly, the utilities of GAM353678 include the diagnosis, prevention and treatment of *Shigella flexneri* 2a str. 301 infection and associated clinical conditions | A |
| GAM35 3678 | CAGCAGCA CACTGTGG TTTGTA | Human | amtB | *Escherichia coli* C FT073 | GAM353678 is a human miRNA-like oligonucleotide, which targets Probable ammonium transporter (amtB, NC_004431 from 547616 to 548902 (+)), a bacterial target gene encoded by the *Escherichia coli* CFT073 genome, as part of an anti-bacterial host defense mechanism. amtB BINDING SITE 1 and amtB BINDING SITE 2 are bacterial target binding sites that are found in the untranslated regions of mRNA encoded by the amtB gene, corresponding to target binding sites such as BINDING SITE I, BINDING SITE II or BINDING SITE III of FIG. 1. The nucleotide sequences of amtB BINDING SITE 1 and amtB BINDING SITE 2, and the complementary secondary structure to the nucleotide sequence of GAM353678 RNA are set forth in Tables 6-7, hereby incorporated herein. Another function of GAM353678 is to inhibit amtB, a GAM353678 bacterial target gene which is associated with *Escherichia coli* CFT073 infection, as part of an anti-bacterial host defense | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | mechanism. Accordingly, the utilities of GAM353678 include the diagnosis, prevention and treatment of *Escherichia coli* CFT07 3 infection and associated clinical conditions | |
| GAM35 3678 | CAGCAGCA CACTGTGG TTTGTA | Human | amtB | *Shigella flexneri* 2a str. 2 457T | GAM353678 is a human miRNA-like oligonucleotide, which targets probable ammonium transporter (amtB, NC_004741 from 407860 to 409146 (+)), a bacterial target gene encoded by the *Shigella flexneri* 2a str. 2457T genome, as part of an anti-bacterial host defense mechanism. amtB BINDING SITE 1 and amtB BINDING SITE 2 are bacterial target binding sites that are found in the untranslated regions of mRNA encoded by the amtB gene, corresponding to target binding sites such as BINDING SITE I, BINDING SITE II or BINDING SITE III of FIG. 1. The nucleotide sequences of amtB BINDING SITE 1 and amtB BINDING SITE 2, and the complementary secondary structure to the nucleotide sequence of GAM353678 RNA are set forth in Tables 6-7, hereby incorporated herein. Another function of GAM353678 is to inhibit amtB, a GAM353678 bacterial target gene which is associated with *Shigella flexneri* 2a str. 2457T infection, as part of an anti-bacterial host defense mechanism. Accordingly, the utilities of GAM353678 inc lude the diagnosis, prevention and treatment of *Shigella flexneri* 2a str. 2457T infection and associated clinical conditions | A |
| GAM35 3678 | CAGCAGCA CACTGTGG TTTGTA | Human | aroA | *Neisseria meningitidis* Z49 1 | GAM353678 is a human miRNA-like oligonucleotide, which targets 5- enolpyruvoylshikimate-3-phosphate synthase (aroA, NC_003116 from 1557502 to 1558803 (+)), a bacterial target gene encoded by the *Neisseria meningitidis* Z2491 genome, as part of an anti- bacterial host defense mechanism. aroA BINDING SITE 1 and aroA BINDING SITE 2 are bacterial target binding sites that are found in the untranslated regions of mRNA encoded by the aroA gene, corresponding to target binding sites such as BINDING SITE I, BINDING SITE II or BINDING SITE III of FIG. 1. The nucleotide sequences of aroA BINDING SITE 1 and aroA BINDING SITE 2, and the complementary secondary structure to the nucleotide sequence of GAM353678 RNA are set forth in Tables 6-7, hereby incorporated herein. Another function of GAM353678 is to inhibit aroA, a GAM353678 bacterial target gene which is associated with *Neisseria meningitidis* Z2491 infection, as part of an anti-bacterial host defense mechanism. Accordingly, the utilities of GAM353678 include the diagnosis, prevention and treatment of *Neisseria meningitidis* Z2491 infection and associated clinical conditions | A |
| GAM35 3678 | CAGCAGCA CACTGTGG TTTGTA | Human | aroD | *Leptospira interrogans serovar lai* str. 56601 | GAM353678 is a human miRNA-like oligonucleotide, which targets 3- dehydroquinate dehydratase (aroD, NC_004342 from 48128 to 48832 (−)), a bacterial target gene encoded by the *Leptospira interrogans serovar lai* str. 56601 genome, as part of an anti- bacterial host defense mechanism. aroD BINDING SITE 1 and aroD BINDING SITE 2 are bacterial target binding sites that are found in the untranslated regions of mRNA encoded by the aroD gene, corresponding to target binding sites such as BINDING SITE | A |

TABLE 8-continued

| GAM NAME | GAM RNA SEQUENCE | GAM ORGA-NISM | TAR-GET | TARGET ORGANISM | GAM GAM FUNCTION | POS |
|---|---|---|---|---|---|---|
| | | | | | I, BINDING SITE II or BINDING SITE III of FIG. 1. The nucleotide sequences of aroD BINDING SITE 1 and aroD BINDING SITE 2, and the complementary secondary structure to the nucleotide sequence of GAM353678 RNA are set forth in Tables 6-7, hereby incorporated herein. Another function of GAM353678 is to inhibit aroD, a GAM353678 bacterial target gene which is associated with *Leptospira interrogans serovar lai* str. 56601 infection, as part of an anti-b acterial host defense mechanism. Accordingly, the utilities of GAM353678 include the diagnosis, prevention and treatment of *Leptospira interrogans serovar lai* str. 56601 infection and associated clinical conditions | |
| GAM35 3678 | CAGCAGCA CACTGTGG TTTGTA | Human | aroH | *Shigella flexneri* 2a str. 3 01 | GAM353678 is a human miRNA-like oligonucleotide, which targets 3-deoxy-D-arabinoheptulosonate-7-phosphate synthase (DAHP synthetase, tryptophan repressible) (aroH, NC_004337 from 1557527 to 1558573 (−)), a bacterial target gene encoded by the *Shigella flexneri* 2a str. 301 genome, as part of an anti-bacterial host defense mechanism. aroH BINDING SITE 1 and aroH BINDING SITE 2 are bacterial target binding sites that are found in the untranslated regions of mRNA encoded by the aroH gene, corresponding to target binding sites such as BINDING SITE I, BINDING SITE II or BINDING SITE III of FIG. 1. The nucleotide sequences of aroH BINDING SITE 1 and aroH BINDING SITE 2, and the complementary secondary structure to the nucleotide sequence of GAM353678 RNA are set forth in Tables 6-7, hereby incorporated herein. Another function of GAM353678 is to inhibit aroH, a GAM353678 bacterial target gene which is associated with *Shigella flexneri* 2a str. 301 infection, as part of an anti-bacterial host defense mechanism. Accordingly, the utilities of GAM353678 include the diagnosis, prevention and treatment of *Shigella flexneri* 2a str. 301 infection and associated clinical conditions | A |
| GAM35 3678 | CAGCAGCA CACTGTGG TTTGTA | Human | avtA | *Shigella flexneri* 2a str. 3 01 | GAM353678 is a human miRNA-like oligonucleotide, which targets alanine-alpha-ketoisovalerate (or valine-pyruvate) transaminase, transaminase C (avtA, NC_004337 from 3721175 to 3722533 (+)), a bacterial target gene encoded by the *Shigella flexneri* 2a str. 301 genome, as part of an anti-bacterial host defense mechanism. avtA BINDING SITE is a bacterial target binding site that is a found in the the 3' untranslated region of mRNA encoded by the avtA gene, corresponding to a target binding site such as BINDING SITE I, BINDING SITE II or BINDING SITE III of FIG. 1. The nucleotide sequences of avtA BINDING SITE, and the complementary secondary structure to the nucleotide sequence of GAM353678 RNA are set forth in Tables 6-7, hereby incorporated herein. Another function of GAM353678 is to inhibit avtA, a GAM353678 bacterial target gene which is associated with *Shigella flexneri* 2a str. 301 infection, as part of an anti-bacterial host defense mechanism. Accordingly, the utilities of GAM353678 include the diagnosis, prevention and treatment of *Shigella flexneri* 2a str. 301 infection and associated clinical conditions | A |

TABLE 8-continued

| GAM NAME | GAM RNA SEQUENCE | GAM ORGANISM | TARGET | TARGET ORGANISM | GAM GAM FUNCTION | POS |
|---|---|---|---|---|---|---|
| GAM35 3678 | CAGCAGCA CACTGTGG TTTGTA | Human | avtA | Shigella flexneri 2a str. 2 457T | GAM353678 is a human miRNA-like oligonucleotide, which targets alanine-alpha-ketoisovalerate/valine-pyruvate transaminase C (avtA, NC_004741 from 4052685 to 4053938 (−)), a bacterial target gene encoded by the Shigella flexneri 2a str. 2457T genome, as part of an anti-bacterial host defense mechanism. avtA BINDING SITE is a bacterial target binding site that is a found in the the 3' untranslated region of mRNA encoded by the avtA gene, corresponding to a target binding site such as BINDING SITE I, BINDING SITE II or BINDING SITE III of FIG. 1. The nucleotide sequences of avtA BINDING SITE, and the complementary secondary structure to the nucleotide sequence of GAM353678 RNA are set forth in Tables 6-7, hereby incorporated herein. Another function of GAM353678 is to inhibit avtA, a GAM353678 bacterial target gene which is associated with Shigella flexneri 2a str. 2457T infection, as part of an anti-bacterial host defense mechanism. Accordingly, the utilities of GAM353678 include the diagnosis, prevention and treatment of Shigella flexneri 2a str. 2457T infection and associated clinical conditions | A |
| GAM35 3678 | CAGCAGCA CACTGTGG TTTGTA | Human | cII | Salmonella enterica enterica serovar Typhi Ty2 | GAM353678 is a human miRNA-like oligonucleotide, which targets transcriptional regulatory protein (cII, NC_004631 from 4520121 to 4520342 (+)), a bacterial target gene encoded by the Salmonella enterica enterica serovar Typhi Ty2 genome, as part of an anti-bacterial host defense mechanism. cII BINDING SITE 1 and cII BINDING SITE 2 are bacterial target binding sites that are found in the untranslated regions of m RNA encoded by the cII gene, corresponding to target binding sites such as BINDING SITE I, BINDING SITE II or BINDING SITE III of FIG. 1. The nucleotide sequences of cII BINDING SITE 1 and cII BINDING SITE 2, and the complementary secondary structure to the nucleotide sequence of GAM353678 RNA are set forth in Tables 6-7, hereby incorporated herein. Another function of GAM353678 is to inhibit cII, a GAM353678 bacterial target gene which is associated with Salmonella enterica enterica serovar Typhi Ty2 infection, as part of an anti-bacterial host defense mechanism. Accordingly, the utilities of GAM353678 include the diagnosis, prevention and treatment of Salmonella enterica enterica serovar Typhi Ty2 infection and associated clinical conditions | A |
| GAM35 3678 | CAGCAGCA CACTGTGG TTTGTA | Human | cII | Salmonella enterica enterica serovar Typhi | GAM353678 is a human miRNA-like oligonucleotide, which targets transcriptional regulatory protein (cII, NC_003198 from 4537312 to 4537533 (+)), a bacterial target gene encoded by the Salmonella enterica enterica serovar Typhi genome, as part of an anti-bacterial host defense mechanism. cII BINDING SITE 1 and cII BINDING SITE 2 are bacterial target binding sites that are found in the untranslated regions of m RNA encoded by the cII gene, corresponding to target binding sites such as BINDING SITE I, BINDING SITE II or BINDING SITE III of FIG. 1. The nucleotide sequences of cII BINDING SITE 1 and cII BINDING SITE 2, and the complementary secondary structure | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | to the nucleotide sequence of GAM353678 RNA are set forth in Tables 6-7, hereby incorporated herein. Another function of GAM353678 is to inhibit cII, a GAM353678 bacterial target gene which is associated with *Salmonella enterica enterica serovar Typhi* infection, as part of an anti- bacterial host defense mechanism. Accordingly, the utilities of GAM 353678 include the diagnosis, prevention and treatment of *Salmonella enterica enterica serovar Typhi* infection and associated clinical conditions | |
| GAM35 3678 | CAGCAGCA CACTGTGG TTTGTA | Human | cysM | *Salmonella typhimurium* LT2 | GAM353678 is a human miRNA-like oligonucleotide, which targets cysteine synthase B (cysM, NC_003197 from 2551651 to 2552562 (−)), a bacterial target gene encoded by the *Salmonella typhimurium* LT2 genome, as part of an anti- bacterial host defense mechanism. cysM BINDING SITE 1 and cysM BINDING SITE 2 are bacterial target binding sites that are found in the untranslated regions of mRNA encoded by the cysM gene, corresponding to target binding sites such as BINDING SITE I, BINDING SITE II or BINDING SITE III of FIG. 1. The nucleotide sequences of cysM BINDING SITE 1 and cysM BINDING SITE 2, and the complementary secondary structure to the nucleotide sequence of GAM353678 RNA are set forth in Tables 6-7, hereby incorporated herein. Another function of GAM353678 is to inhibit cysM, a GAM353678 bacterial target gene which is associated with *Salmonella typhimurium* LT2 infection, as part of an anti-bacterial host defense mechanism. Accordingly, the utilities of GAM353678 include the diagnosis, prevention and treatment of *Salmonella typhimurium* LT2 infection and associated clinical conditions | A |
| GAM35 3678 | CAGCAGCA CACTGTGG TTTGTA | Human | cysQ | *Pseudomonas putida* KT2440 | GAM353678 is a human miRNA-like oligonucleotide, which targets 3'(2'), 5'- bisphosphate nucleotidase (cysQ, NC_002947 from 315184 to 315984 (+)), a bacterial target gene encoded by the *Pseudomonas putida* KT2440 genome, as part of an anti- bacterial host defense mechanism. cysQ BINDING SITE 1 and cysQ BINDING SITE 2 are bacterial target binding sites that are found in the untranslated regions of mRNA encoded by the cysQ gene, corresponding to target binding sites such as BINDING SITE I, BINDING SITE II or BINDING SITE III of FIG. 1. The nucleotide sequences of cysQ BINDING SITE 1 and cysQ BINDING SITE 2, and the complementary secondary structure to the nucleotide sequence of GAM353678 RNA are set forth in Tables 6-7, hereby incorporated herein. Another function of GAM353678 is to inhibit cysQ, a GAM353678 bacterial target gene which is associated with *Pseudomonas putida* KT2440 infection, as part of an anti-bacterial host defense mechanism. Accordingly, the utilities of GAM353678 include the diagnosis, prevention and treatment of *Pseudomonas putida* KT2440 infection and associated clinical conditions | A |
| GAM35 3678 | CAGCAGCA CACTGTGG TTTGTA | Human | dadX | *Escherichia coli* C FT073 | GAM353678 is a human miRNA-like oligonucleotide, which targets Alanine racemase, catabolic (dadX, NC_004431 from 1476306 to 1477376 (+)), a bacterial target gene encoded by the *Escherichia coli* CFT073 genome, as part of an anti- bacterial host defense mechanism. dadX | A |

TABLE 8-continued

| GAM NAME | GAM RNA SEQUENCE | GAM ORGA-NISM | TAR-GET | TARGET ORGANISM | GAM FUNCTION | POS |
|---|---|---|---|---|---|---|
| | | | | | BINDING SITE 1 and dadX BINDING SITE 2 are bacterial target binding sites that are found in the untranslated regions of mRNA encoded by the dadX gene, corresponding to target binding sites such as BINDING SITE I, BINDING SITE II or BINDING SITE III of FIG. 1. The nucleotide sequences of dadX BINDING SITE 1 and dadX BINDING SITE 2, and the complementary secondary structure to the nucleotide sequence of GAM353678 RNA are set forth in Tables 6-7, hereby incorporated herein. Another function of GAM353678 is to inhibit dadX, a GAM353678 bacterial target gene which is associated with *Escherichia coli* CFT073 infection, as part of an anti-bacterial host defense mechanism. Accordingly, the utilities of GAM353678 include the diagnosis, prevention and treatment of *Escherichia coli* CFT073 infection and associated clinical conditions | |
| GAM35 3678 | CAGCAGCA CACTGTGG TTTGTA | Human | def | *Chlamydophila pneumoniae* CWL029 | GAM353678 is a human miRNA-like oligonucleotide, which targets Polypeptide Deformylase (def, NC_000922 from 1221735 to 1222295 (+)), a bacterial target gene encoded by the *Chlamydophila pneumoniae* CWL029 genome, as part of an anti-bacterial host defense mechanism. def BINDING SITE 1 and def BINDING SITE 2 are bacterial target binding sites that are found in the untranslated regions of mRNA encoded by the def gene, corresponding to target binding sites such as BINDING SITE I, BINDING SITE II or BINDING SITE III of FIG. 1. The nucleotide sequences of def BINDING SITE 1 and def BINDING SITE 2, and the complementary secondary structure to the nucleotide sequence of GAM353678 RNA are set forth in Tables 6-7, hereby incorporated herein. Another function of GAM353678 is to inhibit def, a GAM353678 bacterial target gene which is associated with *Chlamydophila pneumoniae* CWL029 infection, as part of an anti-bacterial host defense mechanism. Accordingly, the utilities of GAM353678 include the diagnosis, prevention and treatment of *Chlamydophila pneumoniae* CWL029 infection and associated clinical conditions. | A |
| GAM35 3678 | CAGCAGCA CACTGTGG TTTGTA | Human | def | *Chlamydophila pneumoniae* J138 | GAM353678 is a human miRNA-like oligonucleotide, which targets polypeptide deformylase (def, NC_002491 from 1218069 to 1218629 (+)), a bacterial target gene encoded by the *Chlamydophila pneumoniae* J138 genome, as part of an anti-bacterial host defense mechanism. def BINDING SITE 1 and def BINDING SITE 2 are bacterial target binding sites that are found in the untranslated regions of m RNA encoded by the def gene, corresponding to target binding sites such as BINDING SITE I, BINDING SITE II or BINDING SITE III of FIG. 1. The nucleotide sequences of def BINDING SITE 1 and def BINDING SITE 2, and the complementary secondary structure to the nucleotide sequence of GAM353678 RNA are set forth in Tables 6-7, hereby incorporated herein. Another function of GAM353678 is to inhibit def, a GAM353678 bacterial target gene which is associated with *Chlamydophila pneumoniae* J138 infection, as part of an anti-bacterial host defense mechanism. Accordingly, the utilities of GAM353678 include the | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | diagnosis, prevention and treatment of *Chlamydophila pneumoniae* J138 infection and associated clinical conditions | |
| GAM35 3678 | CAGCAGCA CACTGTGG TTTGTA | Human | dnaE | *Mycobacterium leprae* | GAM353678 is a human miRNA-like oligonucleotide, which targets DNA polymerase III, [alpha] subunit (dnaE, NC_002677 from 1423014 to 1426547 (+)), a bacterial target gene encoded by the *Mycobacterium leprae* genome, as part of an anti-bacterial host defense mechanism. dnaE BINDING SITE 1 through dnaE BINDING SITE 3 are bacterial target binding sites that are found in the untranslated regions of mRNA encoded by the dnaE gene, corresponding to target binding sites such as BINDING SITE I, BINDING SITE II or BINDING SITE III of FIG. 1. The nucleotide sequences of dnaE BINDING SITE 1 through dnaE BINDING SITE 3, and the complementary secondary structure to the nucleotide sequence of GAM353678 RNA are set forth in Tables 6-7, hereby incorporated herein. Another function of GAM353678 is to inhibit dnaE, a GAM353678 bacterial target gene which is associated with *Mycobacterium leprae* infection, as part of an anti-bacterial host defense mechanism. Accordingly, the utilities of GAM353678 include the diagnosis, prevention and treatment of *Mycobacterium leprae* infection and associated clinical conditions | A |
| GAM35 3678 | CAGCAGCA CACTGTGG TTTGTA | Human | dsdA | *Salmonella typhimurium* LT2 | GAM353678 is a human miRNA-like oligonucleotide, which targets D-serine deaminase (dsdA, NC_003197 from 4004453 to 4005775 (+)), a bacterial target gene encoded by the *Salmonella typhimurium* LT2 genome, as part of an anti-bacterial host defense mechanism. dsdA BINDING SITE 1 and dsdA BINDING SITE 2 are bacterial target binding sites that are found in the untranslated regions of mRNA encoded by the dsdA gene, corresponding to target binding sites such as BINDING SITE I, BINDING SITE II or BINDING SITE III of FIG. 1. The nucleotide sequences of dsdA BINDING SITE 1 and dsdA BINDING SITE 2, and the complementary secondary structure to the nucleotide sequence of GAM353678 RNA are set forth in Tables 6-7, hereby incorporated herein. Another function of GAM353678 is to inhibit dsdA, a GAM353678 bacterial target gene which is associated with *Salmonella typhimurium* LT2 infection, as part of an anti-bacterial host defense mechanism. Accordingly, the utilities of GAM353678 include the diagnosis, prevention and treatment of *Salmonella typhimurium* LT2 infection and associated clinical conditions | A |
| GAM35 3678 | CAGCAGCA CACTGTGG TTTGTA | Human | fepC | *Pseudomonas aeruginosa* PA01 | GAM353678 is a human miRNA-like oligonucleotide, which targets ferric enterobactin transport protein FepC (fepC, NC_002516 f rom 4653508 to 4654305 (−)), a bacterial target gene encoded by the *Pseudomonas aeruginosa* PA01 genome, as part of an anti-bacterial host defense mechanism. fepC BINDING SITE 1 and fepC BINDING SITE 2 are bacterial target binding sites that are found in the untranslated regions of mRNA encoded by the fepC gene, corresponding to target binding sites such as BINDING SITE I, BINDING SITE II or BINDING SITE III of FIG. 1. The nucleotide sequences of fepC BINDING SITE 1 and fepC BINDING SITE 2, | A |

TABLE 8-continued

| GAM NAME | GAM RNA SEQUENCE | GAM ORGANISM | TARGET | TARGET ORGANISM | GAM GAM FUNCTION | POS |
|---|---|---|---|---|---|---|
| | | | | | and the complementary secondary structure to the nucleotide sequence of GAM353678 RNA are set forth in Tables 6-7, hereby incorporated herein. Another function of GAM353678 is to inhibit fepC, a GAM353678 bacterial target gene which is associated with *Pseudomonas aeruginosa* PA01 infection, as part of an anti-bacterial host defense mechanism. Accordingly, the utilities of GAM353678 include the diagnosis, prevention and treatment of *Pseudomonas aeruginosa* PA01 infection and associated clinical conditions | |
| GAM35 3678 | CAGCAGCA CACTGTGG TTTGTA | Human | fhaL | *Bordetella pertussis* | GAM353678 is a human miRNA-like oligonucleotide, which targets adhesin (fhaL, NC_002929 from 3085865 to 3098455 (+)), a bacterial target gene encoded by the *Bordetella pertussis* genome, as part of an anti-bacterial host defense mechanism. fhaL BINDING SITE 1 and fhaL BINDING SITE 2 are bacterial target binding sites that are found in the untranslated regions of mRNA encoded by the fhaL gene, corresponding to target binding sites such as BINDING SITE I, BINDING SITE II or BINDING SITE III of FIG. 1. The nucleotide sequences of fhaL BINDING SITE 1 and fhaL BINDING SITE 2, and the complementary secondary structure to the nucleotide sequence of GAM353678 RNA are set forth in Tables 6-7, hereby incorporated herein. Another function of GAM353678 is to inhibit fhaL, a GAM353678 bacterial target gene which is associated with *Bordetella pertussis* infection, as part of an anti-bacterial host defense mechanism. Accordingly, the utilities of GAM353678 include the diagnosis, prevention and treatment of *Bordetella pertussis* infection and associated clinical conditions | A |
| GAM35 3678 | CAGCAGCA CACTGTGG TTTGTA | Human | flhB | *Bordetella pertussis* | GAM353678 is a human miRNA-like oligonucleotide, which targets flagellar biosynthetic protein FlhB (flhB, NC_002929 from 1441767 to 1442921 (+)), a bacterial target gene encoded by the *Bordetella pertussis* genome, as part of an anti-bacterial host defense mechanism. flhB BINDING SITE 1 through flhB BINDING SITE 3 are bacterial target binding sites that are found in the untranslated regions of mRNA encoded by the flhB gene, corresponding to target binding sites such as BINDING SITE I, BINDING SITE II or BINDING SITE III of FIG. 1. The nucleotide sequences of flhB BINDING SITE 1 through flhB BINDING SITE 3, and the complementary secondary structure to the nucleotide sequence of GAM353678 RNA are set forth in Tables 6-7, hereby incorporated herein. Another function of GAM353678 is to inhibit flhB, a GAM353678 bacterial target gene which is associated with *Bordetella pertussis* infection, as part of an anti-bacterial host defense mechanism. Accordingly, the utilities of GAM353678 include the diagnosis, prevention and treatment of *Bordetella pertussis* infection and associated clinical conditions | A |
| GAM35 3678 | CAGCAGCA CACTGTGG TTTGTA | Human | fmtB mr p | (*Staphylococcus*) *aureus* subsp. *aureus* N315 | GAM353678 is a human miRNA-like oligonucleotide, which targets FmtB protein (fmtB(mrp), NC_002745 from 2218145 to 2225590 (−)), a bacterial target gene encoded by the *Staphylococcus aureus* subsp. *aureus* N315 genome, as part | A |

TABLE 8-continued

| GAM NAME | GAM RNA SEQUENCE | GAM ORGANISM | TARGET | TARGET ORGANISM | GAM FUNCTION | POS |
|---|---|---|---|---|---|---|
| | | | | | of an anti-bacterial host defense mechanism. fmtB(mrp) BINDING SITE 1 and fmtB(mrp) BINDING SITE 2 are bacterial target binding sites that are found in the untranslated regions of mRNA encoded by the fmtB(mrp) gene, corresponding to target binding sites such as BINDING SITE I, BINDING SITE II or BINDING SITE III of FIG. 1. The nucleotide sequences of fm tB(mrp) BINDING SITE 1 and fmtB(mrp) BINDING SITE 2, and the complementary secondary structure to the nucleotide sequence of GAM353678 RNA are set forth in Tables 6-7, hereby incorporated herein. Another function of GAM353678 is to inhibit fmtB(mrp), a GAM35 3678 bacterial target gene which is associated with *Staphylococcus aureus* subsp. *aureus* N315 infection, as part of an anti-bacterial host defense mechanism. Accordingly, the utilities of GAM353678 include the diagnosis, prevention and treatment of *Staphylococcus aureus* subsp. *aureus* N315 infection and associated clinical conditions | |
| GAM35 3678 | CAGCAGCA CACTGTGG TTTGTA | Human | fmtB (mr p) | (*Staphylococcus aureus* subsp. *aureus* Mu50 | GAM353678 is a human miRNA-like oligonucleotide, which targets FmtB protein (fmtB(mrp), NC_002758 from 2287935 to 2295380 (−)), a bacterial target gene encoded by the *Staphylococcus aureus* subsp. *aureus* Mu50 genome, as part of an anti-bacterial host defense mechanism. fmtB(mrp) BINDING SITE 1 and fmtB(mrp) BINDING SITE 2 are bacterial target binding sites that are found in the untranslated regions of mRNA encoded by the fmtB(mrp) gene, corresponding to target binding sites such as BINDING SITE I, BINDING SITE II or BINDING SITE III of FIG. 1. The nucleotide sequences of fmtB (mrp) BINDING SITE 1 and fmtB(mrp) BINDING SITE 2, and the complementary secondary structure to the nucleotide sequence of GAM353678 RNA are set forth in Tables 6-7, hereby incorporated herein. Another function of GAM353678 is to inhibit fmtB(mrp), a GAM353678 bacterial target gene which is associated with *Staphylococcus aureus* subsp. *aureus* Mu50 infection, as part of an anti-bacterial host defense mechanism. Accordingly, the utilities of GAM353678 include the diagnosis, prevention and treatment of *Staphylococcus aureus* subsp. *aureus Mu50 infection and associated clinical conditions* | A |
| GAM35 3678 | CAGCAGCA CACTGTGG TTTGTA | Human | ftsY | *Chlamydophila pneumoniae* J1 38 | GAM353678 is a human miRNA-like oligonucleotide, which targets cell division protein ftsY (ftsY, NC_002491 from 1113127 to 1113999 (−)), a bacterial target gene encoded by the *Chlamydophila pneumoniae* J138 genome, as part of an anti-bacterial host defense mechanism. ftsY BINDING SITE 1 and ftsY BINDING SITE 2 are bacterial target binding sites that are found in the untranslated regions of mRNA encoded by the ftsY gene, corresponding to target binding sites such as BINDING SITE I, BINDING SITE II or BINDING SITE III of FIG. 1. The nucleotide sequences of ftsY BINDING SITE 1 and ftsY BINDING SITE 2, and the complementary secondary structure to the nucleotide sequence of GAM353678 RNA are set forth in Tables 6-7, hereby incorporated herein. Another function of | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | GAM353678 is to inhibit ftsY, a GAM353678 bacterial target gene which is associated with *Chlamydophila pneumoniae* J138 infection, as part of an anti-bacterial host defense mechanism. Accordingly, the utilities of GAM353678 include the diagnosis, prevention and treatment of *Chlamydophila pneumoniae* J138 infection and associated clinical conditions | |
| GAM35 3678 | CAGCAGCA CACTGTGG TTTGTA | Human | ftsY | *Chlamydophila pneumoniae* CW L029 | GAM353678 is a human miRNA-like oligonucleotide, which targets Cell Division Protein FtsY (ftsY, NC_000922 from 1115427 to 1116299 (−)), a bacterial target gene encoded by the *Chlamydophila pneumoniae* CWL029 genome, as part of an anti-bacterial host defense mechanism. ftsY BINDING SITE 1 and ftsY BINDING SITE 2 are bacterial target binding sites that are found in the untranslated regions of mRNA encoded by the ftsY gene, corresponding to target binding sites such as BINDING SITE I, BINDING SITE II or BINDING SITE III of FIG. 1. The nucleotide sequences of ftsY BINDING SITE 1 and ftsY BINDING SITE 2, and the complementary secondary structure to the nucleotide sequence of GAM353678 RNA are set forth in Tables 6-7, hereby incorporated herein. Another function of GAM353678 is to inhibit ftsY, a GAM353678 bacterial target gene which is associated with *Chlamydophila pneumoniae* CWL029 infection, as part of an anti-bacterial host defense mechanism. Accordingly, the utilities of GAM353678 include the diagnosis, prevention and treatment of *Chlamydophila pneumoniae* CWL029 infection and associated clinical conditions | A |
| GAM35 3678 | CAGCAGCA CACTGTGG TTTGTA | Human | gad | *Pseudomonas putida* KT2440 | GAM353678 is a human miRNA-like oligonucleotide, which targets guanine aminohydrolase (gad, NC_002947 from 4871625 to 4872929 (+)), a bacterial target gene encoded by the *Pseudomonas putida* KT2440 genome, as part of an anti-bacterial host defense mechanism. gad BINDING SITE 1 and gad BINDING SITE 2 are bacterial target binding sites that are found in the untranslated regions of m RNA encoded by the gad gene, corresponding to target binding sites such as BINDING SITE I, BINDING SITE II or BINDING SITE III of FIG. 1. The nucleotide sequences of gad BINDING SITE 1 and gad BINDING SITE 2, and the complementary secondary structure to the nucleotide sequence of GAM353678 RNA are set forth in Tables 6-7, hereby incorporated herein. Another function of GAM353678 is to inhibit gad, a GAM353678 bacterial target gene which is associated with *Pseudomonas putida* KT2440 infection, as part of an anti-bacterial host defense mechanism. Accordingly, the utilities of GAM353678 include the diagnosis, prevention and treatment of *Pseudomonas putida* KT 2440 infection and associated clinical conditions | A |
| GAM35 3678 | CAGCAGCA CACTGTGG TTTGTA | Human | glcC | *Escherichis coli* CFT073 | GAM353678 is a human miRNA-like oligonucleotide, which targets Glc operon transcriptional activator (glcC, NC_004431 from 3542871 to 3543695 (+)), a bacterial target gene encoded by the *Escherichia coli* CFT073 genome, as part of an anti-bacterial host defense mechanism. glcC BINDING SITE 1 and glcC BINDING SITE 2 are bacterial target binding sites that are found in the untranslated regions of | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | mRNA encoded by the glcC gene, corresponding to target binding sites such as BINDING SITE I, BINDING SITE II or BINDING SITE III of FIG. 1. The nucleotide sequences of glcC BINDING SITE 1 and glcC BINDING SITE 2, and the complementary secondary structure to the nucleotide sequence of GAM353678 RNA are set forth in Tables 6-7, hereby incorporated herein. Another function of GAM353678 is to inhibit glcC, a GAM353678 bacterial target gene which is associated with *Escherichia coli* CFT073 infection, as part of an anti-bacterial host defense mechanism. Accordingly, the utilities of GAM353678 include the diagnosis, prevention and treatment of *Escherichia coli* CFT073 infection and associated clinical conditions | |
| GAM35 3678 | CAGCAGCA CACTGTGG TTTGTA | Human | glgP | *Salmonella enterica enterica serovar Typhi* Ty 2 | GAM353678 is a human miRNA-like oligonucleotide, which targets glycogen phosphorylase (glgP, NC_004631 from 4129215 to 4131662 (+)), a bacterial target gene encoded by the *Salmonella enterica enterica serovar Typhi* Ty2 genome, as part of an anti-bacterial host defense mechanism. glgP BINDING SITE 1 and glgP BINDING SITE 2 are bacterial target binding sites that are found in the untranslated regions of mRNA encoded by the glgP gene, corresponding to target binding sites such as BINDING SITE I, BINDING SITE II or BINDING SITE III of FIG. 1. The nucleotide sequences of glgP BINDING SITE 1 and glgP BINDING SITE 2, and the complementary secondary structure to the nucleotide sequence of GAM353678 RNA are set forth in Tables 6-7, hereby incorporated herein. Another function of GAM353678 is to inhibit glgP, a GAM353678 bacterial target gene which is associated with *Salmonella enterica enterica serovar Typhi* Ty2 infection, as part of an anti-bacterial host defense mechanism. Accordingly, the utilities of GAM353678 include the diagnosis, prevention and treatment of *Salmonella enterica enterica serovar Typhi* Ty2 infection and associated clinical conditions | A |
| GAM35 3678 | CAGCAGCA CACTGTGG TTTGTA | Human | glgP | *Salmonella enterica enterica serovar Typhi* | GAM353678 is a human miRNA-like oligonucleotide, which targets glycogen phosphorylase (glgP, NC_003198 from 4144568 to 414 7015 (+)), a bacterial target gene encoded by the *Salmonella enterica enterica serovar Typhi* genome, as part of an anti-bacterial host defense mechanism. glgP BINDING SITE 1 and glgP BINDING SITE 2 are bacterial target binding sites that are found in the untranslated regions of mRNA encoded by the glgP gene, corresponding to target binding sites such as BINDING SITE I, BINDING SITE II or BINDING SITE III of FIG. 1. The nucleotide sequences of glgP BINDING SITE 1 and glgP BINDING SITE 2, and the complementary secondary structure to the nucleotide sequence of GAM353678 RNA are set forth in Tables 6-7, hereby incorporated herein. Another function of GAM353678 is to inhibit glgP, a GAM353678 bacterial target gene which is associated with *Salmonella enterica enterica serovar Typhi* infection, as part of an anti-bacterial host defense mechanism. Accordingly, the utilities of GAM353678 include the diagnosis, prevention and treatment of | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | *Salmonella enterica enterica* serovar *Typhi* infection and associated clinical conditions | |
| GAM35 3678 | CAGCAGCA CACTGTGG TTTGTA | Human | glpC | *Yersinia pestis* KIM | GAM353678 is a human miRNA-like oligonucleotide, which targets sn-glycerol-3-phosphate dehydrogenase (anaerobic), K-small subunit (glpC, NC_004088 from 454677 to 456047 (+)), a bacterial target gene encoded by the *Yersinia pestis* KIM genome, as part of an anti-bacterial host defense mechanism. glpC BINDING SITE 1 and glpC BINDING SITE 2 are bacterial target binding sites that are found in the untranslated regions of mRNA encoded by the glpC gene, corresponding to target binding sites such as BINDING SITE I, BINDING SITE II or BINDING SITE III of FIG. 1. The nucleotide sequences of glpC BINDING SITE 1 and glpC BINDING SITE 2, and the complementary secondary structure to the nucleotide sequence of GAM353678 RNA are set forth in Tables 6-7, hereby incorporated herein. Another function of GAM353678 is to inhibit glpC, a GAM353678 bacterial target gene which is associated with *Yersinia pestis* KIM infection, as part of an anti-bacterial host defense mechanism. Accordingly, the utilities of GAM353678 include the diagnosis, prevention and treatment of *Yersinia pestis* KIM infection and associated clinical conditions | A |
| GAM35 3678 | CAGCAGCA CACTGTGG TTTGTA | Human | glpC | *Yersinia pestis* | GAM353678 is a human miRNA-like oligonucleotide, which targets anaerobic glycerol-3-phosphate dehydrogenase subunit C (glpC, NC_003143 from 4289650 to 4290897 (−)), a bacterial target gene encoded by the *Yersinia pestis* genome, as part of an anti-bacterial host defense mechanism. glpC BINDING SITE 1 and glpC BINDING SITE 2 are bacterial target binding sites that are found in the untranslated regions of mRNA encoded by the glpC gene, corresponding to target binding sites such as BINDING SITE I, BINDING SITE II or BINDING SITE III of FIG. 1. The nucleotide sequences of glpC BINDING SITE 1 and glpC BINDING SITE 2, and the complementary secondary structure to the nucleotide sequence of GAM353678 RNA are set forth in Tables 6-7, hereby incorporated herein. Another function of GAM353678 is to inhibit glpC, a GAM353678 bacterial target gene which is associated with *Yersinia pestis* infection, as part of an anti-bacterial host defense mechanism. Accordingly, the utilities of GAM353678 include the diagnosis, prevention and treatment of *Yersinia pestis* infection and associated clinical conditions | A |
| GAM35 3678 | CAGCAGCA CACTGTGG TTTGTA | Human | glpD | *Brucella suis* 1330 | GAM353678 is a human miRNA-like oligonucleotide, which targets glycerol-3-phosphate dehydrogenase (glpD, NC_004310 from 210763 to 212274 (+)), a bacterial target gene encoded by the *Brucella suis* 1330 genome, as part of an anti-bacterial host defense mechanism. glpD BINDING SITE 1 and glpD BINDING SITE 2 are bacterial target binding sites that are found in the untranslated regions of mRNA encoded by the glpD gene, corresponding to target binding sites such as BINDING SITE I, BINDING SITE II or BINDING SITE III of FIG. 1. The nucleotide sequences of glpD BINDING SITE | A |

TABLE 8-continued

| GAM NAME | GAM RNA SEQUENCE | GAM ORGA-NISM | TAR-GET | TARGET ORGANISM | GAM GAM FUNCTION | POS |
|---|---|---|---|---|---|---|
| | | | | | 1 and glpD BINDING SITE 2, and the complementary secondary structure to the nucleotide sequence of GAM353678 RNA are set forth in Tables 6-7, hereby incorporated herein. Another function of GAM353678 is to inhibit glpD, a GAM353678 bacterial target gene which is associated with *Brucella suis* 1330 infection, as part of an anti-bacterial host defense mechanism. Accordingly, the utilities of GAM353678 include the diagnosis, prevention and treatment of *Brucella suis* 1330 infection and associated clinical conditions | |
| GAM353678 | CAGCAGCACACTGTGGTTTGTA | Human | ipaH_5 | *Shigella flexneri* 2a str. 2457T | GAM353678 is a human miRNA-like oligonucleotide, which targets invasion plasmid antigen (ipaH_5, NC_004741 from 2023205 to 2024848 (+)), a bacterial target gene encoded by the *Shigella flexneri* 2a str. 2457T genome, as part of an anti-bacterial host defense mechanism. ipaH_5 BINDING SITE 1 and ipaH_5 BINDING SITE 2 are bacterial target binding sites that are found in the untranslated regions of mRNA encoded by the ipaH_5 gene, corresponding to target binding sites such as BINDING SITE I, BINDING SITE II or BINDING SITE III of FIG. 1. The nucleotide sequences of ipaH_5 BINDING SITE 1 and ipaH_5 BINDING SITE 2, and the complementary secondary structure to the nucleotide sequence of GAM353678 RNA are set forth in Tables 6-7, hereby incorporated herein. Another function of GAM353678 is to inhibit ipaH_5, a GAM353678 bacterial target gene which is associated with *Shigella flexneri* 2a str. 2457T infection, as part of an anti-bacterial host defense mechanism. Accordingly, the utilities of GAM353678 include the diagnosis, prevention and treatment of *Shigella flexneri* 2a str. 2457T infection and associated clinical conditions | A |
| GAM353678 | CAGCAGCACACTGTGGTTTGTA | Human | ipaH9.8 | *Shigella flexneri* 2a str. 301 | GAM353678 is a human miRNA-like oligonucleotide, which targets invasion plasmid antigen (ipaH9.8, NC_004337 from 1422064 to 1423779 (−)), a bacterial target gene encoded by the *Shigella flexneri* 2a str. 301 genome, as part of an anti-bacterial host defense mechanism. ipaH9.8 BINDING SITE 1 and ipaH9.8 BINDING SITE 2 are bacterial target binding sites that are found in the untranslated regions of mRNA encoded by the ipaH9.8 gene, corresponding to target binding sites such as BINDING SITE I, BINDING SITE II or BINDING SITE III of FIG. 1. The nucleotide sequences of ipaH9.8 BINDING SITE 1 and ipaH9.8 BINDING SITE 2, and the complementary secondary structure to the nucleotide sequence of GAM353678 RNA are set forth in Tables 6-7, hereby incorporated herein. Another function of GAM353678 is to inhibit ipaH9.8, a GAM353678 bacterial target gene which is associated with *Shigella flexneri* 2a str. 301 infection, as part of an anti-bacterial host defense mechanism. Accordingly, the utilities of GAM353678 include the diagnosis, prevention and treatment of *Shigella flexneri* 2a str. 301 infection and associated clinical conditions. | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| GAM35 3678 | CAGCAGCA CACTGTGG TTTGTA | Human | lives | *Bordetella pertussis* | GAM353678 is a human miRNA-like oligonucleotide, which targets high- affinity branched-chain amino acid transport system permease protein (livH, NC_002929 from 1144729 to 1145607 (+)), a bacterial target gene encoded by the *Bordetella pertussis* genome, as part of an anti-bacterial host defense mechanism. lives BINDING SITE is a bacterial target binding site that is a found in the the 3' untranslated region of mRNA encoded by the livH gene, corresponding to a target binding site such as BINDING SITE I, BINDING SITE II or BINDING SITE III of FIG. 1. The nucleotide sequences of livH BINDING SITE, and the complementary secondary structure to the nucleotide sequence of GAM353678 RNA are set forth in Tables 6-7, hereby incorporated herein. Another function of GAM353678 is to inhibit lives, a GAM353678 bacterial target gene which is associated with *Bordetella pertussis* infection, as part of an anti- bacterial host defense mechanism. Accordingly, the utilities of GAM353678 include the diagnosis, prevention and treatment of *Bordetella pertussis* infection and associated clinical conditions | A |
| GAM35 3678 | CAGCAGCA CACTGTGG TTTGTA | Human | lppI | *Mycobacterium tuberculosis* H37Rv | GAM353678 is a human miRNA-like oligonucleotide, which targets lppI (lppI, NC_000962 from 2291267 to 2291923 (+)), a bacterial target gene encoded by the *Mycobacterium tuberculosis* H37Rv genome, as part of an anti-bacterial host defense mechanism. lppI BINDING SITE 1 and lppI BINDING SITE 2 are bacterial target binding sites that are found in the untranslated regions of mRNA encoded by the lppI gene, corresponding to target binding sites such as BINDING SITE I, BINDING SITE II or BINDING SITE III of FIG. 1. The nucleotide sequences of lppI BINDING SITE 1 and lppI BINDING SITE 2, and the complementary secondary structure to the nucleotide sequence of GAM353678 RNA are set forth in Tables 6-7, hereby incorporated herein. Another function of GAM353678 is to inhibit lppI, a GAM353678 bacterial target gene which is associated with *Mycobacterium tuberculosis* H37Rv infection, as part of an anti-bacterial host defense mechanism. Accordingly, the utilities of GAM353678 include the diagnosis, prevention and treatment of *Mycobacterium tuberculosis* H37Rv infection and associated clinical conditions | A |
| GAM35 3678 | CAGCAGCA CACTGTGG TTTGTA | Human | lppI | *Mycobacterium bovis* subsp *bovis* AF21 22/97 | GAM353678 is a human miRNA-like oligonucleotide, which targets Probable lipoprotein lppI (lppI, NC_002945 from 2275182 to 2275838 (+)), a bacterial target gene encoded by the *Mycobacterium bovis* subsp *bovis* AF2122/97 genome, as part of an anti-bacterial host defense mechanism. lppI BINDING SITE 1 and lppI BINDING SITE 2 are bacterial target binding sites that are found in the untranslated regions of mRNA encoded by the lppI gene, corresponding to target binding sites such as BINDING SITE I, BINDING SITE II or BINDING SITE III of FIG. 1. The nucleotide sequences of lppI BINDING SITE 1 and lppI BINDING SITE 2, and the complementary secondary structure to the nucleotide sequence of GAM353678 RNA are set forth in Tables 6-7, hereby incorporated herein. Another function of | A |

TABLE 8-continued

| GAM NAME | GAM RNA SEQUENCE | GAM ORGA-NISM | TAR-GET | TARGET ORGANISM | GAM GAM FUNCTION | POS |
|---|---|---|---|---|---|---|
| | | | | | GAM353678 is to inhibit lppI, a GAM353678 bacterial target gene which is associated with *Mycobacterium bovis* subsp *bovis* AF2122/97 infection, as part of an anti-bacterial host defense mechanism. Accordingly, the utilities of GAM 353678 include the diagnosis, prevention and treatment of *Mycobacterium bovis* subsp *bovis* AF2122/97 infection and associated clinical conditions | |
| GAM35 3678 | CAGCAGCA CACTGTGG TTTGTA | Human | MGAT5 | Human | GAM353678 is a human miRNA-like oligonucleotide, which targets a human mannosyl (alpha-1,6-)-glycoprotein beta-1,6-N-acetyl-glucosaminyltransferase (MGAT5, Accession number: NM_002410) as part of a host response mechanism associated with a *Salmonella typhimurium* LT2 infection. MGAT5 BINDING SITE is a human target binding site that is a found in the the 3' untranslated region of mRNA encoded by the MGAT5 gene, corresponding to a target binding site such as BINDING SITE I, BINDING SITE II or BINDING SITE III of FIG. 1. Additionally, using the binding site prediction system of the present invention GAM353678-A binds to sequences on orthologous UTR of rat(NM_023095). The nucleotide sequences of MGAT5 BINDING SITE, and the complementary secondary structure to the nucleotide sequence of GAM353678 RNA are set forth in Tables 6-7, hereby incorporated herein. Another function of GAM353678 is to inhibit MGAT5, a GAM353678 human target gene which encodes an enzyme that catalyzes beta 1-6 branching on N-linked carbohydrates. MGAT5 is associated with *Salmonella typhimurium* LT2 infection, and therefore GAM353678 is associated with the abovementioned infection, as part of a host response mechanism. Accordingly, the utilities of GAM353678 include the diagnosis, prevention and treatment of *Salmonella typhimurium* LT2 infection and associated clinical conditions. The function of MGAT5 and its association with various diseases and clinical conditions has been established by previous studies, as described hereinabove with reference to GAM3451. | A |
| GAM35 3678 | CAGCAGCA CACTGTGG TTTGTA | Human | miaA | *Chlamydia trachomatis* | GAM353678 is a human miRNA-like oligonucleotide, which targets tRNA isopentenylpyrophosphate transferase (miaA, NC_000117 from 899276 to 900295 (+)), a bacterial target gene encoded by the *Chlamydia trachomatis* genome, as part of an anti-bacterial host defense mechanism. miaA BINDING SITE 1 and miaA BINDING SITE 2 are bacterial target binding sites that are found in the untranslated regions of mRNA encoded by the miaA gene, corresponding to target binding sites such as BINDING SITE I, BINDING SITE II or BINDING SITE III of FIG. 1. The nucleotide sequences of miaA BINDING SITE 1 and miaA BINDING SITE 2, and the complementary secondary structure to the nucleotide sequence of GAM353678 RNA are set forth in Tables 6-7, hereby incorporated herein. Another function of GAM353678 is to inhibit miaA, a GAM353678 bacterial target gene which is associated with *Chlamydia trachomatis* infection, as part of an anti-bacterial host defense mechanism. Accordingly, the utilities of GAM353678 include the diagnosis, | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | prevention and treatment of *Chlamydia trachomatis* infection and associated clinical conditions | |
| GAM35 3678 | CAGCAGCA CACTGTGG TTTGTA | Human | minE | *Pseudomonas putida* KT2440 | GAM353678 is a human miRNA-like oligonucleotide, which targets cell division topological specificity factor MinE (minE, NC_002947 from 1932680 to 1932934 (−)), a bacterial target gene encoded by the *Pseudomonas putida* KT2440 genome, as part of an anti-bacterial host defense mechanism. minE BINDING SITE is a bacterial target binding site that is a found in the the 3' untranslated region of mRNA encoded by the minE gene, corresponding to a target binding site such as BINDING SITE I, BINDING SITE II or BINDING SITE III of FIG. 1. The nucleotide sequences of minE BINDING SITE, and the complementary secondary structure to the nucleotide sequence of GAM353678 RNA are set forth in Tables 6-7, hereby incorporated herein. Another function of GAM353678 is to inhibit minE, a GAM353678 bacterial target gene which is associated with *Pseudomonas putida* KT2440 infection, as part of an anti-bacterial host defense mechanism. Accordingly, the utilities of GAM353678 include the diagnosis, prevention and treatment of *Pseudomonas putida* KT2440 infection and associated clinical conditions | A |
| GAM35 3678 | CAGCAGCA CACTGTGG TTTGTA | Human | nicT | *Mycobacterium tuberculosis* H37Rv | GAM353678 is a human miRNA-like oligonucleotide, which targets nicT (nicT, NC_000962 from 3166681 to 3167799 (+)), a bacterial target gene encoded by the *Mycobacterium tuberculosis* H37Rv genome, as part of an anti-bacterial host defense mechanism. nicT BINDING SITE 1 and nicT BINDING SITE 2 are bacterial target binding sites that are found in the untranslated regions of mRNA encoded by the nicT gene, corresponding to target binding sites such as BINDING SITE I, BINDING SITE II or BINDING SITE III of FIG. 1. The nucleotide sequences of nicT BINDING SITE 1 and nicT BINDING SITE 2, and the complementary secondary structure to the nucleotide sequence of GAM353678 RNA are set forth in Tables 6-7, hereby incorporated herein. Another function of GAM353678 is to inhibit nicT, a GAM353678 bacterial target gene which is associated with *Mycobacterium tuberculosis* H37Rv infection, as part of an anti-bacterial host defense mechanism. Accordingly, the utilities of GAM353678 include the diagnosis, prevention and treatment of *Mycobacterium tuberculosis* H37Rv infection and associated clinical conditions | A |
| GAM35 3678 | CAGCAGCA CACTGTGG TTTGTA | Human | nicT | *Mycobacterium bovis* subsp *bovis* AF21 22/97 | GAM353678 is a human miRNA-like oligonucleotide, which targets POSSIBLE NICKEL-TRANSPORT INTEGRAL MEMBRANE PROTEIN NICT (nic T, NC_002945 from 3123200 to 3124318 (+)), a bacterial target gene encoded by the *Mycobacterium bovis* subsp *bovis* AF2122/97 genome, as part of an anti-bacterial host defense mechanism. nicT BINDING SITE 1 and nicT BINDING SITE 2 are bacterial target binding sites that are found in the untranslated regions of mRNA encoded by the nicT gene, corresponding to target binding sites such as BINDING SITE I, BINDING SITE II or BINDING SITE III of FIG. 1. The nucleotide sequences of nicT BINDING SITE 1 and nicT BINDING SITE 2, and the | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | complementary secondary structure to the nucleotide sequence of GAM353678 RNA are set forth in Tables 6-7, hereby incorporated herein. Another function of GAM353678 is to inhibit nicT, a GAM353678 bacterial target gene which is associated with *Mycobacterium bovis* subsp *bovis* AF2122/97 infection, as part of an anti-bacterial host defense mechanism. Accordingly, the utilities of GAM353678 include the diagnosis, prevention and treatment of *Mycobacterium bovis* subsp *bovis* AF2122/97 infection and associated clinical conditions | |
| GAM35 3678 | CAGCAGCA CACTGTGG TTTGTA | Human | nupC | *Shigella flexneri* 2a str. 3 01 | GAM353678 is a human miRNA-like oligonucleotide, which targets permease of transport system for 3 nucleosides (nupC, NC_004337 from 2515842 to 2517083 (+)), a bacterial target gene encoded by the *Shigella flexneri* 2a str. 301 genome, as part of an anti-bacterial host defense mechanism. nupC BINDING SITE 1 through nupC BINDING SITE 3 are bacterial target binding sites that are found in the untranslated regions of mRNA encoded by the nupC gene, corresponding to target binding sites such as BINDING SITE I, BINDING SITE II or BINDING SITE III of FIG. 1. The nucleotide sequences of nupC BINDING SITE 1 through nupC BINDING SITE 3, and the complementary secondary structure to the nucleotide sequence of GAM353678 RNA are set forth in Tables 6-7, hereby incorporated herein. Another function of GAM353678 is to inhibit nupC, a GAM353678 bacterial target gene which is associated with *Shigella flexneri* 2a str. 301 infection, as part of an anti-bacterial host defense mechanism. Accordingly, the utilities of GAM353678 include the diagnosis, prevention and treatment of *Shigella flexneri* 2a str. 301 infection and associated clinical conditions | A |
| GAM35 3678 | CAGCAGCA CACTGTGG TTTGTA | Human | nupC | *Escherichia coli* CFT073 | GAM353678 is a human miRNA-like oligonucleotide, which targets Nucleoside permease nupC (nupC, NC_004431 from 2795390 to 2796631 (+)), a bacterial target gene encoded by the *Escherichia coli* CFT073 genome, as part of an anti-bacterial host defense mechanism. nupC BINDING SITE 1 through nupC BINDING SITE 3 are bacterial target binding sites that are found in the untranslated regions of mRNA encoded by the nupC gene, corresponding to target binding sites such as BINDING SITE I, BINDING SITE II or BINDING SITE III of FIG. 1. The nucleotide sequences of nupC BINDING SITE 1 through nupC BINDING SITE 3, and the complementary secondary structure to the nucleotide sequence of GAM353678 RNA are set forth in Tables 6-7, hereby incorporated herein. Another function of GAM353678 is to inhibit nupC, a GAM353678 bacterial target gene which is associated with *Escherichia coli* CFT073 infection, as part of an anti-bacterial host defense mechanism. Accordingly, the utilities of GAM353678 include the diagnosis, prevention and treatment of *Escherichia coli* CFT073 infection and associated clinical conditions | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| GAM35 3678 | CAGCAGCA CACTGTGG TTTGTA | Human | nupC | *Shigella flexneri* 2a str. 2 457T | GAM353678 is a human miRNA-like oligonucleotide, which targets permease of transport system for 3 nucleosides (nupC, NC_004741 from 2494019 to 2495221 (+)), a bacterial target gene encoded by the *Shigella flexneri* 2a str. 2457T genome, as part of an anti-bacterial host defense mechanism. nupC BINDING SITE 1 through nupC BINDING SITE 3 are bacterial target binding sites that are found in the untranslated regions of mRNA encoded by the nupC gene, corresponding to target binding sites such as BINDING SITE I, BINDING SITE II or BINDING SITE III of FIG. 1. The nucleotide sequences of nupC BINDING SITE 1 through nupC BINDING SITE 3, and the complementary secondary structure to the nucleotide sequence of GAM353678 RNA are set forth in Tables 6-7, hereby incorporated herein. Another function of GAM353678 is to inhibit nupC, a GAM353678 bacterial target gene which is associated with *Shigella flexneri* 2a str. 2457T infection, as part of an anti- bacterial host defense mechanism. Accordingly, the utilities of GAM353678 include the diagnosis, prevention and treatment of *Shigella flexneri* 2a str. 2457T infection and associated clinical conditions | A |
| GAM35 3678 | CAGCAGCA CACTGTGG TTTGTA | Human | ompG | *Escherichia coli* CFT073 | GAM353678 is a human miRNA-like oligonucleotide, which targets Outer membrane protein G precursor (ompG, NC_004431 from 1624577 to 1625533 (+)), a bacterial target gene encoded by the *Escherichia coli* CFT073 genome, as part of an anti-bacterial host defense mechanism. ompG BINDING SITE 1 and ompG BINDING SITE 2 are bacterial target binding sites that are found in the untranslated regions of mRNA encoded by the ompG gene, corresponding to target binding sites such as BINDING SITE I, BINDING SITE II or BINDING SITE III of FIG. 1. The nucleotide sequences of ompG BINDING SITE 1 and ompG BINDING SITE 2, and the complementary secondary structure to the nucleotide sequence of GAM353678 RNA are set forth in Tables 6-7, hereby incorporated herein. Another function of GAM353678 is to inhibit ompG, a GAM353678 bacterial target gene which is associated with *Escherichia coli* CFT073 infection, as part of an anti-bacterial host defense mechanism. Accordingly, the utilities of GAM353678 include the diagnosis, prevention and treatment of *Escherichia coli* CFT073 infection and associated clinical conditions | A |
| GAM35 3678 | CAGCAGCA CACTGTGG TTTGTA | Human | orn | *Yersinia pestis* | GAM353678 is a human miRNA-like oligonucleotide, which targets oligoribonuclease (orn, NC_003143 from 378331 to 378876 (+)), a bacterial target gene encoded by the *Yersinia pestis* genome, as part of an anti-bacterial host defense mechanism. orn BINDING SITE is a bacterial target binding site that is a found in the the 3' untranslated region of mRNA encoded by the orn gene, corresponding to a target binding site such as BINDING SITE I, BINDING SITE II or BINDING SITE III of FIG. 1. The nucleotide sequences of orn BINDING SITE, and the complementary secondary structure to the nucleotide sequence of GAM353678 RNA are set forth in Tables 6-7, hereby | A |

TABLE 8-continued

| GAM NAME | GAM RNA SEQUENCE | GAM ORGANISM | TARGET | TARGET ORGANISM | GAM GAM FUNCTION | POS |
|---|---|---|---|---|---|---|
| | | | | | incorporated herein. Another function of GAM353678 is to inhibitorn, a GAM353678 bacterial target gene which is associated with *Yersinia pestis* infection, as part of an anti-bacterial host defense mechanism. Accordingly, the utilities of GAM353678 include the diagnosis, prevention and treatment of *Yersinia pestis* infection and associated clinical conditions | |
| GAM353678 | CAGCAGCACACTGTGGTTTGTA | Human | oxyR | *Salmonella enterica enterica serovar Typhi* | GAM353678 is a human miRNA-like oligonucleotide, which targets hydrogen peroxide-inducible regulon activator (oxyR, NC_003198 from 3607204 to 3608121 (−)), a bacterial target gene encoded by the *Salmonella enterica enterica serovar Typhi* genome, as part of an anti-bacterial host defense mechanism. oxyR BINDING SITE 1 and oxyR BINDING SITE 2 are bacterial target binding sites that are found in the untranslated regions of mRNA encoded by the oxyR gene, corresponding to target binding sites such as BINDING SITE I, BINDING SITE II or BINDING SITE III of FIG. 1. The nucleotide sequences of oxyR BINDING SITE 1 and oxyR BINDING SITE 2, and the complementary secondary structure to the nucleotide sequence of GAM353678 RNA are set forth in Tables 6-7, hereby incorporated herein. Another function of GAM353678 is to inhibit oxyR, a GAM353678 bacterial target gene which is associated with *Salmonella enterica enterica serovar Typhi* infection, as part of an anti-bacterial host defense mechanism. Accordingly, the utilities of GAM353678 include the diagnosis, prevention and treatment of *Salmonella enterica enterica serovar Typhi* infection and associated clinical conditions | A |
| GAM353678 | CAGCAGCACACTGTGGTTTGTA | Human | oxyR | *Salmonella typhimurium* LT2 | GAM353678 is a human miRNA-like oligonucleotide, which targets oxidative stress regulatory protein (oxyR, NC_003197 from 4343080 to 4343997 (+)), a bacterial target gene encoded by the *Salmonella typhimurium* LT2 genome, as part of an anti-bacterial host defense mechanism. oxyR BINDING SITE 1 and oxyR BINDING SITE 2 are bacterial targ et binding sites that are found in the untranslated regions of mRNA encoded by the oxyR gene, corresponding to target binding sites such as BINDING SITE I, BINDING SITE II or BINDING SITE III of FIG.1. The nucleotide sequences of oxyR BINDING SITE 1 and oxyR BINDING SITE 2, and the complementary secondary structure to the nucleotide sequence of GAM353678 RNA are set forth in Tables 6-7, hereby incorporated herein. Another function of GAM353678 is to inhibit oxyR, a GAM353678 bacterial target gene which is associated with *Salmonella typhimurium* LT2 infection, as part of an anti-bacterial host defense mechanism. Accordingly, the utilities of GAM353678 include the diagnosis, prevention and treatment of *Salmonella typhimurium* LT2 infection and associated clinical conditions | A |
| GAM353678 | CAGCAGCACACTGTGGTTTGTA | Human | oxyR | *Salmonella enterica enterica serovar Typhi* Ty 2 | GAM353678 is a human miRNA-like oligonucleotide, which targets hydrogen peroxide-inducible regulon activator (oxyR, NC_004631 from 3592864 to 3593781 (−)), a bacterial target gene encoded by the *Salmonella enterica enterica serovar Typhi* Ty2 genome, as part of an anti-bacterial host defense mechanism. | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | oxyR BINDING SITE 1 and oxyR BINDING SITE 2 are bacterial target binding sites that are found in the untranslated regions of mRNA encoded by the oxyR gene, corresponding to target binding sites such as BINDING SITE I, BINDING SITE II or BINDING SITE III of FIG. 1. The nucleotide sequences of oxyR BINDING SITE 1 and oxyR BINDING SITE 2, and the complementary secondary structure to the nucleotide sequence of GAM353678 RNA are set forth in Tables 6-7, hereby incorporated herein. Another function of GAM353678 is to inhibit oxyR, a GAM353678 bacterial target gene which is associated with *Salmonella enterica enterica serovar Typhi* Ty2 infection, as part of an anti-bacterial host defense mechanism. Accordingly, the utilities of GAM353678 include the diagnosis, prevention and treatment of *Salmonella enterica enterica serovar Typhi* Ty2 infection and associated clinical conditions | |
| GAM35 3678 | CAGCAGCA CACTGTGG TTTGTA | Human | pbpG | *Pseudomonas putida* KT2440 | GAM353678 is a human miRNA-like oligonucleotide, which targets D-alanyl-D-alanine-endopeptidase (pbpG, NC_002947 from 4323707 to 4324633 (+)), a bacterial target gene encoded by the *Pseudomonas putida* KT2440 genome, as part of an anti-bacterial host defense mechanism. pbpG BINDING SITE 1 and pbpG BINDING SITE 2 are bacterial target binding sites that are found in the untranslated regions of mRNA encoded by the pbpG gene, corresponding to target binding sites such as BINDING SITE I, BINDING SITE II or BINDING SITE III of FIG. 1. The nucleotide sequences of pbpG BINDING SITE 1 and pbpG BINDING SITE 2, and the complementary secondary structure to the nucleotide sequence of GAM353678 RNA are set forth in Tables 6-7, hereby incorporated herein. Another function of GAM353678 is to inhibit pbpG, a GAM353678 bacterial target gene which is associated with *Pseudomonas putida* KT2440 infection, as part of an anti-bacterial host defense mechanism. Accordingly, the utilities of GAM353678 include the diagnosis, prevention and treatment of *Pseudomonas putida* KT2440 infection and associated clinical conditions | A |
| GAM35 3678 | CAGCAGCA CACTGTGG TTTGTA | Human | pchA | *Pseudomonas aeruginosa* PA01 | GAM353678 is a human miRNA-like oligonucleotide, which targets salicylate biosynthesis isochorismate synthase (pchA, NC_002516 from 4745120 to 4746550 (+)), a bacterial target gene encoded by the *Pseudomonas aeruginosa* PA01 genome, as part of an anti-bacterial host defense mechanism. pchA BINDING SITE 1 and pchA BINDING SITE 2 are bacterial target binding sites that are found in the untranslated regions of mRNA encoded by the pchA gene, corresponding to target binding sites such as BINDING SITE I, BINDING SITE II or BINDING SITE III of FIG. 1. The nucleotide sequences of pchA BINDING SITE 1 and pchA BINDING SITE 2, and the complementary secondary structure to the nucleotide sequence of GAM353678 RNA are set forth in Tables 6-7, hereby incorporated herein. Another function of GAM353678 is to inhibit pchA, a GAM353678 bacterial target gene which is associated with *Pseudomonas aeruginosa* PA01 infection, as part of an anti-bacterial | A |

TABLE 8-continued

| GAM NAME | GAM RNA SEQUENCE | GAM ORGA- NISM | TAR- GET | TARGET ORGANISM | GAM FUNCTION | POS |
|---|---|---|---|---|---|---|
| | | | | | host defense mechanism. Accordingly, the utilities of GAM353678 include the diagnosis, prevention and treatment of *Pseudomonas aeruginosa* PA01 infection and associated clinical conditions | |
| GAM35 3678 | CAGCAGCA CACTGTGG TTTGTA | Human | pcnA | *Mycobacterium leprae* | GAM353678 is a human miRNA-like oligonucleotide, which targets pcnA (pcnA, NC_002677 from 3248268 to 3249728 (−)), a bacterial target gene encoded by the *Mycobacterium leprae* genome, as part of an anti-bacterial host defense mechanism. pcnA BINDING SITE 1 and pcnA BINDING SITE 2 are bacterial target binding sites that are found in the untranslated regions of mRNA encoded by the pcnA gene, corresponding to target binding sites such as BINDING SITE I, BINDING SITE II or BINDING SITE III of FIG. 1. The nucleotide sequences of pcnA BINDING SITE 1 and pcnA BINDING SITE 2, and the complementary secondary structure to the nucleotide sequence of GAM353678 RNA are set forth in Tables 6-7, hereby incorporated herein. Another function of GAM353678 is to inhibit pcnA, a GAM353678 bacterial target gene which is associated with *Mycobacterium leprae* infection, as part of an anti-bacterial host defense mechanism. Accordingly, the utilities of GAM353678 include the diagnosis, prevention and treatment of *Mycobacterium leprae* infection and associated clinical conditions | A |
| GAM35 3678 | CAGCAGCA CACTGTGG TTTGTA | Human | phnV | *Salmonella enterica enterica serovar Typhi* | GAM353678 is a human miRNA-like oligonucleotide, which targets probable membrane component of 2-aminoethylphosphonate transp orter (phnV, NC_003198 from 471575 to 472366 (−)), a bacterial target gene encoded by the *Salmonella enterica enterica serovar Typhi* genome, as part of an anti-bacterial host defense mechanism. phnV BINDING SITE 1 and phnV BINDING SITE 2 are bacterial target binding sites that are found in the untranslated regions of mRNA encoded by the phnV gene, corresponding to target binding sites such as BINDING SITE I, BINDING SITE II or BINDING SITE III of FIG. 1. The nucleotide sequences of phnV BINDING SITE 1 and phnV BINDING SITE 2, and the complementary secondary structure to the nucleotide sequence of GAM353678 RNA are set forth in Tables 6-7, hereby incorporated herein. Another function of GAM353678 is to inhibit phnV, a GAM353678 bacterial target gene which is associated with *Salmonella enterica enterica serovar Typhi* infection, as part of an anti-bacterial host defense mechanism. Accordingly, the utilities of GAM353678 include the diagnosis, prevention and treatment of *Salmonella enterica enterica serovar Typhi* infection and associated clinical conditions | A |
| GAM35 3678 | CAGCAGCA CACTGTGG TTGTA | Human | phnV | *Salmonella enterica enterica serovar Typhi* Ty 2 | GAM353678 is a human miRNA-like oligonucleotide, which targets probable membrane component of 2-aminoethylphosphonate transporter (phnV, NC_004631 from 2508735 to 2509526 (+)), a bacterial target gene encoded by the *Salmonella enterica enterica serovar Typhi* Ty2 genome, as part of an anti-bacterial host defense mechanism. phnV BINDING SITE 1 and phnV BINDING SITE 2 are bacterial target binding sites that are found in the untranslated regions of mRNA | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | encoded by the phnV gene, corresponding to target binding sites such as BINDING SITE I, BINDING SITE II or BINDING SITE III of FIG. 1. The nucleotide sequences of phnV BINDING SITE 1 and phnV BINDING SITE 2, and the complementary secondary structure to the nucleotide sequence of GAM353678 RNA are set forth in Tables 6-7, hereby incorporated herein. Another function of GAM353678 is to inhibit phnV, a GAM353678 bacterial target gene which is associated with *Salmonella enterica enterica serovar Typhi* Ty2 infection, as part of an anti- bacterial host defense mechanism. Accordingly, the utilities of GAM353678 include the diagnosis, prevention and treatment of *Salmonella enterica enterica serovar Typhi* Ty2 infection and associated clinical conditions | |
| GAM35 3678 | CAGCAGCA CACTGTGG TTTGTA | Human | phoY2 | *Mycobacterium bovis* subsp *bovis* AF21 22/97 | GAM353678 is a human miRNA-like oligonucleotide, which targets PROBABLE PHOSPHATE-TRANSPORT SYSTEM TRANSCRIPTIONAL REGULATORY PROTEIN PHOY2 (phoY2, NC_002945 from 914388 to 915029 (−)), a bacterial target gene encoded by the *Mycobacterium bovis* subsp *bovis* AF2122/97 genome, as part of an anti-bacterial host defense mechanism. phoY2 BINDING SITE 1 and phoY2 BINDING SITE 2 are bacterial target binding sites that are found in the untranslated regions of mRNA encoded by the phoY2 gene, corresponding to target binding sites such as BINDING SITE I, BINDING SITE II or BINDING SITE III of FIG. 1. The nucleotide sequences of phoY2 BINDING SITE 1 and phoY2 BINDING SITE 2, and the complementary secondary structure to the nucleotide sequence of GAM353678 RNA are set forth in Tables 6-7, hereby incorporated herein. Another function of GAM353678 is to inhibit phoY2, a GAM353678 bacterial target gene which is associated with *Mycobacterium bovis* subsp *bovis* AF2122/97 infection, as part of an anti- bacterial host defense mechanism. Accordingly, the utilities of GAM353678 include the diagnosis, prevention and treatment of *Mycobacterium bovis* subsp *bovis* AF2122/97 infection and associated clinical conditions | A |
| GAM35 3678 | CAGCAGCA CACTGTGG TTTGTA | Human | phoY2 | *Mycobacterium tubrculosis* H37Rv | GAM353678 is a human miRNA-like oligonucleotide, which targets phoY2 (phoY2, NC_000962 from 913556 to 914197 (−)), a bacterial target gene encoded by the *Mycobacterium tuberculosis* H37Rv genome, as part of an anti-bacterial host defense mechanism. phoY2 BINDING SITE 1 and phoY2 BINDING SITE 2 are bacterial target binding sites that are found in the untranslated regions of mRNA encoded by the phoY2 gene, corresponding to target binding sites such as BINDING SITE I, BINDING SITE II or BINDING SITE III of FIG. 1. The nucleotide sequences of phoY2 BINDING SITE 1 and phoY2 BINDING SITE 2, and the complementary secondary structure to the nucleotide sequence of GAM353678 RNA are set forth in Tables 6-7, hereby incorporated herein. Another function of GAM353678 is to inhibit phoY2, a GAM353678 bacterial target gene which is associated with *Mycobacterium tuberculosis* H37Rv infection, as part of an anti-bacterial host defense mechanism. Accordingly, the utilities of GAM353678 include the diagnosis, prevention and treatment of | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| GAM35 3678 | CAGCAGCA CACTGTGG TTTGTA | Human | pilT | *Pseudomonas putida* KT2440 | *Mycobacterium tuberculosis* H37Rv infection and associated clinical conditions GAM353678 is a human miRNA-like oligonucleotide, which targets type IV pili twitching motility protein PilT (pilT, NC_002947 from 5816934 to 5817944 (−)), a bacterial target gene encoded by the *Pseudomonas putida* KT2440 genome, as part of an anti-bacterial host defense mechanism. pilT BINDING SITE 1 through pilT BINDING SITE 3 are bacterial target binding sites that are found in the untranslated regions of mRNA encoded by the pilT gene, corresponding to target binding sites such as BINDING SITE I, BINDING SITE II or BINDING SITE III of FIG. 1. The nucleotide sequences of pilT BINDING SITE 1 through pilT BINDING SITE 3, and the complementary secondary structure to the nucleotide sequence of GAM353678 RNA are set forth in Tables 6-7, hereby incorporated herein. Another function of GAM353678 is to inhibit pilT, a GAM353678 bacterial target gene which is associated with *Pseudomonas putida* KT2440 infection, as part of an anti-bacterial host defense mechanism. Accordingly, the utilities of GAM353678 include the diagnosis, prevention and treatment of *Pseudomonas putida* KT2440 infection and associated clinical conditions | A |
| GAM35 3678 | CAGCAGCA CACTGTGG TTTGTA | Human | polA | *Mycobacterium leprae* | GAM353678 is a human miRNA-like oligonucleotide, which targets DNA polymerase I (polA, NC_002677 from 1648220 to 1650955 (−)), a bacterial target gene encoded by the *Mycobacterium leprae* genome, as part of an anti-bacterial host defense mechanism. polA BINDING SITE 1 and polA BINDING SITE 2 are bacterial target binding sites that are found in the untranslated regions of mRNA encoded by the polA gene, corresponding to target binding sites such as BINDING SITE I, BINDING SITE II or BINDING SITE III of FIG. 1. The nucleotide sequences of polA BINDING SITE 1 and polA BINDING SITE 2, and the complementary secondary structure to the nucleotide sequence of GAM353678 RNA are set forth in Tables 6-7, hereby incorporated herein. Another function of GAM353678 is to inhibit polA, a GAM353678 bacterial target gene which is associated with *Mycobacterium leprae* infection, as part of an anti-bacterial host defense mechanism. Accordingly, the utilities of GAM353678 include the diagnosis, prevention and treatment of *Mycobacterium leprae* infection and associated clinical conditions | A |
| GAM35 3678 | CAGCAGCA CACTGTGG TTTGTA | Human | prcA | *Mycobacterium leprae* | GAM353678 is a human miRNA-like oligonucleotide, which targets proteasome [alpha]-type subunit 1 (prcA, NC_002677 from 1576553 to 1577350 (+)), a bacterial target gene encoded by the *Mycobacterium leprae* genome, as part of an anti-bacterial host defense mechanism. prcA BINDING SITE 1 and prcA BINDING SITE 2 are bacterial target binding sites that are found in the untranslated regions of mRNA encoded by the prcA gene, corresponding to target binding sites such as BINDING SITE I, BINDING SITE II or BINDING SITE III of FIG. 1. The nucleotide sequences of prcA BINDING SITE 1 and prcA BINDING SITE 2, and the complementary secondary structure to the | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | nucleotide sequence of GAM353678 RNA are set forth in Tables 6-7, hereby incorporated herein. Another function of GAM353678 is to inhibit prcA, a GAM353678 bacterial target gene which is associated with *Mycobacterium leprae* infection, as part of an anti-bacterial host defense mechanism. Accordingly, the utilities of GAM353678 include the diagnosis, prevention and treatment of *Mycobacterium leprae* infection and associated clinical conditions | |
| GAM35 3678 | CAGCAGCA CACTGTGG TTTGTA | Human | pta | *Pseudomonas putida* KT2440 | GAM353678 is a human miRNA-like oligonucleotide, which targets phosphate acetyltransferase (pta, NC_002947 from 891625 to 893712 (−)), a bacterial target gene encoded by the *Pseudomonas putida* KT2440 genome, as part of an anti-bacterial host defense mechanism. pta BINDING SITE 1 and pta BINDING SITE 2 are bacterial target binding sites that are found in the untranslated regions of mRNA encoded by the pta gene, corresponding to target binding sites such as BINDING SITE I, BINDING SITE II or BINDING SITE III of FIG. 1. The nucleotide sequences of pta BINDING SITE 1 and pta BINDING SITE 2, and the complementary secondary structure to the nucleotide sequence of GAM353678 RNA are set forth i n Tables 6-7, hereby incorporated herein. Another function of GAM353678 is to inhibit pta, a GAM353678 bacterial target gene which is associated with *Pseudomonas putida* KT2440 infection, as part of an anti-bacterial host defense mechanism. Accordingly, the utilities of GAM353678 include the diagnosis, prevention and treatment of *Pseudomonas putida* KT2440 infection and associated clinical conditions | A |
| GAM35 3678 | CAGCAGCA CACTGTGG TTTGTA | Human | ptsH | *Salmonella enterica enterica serovar Typhi* | GAM353678 is a human miRNA-like oligonucleotide, which targets phosphocarrier protein HPr (ptsH, NC_003198 from 2505403 to 2505660 (+)), a bacterial target gene encoded by the *Salmonella enterica enterica serovar Typhi* genome, as part of an anti-bacterial host defense mechanism. ptsH BINDING SITE is a bacterial target binding site that is a found in the the 3' untranslated region of mRNA encoded by the ptsH gene, corresponding to a target binding site such as BINDING SITE I, BINDING SITE II or BINDING SITE III of FIG. 1. The nucleotide sequences of ptsH BINDING SITE, and the complementary secondary structure to the nucleotide sequence of GAM353678 RNA are set forth in Tables 6-7, hereby incorporated herein. Another function of GAM353678 is to inhibit ptsH, a GAM353678 bacterial target gene which is associated with *Salmonella enterica enterica serovar Typhi* infection, as part of an anti-bacterial host defense mechanism. Accordingly, the utilities of GAM353678 include the diagnosis, prevention and treatment of *Salmonella enterica enterica serovar Typhi* infection and associated clinical conditions | A |
| GAM35 3678 | CAGCAGCA CACTGTGG TTTGTA | Human | rbsR | *Shigella flexneri* 2a str. 3 01 | GAM353678 is a human miRNA-like oligonucleotide, which targets regulator for rbs operon (rbsR, NC_004337 from 3947708 to 3 948700 (+)), a bacterial target gene encoded by the *Shigella flexneri* 2a str. 301 genome, as part of an anti-bacterial host defense mechanism. | A |

TABLE 8-continued

| GAM NAME | GAM RNA SEQUENCE | GAM ORGA-NISM | TAR-GET | TARGET ORGANISM | GAM GAM FUNCTION | POS |
|---|---|---|---|---|---|---|
| | | | | | rbsR BINDING SITE 1 through rbsR BINDING SITE 3 are bacterial target binding sites that are found in the untranslated regions of mRNA encoded by the rbsR gene, corresponding to target binding sites such as BINDING SITE I, BINDING SITE II or BINDING SITE III of FIG. 1. The nucleotide sequences of rbsR BINDING SITE 1 through rbsR BINDING SITE 3, and the complementary secondary structure to the nucleotide sequence of GAM353678 RNA are set forth in Tables 6-7, hereby incorporated herein. Another function of GAM353678 is to inhibit rbsR, a GAM353678 bacterial target gene which is associated with *Shigella flexneri* 2a str. 301 infection, as part of an anti-bacterial host defense mechanism. Accordingly, the utilities of GAM353678 include the diagnosis, prevention and treatment of *Shigella flexneri* 2a str. 301 infection and associated clinical conditions | |
| GAM353678 | CAGCAGCACACTGTGGTTTGTA | Human | rbsR | *Shigella flexneri* 2a str. 2457T | GAM353678 is a human miRNA-like oligonucleotide, which targets regulator for rbs operon (rbsR, NC_004741 from 3824594 to 3825577 (−)), a bacterial target gene encoded by the *Shigella flexneri* 2a str. 2457T genome, as part of an anti-bacterial host defense mechanism. rbsR BINDING SITE 1 through rbsR BINDING SITE 3 are bacterial target binding sites that are found in the untranslated regions of mRNA encoded by the rbsR gene, corresponding to target binding sites such as BINDING SITE I, BINDING SITE II or BINDING SITE III of FIG. 1. The nucleotide sequences of rbsR BINDING SITE 1 through rbsR BINDING SITE 3, and the complementary secondary structure to the nucleotide sequence of GAM353678 RNA are set forth in Tables 6-7, hereby incorporated herein. Another function of GAM353678 is to inhibit rbsR, a GAM353678 bacterial target gene which is associated with *Shigella flexneri* 2a str. 2457T infection, as part of an anti-bacterial host defense mechanism. Accordingly, the utilities of GAM353678 include the diagnosis, prevention and treatment of *Shigella flexneri* 2a str. 2457T infection and associated clinical conditions | A |
| GAM353678 | CAGCAGCACACTGTGGTTTGTA | Human | rbsR | *Escherichia coli* CFT073 | GAM353678 is a human miRNA-like oligonucleotide, which targets Ribose operon repressor (rbsR, NC_004431 from 4439260 to 4440252 (+)), a bacterial target gene encoded by the *Escherichia coli* CFT073 genome, as part of an anti-bacterial host defense mechanism. rbsR BINDING SITE 1 through rbsR BINDING SITE 3 are bacterial target binding sites that are found in the untranslated regions of mRNA encoded by the rbsR gene, corresponding to target binding sites such as BINDING SITE I, BINDING SITE II or BINDING SITE III of FIG.l. The nucleotide sequences of rbsR BINDING SITE 1 through rbsR BINDING SITE 3, and the complementary secondary structure to the nucleotide sequence of GAM353678 RNA are set forth in Tables 6-7, hereby incorporated herein. Another function of GAM353678 is to inhibit rbsR, a GAM353678 bacterial target gene which is associated with *Escherichia coli* CFT073 infection, as part of an anti-bacterial host defense mechanism. Accordingly, the utilities of GAM353678 | |

TABLE 8-continued

| GAM NAME | GAM RNA SEQUENCE | GAM ORGA-NISM | TAR-GET | TARGET ORGANISM | GAM GAM FUNCTION | POS |
|---|---|---|---|---|---|---|
| | | | | | include the diagnosis, prevention and treatment of *Escherichia coli* CFT073 infection and associated clinical conditions | |
| GAM35 3678 | CAGCAGCA CACTGTGG TTTGTA | Human | recG | *Mycobacterium leprae* | GAM353678 is a human miRNA-like oligonucleotide, which targets ATP-dependent DNA helicase (recG, NC_002677 from 2014723 to 2016954 (−)), a bacterial target gene encoded by the *Mycobacterium leprae* genome, as part of an anti-bacterial host defense mechanism. recG BINDING SITE 1 and recG BINDING SITE 2 are bacterial target binding sites that are found in the untranslated regions of mRNA encoded by the recG gene, corresponding to target binding sites such as BINDING SITE I, BINDING SITE II or BINDING SITE III of FIG. 1. The nucleotide sequences of recG BINDING SITE 1 and recG BINDING SITE 2, and the complementary secondary structure to the nucleotide sequence of GAM353678 RNA are set forth in Tables 6-7, hereby incorporated herein. Another function of GAM353678 is to inhibit recG, a GAM353678 bacterial target gene which is associated with *Mycobacterium leprae* infection, as part of an anti-bacterial host defense mechanism. Accordingly, the utilities of GAM353678 include the diagnosis, prevention and treatment of *Mycobacterium leprae* infection and associated clinical conditions | A |
| GAM35 3678 | CAGCAGCA CACTGTGG TTTGTA | Human | relA | *Mycobacterium bovis* subsp *bovis* AF21 22/97 | GAM353678 is a human miRNA-like oligonucleotide, which targets PROBABLE GTP PYROPHOSPHOKINASE RELA (ATP:GTP 3'-PYROPHOSPHOTR ANSFERASE) (PPGPP SYNTHETASE I) ((P)PPGPP SYNTHETASE) (GTP DIPHOSPHOKINASE) (relA, NC_002945 from 2875274 to 2877646 (−) ), a bacterial target gene encoded by the *Mycobacterium bovis* subsp *bovis* AF2122/97 genome, as part of an anti-bacterial host defense mechanism. relA BINDING SITE 1 and relA BINDING SITE 2 are bacterial target binding sites that are found in the untranslated regions of mRNA encoded by the relA gene, corresponding to target binding sites such as BINDING SITE I, BINDING SITE II or BINDING SITE III of FIG. 1. The nucleotide sequences of relA BINDING SITE 1 and relA BINDING SITE 2, and the complementary secondary structure to the nucleotide sequence of GAM353678 RNA are set forth in Tables 6-7, hereby incorporated herein. Another function of GAM353678 is to inhibit relA, a GAM353678 bacterial target gene which is associated with *Mycobacterium bovis* subsp *bovis* AF2122/97 infection, as part of an anti-bacterial host defense mechanism. Accordingly, the utilities of GAM353678 include the diagnosis, prevention and treatment of *Mycobacterium bovis* subsp *bovis* AF2122/97 infection and associated clinical conditions | A |
| GAM35 3678 | CAGCAGCA CACTGTGG TTTGTA | Human | relA | *Mycobacterium tuberculosis* H37Rv | GAM353678 is a human miRNA-like oligonucleotide, which targets relA (relA, NC_000962 from 2907824 to 2910196 (−)), a bacterial target gene encoded by the *Mycobacterium tuberculosis* H37Rv genome, as part of an anti-bacterial host defense mechanism. relA BINDING SITE 1 and relA BINDING SITE 2 are bacterial target binding sites that are found in the untranslated regions of mRNA encoded by | A |

TABLE 8-continued

| GAM NAME | GAM RNA SEQUENCE | GAM ORGA-NISM | TAR-GET | TARGET ORGANISM | GAM GAM FUNCTION | POS |
|---|---|---|---|---|---|---|
| | | | | | the relA gene, corresponding to target binding sites such as BINDING SITE I, BINDING SITE II or BINDING SITE III of FIG. 1. The nucleotide sequences of relA BINDING SITE 1 and relA BINDING SITE 2, and the complementary secondary structure to the nucleotide sequence of GAM353678 RNA are set forth in Tables 6-7, hereby incorporated herein. Another function of GAM353678 is to inhibit relA, a GAM353678 bacterial target gene which is associated with *Mycobacterium tuberculosis* H37Rv infection, as part of an anti-bacterial host defense mechanism. Accordingly, the utilities of GAM353678 in clude the diagnosis, prevention and treatment of *Mycobacterium tuberculosis* H37Rv infection and associated clinical conditions | |
| GAM35 3678 | CAGCAGCA CACTGTGG TTTGTA | Human | risA | *Bordetella pertussis* | GAM353678 is a human miRNA-like oligonucleotide, which targets tresponse regulator protein (risA, NC_002929 from 3765257 to 3765991 (−)), a bacterial target gene encoded by the *Bordetella pertussis* genome, as part of an anti-bacterial host defense mechanism. risA BINDING SITE 1 and risA BINDING SITE 2 are bacterial target binding sites that are found in the untranslated regions of mRNA encoded by the risA gene, corresponding to target binding sites such as BINDING SITE I, BINDING SITE II or BINDING SITE III of FIG. 1. The nucleotide sequences of risA BINDING SITE 1 and risA BINDING SITE 2, and the complementary secondary structure to the nucleotide sequence of GAM353678 RNA are set forth in Tables 6-7, hereby incorporated herein. Another function of GAM353678 is to inhibit risA, a GAM353678 bacterial target gene which is associated with *Bordetella pertussis* infection, as part of an anti-bacterial host defense mechanism. Accordingly, the utilities of GAM353678 include the diagnosis, prevention and treatment of *Bordetella pertussis* infection and associated clinical conditions | A |
| GAM35 3678 | CAGCAGCA CACTGTGG TTTGTA | Human | rpsT | *Pseudomonas putida* KT2440 | GAM353678 is a human miRNA-like oligonucleotide, which targets ribosomal protein S20 (rpsT, NC_002947 from 707068 to 707346 (−)), a bacterial target gene encoded by the *Pseudomonas putida* KT2440 genome, as part of an anti-bacterial host defense mechanism. rpsT BINDING SITE 1 and rpsT BINDING SITE 2 are bacterial target binding sites that are found in the untranslated regions of mRNA encoded by the rpsT gene, corresponding to target binding sites such as BINDING SITE I, BINDING SITE II or BINDING SITE III of FIG. 1. The nucleotide sequences of rpsT BINDING SITE 1 and rpsT BINDING SITE 2, and the complementary secondary structure to the nucleotide sequence of GAM353678 RNA are set forth in Tables 6-7, hereby incorporated herein. Another function of GAM353678 is to inhibit rpsT, a GAM353678 bacterial target gene which is associated with *Pseudomonas putida* KT2440 infection, as part of an anti-bacterial host defense mechanism. Accordingly, the utilities of GAM353678 include the diagnosis, prevention and treatment of *Pseudomonas putida* KT2440 infection and associated clinical conditions | A |

TABLE 8-continued

| GAM NAME | GAM RNA SEQUENCE | GAM ORGANISM | TARGET | TARGET ORGANISM | GAM FUNCTION | POS |
|---|---|---|---|---|---|---|
| GAM35 3678 | CAGCAGCA CACTGTGG TTTGTA | Human | ruvB | *Yersinia pestis* | GAM353678 is a human miRNA-like oligonucleotide, which targets Holliday Junction DNA helicase (ruvB, NC_003143 from 2336449 to 2337453 (+)), a bacterial target gene enc

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | inhibit selB, a GAM353678 bacterial target gene which is associated with *Pseudomonas putida* KT2440 infection, as part of an anti-bacterial host defense mechanism. Accordingly, the utilities of GAM353678 include the diagnosis, prevention and treatment of *Pseudomonas putida* KT2440 infection and associated clinical conditions | |
| GAM35 3678 | CAGCAGCA CACTGTGG TTTGTA | Human | SERPI NH1 | Human | GAM353678 is a human miRNA-like oligonucleotide, which targets a human Serine proteinase inhibitor clade H (heat shock protein 47) member 1; (SERPINH1, Accession number: NM_001235) as part of a host response mechanism associated with a *Escherichia coli* CFT073, *Streptococcus pneumoniae* R6, *Streptococcus pneumoniae* TIGR4, *Streptococcus pyogenes* M1 GAS, *Streptococcus pyogenes* MGAS315, *Streptococcus pyogenes* MGAS8232 and *Streptococcus pyogenes* SSI-1 infections. SERPINH1 BINDING SITE 1 and SERPINH1 BINDING SITE 2 are human target binding sites that are found in the untranslated regions of mRNA encoded by the SERPINH1 gene, corresponding to target binding sites such as BINDING SITE I, BINDING SITE II or BINDING SITE III of FIG. 1. Additionally, using the binding site prediction system of the present invention GAM353678-A binds to sequences on orthologous UTR of rat(NM_017173). The nucleotide sequences of SERPINH1 BINDING SITE 1 and SERPINH1 BINDING SITE 2, and the complementary secondary structure to the nucleotide sequence of GAM353678 RNA are set forth in Tables 6-7, hereby incorporated herein. Another function of GAM353678 is to inhibit SERPINH1, a GAM353678 human target gene which encodes a heat shock protein and serpin, that may function as a chaperone for procollagen in the ER. SERPINH1 is associated with *Escherichia coli* CFT073, *Streptococcus pneumoniae* R6, *Streptococcus pneumoniae* TIGR4, *Streptococcus pyogenes* M1 GAS, *Streptococcus pyogenes* MGAS315, *Streptococcus pyogenes* MGAS8232 and *Streptococcus pyogenes* SSI-1 infections, and therefore GAM353678 is associated with the above mentioned infections, as part of a host response mechanism. Accordingly, the utilities of GAM353678 include the diagnosis, prevention and treatment of *Escherichia coli* CFT073, *Streptocoecus pneumoniae* R6, *Streptococcus pneumoniae* TIGR4, *Streptococcus pyogenes* M1 GAS, *Streptococcus pyogenes* MGAS315, *Streptocoecus pyogenes* MGAS8232 and *Streptococcus pyogenes* SSI-1 infections and associated clinical conditions. The function of SERPINH1 and its association with various diseases and clinical conditions has been established by previous studies, as described hereinabove with reference to GAM839. | A |
| GAM35 3678 | CAGCAGCA CACTGTGG TTTGTA | Human | sitD | *Shigella flexneri* 2a str. 301 | GAM353678 is a human miRNA-like oligonucleotide, which targets Iron transport protein, inner membrane component (sitD, NC_004337 from 1405360 to 1406217 (−)), a bacterial target gene encoded by the *Shigella flexneri* 2a str. 301 genome, as part of an anti-bacterial host defense mechanism. sitD BINDING SITE 1 and sitD BINDING SITE 2 are bacterial target binding sites that are found in | A |

TABLE 8-continued

| GAM NAME | GAM RNA SEQUENCE | GAM ORGA-NISM | TAR-GET | TARGET ORGANISM | GAM GAM FUNCTION | POS |
|---|---|---|---|---|---|---|
| | | | | | the untranslated regions of mRNA encoded by the sitD gene, corresponding to target binding sites such as BINDING SITE I, BINDING SITE II or BINDING SITE III of FIG. 1. The nucleotide sequences of sitD BINDING SITE 1 and sitD BINDING SITE 2, and the complementary secondary structure to the nucleotide sequence of GAM353678 RNA are set forth in Tables 6-7, hereby incorporated herein. Another function of GAM353678 is to inhibit sitD, a GAM353678 bacterial target gene which is associated with *Shigella flexneri* 2a str. 301 infection, as part of an anti-bacterial host defense mechanism. Accordingly, the utilities of GAM353678 include the diagnosis, prevention and treatment of *Shigella flexneri* 2a str. 301 infection and associated clinical conditions | |
| GAM353678 | CAGCAGCACACTGTGGTTTGTA | Human | sitD | *Shigella flexneri* 2a str. 2457T | GAM353678 is a human miRNA-like oligonucleotide, which targets Iron transport protein, inner membrane component (sitD, NC_004741 from 1904666 to 1905523 (+)), a bacterial target gene encoded by the *Shigella flexneri* 2a str. 2457T genome, as part of an anti-bacterial host defense mechanism. sitD BINDING SITE 1 and sitD BINDING SITE 2 are bacterial target binding sites that are found in the untranslated regions of mRNA encoded by the sitD gene, corresponding to target binding sites such as BINDING SITE I, BINDING SITE II or BINDING SITE III of FIG. 1. The nucleotide sequences of sitD BINDING SITE 1 and sitD BINDING SITE 2, and the complementary secondary structure to the nucleotide sequence of GAM353678 RNA are set forth in Tables 6-7, hereby incorporated herein. Another function of GAM353678 is to inhibit sitD, a GAM353678 bacterial target gene which is associated with *Shigella flexneri* 2a str. 2457T infection, as part of an anti-bacterial host defense mechanism. Accordingly, the utilities of GAM353678 include the diagnosis, prevention and treatment of *Shigella flexneri* 2a str. 2457T infection and associated clinical conditions | A |
| GAM353678 | CAGCAGCACACTGTGGTTTGTA | Human | speD | *Salmonella enterica enterica serovar Typhi* Ty2 | GAM353678 is a human miRNA-like oligonucleotide, which targets S-adenosylmethionine decarboxylase proenzyme (speD, NC_004631 from 196380 to 197174 (−)), a bacterial target gene encoded by the *Salmonella enterica enterica serovar Typhi* Ty2 genome, as part of an anti-bacterial host defense mechanism. speD BINDING SITE 1 and speD BINDING SITE 2 are bacterial target binding sites that are found in the untranslated regions of mRNA encoded by the speD gene, corresponding to target binding sites such as BINDING SITE I, BINDING SITE II or BINDING SITE III of FIG. 1. The nucleotide sequences of speD BINDING SITE 1 and speD BINDING SITE 2, and the complementary secondary structure to the nucleotide sequence of GAM353678 RNA are set forth in Tables 6-7, hereby incorporated herein. Another function of GAM353678 is to inhibit speD, a GAM353678 bacterial target gene which is associated withi Salmonella enterica enterica serovar *Typhi* Ty2 infection, as part of an anti-bacterial host defense mechanism. Accordingly, the utilities of GAM353678 include the diagnosis, prevention and treatment of *Salmonella enterica enterica* | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | *serovar Typhi* Ty2 infection and associated clinical conditions | |
| GAM35 3678 | CAGCAGCA CACTGTGG TTTGTA | Human | speD | *Salmonella enterica enterica serovar Typhi* | GAM353678 is a human miRNA-like oligonucleotide, which targets S-adenosylmethionine decarboxylase proenzyme (speD, NC_003198 from 196389 to 197183 (−)), a bacterial target gene encoded by the *Salmonella enterica enterica serovar Typhi* genome, as part of an anti-bacterial host defense mechanism. speD BINDING SITE 1 and speD BINDING SITE 2 are bacterial target binding sites that are found in the untranslated regions of mRNA encoded by the speD gene, corresponding to target binding sites such as BINDING SITE I, BINDING SITE II or BINDING SITE III of FIG. 1. The nucleotide sequences of speD BINDING SITE 1 and speD BINDING SITE 2, and the complementary secondary structure to the nucleotide sequence of GAM353678 RNA are set forth in Tables 6-7, hereby incorporated herein. Another function of GAM353678 is to inhibit speD, a GAM353678 bacterial target gene which is associated with *Salmonella enterica enterica serovar Typhi* infection, as part of an anti-bacterial host defense mechanism. Accordingly, the utilities of GAM353678 include the diagnosis, prevention and treatment of *Salmonella enterica enterica serovar Typhi* infection and associated clinical conditions | A |
| GAM35 3678 | CAGCAGCA CACTGTGG TTTGTA | Human | speD | *Salmonella typhimurium* LT2 | GAM353678 is a human miRNA-like oligonucleotide, which targets S-adenosylmethionine decarboxylase (speD, NC_003197 from 194201 to 194995 (−)), a bacterial target gene encoded by the *Salmonella typhimurium* LT2 genome, as part of an anti-bacterial host defense mechanism. speD BINDING SITE 1 and speD BINDING SITE 2 are bacterial target binding sites that are found in the untranslated regions of mRNA encoded by the speD gene, corresponding to target binding sites such as BINDING SITE I, BINDING SITE II or BINDING SITE III of FIG. 1. The nucleotide sequences of speD BINDING SITE 1 and speD BINDING SITE 2, and the complementary secondary structure to the nucleotide sequence of GAM353678 RNA are set forth in Tables 6-7, hereby incorporated herein. Another function of GAM353678 is to inhibit speD, a GAM353678 bacterial target gene which is associated with *Salmonella typhimurium* LT2 infection, as part of an anti-bacterial host defense mechanism. Accordingly, the utilities of GAM353678 include the diagnosis, prevention and treatment of *Salmonella typhimurium* LT2 infection and associated clinical conditions | A |
| GAM35 3678 | CAGCAGCA CACTGTGG TTTGTA | Human | ssb | *Pseudomonas putida* KT2440 | GAM353678 is a human miRNA-like oligonucleotide, which targets single-stranded DNA-binding protein (ssb, NC_002947 from 571027 to 571572 (+)), a bacterial target gene encoded by the *Pseudomonas putida* KT2440 genome, as part of an anti-bacterial host defense mechanism. ssb BINDING SITE 1 and ssb BINDING SITE 2 are bacterial target binding sites that are found in the untranslated regions of m RNA encoded by the ssb gene, corresponding to target binding sites such as BINDING SITE I, BINDING SITE II or BINDING SITE III of FIG. 1. The nucleotide sequences of ssb | A |

TABLE 8-continued

| GAM NAME | GAM RNA SEQUENCE | GAM ORGA-NISM | TAR-GET | TARGET ORGANISM | GAM GAM FUNCTION | POS |
|---|---|---|---|---|---|---|
| | | | | | BINDING SITE 1 and ssb BINDING SITE 2, and the complementary secondary structure to the nucleotide sequence of GAM353678 RNA are set forth in Tables 6-7, hereby incorporated herein. Another function of GAM353678 is to inhibit ssb, a GAM353678 bacterial target gene which is associated with *Pseudomonas putida* KT2440 infection, as part of an anti-bacterial host defense mechanism. Accordingly, the utilities of GAM353678 include the diagnosis, prevention and treatment of *Pseudomonas putida* KT2440 infection and associated clinical conditions | |
| GAM35 3678 | CAGCAGCA CACTGTGG TTTGTA | Human | sseB | *Escherichia coli* CFT073 | GAM353678 is a human miRNA-like oligonucleotide, which targets Protein sseB (sseB, NC_004431 from 2922456 to 2923241 (−) ), a bacterial target gene encoded by the *Escherichia coli* CFT073 genome, as part of an anti-bacterial host defense mechanism. sseB BINDING SITE 1 and sseB BINDING SITE 2 are bacterial target binding sites that are found in the untranslated regions of mRNA encoded by the sseB gene, corresponding to target binding sites such as BINDING SITE I, BINDING SITE II or BINDING SITE III of FIG. 1. The nucleotide sequences of sseB BINDING SITE 1 and sseB BINDING SITE 2, and the complementary secondary structure to the nucleotide sequence of GAM353678 RNA are set forth in Tables 6-7, hereby incorporated herein. Another function of GAM353678 is to inhibit sseB, a GAM353678 bacterial target gene which is associated with *Escherichia coli* CFT073 infection, as part of an anti-bacterial host defense mechanism. Accordingly, the utilities of GAM353678 include the diagnosis, prevention and treatment of *Escherichia coli* CFT073 infection and associated clinical conditions | A |
| GAM35 3678 | CAGCAGCA CACTGTGG TTTGTA | Human | tcfA | *Bordetella pertussis* | GAM353678 is a human miRNA-like oligonucleotide, which targets tracheal colonization factor precursor (tcfA, NC_002929 from 1264436 to 1266379 (+)), a bacterial target gene encoded by the *Bordetella pertussis* genome, as part of an anti-bacterial host defense mechanism. tcfA BINDING SITE 1 and tcfA BINDING SITE 2 are bacterial target binding sites that are found in the untranslated regions of mRNA encoded by the tcfA gene, corresponding to target binding sites such as BINDING SITE I, BINDING SITE II or BINDING SITE III of FIG. 1. The nucleotide sequences of tcfA BINDING SITE 1 and tcfA BINDING SITE 2, and the complementary secondary structure to the nucleotide sequence of GAM353678 RNA are set forth in Tables 6-7, hereby incorporated herein. Another function of GAM353678 is to inhibit tcfA, a GAM353678 bacterial target gene which is associated with *Bordetella pertussis* infection, as part of an anti-bacterial host defense mechanism. Accordingly, the utilities of GAM353678 include the diagnosis, prevention and treatment of *Bordetella pertussis* infection and associated clinical conditions | A |
| GAM35 3678 | CAGCAGCA CACTGTGG TTTGTA | Human | truA | *Mycobacterium leprae* | GAM353678 is a human miRNA-like oligonucleotide, which targets probable pseudouridylate synthase (truA, NC_002677 from 2343329 to 2344078 (−)), a bacterial target gene encoded by the | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | *Mycobacterium leprae* genome, as part of an anti-bacterial host defense mechanism. truA BINDING SITE 1 and truA BINDING SITE 2 are bacterial target binding sites that are found in the untranslated regions of mRNA encoded by the truA gene, corresponding to target binding sites such as BINDING SITE I, BINDING SITE II or BINDING SITE III of FIG. 1. The nucleotide sequences of truA BINDING SITE 1 and truA BINDING SITE 2, and the complementary secondary structure to the nucleotide sequence of GAM353678 RNA are set forth in Tables 6-7, hereby incorporated herein. Another function of GAM353678 is to inhibit truA, a GAM353678 bacterial target gene which is associated with *Mycobacterium leprae* infection, as part of an anti-bacterial host defense mechanism. Accordingly, the utilities of GAM353678 include the diagnosis, prevention and treatment of *Mycobacterium leprae* infection and associated clinical conditions | |
| GAM35 3678 | CAGCAGCA CACTGTGG TTTGTA | Human | trunc ated fmtB | *Staphylococcus aureus* subsp. MW2 | GAM353678 is a human miRNA-like oligonucleotide, which targets truncated FmtB protein (truncated fmtB, NC_003923 *aureus* from 2238083 to 2240143 (−)), a bacterial target gene encoded by the *Staphylococcus aureus* subsp. *aureus* MW2 genome, as part of an anti-bacterial host defense mechanism. truncated fmtB BINDING SITE 1 and truncated fmtB BINDING SITE 2 are bacterial target binding sites that are found in the untranslated regions of mRNA encoded by the truncated fmtB gene, corresponding to target binding sites such as BINDING SITE I, BINDING SITE II or BINDING SITE III of FIG. 1. The nucleotide sequences of truncated fmtB BINDING SITE 1 and truncated fmtB BINDING SITE 2, and the complementary secondary structure to the nucleotide sequence of GAM353678 RNA are set forth in Table s 6-7, hereby incorporated herein. Another function of GAM353678 is to inhibit truncated fmtB, a GAM353678 bacterial target gene which is associated with *Staphylococcus aureus* subsp. *aureus* MW2 infection, as part of an anti-bacterial host defense mechanism. Accordingly, the utilities of GAM353678 include the diagnosis, prevention and treatment of *Staphylococcus aureus* subsp. *aureus* MW2 infection and associated clinical conditions | A |
| GAM35 3678 | CAGCAGCA CACTGTGG TTTGTA | Human | uhpA | *Yersinia pestis* | GAM353678 is a human miRNA-like oligonucleotide, which targets two- component system response regulator (uhpA, NC_003143 from 4522790 to 4523380 (−)), a bacterial target gene encoded by the *Yersinia pestis* genome, as part of an anti-bacterial host defense mechanism. uhpA BINDING SITE 1 and uhpA BINDING SITE 2 are bacterial target binding sites that are found in the untranslated regions of mRNA encoded by the uhpA gene, corresponding to target binding sites such as BINDING SITE I, BINDING SITE II or BINDING SITE III of FIG. 1. The nucleotide sequences of uhpA BINDING SITE 1 and uhpA BINDING SITE 2, and the complementary secondary structure to the nucleotide sequence of GAM353678 RNA are set forth in Tables 6-7, hereby incorporated herein. Another function of GAM353678 is to inhibit uhpA, a GAM353678 | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| | | | | | bacterial target gene which is associated with *Yersinia pestis* infection, as part of an anti-bacterial host defense mechanism. Accordingly, the utilities of GAM353678 include the diagnosis, prevention and treatment of *Yersinia pestis* infection and associated clinical conditions | |
| GAM35 3678 | CAGCAGCA CACTGTGG TTTGTA | Human | ung | *Haemophilus influenzae* Rd | GAM353678 is a human miRNA-like oligonucleotide, which targets uracil DNA glycosylase (ung, NC_000907 from 18676 to 19335 (+)), a bacterial target gene encoded by the *Haemophilus influenzae* Rd genome, as part of an anti-bacterial host defense mechanism. ung BINDING SITE 1 and ung BINDING SITE 2 are bacterial target binding sites that are found in the untranslated regions of mRNA encoded by the ung gene, corresponding to target binding sites such as BINDING SITE I, BINDING SITE II or BINDING SITE III of FIG. 1. The nucleotide sequences of ung BINDING SITE 1 and ung BINDING SITE 2, and the complementary secondary structure to the nucleotide sequence of GAM353678 RNA are set forth in Tables 6-7, hereby incorporated herein. Another function of GAM353678 is to inhibit ung, a GAM353678 bacterial target gene which is associated with *Haemophilus influenzae* Rd infection, as part of an anti-bacterial host defense mechanism. Accordingly, the utilities of GAM353678 include the diagnosis, prevention and treatment of *Haemophilus influenzae* Rd infection and associated clinical conditions | A |
| GAM35 3678 | CAGCAGCA CACTGTGG TTTGTA | Human | vanB | *Pseudomonas aeruginosa* PA01 | GAM353678 is a human miRNA-like oligonucleotide, which targets vanillate O-demethylase oxidoreductase (vanB, NC_002516 from 5504120 to 5505073 (+)), a bacterial target gene encoded by the *Pseudomonas aeruginosa* PA01 genome, as part of an anti-bacterial host defense mechanism. vanB BINDING SITE 1 and vanB BINDING SITE 2 are bacterial target binding sites that are found in the untranslated regions of mRNA encoded by the vanB gene, corresponding to target binding sites such as BINDING SITE I, BINDING SITE II or BINDING SITE III of FIG. 1. The nucleotide sequences of vanB BINDING SITE 1 and vanB BINDING SITE 2, and the complementary secondary structure to the nucleotide sequence of GAM353678 RNA are set forth in Tables 6-7, hereby incorporated herein. Another function of GAM353678 is to inhibit vanB, a GAM353678 bacterial target gene which is associated with *Pseudomonas aeruginosa* PA01 infection, as part of an anti-bacterial host defense mechanism. Accordingly, the utilities of GAM353678 include the diagnosis, prevention and treatment of *Pseudomonas aeruginosa* PA01 infection and associated clinical conditions | A |
| GAM35 3678 | CAGCAGCA CACTGTGG TTTGTA | Human | yabO | *Escherichia coli* CFT073 | GAM353678 is a human miRNA-like oligonucleotide, which targets Ribosomal large subunit pseudouridine synthase A (yabO, NC_004431 from 61489 to 62148 (−)), a bacterial target gene encoded by the *Escherichia coli* CFT073 genome, as part of an anti-bacterial host defense mechanism. yabO BINDING SITE 1 and yabO BINDING SITE 2 are bacterial target binding sites that are found in the untranslated regions of mRNA encoded by the yabO gene, corresponding to target | A |

TABLE 8-continued

| GAM NAME | GAM RNA SEQUENCE | GAM ORGA- NISM | TAR- GET | TARGET ORGANISM | GAM GAM FUNCTION | POS |
|---|---|---|---|---|---|---|
| GAM35 3678 | CAGCAGCA CACTGTGG TTTGTA | Human | yciE | Escherichia coli CFT073 | binding sites such as BINDING SITE I, BINDING SITE II or BINDING SITE III of FIG. 1. The nucleotide sequences of yabO BINDING SITE 1 and yabO BINDING SITE 2, and the complementary secondary structure to the nucleotide sequence of GAM353678 RNA are set forth in Tables 6-7, hereby incorporated herein. Another function of GAM353678 is to inhibit yabO, a GAM353678 bacterial target gene which is associated with *Escherichia coli* CFT073 infection, as part of an anti-bacterial host defense mechanism. Accordingly, the utilities of GAM353678 include the diagnosis, prevention and treatment of *Escherichia coli* CFT073 infection and associated clinical conditions GAM353678 is a human miRNA-like oligonucleotide, which targets Protein yciE (yciE, NC_004431 from 1558641 to 1559147 (−)), a bacterial target gene encoded by the *Escherichia coli* CFT073 genome, as part of an anti-bacterial host defense mechanism. yciE BINDING SITE 1 and yciE BINDING SITE 2 are bacterial target binding sites that are found in the untranslated regions of mRNA encoded by the yciE gene, corresponding to target binding sites such as BINDING SITE I, BINDING SITE II or BINDING SITE III of FIG. 1. The nucleotide sequences of yciE BINDING SITE 1 and yciE BINDING SITE 2, and the complementary secondary structure to the nucleotide sequence of GAM353678 RNA are set forth in Tables 6-7, hereby incorporated herein. Another function of GAM353678 is to inhibit yciE, a GAM353678 bacterial target gene which is associated with *Escherichia coli* CFT073 infection, as part of an anti-bacterial host defense mechanism. Accordingly, the utilities of GAM353678 include the diagnosis, prevention and treatment of *Escherichia coli* CFT073 infectionand associated clinical conditions | A |

Studies documenting the well known correlations between each of a plurality of GAM TARGET GENEs that are described by FIG. 1 and the known gene functions and related diseases are listed in Table 9, hereby incorporated herein. Specifically, in Table 9, lines 6046-6059 describes references of GAM target genes, as set forth in SEQ ID NO:348 in Table 8.

TABLE 9

| TARGET | TARGET ORGANISM | REFERENCES |
|---|---|---|
| MGAT5 | Human | Demetriou, M.; Granovsky, M.; Quaggin, S.; Dennis, J. W.: Negative regulation of T-cell activation and autoimmunity by Mgat5 N-glycosylation. Nature 409: 733-739, 2001. |
| MGAT5 | Human | Granovsky, M.; Fata, J.; Pawling, J.; Muller, W. J.; Khokha, R.; Dennis, J. W.: Suppression of tumor growth and metastasis in Mgat5-deficient mice. Nature Med.6: 306-12, 2000. |
| MGAT5 | Human | Saito, H.; Nishikawa, A.; Gu, J.; Ihara, Y.; Soejima, H.; Wada, Y.; Sekiya, C.; Niikawa, N.; Taniguchi, N.: cDNA cloning and chromosomal mapping of human N-acetyl glucosaminyltransferase V+. Biochem. Biophys. Res. Commun. 198: 318-327, 1994. |

Table 11, lines 275482-275565, shows data of GAM RNA SEQ ID NO:348 printed on microarray chip probes, as described in detail in FIG. 17.

TABLE 11

| PROBE SEQUENCE | PROBE TYPE | GAM RNA SEQ ID/GAM MIR NAME | RNA/MIR SEQUENCE | LIBRARY | SIGNAL | BACK-GROUND Z-SCORE | MIS-MATCH Z-SCORE |
|---|---|---|---|---|---|---|---|
| CCCAGCAGCAC ACTGTGGTTTG TACGCGATCCG TTATCGTTCGG TATCGAACGTA ACGAT | Predicted | 348 | CAGCAGCACACTGTG-GTTTGTA | A2 | 638 | 4.2 | 3.2 |
| CCCAGCAGCAC ACTGTGGTTTG TACGCGATCCG TTATCGTTCGG TATCGAACGTA ACGAT | Predicted | 348 | CAGCAGCACACTGTG-GTTTGTA | D2 | 9435 | 16.6 | 20.9 |
| CCCAGCAGCAC ACTGTGGTTTG TACGCGATCCG TTATCGTTCGG TATCGAACGTA ACGAT | Predicted | 348 | CAGCAGCACACTGTG-GTTTGTA | E1 | 25910 | 14.8 | 27.5 |
| CCCAGCAGCAC ACTGTGGTTTG TACGCGATCCG TTATCGTTCGG TATCGAACGTA ACGAT | Predicted | 348 | CAGCAGCACACTGTG-GTTTGTA | F1 | 65518 | 12.0 | 30.2 |
| CCCAGCAGCAC ACTGTGGTTTG TACGCGATCCG TTATCGTTCGG TATCGAACGTA ACGAT | Predicted | 348 | CAGCAGCACACTGTG-GTTTGTA | G1 | 65518 | 10.1 | 29.3 |
| CCCAGCAGCAC ACTGTGGTTTG TACGCGATCCG TTATCGTTCGG TATCGAACGTA ACGAT | Predicted | 348 | CAGCAGCACACTGTG-GTTTGTA | H1 | 37067 | 9.9 | 28.2 |
| CCCAGCAGCAC ACTGTGGTTTG TACGGATCGTT ATAACGATCCG GTATCGAACGT AACGA | Predicted | 348 | CAGCAGCACACTGTG-GTTTGTA | A2 | 606 | 3.7 | 3.2 |
| CCCAGCAGCAC ACTGTGGTTTG TACGGATCGTT ATAACGATCCG GTATCGAACGT AACGA | Predicted | 348 | CAGCAGCACACTGTG-GTTTGTA | D2 | 7549 | 15.4 | 19.5 |
| CCCAGCAGCAC ACTGTGGTTTG TACGGATCGTT ATAACGATCCG GTATCGAACGT AACGA | Predicted | 348 | CAGCAGCACACTGTG-GTTTGTA | E1 | 20239 | 13.8 | 25.3 |

TABLE 11-continued

| PROBE SEQUENCE | PROBE TYPE | GAM RNA SEQ ID/GAM MIR NAMERNA/MIR SEQUENCE | | LIBRARY | SIGNAL | BACK-GROUND Z-SCORE | MIS-MATCH Z-SCORE |
|---|---|---|---|---|---|---|---|
| CCCAGCAGCAC ACTGTGGTTTG TACGGATCGTT ATAACGATCCG GTATCGAACGT AACGA | Predicted | 348 | CAGCAGCACACTGTG-GTTTGTA | F1 | 65518 | 12.0 | 29.3 |
| CCCAGCAGCAC ACTGTGGTTTG TACGGATCGTT ATAACGATCCG GTATCGAACGT AACGA | Predicted | 348 | CAGCAGCACACTGTG-GTTTGTA | G1 | 65518 | 10.1 | 28.0 |
| CCCAGCAGCAC ACTGTGGTTTG TACGGATCGTT ATAACGATCCG GTATCGAACGT AACGA | Predicted | 348 | CAGCAGCACACTGTG-GTTTGTA | H1 | 27597 | 9.2 | 25.8 |

Table 12, line 177, shows data relating to GAM RNA SEQ ID NO:348 that were validated by means of Wet Laboratory.

TABLE 12

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| CAGCAGCACACTGTG-GTTTGTA | Chip strong | 65518 | 16.623587 | 30.172779 | 348 |

Table 13, lines 3-42, 47-69, 84-121, 143-179, 187-207, 210-256, 264-478 shows sequence data of GAMs associated with different bacterial infections.

TABLE 13

| ROW # | INFECTION NAME | SEQ ID NOs OF GAMS ASSOCIATED WITH INFECTION |
|---|---|---|
| 2 | Bordetella pertussis | 1, 6, 10, 11, 12, 13, 16, 18, 19, 20, 21, 22, 23, 24, 25, 26, 27, 28, 29, 33, 34, 37, 41, 42, 43, 44, 47, 48, 49, 50, 52, 53, 54, 55, 57, 58, 59, 60, 63, 65, 66, 67, 68, 69, 70, 71, 75, 76, 77, 79, 84, 86, 87, 88, 89, 91, 94, 96, 97, 99, 100, 101, 102, 103, 104, 105, 106, 107, 108, 109, 110, 111, 112, 113, 114, 115, 117, 119, 120, 121, 122, 123, 125, 126, 127, 130, 131, 132, 133, 137, 138, 139, 140, 141, 142, 145, 147, 149, 150, 151, 154, 155, 156, 157, 158, 160, 161, 162, 164, 165, 166, 167, 168, 170, 171, 172, 173, 174, 175, 176, 177, 179, 180, 181, 183, 184, 185, 188, 191, 195, 196, 197, 204, 205, 211, 212, 214, 215, 216, 219, 220, 222, 225, 228, 230, 231, 233, 237, 239, 241, 242, 243, 244, 250, 251, 253, 262, 264, 265, 266, 268, 271, 272, 274, 276, 277, 280, 281, 282, 284, 285, 287, 288, 289, 290, 293, 294, 296, 297, 299, 300, 301, 302, 304, 306, 308, 310, 312, 317, 318, 321, 322, 324, 326, 327, 329, 330, 332, 333, 334, 335, 336, 339, 340, 342, 343, 345, 348, 349, 350, 351, 352, 353, 355, 356, 357, 358, 360, 361, 362, 364, 365, 366, 367, 368, 369, 370, 371, 372, 373, 374, 375, 376, 378, 380, 381, 382, 383, 384, 385 and 49788-55666. |
| 3 | Brucella 1330 suis | 1, 6, 10, 11, 12, 13, 14, 16, 18, 19, 21, 23, 27, 32, 35, 37, 39, 40, 42, 47, 48, 49, 50, 52, 53, 58, 62, 63, 65, 68, 70, 71, 77, 79, 80, 85, 86, 89, 90, 98, 102, 105, 107, 108, 109, 111, 112, 114, 115, 119, 120, 124, 125, 121, 122, 123, 126, 132, 138, 141, 142, 143, 150, 151, 152, 154, 155, 156, 157, 158, 160, 161, 162, 164, 166, 168, 171, 172, 173, 175, 176, 177, 180, 181, 183, 185, 186, 190, 195, 198, 199, 200, 201, 205, 207, 211, 212, 214, 215, 217, 218, 219, 220, 221, 222, 225, 229, 230, 231, 233, 236, 237, 240, 241, 243, 244, 250, 251, 256, 258, 263, 264, 265, 266, 270, 277, 279, 280, 281, 282, 285, 287, 289, 290, 293, 294, 295, 297, 300, 302, 303, 306, 308, 310, 312, 315, 318, 319, 320, 321, 330, 331, 333, 334, 335, 342, 343, 347, 348, 349, 353, 354, 356, 357, 360, 361, 364, 365, 366, 368, 369, 370, 371, 373, 374, 375, 377, 381, 382, 384 and 55667-60259. |
| 4 | Chlamydia Trachomatis | 2, 3, 4, 6, 7, 8, 9, 10, 13, 14, 16, 18, 19, 20, 21, 22, 25, 26, 27, 30, 31, 32, 33, 36, 37, 38, 40, 45, 46, 47, 48, 49, 51, 52, 55, 62, 63, 64, 67, 73, 74, 75, 78, 81, 82, 84, 85, 86, 87, 88, 91, 94, 95, 98, 99, 104, 105, 106, 111, 113, 116, 122, 124, 126, 128, 132, 133, 136, 138, 146, 148, 149, 152, 154, 155, 156, 157, 160, 164, 166, 167, 177, 179, 180, 181, 187, 188, 190, 192, 194, 198, 199, 200, 205, 207, 208, 209, 210, 211, 213, 214, 217, 218, 222, 224, 225, 226, 229, 232, 233, 235, 236, 239, 241, 242, 243, 244, 245, 248, 251, 252, 253, 254, 256, 257, 259, 262, 264, 265, 269, 270, 271, 272, 273, 274, |

TABLE 13-continued

| ROW # | INFECTION NAME | SEQ ID NOs OF GAMS ASSOCIATED WITH INFECTION |
|---|---|---|
| | | 278, 279, 287, 288, 289, 293, 295, 296, 297, 298, 299, 302, 303, 305, 306, 309, 311, 312, 316, 318, 319, 320, 322, 323, 324, 325, 326, 327, 328, 330, 332, 333, 335, 338, 340, 341, 343, 344, 345, 348, 349, 350, 353, 354, 356, 363, 373, 384 and 60260-67437. |
| 6 | Chlamydophila pneumoniae CWL029 | 3, 5, 6, 8, 9, 10, 13, 17, 20, 21, 22, 23, 25, 27, 28, 31, 32, 33, 37, 39, 45, 46, 47, 48, 50, 52, 55, 62, 63, 64, 66, 67, 69, 73, 74, 82, 84, 85, 88, 89, 90, 91, 92, 95, 101, 102, 104, 105, 111, 114, 124148, 125, 126, 128, 143, 146, 152, 159, 160, 161, 164, 165, 166, 168, 175180, 181, 187, 176, 177, 178, 179, 189, 190, 192, 194, 201, 203, 205, 207, 208, 209, 212, 213, 214, 217, 218, 221, 223, 224, 227, 232, 233, 234, 236, 238, 239, 241, 242, 243, 244, 245, 247, 248, 252, 257, 258, 259, 260, 262, 263, 271, 272, 274, 275, 279, 281, 282, 283, 286, 289, 295, 297, 298, 299, 302, 305, 306, 309, 311, 312, 314, 319, 323, 324, 325, 326, 327, 330, 333, 338, 340, 343, 344, 345, 346, 348, 349, 350, 352, 353, 354, 356, 363, 377, 382, 383, 384 and 68148-75439. |
| 7 | Chlamydophila pneumoniae J138 | 3, 5, 6, 8, 9, 10, 17, 20, 21, 22, 23, 25, 27, 31, 32, 33, 37, 39, 45, 46, 47, 50, 52, 55, 62, 63, 64, 66, 67, 69, 73, 74, 8290, 92, 95, 101, 84, 85, 88, 89, 102, 104, 105, 111, 114, 125, 126, 128, 148, 152, 159, 160, 161, 143, 146, 164, 165, 166, 168, 175, 176, 177, 178, 179, 187, 189, 190, 192, 194, 201, 203, 205, 207, 208, 209, 212, 180, 181, 213, 214, 217, 218, 221, 223, 224, 227, 232, 233, 234, 236, 238, 239, 241, 242, 243, 244, 245, 247, 248, 252, 257, 259, 260, 262, 263, 271, 272, 274, 275, 279, 281, 282, 283, 286, 289, 295, 297, 298, 299, 302, 305, 306, 309, 311, 312, 314, 319, 323, 325, 326, 327, 330, 333, 338, 340, 343, 344, 345, 346, 348, 349, 350, 352, 353, 354, 356, 363, 377, 382, 383, 384 and 75440-82241. |
| 10 | Escherichia coli CFT 073 | 1, 2, 4, 5, 6, 7, 8, 9, 10, 11, 12, 13, 14, 16, 17, 18, 19, 21, 22, 23, 25, 26, 27, 28, 30, 31, 33, 34, 35, 36, 37, 39, 40, 42, 43, 45, 46, 47, 48, 49, 50, 51, 52, 53, 55, 56, 57, 58, 59, 62, 63, 64, 65, 66, 67, 68, 69, 70, 71, 72, 73, 75, 76, 78, 79, 80, 81, 82, 83, 84, 85, 86, 87, 88, 89, 90, 91, 92, 93, 94, 95, 96, 97, 99, 100, 101, 102, 103, 105, 106, 107, 108, 109, 110, 111, 112, 113, 114, 115, 116, 119, 120, 121, 122, 123, 124, 125, 126, 129, 131, 132, 133, 135, 136, 137, 138, 140, 141, 142, 143, 145, 146, 147, 148, 152, 154, 155, 156, 157, 158, 160, 161, 162, 163, 164, 165, 166, 167, 168, 171, 173, 174, 175, 176, 177, 179, 180, 181, 182, 184, 185, 186, 190, 191, 192, 193, 195, 196, 197, 203, 204, 205, 206, 207, 208, 209, 210, 211, 212, 213, 214, 215, 216, 217, 218, 220, 221, 222, 223, 224, 225, 229, 230, 231, 232, 233, 234, 235, 236, 237, 238, 239, 241, 242, 243, 244, 245, 246, 247, 248, 249, 250, 251, 252, 253, 254, 255, 256, 257, 258, 260, 261, 262, 265, 266, 267, 268, 270, 271, 272, 274, 276, 277, 278, 279, 280, 281, 282, 283, 284, 285, 287, 288, 289, 290, 291, 292, 293, 294, 295, 296, 297, 299, 300, 301, 302, 303, 305, 306, 307, 308, 309, 310, 311, 312, 314, 315, 316, 317, 318, 321, 322, 323, 324, 325, 326, 327, 329, 331, 332, 333, 334, 335, 336, 337, 338, 339, 340, 343, 344, 345, 347, 348, 349, 350, 351, 352, 353, 354, 355, 356, 357, 358, 359, 360, 361, 364, 365, 367, 368, 369, 370, 372, 373, 374, 375, 376, 378, 380, 381, 382, 383, 384 and 90623-103607. |
| 11 | Haemophilus influenzae Rd | 2, 3, 5, 6, 7, 8, 9, 10, 13, 15, 19, 20, 21, 22, 25, 26, 27, 30, 31, 32, 33, 34, 37, 38, 40, 41, 45, 46, 48, 49, 50, 51, 52, 66, 67, 68, 73, 53, 55, 62, 63, 64, 78, 81, 83, 84, 85, 88, 90, 91, 92, 98, 101, 105, 106, 111, 116, 117, 119, 122, 123, 124, 125, 126, 134, 138, 144, 146, 149, 151, 152, 155, 156, 160, 161, 164, 165, 166, 169, 171, 172, 174, 176, 177, 179, 180, 183, 190, 197, 198, 199, 200, 201, 203, 205, 207, 208, 211, 213, 214, 218, 221, 223, 226, 228, 229, 234, 236, 239, 240, 242, 244, 247, 248, 251, 254, 255, 256, 259, 262, 263, 264, 271, 272, 274, 277, 279, 281, 282, 283, 295, 296, 299, 302, 305, 306, 308, 311, 312, 313, 316, 317, 318, 319, 322, 323, 324, 325, 326, 327, 329, 333, 335, 338, 339, 340, 343, 344, 345, 348, 351, 353, 354, 356, 365, 368, 371, 375, 377, 379, 380, 385 and 103608-111433. |
| 12 | Leptospira interrogans serovar lai str. 56601 | 1, 3, 5, 7, 8, 10, 13, 19, 22, 25, 32, 38, 39, 41, 48, 49, 52, 67, 71, 73, 84, 85, 90, 91, 93, 95, 117, 124, 128, 164, 174, 192, 193, 203, 178, 179, 187, 190, 207, 225, 226, 227, 229, 238, 244, 258, 259, 262, 272, 279, 193, 203, 256, 257, 295, 298, 299, 303, 306, 307, 316, 324, 327, 333, 338, 340, 344, 348, 376, 379, 384 and 111434-116384. |
| 15 | Mycobacterium bovis AF2122/9 subsp bovis 7 | 1, 3, 4, 5, 6, 7, 11, 12, 13, 14, 15, 16, 17, 18, 19, 20, 21, 22, 23, 24, 25, 26, 27, 28, 29, 31, 32, 33, 36, 37, 39, 41, 42, 52, 43, 45, 46, 47, 48, 50, 51, 53, 54, 55, 57, 58, 59, 73, 75, 76, 60, 61, 62, 71, 64, 65, 66, 67, 68, 69, 70, 77, 78, 79, 80, 83, 84, 86, 87, 88, 89, 100, 101, 102, 90, 91, 93, 96, 97, 99, 103, 104, 105, 106, 107, 108, 109, 110, 111, 112, 113, 114, 115, 116, 117, 118, 119, 120, 121, 122, 123, 125, 127, 130, 131, 132, 133, 134, 135, 137, 138, 139, 141, 142, 143, 144, 145, 146, 147, 148, 149, 150, 151, 152, 154, 155, 156, 157, 158, 159, 160, 161, 162, 163, 165, 166, 167, 168, 170, 171, 172, 173, 174, 175, 176, 177, 178, 179, 180, 181, 183, 184, 185, 188, 189, 190, 191, 193, 194, 195, 196, 197, 198, 199, 200, 201, 202, 203, 204, 205, 206, 207, 208, 210, 211, 212, 213, 214, 215, 216, 218, 219, 220, 222, 225, 230, 231, 233, 236, 237, 239, 240, 241, 242, 243, 244, 245, 246, 250, 251, 252, 253, 254, 255, 256, 257, 261, 262, 263, 264, 265, 266, 267, 268, 270, 271, 273, 276, 277, 278, 280, 281, 282, 283, 285, 286, 287, 288, 289, 290, 291, 292, 293, 294, 296, 297, 299, 300, 302, 303, 304, 305, 306, 308, 310, 312, 313, 314, 315, 318, 320, 321, 322, 323, 324, 325, 326, 327, 329, 330, 331, 332, 333, 334, 335, 336, 337, 341, 342, 345, 346, 347, 348, 349, 350, 351, 352, 353, 355, 356, 357, 358, 360, 361, 362, 364, 365, 366, 367, 369, 370, 371, 372, 373, 374, 375, 376, 378, 380, 381, 382, 383, 384, 385 and 127919-137561. |
| 16 | Mycobacterium leprae | 3, 4, 5, 6, 7, 12, 13, 14, 15, 18, 19, 21, 22, 23, 24, 26, 29, 31, 32, 33, 36, 37, 39, 41, 42, 43, 45, 46, 47, 48, 49, 50, 53, 54, 68, 69, 70, 57, 59, 62, 65, 71, 73, 74, 75, 76, 78, 81, 83, 84, 86, 90, 94, 96, 98, 101, 103, 106, 107, 109, 110, 111, 112, 113, 114, 115, 116, 118, 119, 120, 121, 123, 131, 133, 134, 135, 137, 142, 143, 144, 145, 146, 147, 149, 154, 156, 157, 158, 159, 161, 162, 163, 165, 166, 167, 171, 172, 173, 174, 175, 176, 179, 183, 184, 185, 187, 188, 189, 190, 193, 196, 197, 198, 199, 200, 201, 202, 204, 205, 206, 211, 212, 214, 215, 216, 218, 219, 220, 221, 223, 224, 225, 228, 230, 231, 232, 233, 234, 235, 236, 237, 241, 242, 243, 245, 249, 250, 251, 253, 254, 256, 258, 261, 263, 265, 267, 268, 269, 271, 274, 276, 277, 280, 281, 284, 288, 289, 290, 291, 293, 294, 295, 296, 297, 299, 300, 301, 302, 303, 305, 306, 307, 309, 310, 311, 312, 313, 314, 315, 318, 320, 321, 323, 324, 327, 329, 330, 331, 332, 333, 334, 335, 336, 337, 338, 339, 340, 341, 343, 345, 346, 347, 348, 349, 353, 355, 356, 357, 358, 360, 361, 364, 365, 368, 369, 370, 371, 372, 374, 375, 376, 377, 378, 380, 381, 382, 383 and 137562-144598. |
| 18 | Mycobacterium tuberculosis H37Rv | 1, 3, 4, 5, 6, 7, 10, 11, 12, 13, 14, 15, 16, 17, 18, 19, 20, 21, 22, 23, 24, 25, 26, 27, 28, 29, 31, 32, 33, 37, 39, 41, 42, 43, 50, 51, 52, 45, 46, 47, 48, 53, 54, 55, 57, 58, 59, 60, 61, 62, 63, 64, 65, 66, 67, 68, 69, 70, 71, 73, 75, 76, 77, 78, 79, 80, 83, 84, 86, 87, 88, 89, 90, 91, 93, 94, 96, 97, 99, 100, 101, 102, 103, 104, |

TABLE 13-continued

| ROW # | INFECTION NAME | SEQ ID NOs OF GAMS ASSOCIATED WITH INFECTION |
|---|---|---|
| | | 105, 107, 108, 109, 110, 111, 112, 113, 114, 115, 116, 117, 118, 119, 120, 121, 122, 123, 125, 127, 130, 131, 132, 133, 134, 135, 137, 138, 139, 141, 142, 143, 144, 145, 146, 147, 148, 149, 150, 151, 152, 153, 154, 155, 156, 157, 158, 159, 160, 161, 162, 163, 165, 166, 167, 168, 170, 171, 172, 173, 174, 175, 176, 177, 178, 179, 180, 181, 183, 184, 185, 188, 189, 190, 191, 194, 195, 196, 197, 198, 199, 200, 201, 202, 203, 204, 205, 206, 207, 208, 210, 211, 212, 213, 214, 215, 216, 218, 219, 220, 222, 225, 230, 231, 233, 234, 236, 237, 239, 240, 241, 242, 243, 244, 245, 246, 250, 251, 252, 253, 254, 255, 256, 257, 261, 262, 263, 264, 265, 266, 267, 268, 270, 271, 272, 273, 274, 276, 277, 278, 280, 281, 282, 283, 284, 285, 286, 287, 288, 289, 290, 291, 292, 293, 294, 296, 297, 298, 299, 300, 302, 303, 304, 305, 306, 308, 310, 312, 313, 314, 315, 318, 320, 321, 323, 324, 325, 326, 327, 329, 330, 331, 332, 333, 334, 335, 336, 337, 341, 342, 345, 346, 347, 348, 349, 350, 351, 352, 353, 355, 356, 357, 358, 360, 361, 362, 364, 365, 366, 367, 368, 369, 370, 371, 372, 373, 374, 375, 376, 378, 380, 381, 382, 383, 384, 385 and 146807-155497. |
| 20 | *Neisseria meningitidis* Z2491 | 1, 6, 7, 8, 10, 12, 15, 17, 21, 22, 26, 28, 30, 37, 39, 40, 45, 49, 52, 56, 58, 60, 62, 63, 67, 70, 76, 86, 89, 90, 91, 96, 98, 102, 103, 105, 107, 108, 109, 111, 112, 113, 114, 115, 122, 123, 124, 125, 126, 127, 133, 138, 141, 142, 143,145, 147, 148, 149, 152, 157, 158, 164, 165, 166, 170, 171, 175, 176, 178, 181, 183, 187, 189, 197, 203, 217, 218, 219, 220, 221, 222, 225, 229, 230, 231, 237, 239, 243, 245, 247, 248, 251, 253, 254, 256, 257, 258, 259, 264, 265, 268, 273, 281, 282, 283, 285, 287, 289, 290, 293, 294, 295, 297, 300, 302, 306, 308, 314, 315, 316, 319, 321, 322, 325, 327, 329, 332, 333, 334, 338, 340, 341, 344, 346, 348, 349, 350, 351, 354, 355, 356, 365, 371, 372, 375, 376, 380, 381, 382, 384 and 155834-160603. |
| 21 | *Pseudomonas aeruginosa* PA01 | 1, 2, 6, 10, 11, 12, 13, 14, 16, 17, 18, 19, 20, 21, 22, 23, 24, 25, 26, 27, 28, 29, 30, 31, 33, 34, 35, 36, 37, 41, 42, 56, 43, 45, 46, 48, 49, 50, 52, 54, 55, 57, 56, 59, 60, 62, 63, 64, 76, 77, 78, 79, 81, 65, 66, 67, 68, 69, 70, 71, 73, 82, 83, 84, 86, 87, 88, 89, 90, 91, 94, 95, 96, 97, 99, 100, 101, 102, 103, 105, 106, 107, 108, 109, 110, 111, 112, 113, 114, 115, 116, 118, 119, 120, 121, 122, 123, 124, 125, 126, 127, 130, 131, 134, 137, 138, 139, 140, 141, 142, 144, 147, 149, 150, 151, 152, 154, 155, 156, 157, 158, 160, 161, 162, 163, 164, 165, 166, 167, 168, 169, 170, 171, 172, 173, 174, 175, 176, 177, 179, 180, 181, 183, 184, 185, 188, 190, 192, 193, 194, 195, 196, 197, 202, 204, 205, 208, 210, 211, 212, 213, 214, 215, 216, 218, 220, 222, 225, 228, 229, 230, 231, 232, 233, 236, 237, 241, 242, 243, 244, 250, 251, 253, 258, 262, 264, 265, 266, 267, 268, 270, 271, 272, 273, 274, 276, 277, 280, 281, 282, 283, 285, 286, 287, 288, 289, 290, 291, 292, 293, 294, 296, 297, 296, 299, 300, 301, 302, 306, 312, 314, 318, 319, 320, 321, 323, 324, 325, 327, 329, 330, 331, 333, 334, 335, 336, 339, 340, 341, 342, 343, 345, 347, 348, 349, 350, 351, 352, 353, 355, 356, 357, 358, 360, 361, 362, 364, 365, 366, 367, 368, 369, 370, 371, 372, 373, 374, 375, 376, 378, 380, 381, 382, 383, 384 and 160604-170274. |
| 22 | *Pseudomonas K putida* T2440 | 1, 5, 7, 9, 10, 11, 12, 13, 14, 16, 18, 19, 23, 24, 25, 26, 27, 28, 29, 31, 33, 34, 36, 37, 38, 39, 41, 42, 43, 44, 45, 46, 47, 49, 50, 51, 52, 53, 54, 55, 57, 58, 59, 61, 64, 65, 66, 68, 69, 70, 71, 73, 76, 84, 85, 86, 88, 89, 91, 94, 98, 99, 101, 102, 103, 105, 106, 107, 108, 109, 110, 111, 112, 113, 114, 115, 117, 118, 119, 120, 121, 122, 123, 125, 126, 131, 132, 133, 134, 135, 137, 138, 140, 141, 142, 143, 144, 145, 146, 147, 148, 149, 150, 151, 152, 153, 154, 155, 156, 157, 158, 159, 160, 161, 162, 163, 164, 166, 167, 168, 171, 172, 173, 174, 175, 176, 177, 179, 180, 181, 183, 184, 185, 187, 190, 191, 193, 195, 196, 197, 202, 204, 205, 207, 211, 212, 214, 215, 216, 220, 221, 222, 225, 228, 229, 230, 231, 232, 233, 234, 236, 237, 239, 240, 241, 242, 243, 244, 248, 250, 251, 253, 255, 258, 264, 265, 266, 267, 270, 271, 272, 274, 276, 277, 280, 281, 282, 283, 284, 285, 287, 288, 289, 290, 291, 292, 293, 294, 295, 296, 299, 300, 301, 302, 303, 304, 305, 306, 308, 310, 312, 313, 314, 316, 317, 318, 320, 321, 322, 323, 324, 327, 329, 333, 334, 335, 336, 337, 342, 343, 345, 346, 347, 348, 349, 350, 351, 352, 353, 354, 355, 356, 357, 358, 360, 361, 364, 365, 366, 367, 368, 369, 370, 371, 373, 374, 375, 376, 377, 378, 380, 381, 382, 383, 384, 385 and 170275-178543. |
| 24 | *Salmonella enterica enterica serovar Typhi* | 1, 3, 4, 6, 7, 8, 9, 10, 11, 12, 13, 16, 17, 18, 19, 20, 21, 22, 23, 25, 26, 27, 28, 30, 31, 32, 33, 35, 37, 38, 39, 51, 40, 42, 43, 45, 46, 47, 48, 49, 50, 52, 55, 56, 57, 58, 59, 60, 62, 63, 64, 65, 66, 67, 68, 69, 70, 71, 72, 73, 75, 7, 79, 80, 81, 83, 84, 86, 88, 89, 90, 91, 92, 94, 95, 98, 99, 100, 101, 102, 105, 106, 107, 108, 109, 111, 112, 113, 114, 115, 119, 120, 121, 122, 123, 124, 125, 126, 127, 129, 131, 132, 133, 135, 136, 137, 138, 142, 143, 144, 145, 146, 147, 148, 150, 152, 153, 154, 155, 156, 157, 158, 160, 161, 162, 163, 164, 165, 166, 167, 171, 172, 173, 174, 175, 176, 177, 179, 180, 181, 182, 183, 185, 187, 188, 189, 190, 191, 192, 193, 194, 195, 196, 197, 198, 199, 200, 201, 202, 203, 204, 205, 206, 208, 212, 213, 214, 215, 216, 217, 218, 219, 220, 221, 222, 223, 225, 226, 229, 230, 231, 232, 233, 234, 235, 236, 237, 238, 239, 240, 241, 242, 243, 244, 245, 247, 248, 250, 251, 252, 253, 254, 255, 256, 257, 260, 261, 262, 263, 265, 266, 269, 270, 271, 272, 274, 276, 277, 278, 280, 281, 282, 283, 284, 285, 287, 288, 289, 290, 291, 292, 293, 294, 295, 296, 297, 298, 299, 300, 301, 302, 303, 304, 305, 306, 311, 312, 314, 315, 318, 319, 323, 324, 325, 327, 328, 329, 330, 331, 332, 333, 334, 335, 336, 337, 339, 340, 341, 342, 343, 344, 345, 346, 347, 348, 349, 351, 352, 353, 354, 355, 356, 357, 358, 360, 361, 364, 365, 366, 367, 369, 370, 371, 373, 374, 375, 376, 378, 379, 380, 381, 382, 383, 384, 385 and 179915-190940. |
| 25 | *Salmonella enterica enterica serovar Typhi Ty2* | 1, 2, 3, 4, 6, 7, 8, 9, 10, 11, 12, 13, 14, 16, 17, 18, 19, 20, 21, 22, 23, 25, 26, 27, 28, 30, 31, 32, 33, 35, 37, 38, 50, 39, 40, 42, 43, 45, 46, 47, 48, 49, 51, 52, 55, 56, 57, 58, 59, 69, 70, 71, 72, 73, 60, 62, 63, 64, 65, 66, 67, 68, 75, 77, 79, 80, 81, 83, 84, 85, 86, 88, 89, 90, 91, 94, 95, 98, 99, 100, 101, 102, 105, 106, 107, 108, 109, 111, 112, 113,114, 115, 116, 119, 120, 121, 122, 123, 124, 125, 126, 127, 129, 131, 132, 133, 135, 136, 137, 138, 142, 143, 144, 145, 146, 147, 148, 150, 152, 153, 154, 155, 156, 157, 158, 160, 161, 162, 163, 164, 165, 166, 167, 171, 172, 173, 174, 175, 176, 177, 179, 180, 181, 182, 183, 185, 187, 188, 189, 190, 191, 192, 193, 194, 195, 196, 197, 198, 199, 200, 201, 202, 203, 204, 205, 206, 208, 212, 213, 214, 215, 216, 217, 218, 219, 220, 221, 222, 223, 225, 229, 230, 231, 232, 233, 234, 235, 236, 237, 238, 239, 240, 241, 242, 243, 244, 245, 247, 248, 250, 251, 252, 253, 254, 255, 256, 257, 260, 261, 262, 263, 265, 266, 269, 270, 271, 272, 274, 276, 277, 278, 280, 281, 282, 283, 284, 285, 287, 288, 289, |

TABLE 13-continued

| ROW # | INFECTION NAME | SEQ ID NOs OF GAMS ASSOCIATED WITH INFECTION |
|---|---|---|
| | | 290, 291, 292, 293, 294, 295, 296, 297, 298, 299, 300, 301, 302, 303, 304, 305, 306, 308, 311, 312, 314, 315, 318, 319, 323, 324, 325, 327, 328, 329, 330, 331, 332, 333, 334, 335, 336, 337, 338, 339, 340, 341, 342, 343, 344, 345, 346, 347, 348, 349, 351, 352, 353, 354, 355, 356, 357, 358, 360, 361, 364, 365, 366, 367, 369, 370, 371, 373, 374, 375, 376, 378, 379, 380, 381, 382, 383, 384, 385 and 190941-201927. |
| 26 | Salmonella typhimurium LT2 | 1, 2, 3, 5, 6, 7, 8, 9, 10, 11, 12, 13, 14, 16, 17, 18, 19, 20, 21, 22, 23, 24, 25, 26, 27, 28, 29, 30, 31, 32, 33, 48, 49, 36, 37, 38, 39, 42, 43, 45, 46, 47, 50, 51, 52, 54, 55, 56, 57, 58, 59, 60, 62, 63, 64, 65, 66, 67, 68, 69, 70, 71, 72, 73, 75, 77, 79, 82, 83, 84, 86, 88, 89, 90, 91, 94, 95, 96, 100, 101, 102, 103, 104, 105, 107, 108, 109, 111, 112, 113, 114, 115, 116, 119, 120, 121, 122, 123, 124, 125, 126, 127, 129, 131, 132, 133, 135, 137, 138, 142, 143, 144, 145, 146, 147, 148, 149, 150, 151, 152, 154, 155, 156, 157, 158, 160, 161, 162, 163, 164, 165, 166, 167, 168, 170, 171, 172, 173, 174, 175, 176, 177, 179, 180, 181, 182, 183, 185, 187, 188, 189, 190, 192, 193, 194, 195, 196, 197, 198, 199, 200, 201, 202, 203, 204, 205, 206, 207, 208, 211, 212, 213, 214, 215, 216, 217, 218, 219, 220, 221, 222, 225, 226, 227, 228, 229, 230, 231, 232, 233, 234, 235, 236, 237, 238, 239, 240, 241, 242, 243, 244, 245, 247, 248, 249, 250, 251, 252, 253, 255, 256, 257, 258, 260, 261, 262, 263, 266, 267, 268, 270, 271, 272, 273, 274, 275, 276, 279, 280, 281, 282, 285, 287, 288, 289, 290, 291, 292, 293, 294, 296, 297, 298, 299, 300, 302, 303, 306, 307, 308, 309, 310, 311, 312, 314, 315, 317, 318, 319, 323, 324, 325, 326, 327, 328, 329, 330, 331, 332, 333, 334, 335, 336, 337, 338, 340, 341, 342, 343, 344, 345, 347, 348, 349, 350, 351, 352, 353, 354, 355, 356, 357, 358, 359, 360, 361, 362, 363, 364, 365, 366, 368, 369, 370, 371, 373, 374, 375, 376, 379, 380, 381, 382, 383, 384, 385 and 201928-215605. |
| 27 | Shigella 2a flexneri str. 2457T | 1, 2, 5, 6, 9, 10, 11, 12, 13, 14, 16, 17, 18, 19, 21, 22, 23, 24, 25, 26, 27, 28, 29, 30, 32, 33, 35, 36, 37, 50, 51, 38, 39, 40, 41, 42, 43, 46, 47, 48, 49, 52, 54, 55, 56, 57, 58, 59, 62, 63, 65, 66, 67, 68, 69, 70, 71, 73, 76, 78, 80, 83, 84, 85, 86, 87, 88, 89, 90, 91, 93, 94, 95, 97, 99, 101, 102, 103, 104, 105, 107, 108, 109, 110, 111, 112, 113, 114, 115, 116, 117, 119, 120, 121, 122, 123, 124, 125, 126, 129, 131, 132, 133, 134, 135, 136, 137, 138, 139, 141, 142, 143, 145, 146, 147, 148, 149, 150, 151, 152, 154, 155, 156, 157, 158, 160, 161, 162, 163, 164, 165, 166, 167, 171, 172, 173, 174, 175, 176, 177, 179, 180, 181, 182, 184, 185, 187, 190, 191, 195, 196, 197, 198, 199, 200, 201, 202, 203, 204, 205, 207, 208, 212, 213, 214, 216, 218, 220, 221, 222, 223, 224, 225, 229, 230, 231, 232, 233, 234, 236, 237, 238, 239, 240, 241, 242, 243, 244, 245, 247, 248, 250, 251, 252, 253, 254, 255, 256, 257, 260, 261, 262, 263, 265, 268, 270, 271, 272, 274, 276, 277, 278, 279, 280, 281, 282, 283, 284, 285, 287, 288, 289, 290, 291, 292, 293, 295, 3296, 297, 298, 299, 300, 01, 302, 304, 306, 307, 308, 309, 310, 311, 312, 314, 315, 316, 317, 318, 320, 321, 322, 323, 324, 325, 327, 328, 329, 331, 332, 333, 334, 335, 336, 337, 338, 339, 340, 341, 343, 344, 345, 346, 347, 348, 349, 350, 351, 352, 353, 354, 356, 357, 358, 359, 360, 361, 362, 364, 365, 366, 367, 368, 369, 371, 373, 374, 375, 376, 379, 380, 381, 382, 383, 384, 385 and 215606-226197. |
| 28 | Shigella 2a flexneri str. 301 | 1, 2, 5, 6, 9, 10, 11, 12, 13, 14, 16, 17, 18, 19, 21, 22, 23, 24, 25, 26, 27, 28, 29, 30, 32, 33, 35, 36, 37, 52, 39, 40, 41, 42, 43, 46, 47, 48, 49, 50, 51, 54, 55, 56, 57, 58, 59, 62, 63, 64, 65, 66, 67, 68, 69, 70, 71, 73, 76, 77, 78, 80, 83, 84, 85, 86, 87, 88, 89, 90, 91, 92, 93, 94, 95, 97, 99, 101, 102, 103, 104, 105, 107, 108, 109, 110, 111, 112, 113, 114, 115, 116, 119, 120, 121, 122, 123, 124, 125, 126, 129, 132, 133, 134, 135, 136, 137, 138, 141, 142, 143, 144, 145, 146, 147, 148, 149, 150, 151, 152, 154, 155, 156, 157, 158, 159, 160, 161, 162, 163, 164, 165, 166, 167, 168, 171, 172, 173, 174, 175, 176, 177, 179, 180, 181, 182, 184, 185, 187, 190, 191, 195, 196, 197, 198, 199, 200, 201, 202, 203, 205, 207, 208, 210, 212, 213, 214, 216, 217, 218, 220, 221, 222, 223, 224, 225, 229, 230, 231, 232, 233, 234, 236, 237, 238, 239, 240, 241, 242, 243, 244, 245, 247, 248, 250, 251, 252, 253, 254, 255, 256, 257, 260, 262, 263, 264, 265, 266, 268, 269, 270, 271, 272, 274, 276, 277, 278, 279, 280, 281, 282, 283, 284, 285, 287, 288, 289, 290, 291, 292, 293, 295, 296, 297, 298, 299, 300, 301, 302, 304, 306, 308, 309, 311, 312, 314, 315, 316, 317, 318, 320, 321, 323, 324, 325, 327, 328, 329, 331, 333, 334, 335, 336, 337, 338, 339, 340, 341, 343, 344, 345, 346, 347, 348, 349, 350, 351, 352, 353, 354, 356, 357, 358, 359, 360, 361, 362, 364, 365, 366, 367, 368, 369, 371, 373, 374, 375, 376, 378, 379, 380, 381, 382, 383, 384, 385 and 226198-237003. |
| 29 | Staphylococcus Aureus subsp. aureus Mu50 | 2, 5, 7, 8, 9, 10, 13, 16, 19, 22, 25, 27, 31, 32, 33, 35, 36, 38, 39, 40, 41, 45, 46, 47, 48, 50, 51, 52, 55, 62, 63, 67, 71, 73, 81, 83, 84, 85, 90, 91, 92, 93, 95, 98, 100, 101, 105, 106, 111, 113, 116, 119, 120, 124, 131, 133, 138, 139, 146, 147, 149, 152, 153, 156, 160, 161, 162, 165, 166, 169, 171, 172, 174, 177, 179, 180, 181, 190, 192, 203, 204, 205, 207, 208, 213, 214, 217, 218, 222, 228, 231, 232, 236, 238, 240, 242, 244, 245, 247, 248, 252, 254, 256, 259, 261, 262, 270, 271, 272, 274, 275, 287, 293, 294, 299, 301, 302, 305, 306, 308, 309, 311, 316, 317, 323, 324, 325, 326, 327, 332, 333, 334, 335, 337, 339, 340, 342, 343, 344, 345, 346, 348, 349, 351, 353, 354, 356, 363, 365, 368, 371, 375, 379, 381 and 237004-244310. |
| 30 | Staphylococcus subsp. aureus MW2 | 2, 5, 7, 8, 10, 13, 16, 19, 22, 25, 27, 30, 31, 32, 33, 38, 39, 40, 41, 45, 46, 47, 48, 50, 51, 52, 55, 62, 63, 67, 71, 72, 73, 78, 81, 83, 84, 90, 91, 92, 93, 95, 98, 100, 101, 105, 106, 109, 111, 113, 117, 119, 120, 124, 126, 128, 130, 131, 133, 134, 138, 139, 143, 149, 152, 153, 156, 160, 161, 162, 166, 169, 171, 172, 174, 177, 179, 180, 181, 182, 190, 192, 203, 204, 205, 207, 208, 213, 214, 217, 218, 222, 228, 231, 232, 236, 238, 242, 244, 247, 248, 252, 254, 256, 257, 259, 261, 262, 271, 272, 274, 279, 287, 293, 294, 295, 299, 301, 302, 306, 307, 308, 309, 315, 316, 323, 324, 325, 326, 327, 332, 333, 334, 335, 337, 338, 339, 342, 343, 344, 345, 346, 348, 350, 351, 353, 356, 363, 365, 368, 371, 375, 379, 381 and 244311-250683. |
| 31 | Staphylococcus aureus subsp. aureus N315 | 2, 5, 7, 8, 9, 10, 13, 16, 19, 22, 25, 27, 31, 32, 33, 35, 36, 38, 39, 40, 41, 45, 46, 47, 48, 50, 51, 52, 55, 62, 63, 67, 71, 73, 81, 83, 84, 85, 90, 91, 92, 93, 95, 98, 100, 101, 105, 106, 111, 113, 117, 119, 120, 124, 131, 133, 134, 138, 139, 143, 146, 147, 149, 152, 153, 156, 160, 161, 162, 166, 169, 171, 172, 174, 177, 179, 180, 181, 190, 192, 203, 204, 205, 207, 208, 213, 214, 217, 218, 222, 226, 228, 231, 232, 236, 238, 240, 242, 244, 245, 247, 248, 252, 254, 256, 259, 260, 261, 262, 270, 271, 272, 274, 275, 279, 287, 293, 294, 299, 301, 302, 305, 306, 307, 308, 309, 311, 316, 317, 323, 324, 325, 326, 327, 332, 333, 334, 335, 337, 339, 340, 342, 343, 344, 345, 346, 348, 349, 351, 353, 354, 356, 363, 365, 368, 371, 375, 379, 381 and 250684-257140. |
| 32 | Streptococcus Pneumoniae R6 | 2, 3, 5, 6, 10, 13, 14, 17, 20, 21, 22, 23, 25, 26, 27, 30, 31, 32, 33, 35, 36, 37, 38, 39, 40, 41, 46, 47, 48, 49, 50, 52, 55, 56, 62, 63, 67, 73, 77, 81, 83, 84, |

TABLE 13-continued

| ROW # | INFECTION NAME | SEQ ID NOs OF GAMS ASSOCIATED WITH INFECTION |
|---|---|---|
| | | 85, 87, 90, 91, 92, 94, 95, 100, 101, 102, 105, 106, 111, 112, 114, 115, 116, 117, 119, 123, 124, 126, 133, 136, 138, 143, 145, 146, 147, 149, 152, 156, 160, 161, 164, 166, 168, 169, 171, 172, 174, 175, 176, 177, 179, 180, 190, 192, 203, 204, 205, 208, 209, 213, 214, 217, 218, 223, 226, 228, 229, 232, 233, 235, 236, 238, 239, 242, 244, 245, 246, 247, 248, 249, 252, 255, 256, 257, 258, 259, 260, 261, 262, 264, 268, 271, 274, 279, 282, 284, 287, 295, 296, 297, 298, 299, 300, 302, 303, 305, 306, 307, 309, 311, 312, 314, 315, 316, 320, 321, 323, 324, 325, 326, 327, 329, 333, 335, 338, 340, 341, 344, 345, 348, 350, 351, 352, 353, 356, 357, 359, 365, 368, 371, 372, 373, 375, 377, 379, 380, 382, 384, 385 and 257141-265301. |
| 33 | Streptococcus pneumoniae TIGR4 | 2, 10, 13, 25, 27, 33, 46, 48, 50, 52, 55, 62, 63, 67, 73, 81, 84, 91, 101, 105, 106, 111, 119, 149, 152, 160, 161, 176, 177, 164, 166, 168, 169, 171, 172, 175, 179, 180, 190, 205, 208, 213, 214, 218, 228, 236, 242, 244, 246, 262, 268, 271, 272, 274, 297, 299, 306, 321, 323, 324, 325, 327, 329, 333, 340, 345, 348, 351, 353, 356, 359, 365, 368, 371, 372, 375, 380 and 265302-266788. |
| 34 | Streptococcus pyogenes M1 GAS | 3, 5, 8, 10, 21, 22, 25, 27, 32, 37, 38, 39, 40, 43, 49, 90, 95, 96, 106, 116, 126, 129, 138, 163, 164, 168, 175, 261, 262, 176, 180, 226, 232, 244, 246, 259, 268, 283, 295, 296, 297, 299, 306, 309, 316, 321, 329, 330, 333, 348, 349, 359, 372, 379, 380 and 266789-269521. |
| 35 | Streptococcus pyogenes MGAS315 | 3, 8, 10, 13, 20, 22, 25, 27, 31, 32, 33, 37, 38, 40, 46, 48, 52, 55, 62, 67, 73, 84, 90, 91, 105, 106, 113, 116, 175, 176, 129, 138, 152, 160, 164, 166, 168, 177, 179, 180, 186, 190, 192, 208, 211, 213, 214, 218, 226, 229, 232, 236, 242, 244, 246, 262, 268, 271, 272, 274, 282, 283, 295, 296, 297, 299, 306, 309, 312, 321, 323, 324, 325, 327, 329, 333, 340, 345, 348, 349, 353, 356, 359, 372, 379, 380, 381 and 269522-272357. |
| 36 | Streptococcus pyogenes MGAS8232 | 3, 4, 8, 10, 13, 21, 22, 25, 27, 31, 33, 37, 38, 39, 40, 46, 48, 52, 55, 62, 67, 73, 84, 90, 91, 95, 105, 106, 113, 116, 129, 138, 168, 152, 160, 163, 164, 166, 175, 176, 177, 179, 180, 190, 205, 208, 213, 214, 218, 226, 232, 236, 242, 244, 246, 247, 259, 260, 261, 262, 268, 271, 272, 274, 295, 296, 297, 299, 306, 307, 309, 316, 321, 323, 324, 325, 327, 329, 330, 333, 337, 340, 344, 345, 348, 349, 353, 356, 359, 363, 372, 379, 380, 381 and 272358-275553. |
| 37 | Streptococcus pyogenes SSI-1 | 10, 13, 25, 27, 31, 33, 46, 48, 52, 55, 62, 67, 73, 84, 91, 164, 166, 168, 175, 176, 177, 179, 180, 190, 205, 208, 213, 214, 242, 218, 236, 244, 246, 262, 268, 271, 272, 274, 297, 299, 306, 324, 325, 327, 329, 321, 323, 105, 113, 152, 160, 333, 340, 345, 348, 353, 356, 359, 372, 380, 381 and 275554-276703. |
| 38 | Treponema subsp. pallidum str. Nichols | 3, 10, 13, 48, 52, 57, 59, 67, 81, 84, 86, 90, 91, 121, 131, 134, 174, 175, 176, 184, 218, 228, 231, 235, 236, 243, 261, 262, 269, 272 306, 289, 291, 295, 299, 312, 324, 329, 332, 333, 340 345, 356, 358 and 276704-277654. |
| 39 | Yersinia pestis | 1, 2, 3, 4, 5, 6, 7, 8, 9, 10, 12, 13, 16, 18, 19, 21, 22, 25, 26, 27, 28, 29, 30, 31, 32, 33, 34, 36, 37, 39, 40, 41, 54, 42, 43, 45, 46, 47, 48, 51, 52, 53, 55, 57, 58, 61, 62, 63, 67, 68, 70, 71, 73, 75, 76, 78, 82, 84, 85, 87, 88, 89, 90, 91, 93, 94, 95, 98, 99, 101, 102, 103, 105, 106, 107, 108, 111, 112, 113, 114, 115, 116, 117, 120, 121, 122, 123, 124, 125, 126, 129, 130, 131, 132, 133, 134, 135, 136, 138, 140, 141, 142, 143, 146, 148, 149, 151, 152, 153, 154, 155, 156, 160, 164, 165, 166, 167, 169, 171, 172, 174, 175, 176, 177, 178, 179, 180, 182, 184, 186, 187, 188, 190, 191, 192, 193, 196, 197, 198, 199, 200, 201, 202, 203, 205, 206, 208, 209, 211, 213, 214, 215, 217, 218, 219, 220, 221, 222, 224, 225, 226, 227, 229, 230, 232, 233, 234, 236, 237, 238, 239, 240, 241, 242, 243, 244, 245, 250, 251, 252, 253, 255, 256, 257, 258, 259, 260, 262, 263, 264, 270, 271, 272, 274, 276, 279, 280, 281, 282, 283, 286, 287, 289, 291, 292, 293, 295, 296, 298, 299, 300, 301, 302, 304, 306, 307, 308, 309, 311, 314, 315, 317, 319, 321, 322, 323, 324, 325, 326, 327, 329, 330, 331, 333, 334, 335, 336, 337, 340, 341, 342, 343, 344, 345, 346, 348, 349, 350, 351, 352, 353, 354, 355, 356, 357, 358, 359, 363, 364, 365, 367, 368, 370, 372, 373, 374, 376, 377, 378, 379, 380, 381, 382, 383, 384 and 277655-287825. |
| 40 | Yersinia pestis KIM | 1, 2, 3, 4, 5, 6, 7, 8, 9, 10, 12, 13, 16, 18, 19, 20, 21, 22, 25, 26, 27, 28, 29, 31, 32, 33, 34, 36, 37, 39, 40, 41, 53, 54, 42, 43, 45, 46, 47, 48, 51, 52, 55, 57, 58, 61, 62, 63, 65, 67, 68, 70, 71, 72, 73, 75, 76, 78, 84, 85, 87, 88, 89, 90, 91, 93, 94, 95, 97, 99, 101, 102, 103, 105, 106, 107, 108, 111, 112, 113, 114, 115, 117, 118, 120, 121, 122, 123, 124, 125, 126, 129, 130, 131, 132, 133, 134, 135, 136, 138, 140, 142, 143, 146, 147, 148, 149, 151, 152, 153, 154, 156, 158, 160, 164, 165, 166, 169, 171, 172, 174, 175, 176, 177, 178, 179, 180, 182, 186, 187, 188, 190, 191, 192, 193, 196, 197, 198, 199, 200, 201, 202, 203, 205, 206, 207, 208, 209, 211, 213, 214, 215, 217, 218, 220, 221, 222, 224, 225, 226, 227, 229, 230, 232, 233, 234, 235, 236, 237, 238, 239, 240, 241, 242, 243, 244, 247, 248, 250, 251, 252, 253, 255, 256, 257, 258, 260, 262, 263, 264, 270, 271, 272, 274, 276, 279, 281, 282, 283, 284, 286, 287, 288, 289, 291, 292, 293, 294, 295, 296, 298, 299, 300, 302, 303, 305, 306, 307, 308, 309, 311, 314, 315, 317, 318, 319, 321, 322, 323, 324, 325, 327, 329, 330, 331, 333, 334, 335, 336, 337, 340, 341, 342, 343, 344, 345, 346, 348, 349, 350, 351, 352, 353, 354, 355, 356, 357, 358, 359, 362, 363, 364, 365, 367, 368, 370, 373, 374, 375, 376, 377, 378, 379, 380, 381, 382, 383, 384, 385 and 287826-298021. |

The present invention discloses a novel group of bacterial and human oligonucleotides, belonging to the miRNA-like oligonucleotide group, here termed GAM oligonucleotides, for which a specific complementary binding has been determined bioinformatically.

Reference is now made to FIG. 2, which is a simplified block diagram illustrating a bioinformatic oligonucleotide detection system and method constructed and operative in accordance with a preferred embodiment of the present invention.

An important feature of the present invention is a bioinformatic oligonucleotide detection engine 100, which is capable of bioinformatically detecting oligonucleotides of the present invention.

The functionality of the bioinformatic oligonucleotide detection engine 100 includes receiving expressed RNA data 102, sequenced DNA data 104, and protein function data 106; performing a complex process of analysis of this data as elaborated hereinbelow, and based on this analysis provides information, designated by reference numeral 108, identifying and describing features of novel oligonucleotides.

Expressed RNA data 102 comprises published expressed sequence tags (EST) data, published mRNA data, as well as other published RNA data. Sequenced DNA data 104 comprises alphanumeric data representing genomic sequences and preferably including annotations such as information indicating the location of known protein-coding regions relative to the genomic sequences.

Protein function data 106 comprises information from scientific publications e.g. physiological functions of known proteins and their connection, involvement and possible utility in treatment and diagnosis of various diseases.

Expressed RNA data 102 and sequenced DNA data 104 may preferably be obtained from data published by the National Center for Biotechnology Information (NCBI) at the National Institute of Health (NIH) (Jenuth, J. P. (2000). Methods Mol. Biol. 132:301-312(2000), herein incorporated by reference) as well as from various other published data sources. Protein function data 106 may preferably be obtained from any one of numerous relevant published data sources, such as the Online Mendelian Inherited Disease In Man (OMIM™, Hamosh et al., Nucleic Acids Res. 30: 52-55 (2002)) database developed by John Hopkins University, and also published by NCBI (2000).

Prior to or during actual detection of bioinformatically-detected group of novel oligonucleotides 108 by the bioinformatic oligonucleotide detection engine 100, bioinformatic oligonucleotide detection engine training & validation functionality 110 is operative. This functionality uses one or more known miRNA oligonucleotides as a training set to train the bioinformatic oligonucleotide detection engine 100 to bioinformatically recognize miRNA-like oligonucleotides, and their respective potential target binding sites. Bioinformatic oligonucleotide detection engine training & validation functionality 110 is further described hereinbelow with reference to FIG. 3.

The bioinformatic oligonucleotide detection engine 100 preferably comprises several modules which are preferably activated sequentially, and are described as follows:

A non-protein-coding genomic sequence detector 112 operative to bioinformatically detect non-protein-coding genomic sequences. The non-protein-coding genomic sequence detector 112 is further described herein below with reference to FIGS. 4A and 4B.

A hairpin detector 114 operative to bioinformatically detect genomic "hairpin-shaped" sequences, similar to GAM FOLDED PRECURSOR RNA (FIG. 1). The hairpin detector 114 is further described herein below with reference to FIGS. 5A and 5B.

A Dicer-cut location detector 116 operative to bioinformatically detect the location on a GAM FOLDED PRECURSOR RNA which is enzymatically cut by DICER COMPLEX (FIG. 1), yielding "diced" GAM RNA. The Dicer-cut location detector 116 is further described herein below with reference to FIGS. 6A-6C.

A target gene binding site detector 118 operative to bioinformatically detect target genes having binding sites, the nucleotide sequence of which is partially complementary to that of a given genomic sequence, such as a nucleotide sequence cut by DICER COMPLEX. The target gene binding site detector 118 is further described hereinbelow with reference to FIGS. 7A and 7B.

A function & utility analyzer, designated by reference numeral 120, is operative to analyze the function and utility of target genes in order to identify target genes which have a significant clinical function and utility. The function & utility analyzer 120 is further described hereinbelow with reference to FIG. 8

According to an embodiment of the present invention, the bioinformatic oligonucleotide detection engine 100 may employ a cluster of 40 personal computers (PCs; XEON®, 2.8 GHz, with 80 GB storage each) connected by Ethernet to eight servers (2-CPU, XEON™ 1.2-2.2 GHz, with ~200 GB storage each) and combined with an 8-processor server (8-CPU, Xeon 550 Mhz w/8 GB RAM) connected via 2 HBA fiber-channels to an EMC CLARIION™ 100-disks, 3.6 Terabyte storage device. A preferred embodiment of the present invention may also preferably comprise software that utilizes a commercial database software program, such as MICROSOFT ™ SQL Server 2000.

According to a preferred embodiment of the present invention, the bioinformatic oligonucleotide detection engine 100 may employ a cluster of 80 Servers (XEON®, 2.8 GHz, with 80 GB storage each) connected by Ethernet to eight servers (2-CPU, XEON™ 1.2-2.2 GHz, with ~200 GB storage each) and combined with storage device (Promise Technology Inc., RM8000) connected to an 8-disks, 2 Terabytes total. A preferred embodiment of the present invention may also preferably comprise software that utilizes a commercial database software program, such as MICROSOFT ™ SQL Server 2000. It is appreciated that the abovementioned hardware configuration is not meant to be limiting and is given as an illustration only. The present invention may be implemented in a wide variety of hardware and software configurations.

The present invention discloses 21,916 bacterial and 6,100 human novel oligonucleotides of the GAM group of oligonucleotides, which have been detected bioinformatically and 6,056 bacterial and 430 novel polynucleotides of the GR group of polynucleotides, which have been detected bioinformatically. Laboratory confirmation of bioinformatically predicted oligonucleotides of the GAM group of oligonucleotides, and several bioinformatically predicted polynucleotides of the GR group of polynucleotides, is described hereinbelow with reference to FIGS. 13-15D, FIG. 18 and Table 12.

Reference is now made to FIG. 3, which is a simplified flowchart illustrating operation of a preferred embodiment of the bioinformatic oligonucleotide detection engine training & validation functionality 110 described hereinabove with reference to FIG. 2.

Bioinformatic oligonucleotide detection engine training & validation functionality 110 begins by training the bioinformatic oligonucleotide detection engine 100 (FIG. 2) to recognize one or more known miRNA oligonucleotides, as designated by reference numeral 122. This training step comprises hairpin detector training & validation functionality 124, further described hereinbelow with reference to FIG. 5A, Dicer-cut location detector training & validation functionality 126, further described hereinbelow with reference to FIGS. 6A and 6B, and target gene binding site detector training & validation functionality 128, further described hereinbelow with reference to FIG. 7A.

Next, the bioinformatic oligonucleotide detection engine training & validation functionality 110 is operative bioinformatically detect novel oligonucleotides, using bioinformatic oligonucleotide detection engine 100 (FIG. 2), as designated by reference numeral 130. Wet lab experiments are preferably conducted in order to validate expression and preferably function of some samples of the novel oligonucleotides detected by the bioinformatic oligonucleotide detection engine 100, as designated by reference numeral 132. FIGS. 13A-15D, FIG. 18 and Table 12 illustrate examples of wet lab validation of sample novel human oligonucleotides bioinformatically-detected in accordance with a preferred embodiment of the present invention.

Figure 4A:
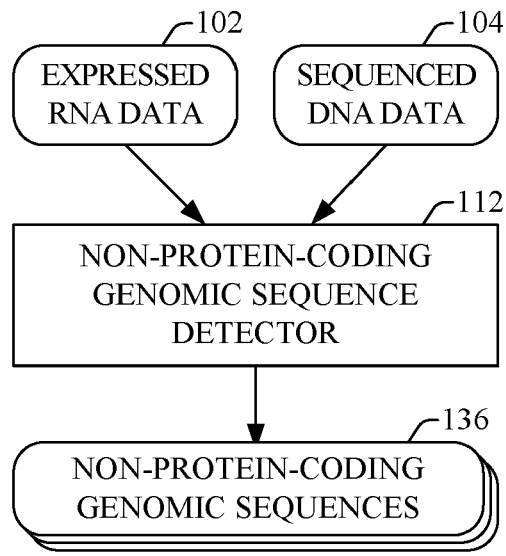
FIG. 4A is a simplified block diagram of a non-coding genomic sequence detector constructed and operative in accordance with a preferred embodiment of the present invention.

Reference is now made to FIG. 4A, which is a simplified block diagram of a preferred implementation of the non-protein-coding genomic sequence detector 112 described hereinabove with reference to FIG. 2. The non-protein-coding genomic sequence detector 112 preferably receives at least two types of published genomic data: Expressed RNA data 102 and sequenced DNA data 104. The expressed RNA data 102 may include, inter alia, EST data, EST clusters data, EST genome alignment data and mRNA data. Sources for expressed RNA data 102 include NCBI dbEST, NCBI Uni-Gene clusters and mapping data, and TIGR gene indices (Kirkness F. and Kerlavage, A. R., Methods Mol. Biol. 69:261-268 (1997)). Sequenced DNA data 104 may include sequence data (FASTA format files), and feature annotations (GenBank file format) mainly from NCBI databases. Based on the abovementioned input data, the non-protein-coding genomic sequence detector 112 produces a plurality of non-protein-coding genomic sequences 136. Preferred operation of the non-protein-coding genomic sequence detector 112 is described hereinbelow with reference to FIG. 4B.

Figure 4B:
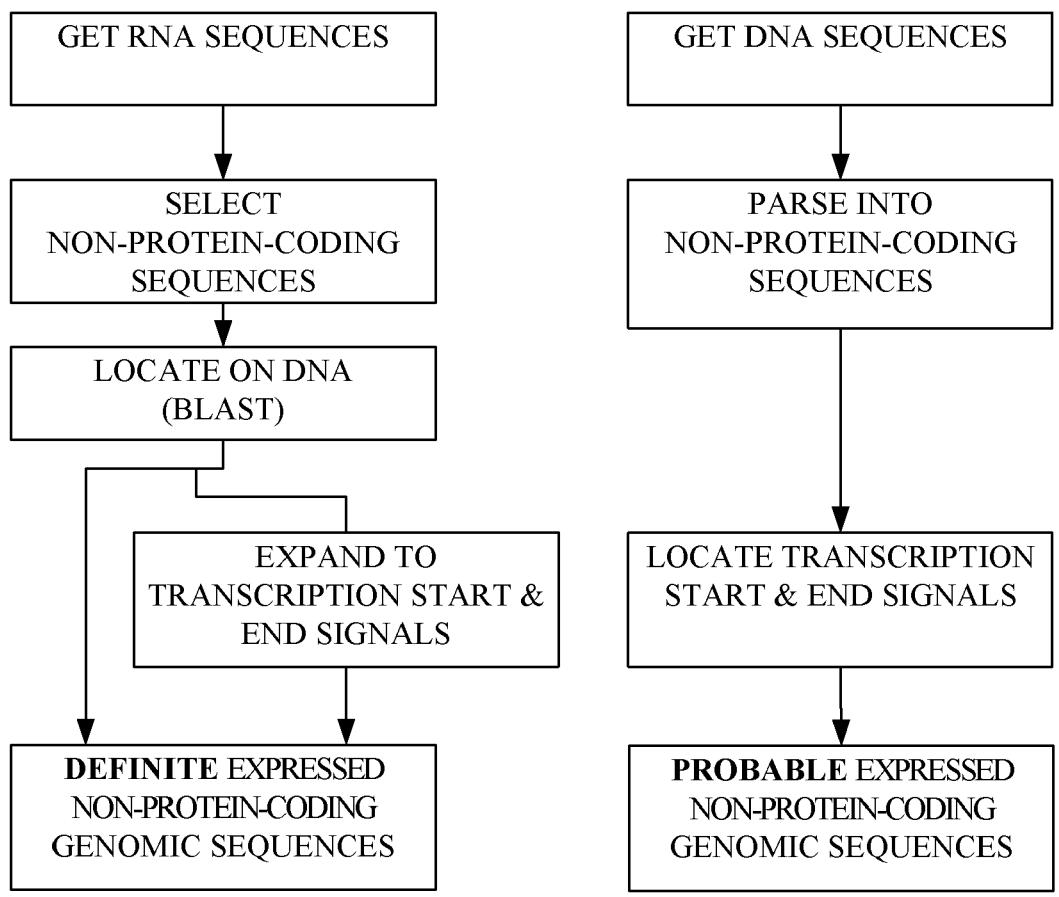
FIG. 4B is a simplified flowchart illustrating operation of a non-coding genomic sequence detector constructed and operative in accordance with a preferred embodiment of the present invention.

Reference is now made to FIG. 4B, which is a simplified flowchart illustrating a preferred operation of the non-protein-coding genomic sequence detector 112 of FIG. 2. Detection of non-protein-coding genomic sequences 136, generally preferably progresses along one of the following two paths:

A first path for detecting non-protein-coding genomic sequences 136 (FIG. 4A) begins with receipt of a plurality of known RNA sequences, such as EST data. Each RNA sequence is first compared with known protein-coding DNA sequences, in order to select only those RNA sequences which are non-protein-coding, i.e. intergenic or intronic sequences. This can preferably be performed by using one of many alignment algorithms known in the art, such as BLAST (Altschul et al., J. Mol. Biol. 215:403-410 (1990)). This sequence comparison preferably also provides localization of the RNA sequence on the DNA sequences.

Alternatively, selection of non-protein-coding RNA sequences and their localization on the DNA sequences can be performed by using publicly available EST cluster data and genomic mapping databases, such as the UNIGENE database published by NCBI or the TIGR database. Such databases, map expressed RNA sequences to DNA sequences encoding them, find the correct orientation of EST sequences, and indicate mapping of ESTs to protein-coding DNA regions, as is well known in the art. Public databases, such as TIGR, may also be used to map an EST to a cluster of ESTs, known in the art as Tentative Human Consensus and assumed to be expressed as one segment. Publicly available genome annotation databases, such as NCBI's GenBank, may also be used to deduce expressed intronic sequences.

Optionally, an attempt may be made to "expand" the non-protein RNA sequences thus found, by searching for transcription start and end signals, respectively upstream and downstream of the location of the RNA on the DNA, as is well known in the art.

A second path for detecting non-protein-coding genomic sequences 136 (FIG. 4A) begins with receipt of DNA sequences. The DNA sequences are parsed into non-protein-coding sequences, using published DNA annotation data, by extracting those DNA sequences which are between known protein-coding sequences. Next, transcription start and end signals are sought. If such signals are found, and depending on their robustness, probable expressed non-protein-coding genomic sequences are obtained. Such approach is especially useful for identifying novel GAM oligonucleotides which are found in proximity to other known miRNA oligonucleotides, or other wet lab validated GAM oligonucleotides. Since, as described hereinbelow with reference to FIG. 9, GAM oligonucleotides are frequently found in clusters; sequences located near known miRNA oligonucleotides are more likely to contain novel GAM oligonucleotides. Optionally, sequence orthology, i.e. sequence conservation in an evolutionary related species, may be used to select genomic sequences having a relatively high probability of containing expressed novel GAM oligonucleotides. It is appreciated that in detecting non-human GAM oligonucleotides of the present invention the bioinformatic oligonucleotide detection engine 100 utilizes the input genomic sequences, without filtering protein-coding regions detected by the non-protein-coding genomic sequence detector 112, hence non-protein-coding genomic sequences 136 refers to GENOMIC SEQUENCES only.

Figure 5A:
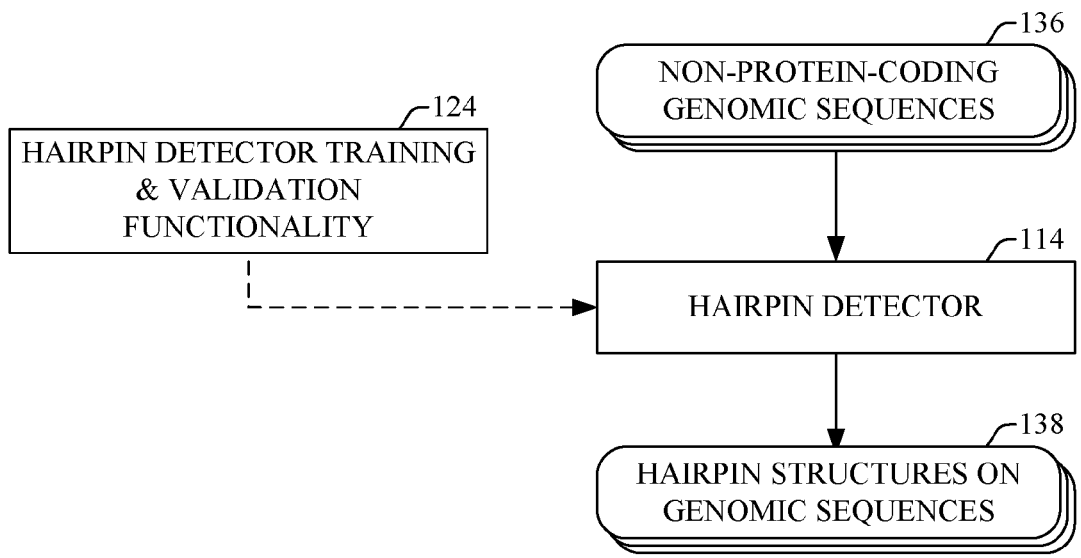
FIG. 5A is a simplified block diagram of a hairpin detector constructed and operative in accordance with a preferred embodiment of the present invention.

Reference is now made to FIG. 5A, which is a simplified block diagram of a preferred implementation of the hairpin detector 114 described hereinabove with reference to FIG. 2.

The goal of the hairpin detector 114 is to detect hairpin-shaped genomic sequences, similar to those of known miRNA oligonucleotides. A hairpin-shaped genomic sequence is a genomic sequence, having a first half which is at least partially complementary to a second half thereof, which causes the halves to folds onto themselves, thereby forming a hairpin structure, as mentioned hereinabove with reference to FIG. 1.

The hairpin detector 114 (FIG. 2) receives a plurality of non-protein-coding genomic sequences 136 (FIG. 4A). Following operation of hairpin detector training & validation functionality 124 (FIG. 3), the hairpin detector 114 is operative to detect and output hairpin-shaped sequences, which are found in the non-protein-coding genomic sequences 136. The hairpin-shaped sequences detected by the hairpin detector 114 are designated hairpin structures on genomic sequences 138. A preferred mode of operation of the hairpin detector 114 is described hereinbelow with reference to FIG. 5B.

Hairpin detector training & validation functionality 124 includes an iterative process of applying the hairpin detector 114 to known hairpin-shaped miRNA precursor sequences, calibrating the hairpin detector 114 such that it identifies a training set of known hairpin-shaped miRNA precursor sequences, as well as other similarly hairpin-shaped sequences. In a preferred embodiment of the present invention, the hairpin detector training & validation functionality 124 trains the hairpin detector 114 and validates each of the steps of operation thereof described hereinbelow with reference to FIG. 5B The hairpin detector training & validation functionality 124 preferably uses two sets of data: the aforesaid training set of known hairpin-shaped miRNA precursor sequences, such as hairpin-shaped miRNA precursor sequences of 440 miRNA oligonucleotides of *H. sapiens, M. musculus, C. elegans, C. Brigssae* and *D. Melanogaster*, annotated in the RFAM database (Griffiths-Jones 2003), and a background set of about 1000 hairpin-shaped sequences found in expressed non-protein-coding human genomic sequences. The background set is expected to comprise some valid, previously undetected hairpin-shaped miRNA-like precursor sequences, and many hairpin-shaped sequences which are not hairpin-shaped miRNA-like precursors.

In a preferred embodiment of the present invention the efficacy of the hairpin detector 114 (FIG. 2) is confirmed. For example, when a similarity threshold is chosen such that 87% of the known hairpin-shaped miRNA precursors are successfully predicted, only 21.8% of the 1000 background set of hairpin-shaped sequences are predicted to be hairpin-shaped miRNA-like precursors.

Figure 5B:
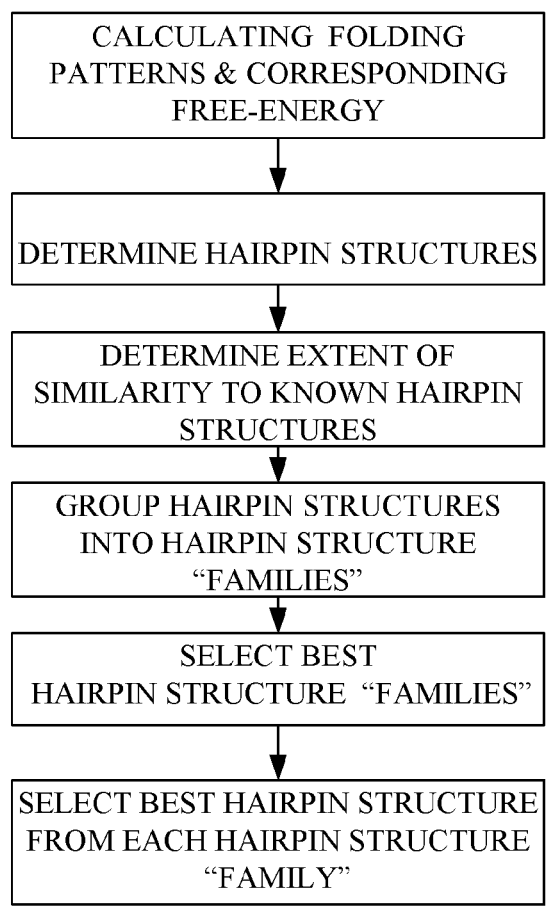
FIG. 5B is a simplified flowchart illustrating operation of a hairpin detector constructed and operative in accordance with a preferred embodiment of the present invention.

Reference is now made to FIG. 5B, which is a simplified flowchart illustrating preferred operation of the hairpin detector 114 of FIG. 2. The hairpin detector 114 preferably initially uses a secondary structure folding algorithm based on free-energy minimization, such as the MFOLD algorithm, described in Mathews et al. J. Mol. Biol. 288:911-940 (1999) and Zuker, M. Nucleic Acids Res. 31: 3406-3415 (2003), the disclosure of which is hereby incorporated by reference. This algorithm is operative to calculate probable secondary structure folding patterns of the non-protein-coding genomic sequences 136 (FIG. 4A) as well as the free-energy of each of these probable secondary folding patterns. The secondary structure folding algorithm, such as the MFOLD algorithm (Mathews, 1997; Zuker 2003), typically provides a listing of the base-pairing of the folded shape, i.e. a listing of each pair of connected nucleotides in the sequence.

Next, the hairpin detector 114 analyzes the results of the secondary structure folding patterns, in order to determine the presence and location of hairpin folding structures. The goal of this second step is to assess the base-pairing listing provided by the secondary structure folding algorithm, in order to determine whether the base-pairing listing describes one or more hairpin type bonding pattern. Preferably, sequence segment corresponding to a hairpin structure is then separately analyzed by the secondary structure folding algorithm in order to determine its exact folding pattern and free-energy.

The hairpin detector 114 then assesses the hairpin structures found by the previous step, comparing them to hairpin structures of known miRNA precursors, using various characteristic hairpin structure features such as its free-energy and its thermodynamic stability, the amount and type of mismatched nucleotides and the existence of sequence repeat-elements, number of mismatched nucleotides in positions 18-22 counting from loop, and Percent of G nucleotide. Only hairpins that bear statistically significant resemblance to the training set of hairpin structures of known miRNA precursors, according to the abovementioned parameters, are accepted.

In a preferred embodiment of the present invention, similarity to the training set of hairpin structures of known miRNA precursors is determined using a "similarity score" which is calculated using a multiplicity of terms, where each term is a function of one of the above-mentioned hairpin structure features. The parameters of each function are found heuristically from the set of hairpin structures of known miRNA precursors, as described hereinabove with reference to hairpin detector training & validation functionality 124 (FIG. 3). The selection of the features and their function parameters is optimized so as to achieve maximized separation between the distribution of similarity scores validated miRNA precursor hairpin structures, and the distribution of similarity scores of hairpin structures detected in the background set mentioned hereinabove with reference to FIG. 5B.

In an alternative preferred embodiment of the present invention, the step described in the preceding paragraph may be split into two stages. A first stage implements a simplified scoring method, typically based on thresholding a subset of the hairpin structure features described hereinabove, and may employ a minimum threshold for hairpin structure length and a maximum threshold for free-energy. A second stage is preferably more stringent, and preferably employs a full calculation of the weighted sum of terms described hereinabove. The second stage preferably is performed only on the subset of hairpin structures that survived the first stage.

The hairpin detector 114 also attempts to select hairpin structures whose thermodynamic stability is similar to that of hairpin structures of known miRNA precursors. This may be achieved in various ways. A preferred embodiment of the present invention utilizes the following methodology, preferably comprising three logical steps:

First, the hairpin detector 114 attempts to group hairpin structures into "families" of closely related hairpin structures. As is known in the art, a secondary structure folding algorithm typically provides multiple alternative folding patterns, for a given genomic sequence and indicates the free-energy of each alternative folding pattern. It is a particular feature of the present invention that the hairpin detector 114 preferably assesses the various hairpin structures appearing in the various alternative folding patterns and groups' hairpin structures which appear at identical or similar sequence locations in various alternative folding patterns into common sequence location based "families" of hairpins. For example, all hairpin structures whose center is within 7 nucleotides of each other may be grouped into a "family". Hairpin structures may also be grouped into a "family" if their nucleotide sequences are identical or overlap to a predetermined degree.

It is also a particular feature of the present invention that the hairpin structure "families" are assessed in order to select only those families which represent hairpin structures that are as thermodynamically stable as those of hairpin structures of known miRNA precursors. Preferably only families which are represented in at least a selected majority of the alternative secondary structure folding patterns, typically 65%, 80% or 100% are considered to be sufficiently stable. Our tests suggest that only about 50% of the hairpin structures, predicted by the MFOLD algorithm with default parameters, are members of sufficiently stable families, comparing to about 90% of the hairpin structures that contain known miRNAs. This percent depends on the size of the fraction that was fold. In an alternative embodiment of the present invention we use fractions of size 1000 nts as preferable size. Different embodiment uses other sizes of genomics sequences, more or less strict demand for representation in the alternative secondary structure folding patterns.

It is an additional particular feature of the present invention that the most suitable hairpin structure is selected from each selected family. For example, a hairpin structure which has the greatest similarity to the hairpin structures appearing in alternative folding patterns of the family may be preferred. Alternatively or additionally, the hairpin structures having relatively low free-energy may be preferred.

Alternatively or additionally considerations of homology to hairpin structures of other organisms and the existence of clusters of thermodynamically stable hairpin structures located adjacent to each other along a sequence may be important in selection of hairpin structures. The tightness of the clusters in terms of their location and the occurrence of both homology and clusters may be of significance.

Figure 6A:
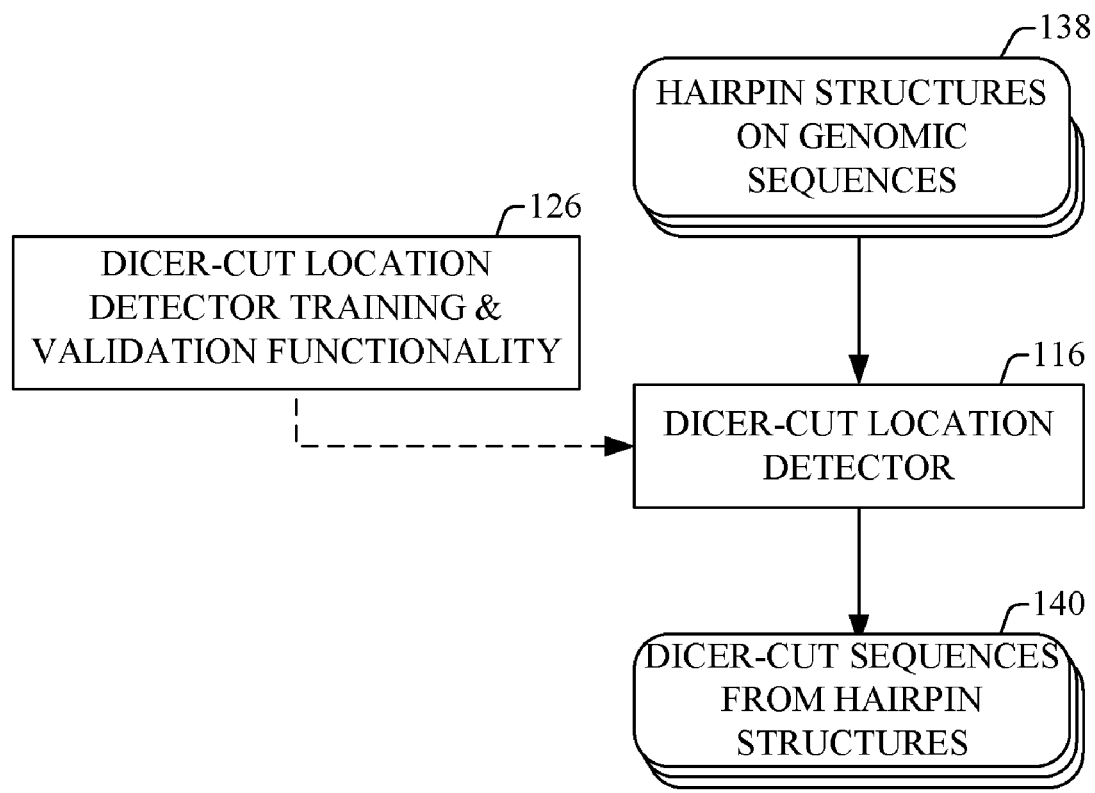
FIG. 6A is a simplified block diagram of a Dicer-cut location detector constructed and operative in accordance with a preferred embodiment of the present invention.
Figure 6B:
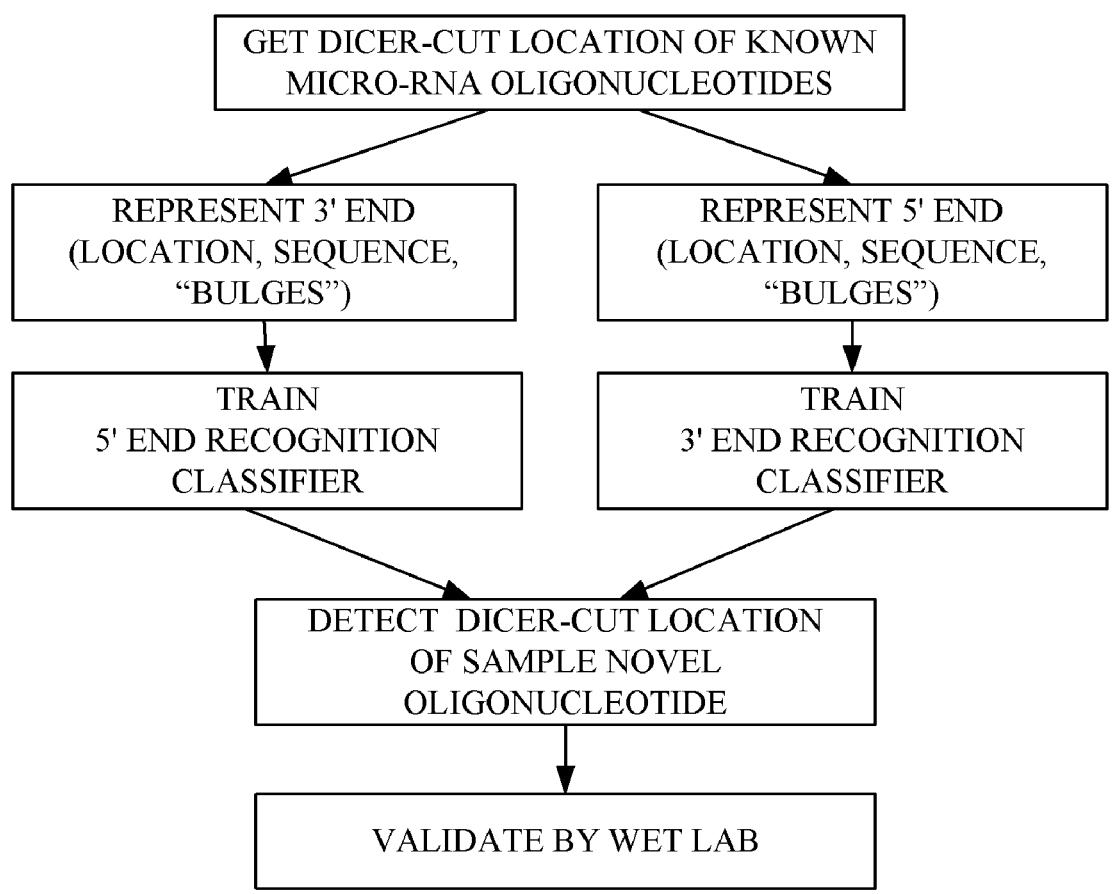
FIG. 6B is a simplified flowchart illustrating training of a Dicer-cut location detector constructed and operative in accordance with a preferred embodiment of the present invention.
Figure 6C:
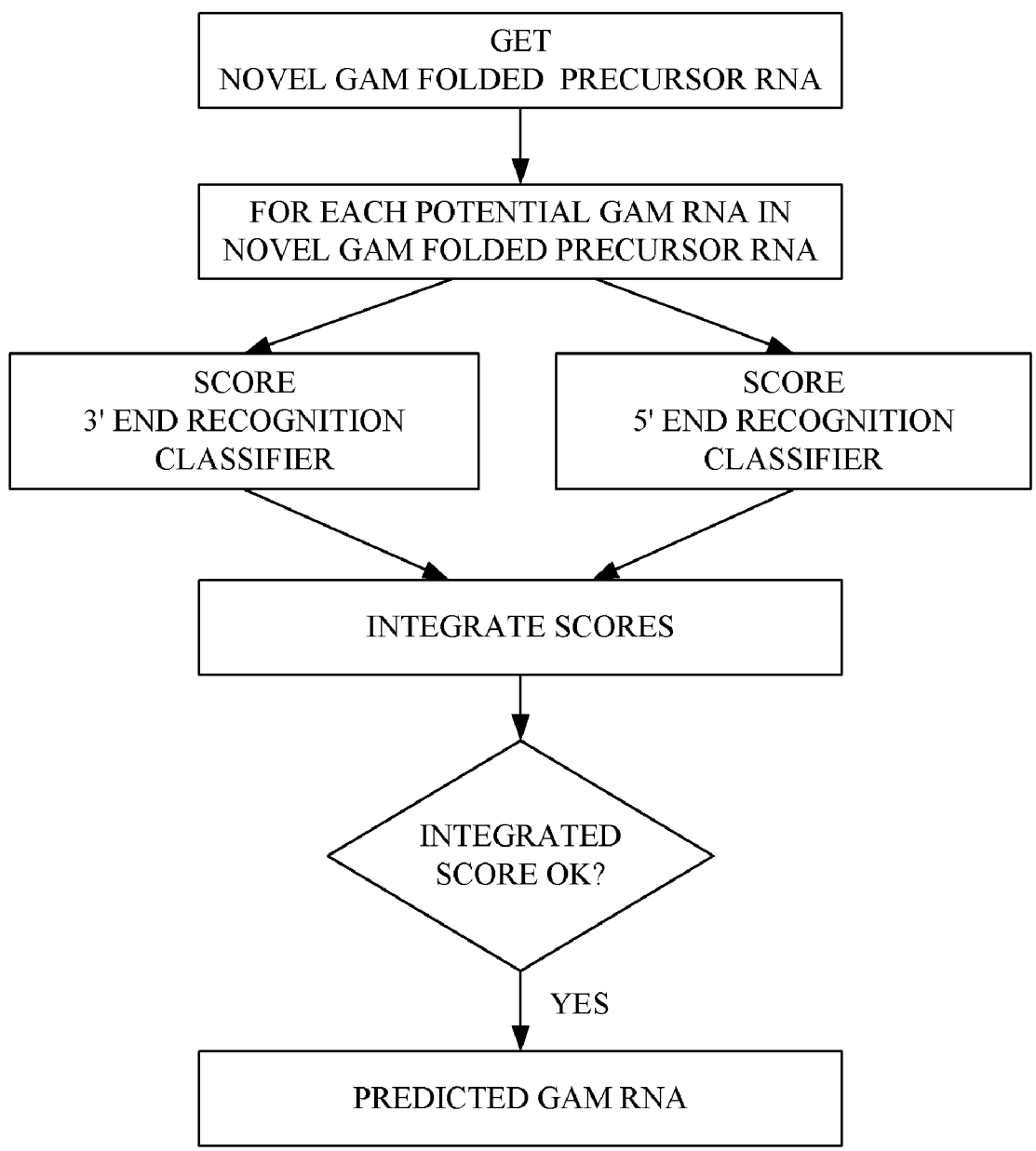
FIG. 6C is a simplified flowchart illustrating operation of a Dicer-cut location detector constructed and operative in accordance with a preferred embodiment of the present invention.

Reference is now made to FIGS. 6A-6C, which together describe the structure and operation of the Dicer-cut location detector 116, described hereinabove with reference to FIG. 2.

Reference is now made to FIG. 6A, which is a simplified block diagram of a preferred implementation of the Dicer-cut location detector 116. The goal of the Dicer-cut location detector 116 is to detect the location in which the DICER COMPLEX, described hereinabove with reference to FIG. 1, dices GAM FOLDED PRECURSOR RNA, yielding GAM RNA.

The Dicer-cut location detector 116 therefore receives a plurality of hairpin structures on genomic sequences, designated by reference numeral 138 (FIG. 5A), and following operation of Dicer-cut location detector training & validation functionality 126 (FIG. 3), is operative to detect a plurality of Dicer-cut sequences from hairpin structures, designated by reference numeral 140.

Reference is now made to FIG. 6B, which is a simplified flowchart illustrating a preferred implementation of Dicer-cut location detector training & validation functionality 126.

A general goal of the Dicer-cut location detector training & validation functionality 126 is to analyze the Dicer-cut locations of known diced miRNA on respective hairpin-shaped miRNA precursors in order to determine a common pattern in these locations, which can be used to predict Dicer-cut locations on GAM folded precursor RNAs.

The Dicer-cut locations of known miRNA precursors are obtained and studied. Locations of the 5' and/or 3' ends of the known diced miRNA oligonucleotides are preferably represented by their respective distances from the 5' end of the corresponding hairpin-shaped miRNA precursor. Additionally or alternatively, the 5' and/or 3' ends of the known diced miRNA oligonucleotides are preferably represented by the relationship between their locations and the locations of one or more nucleotides along the hairpin-shaped miRNA precursor. Additionally or alternatively, the 5' and/or 3' ends of the known diced miRNA oligonucleotides are preferably represented by the relationship between their locations and the locations of one or more bound nucleotide pairs along the hairpin-shaped miRNA precursor. Additionally or alternatively, the 5' and/or 3' ends of the known diced miRNA oligonucleotides are preferably represented by the relationship between their locations and the locations of one or more mismatched nucleotide pairs along the hairpin-shaped miRNA precursor. Additionally or alternatively, the 5' and/or 3' ends of the known diced miRNA oligonucleotides are preferably represented by the relationship between their locations and the locations of one or more unmatched nucleotides along the hairpin-shaped miRNA precursor. Additionally or alternatively, locations of the 5' and/or 3' ends of the known diced miRNA oligonucleotides are preferably represented by their respective distances from the loop located at the center of the corresponding hairpin-shaped miRNA precursor.

One or more of the foregoing location metrics may be employed in the Dicer-cut location detector training & validation functionality 126. Additionally, metrics related to the nucleotide content of the diced miRNA and/or of the hairpin-shaped miRNA precursor may be employed.

In a preferred embodiment of the present invention, Dicer-cut location detector training & validation functionality 126 preferably employs standard machine learning techniques known in the art of machine learning to analyze existing patterns in a given "training set" of examples. Standard machine learning techniques are capable, to a certain degree, of detecting patterns in examples to which they have not been previously exposed that are similar to those in the training set. Such machine learning techniques include, but are not limited to neural networks, Bayesian Modeling, Bayesian Networks, Support Vector Machines (SVM), Genetic Algorithms, Markovian Modeling, Maximum Likelihood Modeling, Nearest Neighbor Algorithms, Decision Trees and other techniques, as is well-known in the art.

In accordance with an embodiment of the present invention, two or more classifiers or predictors based on the abovementioned machine learning techniques are separately trained on the abovementioned training set, and are used jointly in order to predict the Dicer-cut location. As an example, FIG. 6B illustrates operation of two classifiers, a 3' end recognition classifier and a 5' end recognition classifier. Most preferably, the Dicer-cut location detector training & validation functionality 126 implements a "best-of-breed" approach employing a pair of classifiers based on the abovementioned Bayesian Modeling and Nearest Neighbor Algorithms, and accepting only "potential GAM RNAs" that score highly on one of these predictors. In this context, "high scores" means scores that have been demonstrated to have low false positive value when scoring known miRNA oligonucleotides. Alternatively, the Dicer-cut location detector training & validation functionality 126 may implement operation of more or less than two classifiers.

Predictors used in a preferred embodiment of the present invention are further described hereinbelow with reference to FIG. 6C. A computer program listing of a computer program implementation of the Dicer-cut location detector training & validation functionality 126 is enclosed on an electronic medium in computer-readable form, and is hereby incorporated by reference herein.

When evaluated on the abovementioned validation set of 440 published miRNA oligonucleotides using k-fold cross validation (Mitchell, 1997) with k=3, the performance of the resulting predictors is as follows: In 70% of known miRNA oligonucleotides, a 5' end location is correctly determined by a Support Vector Machine predictor within up to two nucleotides; a Nearest Neighbor (EDIT DISTANCE) predictor achieves 56% accuracy (247/440); and a Two-Phased Predictor that uses Bayesian modeling (TWO PHASED) achieves 80% accuracy (352/440) when only the first phase is used. When the second phase (strand choice) is implemented by a naive Bayesian model, the accuracy is 55% (244/440), and when the K-nearest-neighbor modeling is used for the second phase, 374/440 decisions are made and the accuracy is 65% (242/374). A K-nearest-neighbor predictor (FIRST-K) achieves 61% accuracy (268/440). The accuracies of all predictors are considerably higher on top-scoring subsets of published miRNA oligonucleotides.

Finally, in order to validate the efficacy and accuracy of the Dicer-cut location detector 116, a sample of novel oligonucleotides detected thereby is preferably selected, and validated by wet lab experiments. Laboratory results validating the efficacy of the Dicer-cut location detector 116 are described hereinbelow with reference to FIGS. 13-15D, FIG. 18 and also in the enclosed file Table 12.

Reference is now made to FIG. 6C, which is a simplified flowchart illustrating an operation of a Dicer-cut location detector 116 (FIG. 2), constructed and operative in accordance with a preferred embodiment of the present invention. The Dicer-cut location detector 116 preferably comprises a machine learning computer program module, which is trained to recognize Dicer-cut locations on known hairpin-shaped miRNA precursors, and based on this training, is operable to detect Dicer-cut locations of novel GAM RNA (FIG. 1) on GAM FOLDED PRECURSOR RNA (FIG. 1). In a preferred embodiment of the present invention, the Dicer-cut location module preferably utilizes machine learning algorithms, including but not limited to Support Vector Machine, Bayesian modeling, Nearest Neighbors, and K-nearest-neighbor algorithms that are known in the art.

When initially assessing a novel GAM FOLDED PRECURSOR RNA, each 19-24 nt-long segment thereof is considered to be a potential GAM RNA, because the Dicer-cut location is initially unknown.

For each such potential GAM RNA, the location of its 5' end or the locations of its 5' and 3' ends are scored by at least one recognition classifier or predictor, operating on features such as the following: Locations of the 5' and/or 3' ends of the known diced miRNA oligonucleotides, which are preferably represented by their respective distances from the 5' end of the corresponding hairpin-shaped miRNA precursor. Additionally or alternatively, the 5' and/or 3' ends of the known diced miRNA oligonucleotides, which are preferably represented by the relationship between their locations and the locations of one or more nucleotides along the hairpin-shaped miRNA precursor. Additionally or alternatively, the 5' and/or 3' ends of the known diced miRNA oligonucleotides, which are preferably represented by the relationship between their locations and the locations of one or more bound nucleotide pairs along the hairpin-shaped miRNA precursor. Additionally or alternatively, the 5' and/or 3' ends of the known diced miRNA oligonucleotides, which are preferably represented by the relationship between their locations and the locations of one or more mismatched nucleotide pairs along the hairpin-shaped miRNA precursor. Additionally or alternatively, the 5' and/or 3' ends of the known diced miRNA oligonucleotides, which are preferably represented by the relationship between their locations and the locations of one or more unmatched nucleotides along the hairpin-shaped miRNA precursor. Additionally or alternatively, locations of the 5' and/or 3' ends of the known diced miRNA oligonucleotides, which are preferably represented by their respective distances from the loop located at the center of the corresponding hairpin-shaped miRNA precursor. Additionally or alternatively, metrics related to the nucleotide content of the diced miRNA and/or of the hairpin-shaped miRNA precursor.

In a preferred embodiment of the present invention, the Dicer-cut location detector 116 (FIG. 2) may use a Support Vector Machine predictor.

In another preferred embodiment of the present invention, the Dicer-cut location detector 116 (FIG. 2) preferably employs an "EDIT DISTANCE" predictor, which seeks sequences that are similar to those of known miRNA oligonucleotides, utilizing a Nearest Neighbor algorithm, where a similarity metric between two sequences is a variant of the Edit Distance algorithm (Gusfield, 1997). The EDIT DISTANCE predictor is based on an observation that miRNA oligonucleotides tend to form clusters, the members of which show marked sequence similarity.

In yet another preferred embodiment of the present invention, the Dicer-cut location detector 116 (FIG. 2) preferably uses a "TWO PHASE" predictor, which predicts the Dicer-cut location in two distinct phases: (a) selecting a double-stranded segment of the GAM FOLDED PRECURSOR RNA (FIG. 1) comprising the GAM RNA by naive Bayesian modeling and (b) detecting which strand of the double-stranded segment contains GAM RNA (FIG. 1) by employing either naive or K-nearest-neighbor modeling. K-nearest-neighbor modeling is a variant of the "FIRST-K" predictor described hereinbelow, with parameters optimized for this specific task. The "TWO PHASE" predictor may be operated in two modes: either utilizing only the first phase and thereby producing two alternative Dicer-cut location predictions, or utilizing both phases and thereby producing only one final Dicer-cut location.

In still another preferred embodiment of the present invention, the Dicer-cut location detector 116 preferably uses a "FIRST-K" predictor, which utilizes a K-nearest-neighbor algorithm. The similarity metric between any two sequences is 1-E/L, where L is a parameter, preferably 8-10 and E is the edit distance between the two sequences, taking into account only the first L nucleotides of each sequence. If the K-nearest-neighbor scores of two or more locations on the GAM FOLDED PRECURSOR RNA (FIG. 1) are not significantly different, these locations are further ranked by a Bayesian model, similar to the one described hereinabove.

In accordance with an embodiment of the present invention, scores of two or more of the abovementioned classifiers or predictors are integrated, yielding an integrated score for each potential GAM RNA. As an example, FIG. 6C illustrates an integration of scores from two classifiers, a 3' end recognition classifier and a 5' end recognition classifier, the scores of which are integrated to yield an integrated score. Most preferably, the INTEGRATED SCORE of FIG. 6C preferably implements a "best-of-breed" approach employing a pair of classifiers and accepting only "potential GAM RNAs" that score highly on one of the abovementioned "EDIT DISTANCE" or "TWO PHASE" predictors. In this context, "high scores" means scores that have been demonstrated to have low false positive value when scoring known miRNA oligonucleotides. Alternatively, the INTEGRATED SCORE may be derived from operation of more or less than two classifiers.

The INTEGRATED SCORE is evaluated as follows: (a) the "potential GAM RNA" having the highest score is preferably taken to be the most probable GAM RNA, and (b) if the integrated score of this most probable GAM RNA is higher than a pre-defined threshold, then the most probable GAM RNA is accepted as a PREDICTED GAM RNA. Preferably, this evaluation technique is not limited to the highest scoring potential GAM RNA.

In a preferred embodiment of the present invention, PREDICTED GAM RNAs comprising a low complexity nucleotide sequence (e.g., ATATATA) may optionally be filtered out, because there is a high probability that they are part of a repeated element in the DNA, and are therefore not functional, as is known in the art. For each PREDICTED GAM RNA sequence, the number of occurrences of each two nt combination (AA, AT, AC) comprised in that sequence is counted. PREDICTED GAM RNA sequences where the sum of the two most probable combinations is higher than a threshold, preferably 8-10, are filtered out. As an example, when the threshold is set such that 2% of the known miRNA oligonucleotides are filtered out, 30% of the predicted GAM RNAs are filtered out.

Figure 7A:
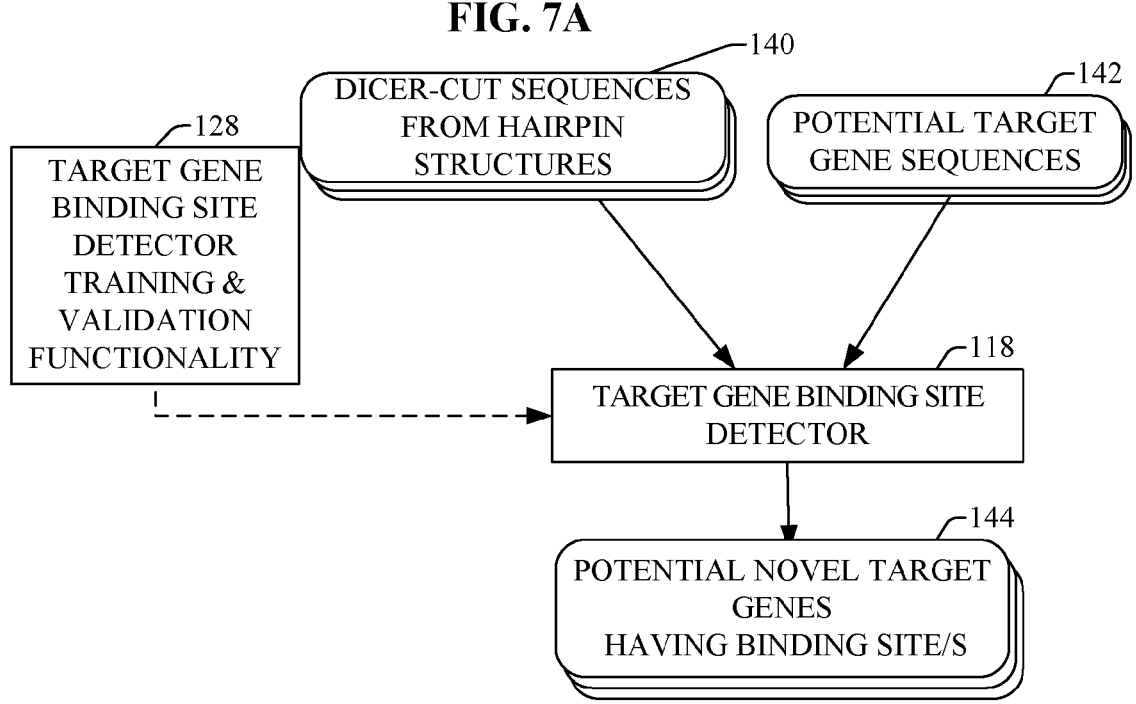
FIG. 7A is a simplified block diagram of a target gene binding site detector constructed and operative in accordance with a preferred embodiment of the present invention.

Reference is now made to FIG. 7A, which is a simplified block diagram of a preferred implementation of the target gene binding site detector 118 described hereinabove with reference to FIG. 2. The goal of the target gene binding site detector 118 is to detect one or more binding sites located in 3'UTRs of the mRNA of a known gene, such as BINDING SITE I, BINDING SITE II and BINDING SITE III (FIG. 1), the nucleotide sequence of which binding sites is partially or fully complementary to a GAM RNA, thereby determining that the abovementioned known gene is a target gene of the GAM RNA.

The target gene binding site detector 118 (FIG. 2) receives a plurality of Dicer-cut sequences from hairpin structures 140 (FIG. 6A) and a plurality of potential target gene sequences 142, which are derived from sequenced DNA data 104 (FIG. 2).

The target gene binding site detector training & validation functionality 128 (FIG. 3) is operative to train the target gene binding site detector 118 on known miRNA oligonucleotides and their respective target genes and to build a background model for an evaluation of the probability of achieving similar results randomly (P value) for the target gene binding site detector 118 results. The target gene binding site detector training & validation functionality 128 constructs the model by analyzing both heuristically and computationally the results of the target gene binding site detector 118.

Following operation of target gene binding site detector training & validation functionality 128 (FIG. 3), the target gene binding site detector 118 is operative to detect a plurality of potential novel target genes having binding site/s 144, the nucleotide sequence of which is partially or fully complementary to that of each of the plurality of Dicer-cut sequences from hairpin structures 140. Preferred operation of the target gene binding site detector 118 is further described hereinbelow with reference to FIG. 7B.

Figure 7B:
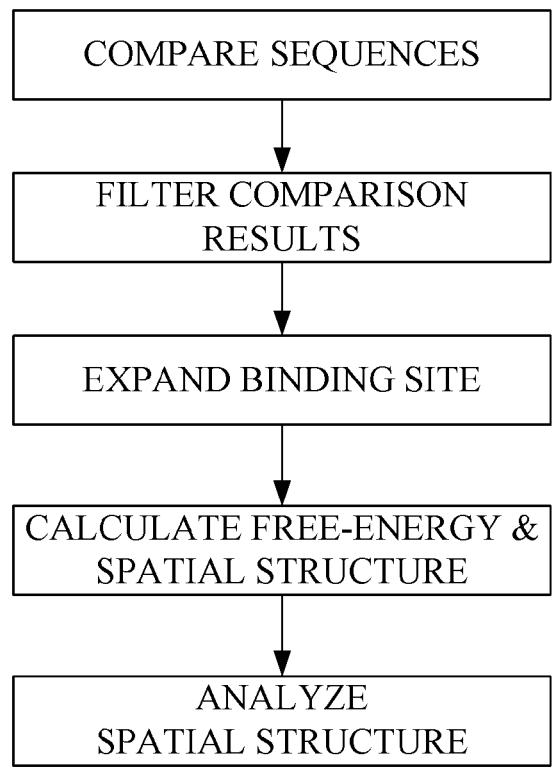
FIG. 7B is a simplified flowchart illustrating operation of a target gene binding site detector constructed and operative in accordance with a preferred embodiment of the present invention.

Reference is now made to FIG. 7B, which is a simplified flowchart illustrating a preferred operation of the target gene binding site detector 118 of FIG. 2.

In an embodiment of the present invention, the target gene binding site detector 118 first compares nucleotide sequences of each of the plurality of Dicer-cut sequences from hairpin structures 140 (FIG. 6A) to the potential target gene sequences 142 (FIG. 7A), such as 3' side UTRs of known mRNAs, in order to find crude potential matches. This step may be performed using a simple alignment algorithm such as BLAST.

Then, the target gene binding site detector 118 filters these crude potential matches, to find closer matches, which more closely resemble published miRNA oligonucleotide binding sites.

Next, the target gene binding site detector 118 expands the nucleotide sequences of the 3'UTR binding site found by the sequence comparison algorithm (e.g. BLAST or EDIT DISTANCE). A determination is made whether any sub-sequence of the expanded sequence may improve the match. The best match is considered the alignment.

Free-energy and spatial structure are computed for the resulting binding sites. Calculation of spatial structure may be performed by a secondary structure folding algorithm based on free-energy minimization, such as the MFOLD algorithm described in Mathews et al. (J. Mol. Biol. 288: 911-940 (1999)) and Zuker (Nucleic Acids Res. 31: 3406-3415 (2003)), the disclosure of which is hereby incorporated by reference. Free-energy, spatial structure and the above preferences are reflected in scoring. The resulting scores are compared with scores characteristic of known binding sites of published miRNA oligonucleotides, and each binding site is given a score that reflects its resemblance to these known binding sites.

Finally, the target gene binding site detector 118 analyzes the spatial structure of the binding site. Each 3'UTR-GAM oligonucleotide pair is given a score. Multiple binding sites of the same GAM oligonucleotides to a 3'UTR are given higher scores than those that bind only once to a 3'UTR.

In a preferred embodiment of the present invention, performance of the target gene binding site detector 118 may be improved by integrating several of the abovementioned logical steps, using the methodology described hereinbelow.

For each of the Dicer-cut sequence from hairpin structures 140, its starting segment, e.g. a segment comprising the first 8 nts from its 5' end, is obtained. For each starting segment, all of the 9 nt segments that are highly complementary to the starting segment are calculated. These calculated segments are referred to here as "potential binding site end segments". In a preferred embodiment of the present invention, for each 8 nt starting segment, the potential binding site end segments are all 9 nt segments whose complementary sequence contains a 7-9 nt sub-sequence that is not different from the starting segment by more than an insertion, deletion or replacement of one nt. Calculation of potential binding site end segments is preferably performed by a pre-processing tool that maps all possible 8 nt segments to their respective 9 nt segments.

Next, the mRNAs 3'UTRs is parsed into all the segments, with the same length as the potential binding site end segments, preferably 9 nt segments, comprised in the 3'UTR. Location of each such segment is noted, stored in a performance-efficient data structure and compared to the potential binding site end segments calculated in the previous step.

The target gene binding site detector 118 then expands the binding site sequence, preferably in the binding site 5' direction (i.e. immediately upstream), assessing the degree of its alignment to the Dicer-cut sequence from hairpin structures 140. Preferably, an alignment algorithm is implemented which uses specific weighting parameters based on an analysis of known miRNA oligonucleotide binding sites. As an example, it is apparent that a good match of the 3' end of the binding site is critically important, a match of the 5' end is less important but can compensate for a small number of mismatches at the 3' end of the binding site, and a match of the middle portion of the binding site is much less important.

Next, the number of binding sites found in a specific 3'UTR, the degree of alignment of each of these binding sites, and their proximity to each other are assessed and compared to these properties found in known binding sites of published miRNA oligonucleotides. In a preferred embodiment, the fact that many of the known binding sites are clustered is used to evaluate the P value of obtaining a cluster of a few binding sites on the same target gene 3'UTR in the following way. It scans different score thresholds and calculates for each threshold the number and positions of possible binding sites with a score above the threshold. It then gets a P value for each threshold from a preprocessed calculated background matrix, described hereinbelow, and a number and positions of binding sites combination. The output score for each Dicer-cut sequences from hairpin structures 140 and potential target gene sequences 142 is the minimal P value, normalized with the number of threshold trails using a Bernoulli distribution. A preference of low P value pairs is made.

As mentioned hereinabove, for each target gene, a preprocessed calculated background matrix is built. The matrix includes rows for each number of miRNA oligonucleotide binding sites (in the preferred embodiment, the matrix includes 7 rows to accommodate 0 to 6 binding sites), and columns for each different score threshold (in the preferred embodiment, the matrix includes 5 columns for 5 different thresholds). Each matrix cell, corresponding to a specific number of binding sites and thresholds, is set to be the probability of getting equal or higher number binding sites and an equal or higher score using random 22 nt-long sequences with the same nucleotide distribution as known miRNA oligonucleotides (29.5% T, 24.5% A, 25% G and 21% C). Those probabilities are calculated by running the above procedure for 10000 random sequences that preserved the known miRNA nucleotide distribution (these sequence will be also referred to as miRNA oligonucleotide random sequences). The P value can be estimated as the number of random sequences that obeys the matrix cell requirement divided by the total number of random sequences (10000). In the preferred embodiment, 2 matrices are calculated. The P values of the second matrix are calculated under a constraint that at least two of the binding site positions are under a heuristically-determined constant value. The values of the second matrix are calculated without this constraint. The target gene binding site detector 118 uses the second matrix if the binding site positions agree with the constraint. Otherwise, it uses the first. In an alternative embodiment, only one matrix is calculated without any constraint on the binding sites positions.

A test performed using the target gene binding site detector 118 shows that all of the known miRNA oligonucleotide target genes are found using this algorithm with a P value of less than 0.5%. Running known miRNA oligonucleotides against 3400 potential 3'UTR of target gene sequences yields on average 32 target genes for each miRNA oligonucleotide with a P value less than 0.5%, while background sequences, as well as inverse or complement sequence of known miRNA oligonucleotide (which preserve their high order sequence statistics) found, as expected, 17 target genes on average. This result reflects that the algorithm has the ability to detect real target genes with 47% accuracy.

Finally, orthology data may optionally be used to further prefer binding sites based on their conservation. Preferably, this may be used in cases such as (a) where both the target mRNA and miRNA oligonucleotide have orthologues in another organism, e.g. Human-Mouse orthology, or (b) where a miRNA oligonucleotide (e.g. viral miRNA oligonucleotide) targets two mRNAs in orthologous organisms. In such cases, binding sites that are conserved are preferred.

In accordance with another preferred embodiment of the present invention, binding sites may be searched by a reverse process. Sequences of K (preferably 22) nucleotides in a UTR of a target gene are assessed as potential binding sites. A sequence comparison algorithm, such as BLAST or EDIT DISTANCE variant, is then used to search elsewhere in the genome for partially or fully complementary sequences that are found in known miRNA oligonucleotides or computationally-predicted GAM oligonucleotides. Only complementary sequences that meet predetermined spatial structure and free-energy criteria as described hereinabove, are accepted. Clustered binding sites are strongly preferred and potential binding sites and potential GAM oligonucleotides that occur in evolutionarily-conserved genomic sequences are also preferred. Scoring of candidate binding sites takes into account free-energy and spatial structure of the binding site complexes, as well as the aforesaid preferences.

The 3'UTR of each bacterial gene is extracted from the 500 nts that lay downstream to the gene-coding region. Care is taken that the extracted 3'UTR is not partly covered by the predicted 5'UTR of the next gene-coding region, considered 300 nts upstream. This method is applied on known (not hypothetical) bacterial genes of completed pathogenic eubacterial genomes taken from the updated NCBI Ref_seq database on 17 Mar. 2004.

Figure 8:
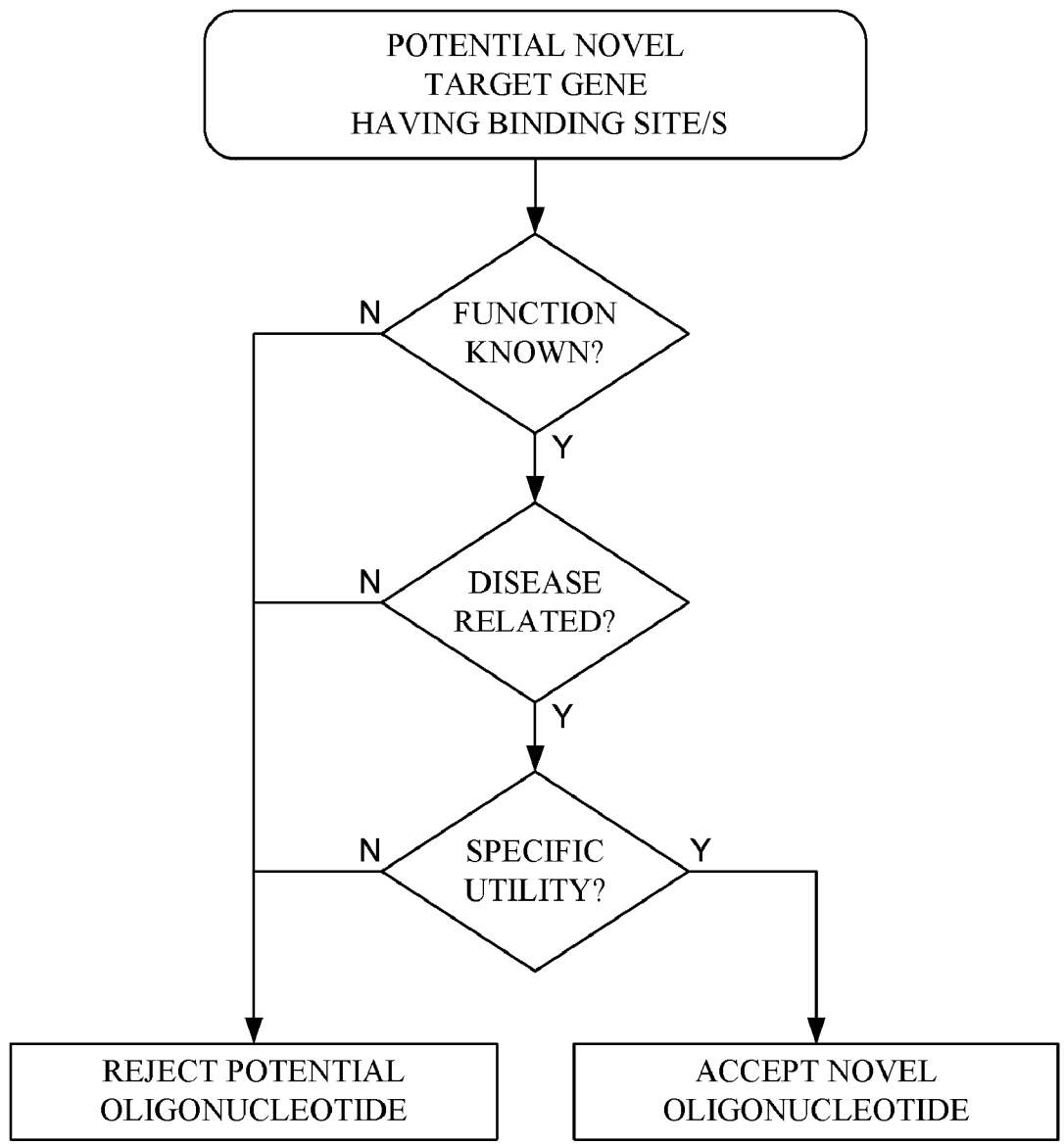
FIG. 8 is a simplified flowchart illustrating operation of a function and utility analyzer constructed and operative in accordance with a preferred embodiment of the present invention.

Reference is now made to FIG. 8, which is a simplified flowchart illustrating a preferred operation of the function & utility analyzer 120 described hereinabove with reference to FIG. 2. The goal of the function & utility analyzer 120 is to determine if a potential target gene is in fact a valid clinically useful target gene. Since a potential novel GAM oligonucleotide binding a binding site in the UTR of a target gene is understood to inhibit expression of that target gene, and if that target gene is shown to have a valid clinical utility, then in such a case it follows that the potential novel oligonucleotide itself also has a valid useful function which is the opposite of that of the target gene.

The function & utility analyzer 120 preferably receives as input a plurality of potential novel target genes having binding site/s 144 (FIG. 7A), generated by the target gene binding site detector 118 (FIG. 2). Each potential oligonucleotide is evaluated as follows: First, the system checks to see if the function of the potential target gene is scientifically well established. Preferably, this can be achieved bioinformatically by searching various published data sources presenting information on known function of proteins. Many such data sources exist and are published, as is well known in the art. Next, for those target genes the function of which is scientifically known and is well documented, the system then checks if scientific research data exists which links them to known diseases. For example, a preferred embodiment of the present invention utilizes the OMIM™ (Hamosh et al, 2002) database published by NCBI, which summarizes research publications relating to genes which have been shown to be associated with diseases. Finally, the specific possible utility of the target gene is evaluated. While this process too may be facilitated by bioinformatic means, it might require manual evaluation of published scientific research regarding the target gene, in order to determine the utility of the target gene to the diagnosis and or treatment of specific disease. Only potential novel oligonucleotides, the target genes of which have passed all three examinations, are accepted as novel oligonucleotide.

Figure 9:
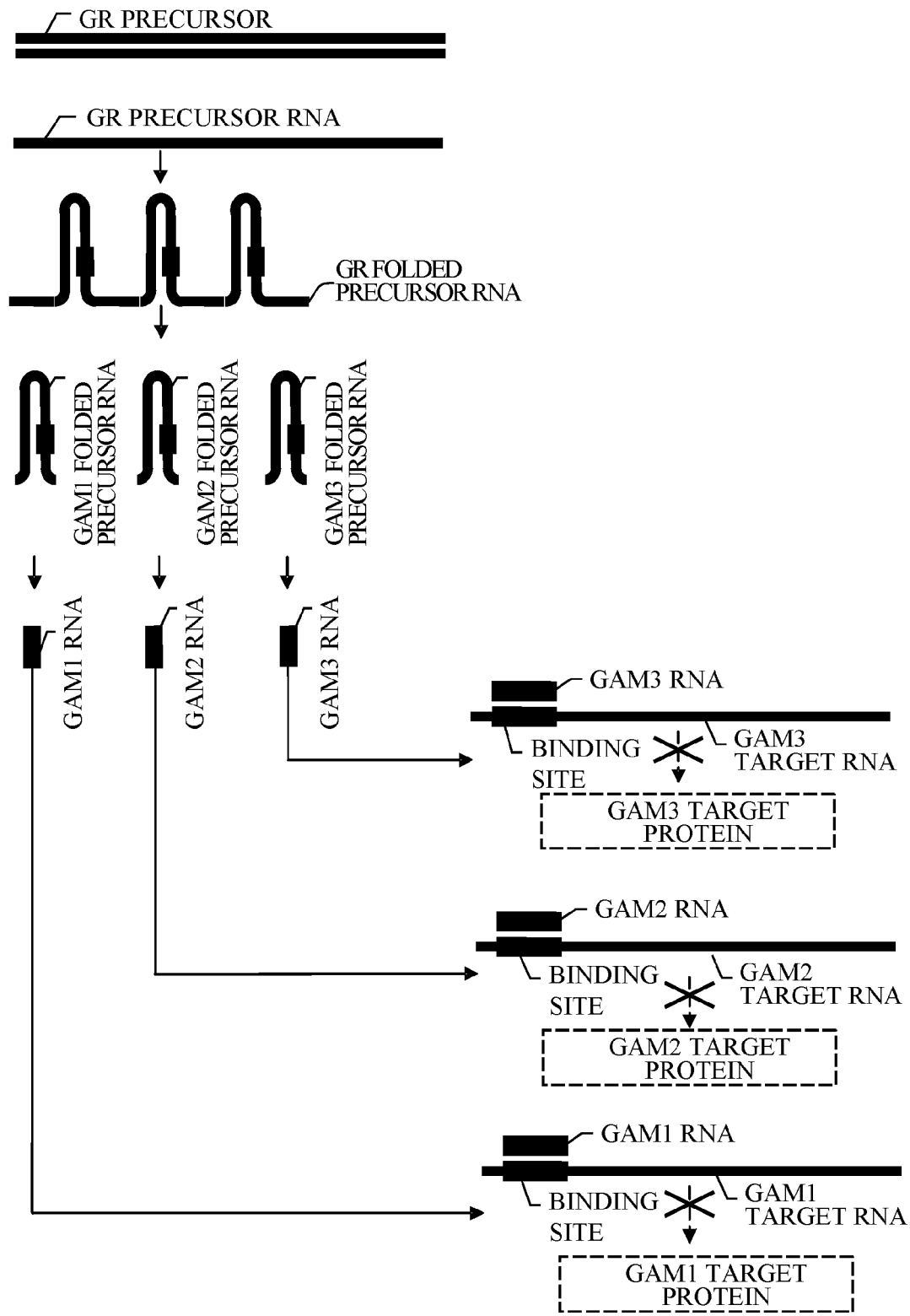
FIG. 9 is a simplified diagram describing a novel bioinformatically-detected group of regulatory polynucleotides, referred to here as Genomic Record (GR) polynucleotides, each of which encodes an "operon-like" cluster of novel microRNA-like oligonucleotides, which in turn modulate expression of one or more target genes.

Reference is now made to FIG. 9, which is a simplified diagram describing each of a plurality of novel bioinformatically-detected regulatory polynucleotide referred to in this Table as the Genomic Record (GR) polynucleotide. GR encodes an operon-like cluster of novel miRNA-like oligonucleotides, each of which in turn modulates expression of at least one target gene. The function and utility of at least one target gene is known in the art.

The GR PRECURSOR is a novel, bioinformatically-detected, regulatory, non-protein-coding polynucleotide. The method by which the GR PRECURSOR is detected is described hereinabove with additional reference to FIGS. 1-9.

GR PRECURSOR is preferably encoded by the bacterial genome and contains a cluster of novel bacterial oligonucleotides, which preferably bind to human target genes or to bacterium genes. Alternatively or additionally, GR PRECURSOR is encoded by the human genome and contains a cluster of novel human oligonucleotides, which preferably bind to bacterial target genes or to human genes.

The GR PRECURSOR encodes GR PRECURSOR RNA that is typically several hundred to several thousand nts long. The GR PRECURSOR RNA folds spatially, forming the GR FOLDED PRECURSOR RNA. It is appreciated that the GR FOLDED PRECURSOR RNA comprises a plurality of what is known in the art as hairpin structures. Hairpin structures result from the presence of segments of the nucleotide sequence of GR PRECURSOR RNA in which the first half of each such segment has a nucleotide sequence which is at least a partial, and sometimes an accurate, reverse-complement sequence of the second half thereof, as is well known in the art.

The GR FOLDED PRECURSOR RNA is naturally processed by cellular enzymatic activity into a plurality of separate GAM precursor RNAs herein schematically represented by GAM1 FOLDED PRECURSOR RNA through GAM3 FOLDED PRECURSOR RNA. Each GAM folded precursor RNA is a hairpin-shaped RNA segment, corresponding to GAM FOLDED PRECURSOR RNA of FIG. 1.

The abovementioned GAM folded precursor RNAs are diced by DICER COMPLEX of FIG. 1, yielding short RNA segments of about 22 nts in length schematically represented by GAM1 RNA through GAM3 RNA. Each GAM RNA corresponds to GAM RNA of FIG. 1. GAM1 RNA, GAM2 RNA and GAM3 RNA each bind complementarily to binding sites located in the untranslated regions of their respective target genes, designated GAM1 TARGET RNA, GAM2 TARGET RNA and GAM3 TARGET RNA, respectively. These target binding sites correspond to BINDING SITE I, BINDING SITE II and BINDING SITE III of FIG. 1. The binding of each GAM RNA to its target RNA inhibits the translation of its respective target proteins, designated GAM1 TARGET PROTEIN, GAM2 TARGET PROTEIN and GAM3 TARGET PROTEIN, respectively.

It is appreciated that the specific functions, and accordingly the utilities, of the GR polynucleotide are correlated with and may be deduced from the identity of the target genes that are inhibited by GAM RNAs that are present in the operon-like cluster of the polynucleotide. Thus, for the GR polynucleotide, schematically represented by GAM1 TARGET PROTEIN through GAM3 TARGET PROTEIN that are inhibited by the GAM RNA. The function of these target genes is elaborated in Table 8, hereby incorporated herein.

Figure 10:
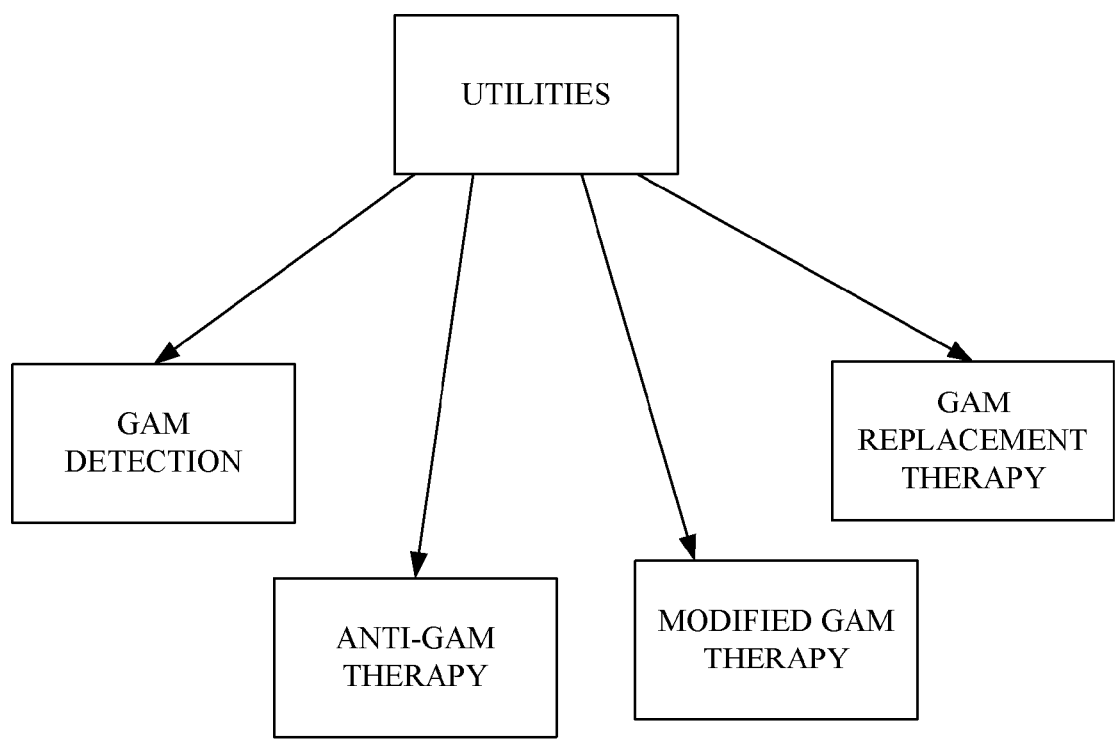
FIG. 10 is a block diagram illustrating different utilities of novel oligonucleotides and novel operon-like polynucleotides, both of the present invention.

Reference is now made to FIG. 10, which is a block diagram illustrating different utilities of oligonucleotide of the novel group of oligonucleotides of the present invention referred to here as GAM oligonucleotides and GR polynucleotides. The present invention discloses a first plurality of novel oligonucleotides referred to here as GAM oligonucleotides and a second plurality of operon-like polynucleotides referred to here as GR polynucleotides, each of the GR polynucleotide encoding a plurality of GAM oligonucleotides. The present invention further discloses a very large number of known target genes, which are bound by, and the expression of which is modulated by each of the novel oligonucleotides of the present invention. Published scientific data referenced by the present invention provides specific, substantial, and credible evidence that the abovementioned target genes modulated by novel oligonucleotides of the present invention, are associated with various diseases. Specific novel oligonucleotides of the present invention, target genes thereof and diseases associated therewith, are described hereinbelow with reference to Tables 1 through 12. It is therefore appreciated that a function of GAM oligonucleotides and GR polynucleotides of the present invention is modulation of expression of target genes related to known bacterial diseases, and that therefore utilities of novel oligonucleotides of the present invention include diagnosis and treatment of the abovementioned diseases.

FIG. 10 describes various types of diagnostic and therapeutic utilities of novel oligonucleotides of the present invention. A utility of novel oligonucleotide of the present invention is detection of GAM oligonucleotides and of GR polynucleotides. It is appreciated that since GAM oligonucleotides and GR polynucleotides modulate expression of disease related target genes, that detection of expression of GAM oligonucleotides in clinical scenarios associated with said bacterial diseases is a specific, substantial and credible utility. Diagnosis of novel oligonucleotides of the present invention may preferably be implemented by RNA expression detection techniques, including but not limited to biochips, as is well known in the art. Diagnosis of expression of oligonucleotides of the present invention may be useful for research purposes, in order to further understand the connection between the novel oligonucleotides of the present invention and the abovementioned related bacterial diseases, for disease diagnosis and prevention purposes, and for monitoring disease progress.

Another utility of novel oligonucleotides of the present invention is anti-GAM therapy, a mode of therapy which allows up regulation of a bacterial disease-related target gene of a novel GAM oligonucleotide of the present invention, by lowering levels of the novel GAM oligonucleotide which naturally inhibits expression of that target gene. This mode of therapy is particularly useful with respect to target genes which have been shown to be under-expressed in association with a specific bacterial disease. Anti-GAM therapy is further discussed hereinbelow with reference to FIGS. 11A and 11B.

A further utility of novel oligonucleotides of the present invention is GAM replacement therapy, a mode of therapy which achieves down regulation of a bacterial disease related target gene of a novel GAM oligonucleotide of the present invention, by raising levels of the GAM which naturally inhibits expression of that target gene. This mode of therapy is particularly useful with respect to target genes which have been shown to be over-expressed in association with a specific bacterial disease. GAM replacement therapy involves introduction of supplementary GAM products into a cell, or stimulation of a cell to produce excess GAM products. GAM replacement therapy may preferably be achieved by transfecting cells with an artificial DNA molecule encoding a GAM which causes the cells to produce the GAM product, as is well known in the art.

Yet a further utility of novel oligonucleotides of the present invention is modified GAM therapy. Disease conditions are likely to exist, in which a mutation in a binding site of a GAM RNA prevents natural GAM RNA to effectively bind inhibit a bacterial disease related target gene, causing up regulation of that target gene, and thereby contributing to the disease pathology. In such conditions, a modified GAM oligonucleotides is designed which effectively binds the mutated GAM binding site, i.e. is an effective anti-sense of the mutated GAM binding site, and is introduced in disease effected cells. Modified GAM therapy is preferably achieved by transfecting cells with an artificial DNA molecule encoding the modified GAM which causes the cells to produce the modified GAM product, as is well known in the art.

Reference is now made to FIGS. 11A and 11B, which are simplified diagrams which when taken together illustrate anti-GAM therapy mentioned hereinabove with reference to FIG. 10. A utility of novel GAMs of the present invention is anti-GAM therapy, a mode of therapy which allows up regulation of a bacterial disease-related target gene of a novel GAM of the present invention, by lowering levels of the novel GAM which naturally inhibits expression of that target gene. FIG. 11A shows a normal GAM inhibiting translation of a target gene by binding of GAM RNA to a BINDING SITE found in an untranslated region of GAM TARGET RNA, as described hereinabove with reference to FIG. 1.

FIG. 11B shows an example of anti-GAM therapy. ANTI-GAM RNA is short artificial RNA molecule the sequence of which is an anti-sense of GAM RNA. Anti-GAM treatment comprises transfecting diseased cells with ANTI-GAM RNA, or with a DNA encoding thereof. The ANTI-GAM RNA binds the natural GAM RNA, thereby preventing binding of natural GAM RNA to its BINDING SITE. This prevents natural translation inhibition of GAM TARGET RNA by GAM RNA, thereby up regulating expression of GAM TARGET PROTEIN.

It is appreciated that anti-GAM therapy is particularly useful with respect to target genes which have been shown to be under-expressed in association with a specific bacterial disease.

Furthermore, anti-GAM therapy is particularly useful, since it may be used in situations in which technologies known in the art as RNAi and siRNA can not be utilized. As in known in the art, RNAi and siRNA are technologies which offer means for artificially inhibiting expression of a target protein, by artificially designed short RNA segments which bind complementarily to mRNA of said target protein. However, RNAi and siRNA can not be used to directly up regulate translation of target proteins.

Figure 12A:
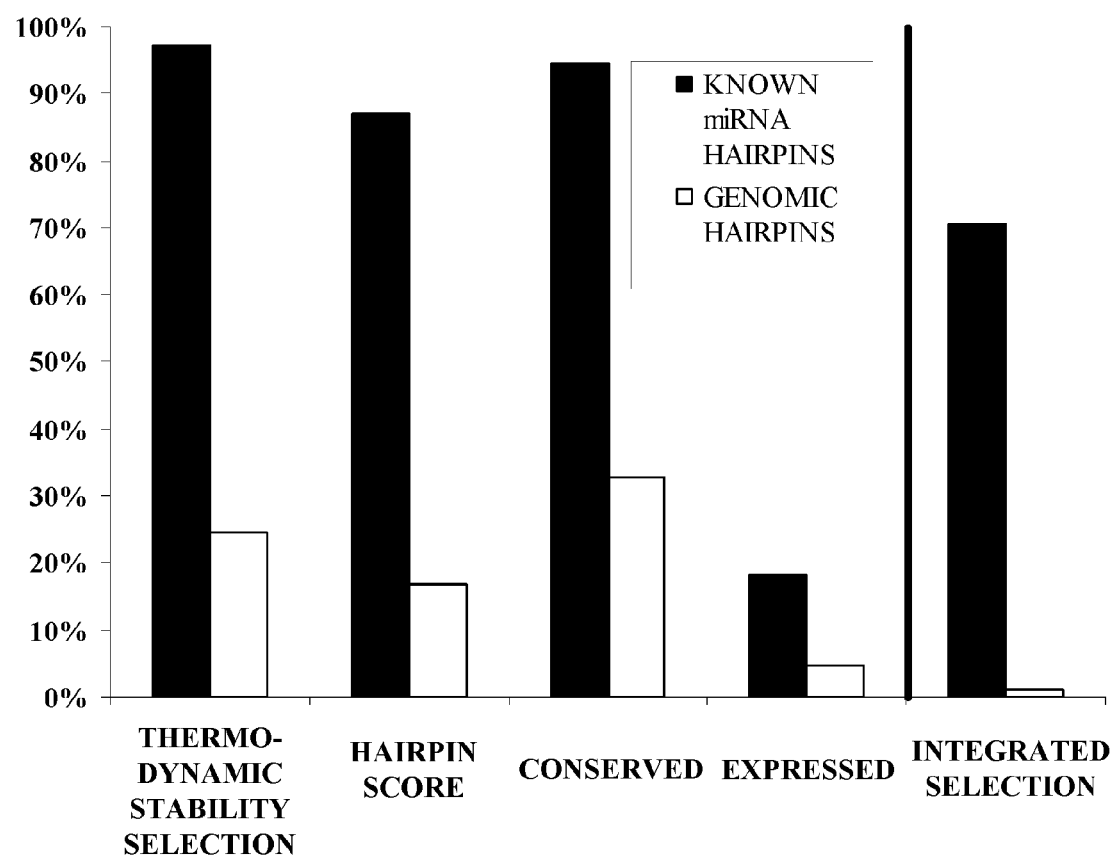
FIG. 12A is a bar graph illustrating performance results of a hairpin detector constructed and operative in accordance with a preferred embodiment of the present invention.

Reference is now made to FIG. 12A, which is a bar graph illustrating performance results of the hairpin detector 114 (FIG. 2) constructed and operative in accordance with a preferred embodiment of the present invention.

FIG. 12A illustrates efficacy of several features used by the hairpin detector 114 to detect GAM FOLDED PRECURSOR RNAs (FIG. 1). The values of each of these features is compared between a set of published miRNA precursor oligonucleotides, represented by shaded bars, and a set of random hairpins folded from the human genome denoted hereinbelow as a hairpin background set, represented by white bars. The published miRNA precursor oligonucleotides set is taken from RFAM database, Release 2.1 and includes 148 miRNA oligonucleotides from *H. Sapiens*. The background set comprises a set of 10,000 hairpins folded from the human genome.

It is appreciated that the hairpin background set is expected to comprise some valid, previously undetected hairpin-shaped miRNA precursor-like GAM FOLDED PRECURSOR RNAs of the present invention, and many hairpin-shaped sequences that are not hairpin-shaped miRNA-like precursors.

For each feature, the bars depict the percent of known miRNA hairpin precursors (shaded bars) and the percent of background hairpins (white bars) that pass the threshold for that feature. The percent of known miRNA oligonucleotides that pass the threshold indicates the sensitivity of the feature, while the corresponding background percent implies the specificity of the feature, although not precisely, because the background set comprises both true and false examples.

The first bar pair, labeled Thermodynamic Stability Selection, depicts hairpins that have passed the selection of "families" of closely related hairpin structures, as described hereinabove with reference to FIG. 5B.

The second bar pair, labeled Hairpin Score, depicts hairpins that have been selected by hairpin detector 114 (FIG. 5B), regardless of the "families" selection.

The third bar pair, labeled Conserved, depicts hairpins that are conserved in human, mouse and rat, (UCSC Goldenpath™ HG16 database).

The fourth bar pair, labeled Expressed, depicts hairpins that are found in EST blocks.

The fifth bar pair, labeled Integrated Selection, depicts hairpin structures predicted by a preferred embodiment of the present invention to be valid GAM PRECURSORs. In a preferred embodiment of the present invention, a hairpin may be considered to be a GAM PRECURSOR if its hairpin detector score is above 0, and it is in one of the following groups: a) in an intron and conserved or b) in an intergenic region and conserved or c) in an intergenic region and expressed, as described below. Further filtering of GAM precursor may be obtained by selecting hairpins with a high score of Dicer-cut location detector 116 as described hereinabove with reference to FIGS. 6A-6C, and with predicted miRNA oligonucleotides, which pass the low complexity filter as described hereinabove, and whose targets are selected by the target gene binding site detector 118 as described hereinabove with reference to FIGS. 7A-7B.

It is appreciated that these results validate the sensitivity and specificity of the hairpin detector 114 (FIG. 2) in identifying novel GAM FOLDED PRECURSOR RNAs, and in effectively distinguishing them from the abundant hairpins found in the genome.

Figure 12B:
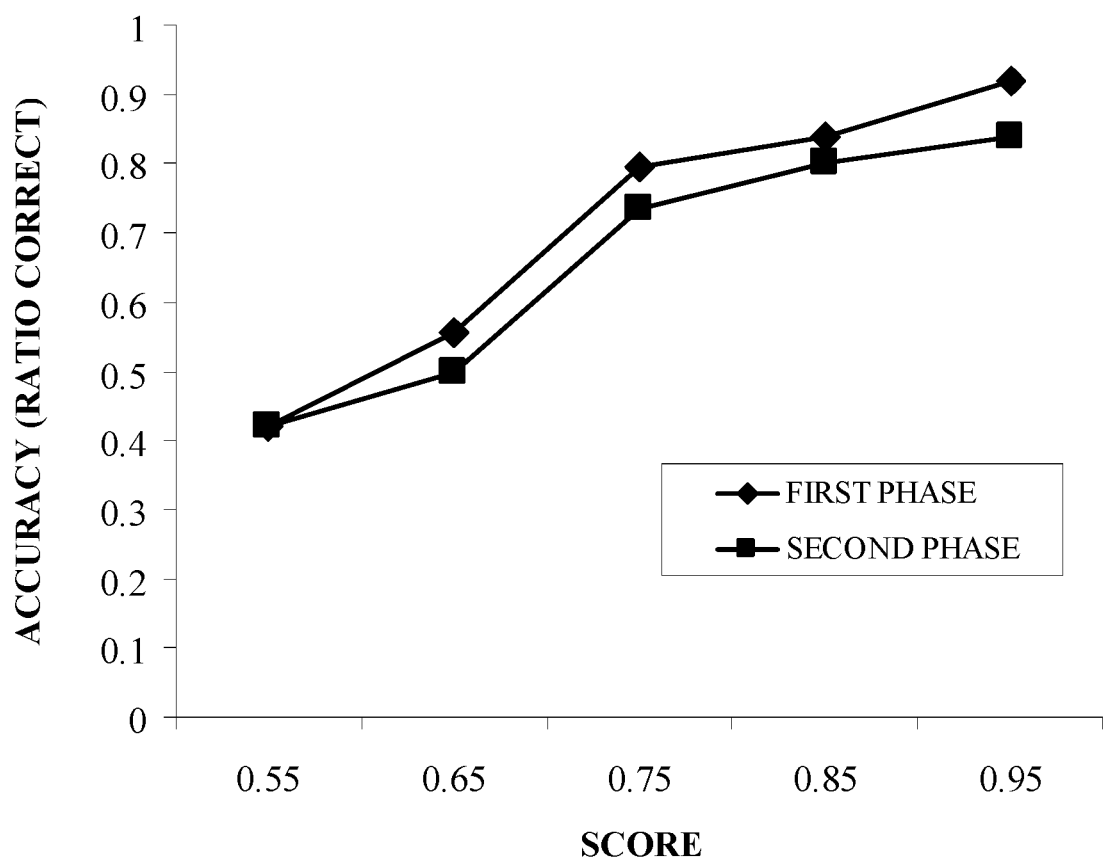
FIG. 12B is a line graph illustrating accuracy of a Dicer-cut location detector constructed and operative in accordance with a preferred embodiment of the present invention.

Reference is now made to FIG. 12B, which is a line graph illustrating accuracy of a Dicer-cut location detector 116 (FIG. 2) constructed and operative in accordance with a preferred embodiment of the present invention.

To determine the accuracy of the Dicer-cut location detector 116, a stringent training and test set was chosen from the abovementioned set of 440 known miRNA oligonucleotides, such that no two miRNA oligonucleotides in the set are homologous. This was performed to get a lower bound on the accuracy and avoid effects of similar known miRNA oligonucleotides appearing in both the training and test sets. On this stringent set of size 204, mfold cross validation with k=3 was performed to determine the percent of known miRNA oligonucleotides in which the Dicer-cut location detector 116 described hereinabove predicted the correct miRNA oligonucleotide up to two nucleotides from the correct location. The accuracy of the TWO PHASED predictor is depicted in the graph. The accuracy of the first phase of the TWO PHASED predictor is depicted by the upper line, and that of both phases of the TWO PHASED predictor is depicted by the lower line. Both are binned by the predictor score, where the score is the score of the first stage.

It is appreciated that these results validate the accuracy of the Dicer-cut location detector 116.

Figure 12C:
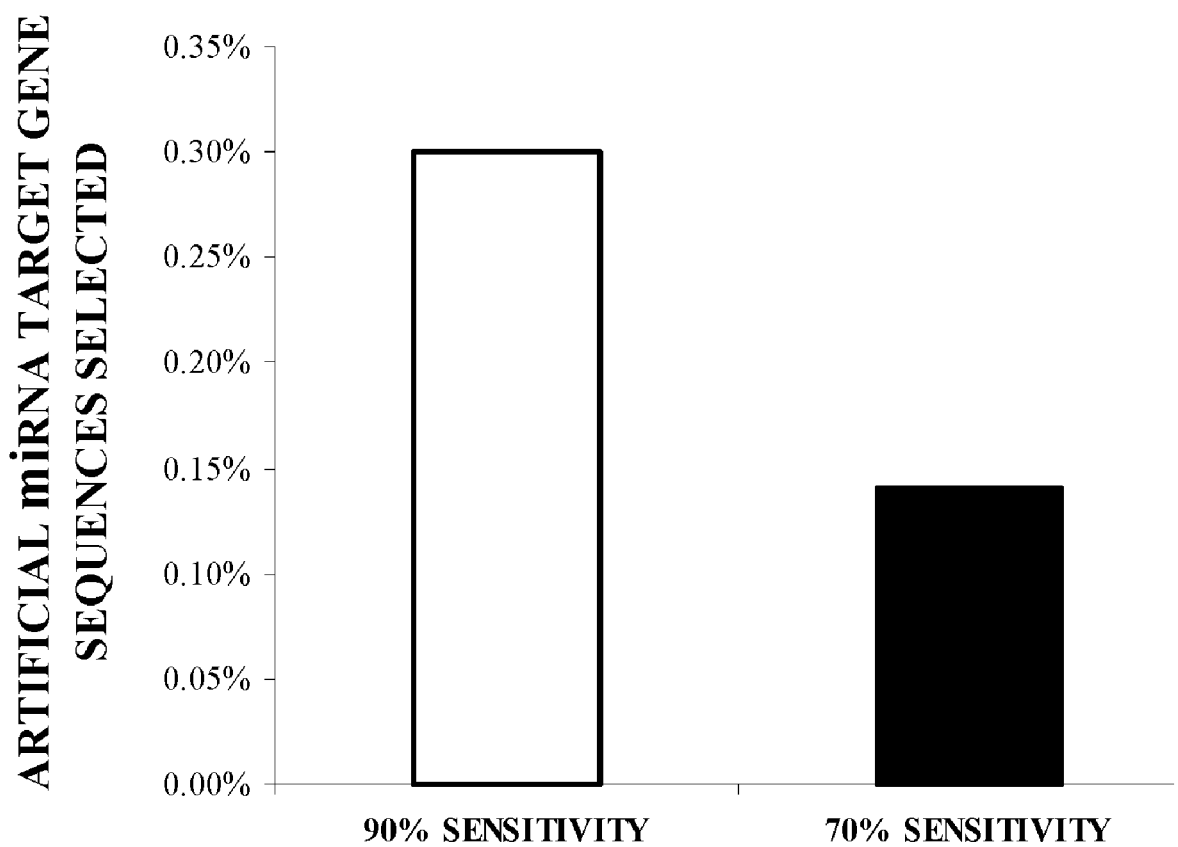
FIG. 12C is a bar graph illustrating performance results of the target gene binding site detector 118, constructed and operative in accordance with a preferred embodiment of the present invention.

Reference is now made to FIG. 12C, which is a bar graph illustrating the performance results of the target gene binding site detector 118 (FIG. 7A) constructed and operative in accordance with a preferred embodiment of the present invention.

FIG. 12C illustrates specificity and sensitivity of the target gene binding site detector 118. The values presented are the result of testing 10000 artificial miRNA oligonucleotide sequences (random 22 nt sequences with the same base composition as published miRNA oligonucleotide sequence). Adjusting the threshold parameters to fulfill 90% sensitivity of validated, published miRNA-3'UTR pairs, requires the P VAL of potential target gene sequences-Dicer-cut sequences to be less than 0.01 and also the P VAL of potential target ortholog gene sequences-Dicer-cut sequences to be less than 0.05. The target gene binding site detector 118 can filter out 99.7% of potential miRNA/gene pairs, leaving only the 0.3% that contain the most promising potential miRNA/gene pairs. Limiting the condition for the P VAL of potential target ortholog gene sequences-Dicer-cut sequences to be less than 0.01 reduces the sensitivity ratio to 70% but filters out more then 50% of the remaining 0.3%, to a final ratio of less than 0.15%.

It is appreciated that these results validate the sensitivity and specificity of the target gene binding site detector 118.

Reference is now made to FIG. 13, which is a summary table of laboratory results validating the expression of 29 novel human GAM RNA oligonucleotides in HeLa cells or, alternatively, in liver or thymus tissues detected by the bioinformatic oligonucleotide detection engine 100 (FIG. 2).

As a positive control, we used a reference set of eight known human miRNA oligonucleotides: hsa-MIR-21; hsa-MIR-27b; hsa-MIR-186; hsa-MIR-93; hsa-MIR-26a; hsa-MIR-191; hsa-MIR-31; and hsa-MIR-92. All positive controls were successfully validated by sequencing.

The table of FIG. 13 lists all GAM RNA predictions whose expression was validated. The field "Primer Sequence" contains the "specific" part of the primer; the field "Sequenced sequence" represents the nucleotide sequence detected by cloning (excluding the hemispecific primer sequence); the field "Predicted GAM RNA" contains the GAM RNA predicted sequence; the field "Distance indicate the distance from Primer; the number of mismatches between the "specific" region of the primer and the corresponding part of the GAM RNA sequence; the field "GAM Name" contains GAM RNA PRECURSOR ID followed by "A" or "B", which represents the GAM RNA position on the precursor as elaborated in the attached Tables.

A primer was designed such that its first half, the 5' region, is complementary to the adaptor sequence and its second half, the 3' region, anneals to the 5' terminus of GAM RNA sequence, yielding a hemispecific primer (as elaborated hereinbelow in the Methods section). A sample of 13 predicted GAM RNA sequences was examined by PCR using hemispecific primers and a primer specific to the 3' adaptor. PCR products were cloned into plasmid vectors and then sequenced. For all 13 predicted GAM RNA sequences, the GAM RNA sequence found in the hemispecific primer plus the sequence observed between the hemispecific primer and the 3' adaptor was completely included in the expected GAM RNA sequence (rows 1-7, and 29). The rest are GAM RNA predictions that were verified by cloning and sequencing, yet, by using a primer that was originally designed for a slightly different prediction.

It is appreciated that failure to detect a predicted oligonucleotide in the lab does not necessarily indicate a mistaken bioinformatic prediction. Rather, it may be due to technical sensitivity limitation of the lab test, or because the predicted oligonucleotides are not expressed in the tissue examined, or at the development phase tested. The observed GAM RNAs may be strongly expressed in HeLa cells while the original GAM RNAs are expressed at low levels in HeLa cells or not expressed at all. Under such circumstances, primer sequences containing up to three mismatches from a specific GAM RNA sequence may amplify it. Thus, we also considered cases in which differences of up to 3 mismatches in the hemispecific primer occur.

The 3' terminus of observed GAM RNA sequences is often truncated or extended by one or two nucleotides. Cloned sequences that were sequenced from both 5' and 3' termini have an asterisk appended to the row number.

Interestingly, the primer sequence followed by the observed cloned sequence is contained within five GAM RNA sequences of different lengths, and belong to 24 precursors derived from distinct loci (Row 29). Out of these, one precursor appears four times in the genome and its corresponding GAM Names are 351973-A, 352169-A, 352445-A and 358164-A.

The sequence presented in Row 29 is a representative of the group of five GAM RNAs. The full list of GAM RNA sequences and their corresponding precursors is as follows (each GAM RNA sequence is followed by the GAM Name): TCACTGCAACCTCCACCTCCCA (SEQ ID NO: 4254782) (352092, 352651, 355761), TCACTGCAACCTC-CACCTCCCG (SEQ ID NO: 4254783) (351868, 352440, 351973, 352169, 352445, 358164, 353737, 352382, 352235, 352232, 352268, 351919, 352473, 352444, 353638, 353004, 352925, 352943), TCACTGCAACCTCCACCTCCTG (SEQ ID NO: 4254784) (358311), TCACTGCAACCTC-CACCTTCAG (SEQ ID NO: 4254785) (353323), and TCACTGCAACCTCCACCTTCCG (SEQ ID NO: 4254786) (353856).

Method Section
Cell Lines

Three common human cell lines, obtained from Dr. Yonat Shemer at Soroka Medical Center, Be'er Sheva, Israel, were used for RNA extraction; Human Embryonic Kidney HEK-293 cells, Human Cervix Adenocarcinoma HeLa cells and Human Prostate Carcinoma PC3 cells.

RNA Purification

Several sources of RNA were used to prepare libraries:

Total HeLa S100 RNA was prepared from HeLa S100 cellular fraction (4 C Biotech, Belgium) through an SDS (1%)-Proteinase K (200 g/ml) 30 minute incubation at 37 C followed by an acid Phenol-Chloroform purification and iso-propanol precipitation (Sambrook et al; Molecular Cloning-A Laboratory Manual).

Total HeLa, HEK-293 and PC3 cell RNA was prepared using the standard Tri-Reagent protocol (Sigma) according to the manufacturer's instructions, except that 1 volume of isopropanol was substituted with 3 volumes of ethanol.

Nuclear and Cytoplasmic RNA was prepared from HeLa or HEK-293 cells in the following manner:

Cell were washed and harvested in ice-cold PBS and precipitated in a swing-out rotor at 1200 rpm at 4 C for 5 minutes. Pellets were loosened by gentle vortexing. 4 ml of "NP40 lysis buffer" (10 mM Tris HCl, 5 mM MgCl2, 10 mM NaCl, 0.5% Nonidet P40, 1 mM Spermidine, 1 mM DTT, 140 U/ml rRnasine) was then added per 5*10^7 cells. Cells and lysis buffer were incubated for 5 minutes on ice and centrifuged in a swing-out rotor at 500×g at 4 C for 5 minutes. Supernatant, termed cytoplasm, is carefully removed to a tube containing SDS (1% final) and proteinase-K (200 g/ml final). Pellet, termed nuclear fraction, is re-washed and incubated with a similar amount of fresh lysis buffer. Lysis is monitored visually under a microscope at this stage, typically for 5 minutes. Nuclei are pelleted in a swing-out rotor at 500×g at 4 C for 5 minutes. Supernatant is pooled, incubated at 37 C for 30 minutes, Phenol/Chloroform-extracted, and RNA is alcohol-precipitated (Sambrook et al). Nuclei are loosened and then homogenized immediately in >10 volumes of Tri-Reagent (Sigma). Nuclear RNA is then prepared according to the manufacturer's instructions.

Total Tissue RNA

Total tissue RNA was obtained from Ambion USA, and included Human Liver, Thymus, Placenta, Testes and Brain.

RNA Size Fractionation

RNA used for libraries was always size-fractionated. Fractionation was done by loading up to 500 microgram RNA per YM100 Amicon Microcon column (Millipore) followed by a 500×g centrifugation for 40 minutes at 4 C. Flow-through "YM100" RNA is about one quarter of the total RNA and was used for library preparation or fractionated further by loading onto a YM30 Amicon Microcon column (Millipore) followed by a 13,500×g centrifugation for 25 minutes at 4 C. Flow-through "YM30" was used for library preparation "as is" and consists of less than 0.5% of total RNA. Additional size fractionation was achieved during library preparation.

Library Preparation

Two types of cDNA libraries, designated "One-tailed" and "Ligation", were prepared from the one of the abovementioned fractionated RNA samples. RNA was dephosphorylated and ligated to an RNA (designated with lowercase letters)-DNA (designated with UPPERCASE letters)hybrid 5'-phosphorylated, 3'idT blocked 3'-adapter (5'-P-uuuAAC-CGCATCCTTCTC-idT-3' (SEQ ID NO: 4254787) Dharma-con #P-002045-01-05)(as elaborated in Elbashir et al., Genes Dev. 15:188-200 (2001)) resulting in ligation only of RNase III type cleavage products. 3'-Ligated RNA was excised and purified from a half 6%,half 13% polyacrylamide gel to remove excess adapter with a Nanosep 0.2 microM centrifugal device (Pall) according to instructions, and precipitated with glycogen and 3 volumes of ethanol. Pellet was resuspended in a minimal volume of water.

For the "Ligation" library, a DNA (UPPERCASE)-RNA (lowercase) hybrid 5'-adapter (5'-TACTAATACGACTCAC-Taaa-3' (SEQ ID NO: 4254788) Dharmacon #P-002046-01-05)was ligated to the 3'-adapted RNA, reverse transcribed with "EcoRI-RT":(5'-GACTA GCTGGAATTCAAGGAT-GCGGTTAAA-3') (SEQ ID NO: 4254789), PCR-amplified with two external primers essentially as in Elbashir et al. (2001),except that primers were "EcoRI-RT" and "PstI Fwd" (5'-CAGCCAACGCTGCAGATACGACTCACTAAA-3').

(SEQ ID NO: 4254790) This PCR product was used as a template for a second round of PCR with one hemispecific and one external primer or with two hemispecific primers.

For the "One-tailed" library, the 3'-adapted RNA was annealed to 20 pmol primer "EcoRI RT"by heating to 70 C and cooling 0.1 C/sec to 30 C and then reverse-transcribed with Superscript II RT (according to manufacturer's instructions, Invitrogen) in a 20 microliters volume for 10 alternating 5 minute cycles of 37 C and 45 C. Subsequently, RNA was digested with 1 microliter 2M NaOH and 2mM EDTA at 65 C for 10 minutes. cDNA was loaded on a polyacrylamide gel, excised and gel-purified from excess primer as above (invisible, judged by primer run alongside) and resuspended in 13 microliters of water. Purified cDNA was then oligo-dC tailed with 400U of recombinant terminal transferase (Roche Molecular Biochemicals), 1 microliter 100 microM dCTP, 1 microliter 15mM CoCl2,and 4 microliters reaction buffer, to a final volume of 20 microliters for 15 minutes at 37 C. Reaction was stopped with 2 microliters 0.2M EDTA and 15 microliters 3M NaOAc pH 5.2.Volume was adjusted to 150 microliters with water, Phenol: Bromochloropropane 10:1 extracted and subsequently precipitated with glycogen and 3 volumes of ethanol. C-tailed cDNA was used as a template for PCR with the external primers "T3-PstBsg(G/I)18"(5'-AAT-TAACCCTCACTAAAGGCTGCAGGTGCAG-GIGGGIIGGGIIGG GIIGN-3' (SEQ ID NO: 4254791) where I stands for Inosine and N for any of the 4 possible deoxynucleotides), and with "EcoRI Nested"(5'-GGAAT-TCAAGGATGCGGTTA-3') (SEQ ID NO: 4254792). This PCR product was used as a template for a second round of PCR with one hemispecific and one external primer or with two hemispecific primers.

Primer Design and PCR

Hemispecific primers were constructed for each predicted GAM RNA oligonucleotide by an in-house program designed to choose about half of the 5' or 3' sequence of the GAM RNA corresponding to a TM of about 30 -34 C constrained by an optimized 3' clamp, appended to the cloning adapter sequence (for "One-tailed" libraries, 5'-GGN-NGGGNNG (SEQ ID NO: 4254793) on the 5' end or TTTAACCGCATC-3' (SEQ ID NO: 4254794) on the 3' end of the GAM RNA; for "Ligation" libraries, the same 3' adapter and 5'-CGACTCACTAAA (SEQ ID NO: 4254795) on the 5' end of the GAM RNA). Consequently, a fully complementary primer of a TM higher than 60 C was created covering only one half of the GAM RNA sequence permitting the unbiased elucidation by sequencing of the other half.

For each primer, the following criteria were used: Primers were graded according to the TM of the primer half and the nucleotide content of 3 nucleotides of the 3' clamp from worst to best, roughly: GGG-3'<CCC-3'<TTT-3'/AAA-3'<GG-3'<CC-3'<a TM lower than 30<a TM higher than 34<TT-3'/AA-3'<3G/C nucleotide combination <3 A/T nucleotide combination <any combination of two/three different nucleotides <any combination of three/three different nucleotides.

Validation PCR Product by Southern Blot

GAM RNA oligonucleotides were validated by hybridization of Polymerase Chain Reaction (PCR)-product Southern blots with a probe to the predicted GAM RNA.

PCR product sequences were confirmed by Southern blot (Southern E. M., Biotechnology 1992, 24:122-139 (1975)) and hybridization with DNA oligonucleotide probes synthesized as complementary (antisense) to predicted GAM RNA oligonucleotides. Gels were transferred onto a Biodyne PLUS 0.45 m (Pall) positively charged nylon membrane and UV cross-linked. Hybridization was performed overnight with DIG-labeled probes at 42 C in DIG Easy-Hyb buffer (Roche). Membranes were washed twice with 2×SSC and 0.1% SDS for 10 minutes at 42 C and then washed twice with 0.5×SSC and 0.1% SDS for 5 min at 42 C. The membrane was then developed by using a DIG luminescent detection kit (Roche) using anti-DIG and CSPD reaction, according to the manufacturer's protocol. All probes were prepared according to the manufacturer's (Roche Molecular Biochemicals) protocols: Digoxigenin (DIG) labeled antisense transcripts were prepared from purified PCR products using a DIG RNA labeling kit with T3 RNA polymerase. DIG-labeled PCR was prepared by using a DIG PCR labeling kit. 3'-DIG-tailed oligo ssDNA anti-sense probes, containing DIG-dUTP and dATP at an average tail length of 50 nts were prepared from 100 pmole oligonucleotides with the DIG Oligonucleotide Labeling Kit. Control reactions contained all of the components of the test reaction except library template.

Validation of PCR Product by Nested PCR on the Ligation

To further validate predicted GAM PCR product sequence derived from hemi-primers, a PCR-based diagnostic technique was devised to amplify only those products containing at least two additional nucleotides of the non hemi-primer defined part of the predicted GAM RNA oligonucleotide. In essence, a diagnostic primer was designed so that its 3' end, which is the specificity determining side, was identical to the desired GAM RNA oligonucleotide, 2-10 nts (typically 4-7, chosen for maximum specificity) further into its 3' end than the nucleotide stretch primed by the hemi-primer. The hemi-primer PCR product was first ligated into a T-cloning vector (pTZ57/T or pGEM-T) as described hereinabove. The ligation reaction mixture was used as template for the diagnostic PCR under strict annealing conditions with the new diagnostic primer in conjunction with a general plasmid-homologous primer, resulting in a distinct ~200 base-pair product. This PCR product can be directly sequenced, permitting the elucidation of the remaining nucleotides up to the 3' of the mature GAM RNA oligonucleotide adjacent to the 3' adapter. Alternatively, following analysis of the diagnostic PCR reaction on an agarose gel, positive ligation reactions (containing a band of the expected size) were transformed into E. coli. Using this same diagnostic technique and as an alternative to screening by Southern blot colony hybridization, transformed bacterial colonies were screened by colony-PCR (Gussow, D. and Clackson, T, Nucleic Acids Res. 17:4000 (1989)) with the nested primer and the vector primer, prior to plasmid purification and sequencing.

Validation of PCR Product by Cloning and Sequencing

PCR products were inserted into pGEM-T (Promega) or pTZ57/T (MBI Fermentas), heat-shock transformed into competent JM109 E. coli (Promega) and seeded on LB-Ampicilin plates with IPTG and Xgal. White and light blue colonies were transferred to duplicate gridded plates, one of which was blotted onto a membrane (Biodyne Plus, Pall) for hybridization with DIG tailed oligo probes (according to instructions, Roche) complementary to the expected GAM. Plasmid DNA from positive colonies was sequenced.

It is appreciated that the results summarize in FIG. 13 validate the efficacy of the bioinformatic oligonucleotide detection engine 100 of the present invention.

Figures 14A, 14B, 14C:
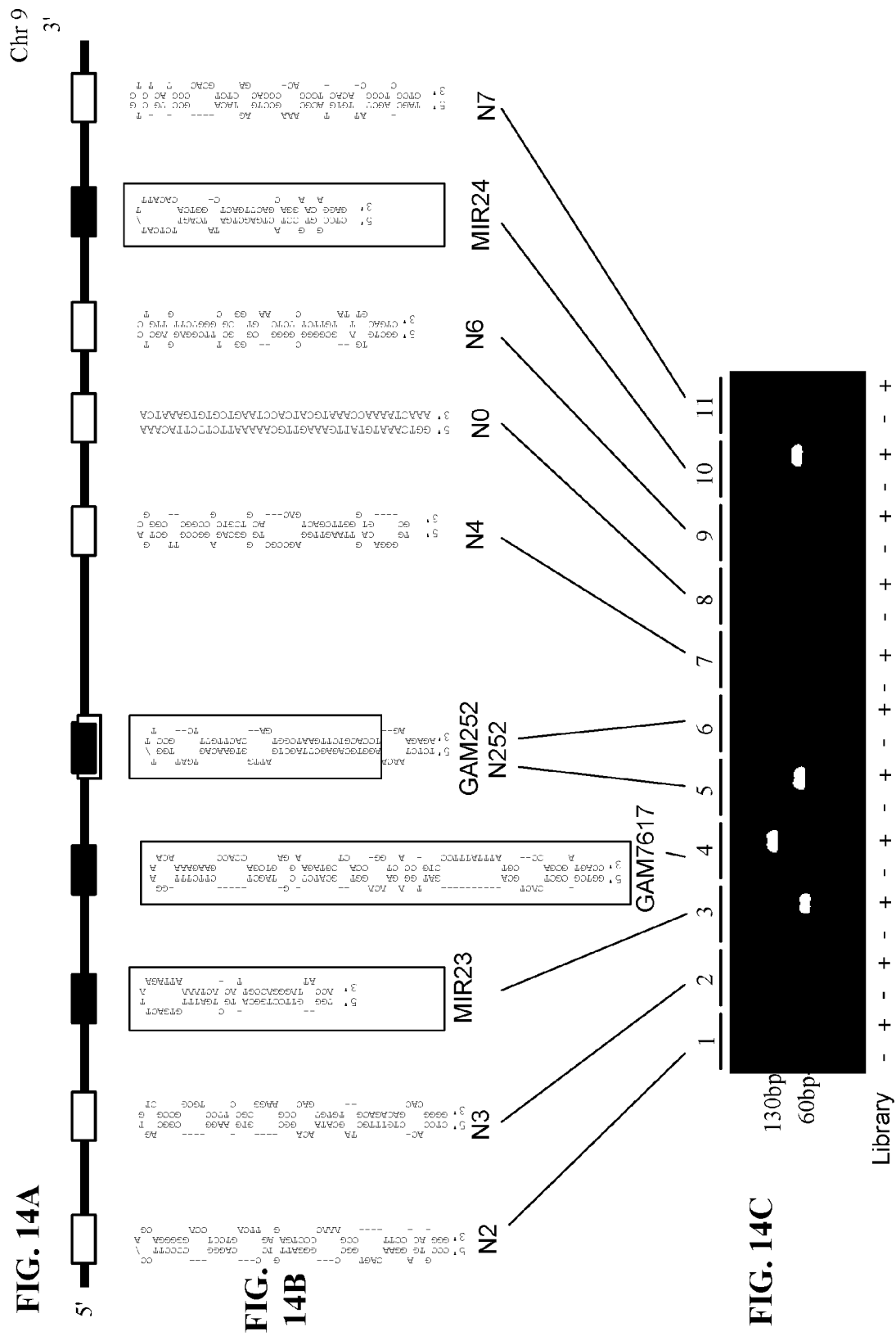
FIG. 14A is a schematic representation of an "operon-like" cluster of novel human hairpin sequences detected by a bioinformatic oligonucleotide detection engine constructed and operative in accordance with a preferred embodiment of the present invention, and non-GAM hairpin sequences used as negative controls thereto.
FIG. 14B is a schematic representation of secondary folding of hairpins of the operon-like cluster of FIG. 14A. The hairpins shown are as follows N2 (SEQ ID NO: 4254760), N3 (SEQ ID NO: 4254761), MIR23 (SEQ ID NO: 4254762), GAM22 (SEQ ID NO: 4254763), GAM7617 (SEQ ID NO: 4254764), N252 (SEQ ID NO: 4254765), N4 (SEQ ID NO: 4254766), N0 (SEQ ID NO: 4254767), N6 (SEQ ID NO: 4254768), MIR24 (SEQ ID NO: 4254769), and N7 (SEQ ID NO: 4254770)
FIG. 14C is a picture of laboratory results demonstrating expression of novel oligonucleotides of FIGS. 14A and 14B and lack of expression of the negative controls, thereby validating efficacy of bioinformatic detection of GAM oligonucleotides and GR polynucleotides detected by a bioinformatic oligonucleotide detection engine, constructed and operative in accordance with a preferred embodiment of the present invention.

Reference is now made to FIG. 14A, which is a schematic representation of a novel human GR polynucleotide, located on chromosome 9, comprising 2 known human miRNA oligonucleotides—MIR24 and MIR23, and 2 novel GAM oligonucleotides, herein designated GAM7617 and GAM252 (later discovered by other researchers as hsa-mir-27b), all marked by solid black boxes. FIG. 14A also schematically illustrates 6 non-GAM hairpin sequences, and one non-hairpin sequence, all marked by white boxes, and serving as negative controls. By "non-GAM hairpin sequences" is meant sequences of a similar length to known miRNA precursor sequences, which form hairpin secondary folding pattern similar to miRNA precursor hairpins, and yet which are assessed by the bioinformatic oligonucleotide detection engine 100 not to be valid GAM PRECURSOR hairpins. It is appreciated that FIG. 14A is a simplified schematic representation, reflecting only the order in which the segments of interest appear relative to one another, and not a proportional distance between the segments.

Reference is now made to FIG. 14B, which is a schematic representation of secondary folding of each of the MIRs and GAMs of the GR MIR24, MIR23, GAM7617 and GAM252, and of the negative control non-GAM hairpins, herein designated N2, N3, N252, N4, N6 and N7. N0 is a non-hairpin control, of a similar length to that of known miRNA precursor hairpins. It is appreciated that the negative controls are situated adjacent to and in between real miRNA oligonucleotides and GAM predicted oligonucleotides and demonstrates similar secondary folding patterns to that of known MIRs and GAMs.

Reference is now made to FIG. 14C, which is a picture of laboratory results of a PCR test upon a YM100 size-fractionated "ligation" library, utilizing a set of specific primer pairs located directly inside the boundaries of the hairpins. Due to the nature of the library the only PCR amplifiable products can result from RNaseIII type enzyme cleaved RNA, as expected for legitimate hairpin precursors presumed to be produced by DROSHA (Lee et al, Nature 425 415-419, 2003). FIG. 14C demonstrates expression of hairpin precursors of known miRNA oligonucleotides hsa-mir23 and hsa-mir24, and of novel bioinformatically-detected GAM7617 and GAM252 hairpins predicted bioinformatically by a system constructed and operative in accordance with a preferred embodiment of the present invention. FIG. 14C also shows that none of the 7 controls (6 hairpins designated N2, N3, N23, N4, N6 and N7 and 1 non-hairpin sequence designated N0) were expressed. N252 is a negative control sequence partially overlapping GAM252.

In the picture, test lanes including template are designated "+" and the control lane is designated "−". The control reaction contained all the components of the test reaction except library template. It is appreciated that for each of the tested hairpins, a clear PCR band appears in the test ("+") lane, but not in the control ("−") lane.

FIGS. 14A through 14C, when taken together validate the efficacy of the bioinformatic oligonucleotide detection engine in: (a) detecting known miRNA oligonucleotides; (b) detecting novel GAM PRECURSOR hairpins which are found adjacent to these miRNA oligonucleotides, and which despite exhaustive prior biological efforts and bioinformatic detection efforts, went undetected; (c) discerning between GAM (or MIR) PRECURSOR hairpins, and non-GAM hairpins.

It is appreciated that the ability to discern GAM-hairpins from non-GAM-hairpins is very significant in detecting GAM oligonucleotides since hairpins are highly abundant in the genome. Other miRNA prediction programs have not been able to address this challenge successfully.

Reference is now made to FIG. 15A, which is an annotated sequence of an EST comprising a novel GAM oligonucleotides detected by the oligonucleotide detection system of the present invention. FIG. 15A shows the nucleotide sequence of a known human non-protein-coding EST (Expressed Sequence Tag), identified as EST72223. The EST72223 clone obtained from TIGR database (Kirkness and Kerlavage, 1997) was sequenced to yield the above 705 bp transcript with a polyadenyl tail. It is appreciated that the sequence of this EST comprises sequences of one known miRNA oligonucleotide, identified as hsa-MIR98, and of one novel GAM oligonucleotide referred to here as GAM25, detected by the bioinformatic oligonucleotide detection engine 100 (FIG. 2) of the present invention.

The sequences of the precursors of the known MIR98 and of the predicted GAM25 precursors are marked in bold, the sequences of the established miRNA 98 and of the predicted miRNA-like oligonucleotide GAM25 are underlined.

Figure 15D:
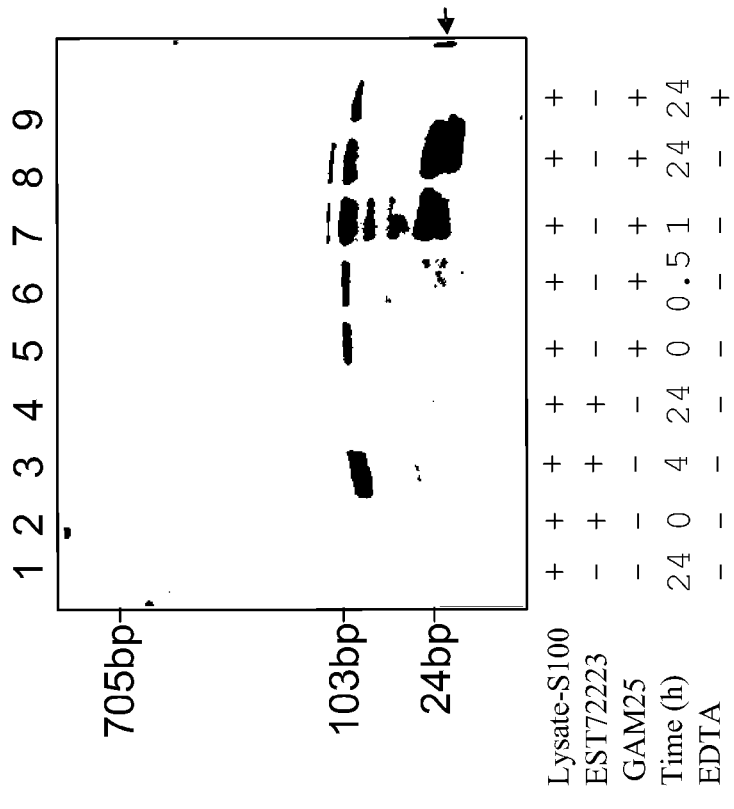
Figure 15C:
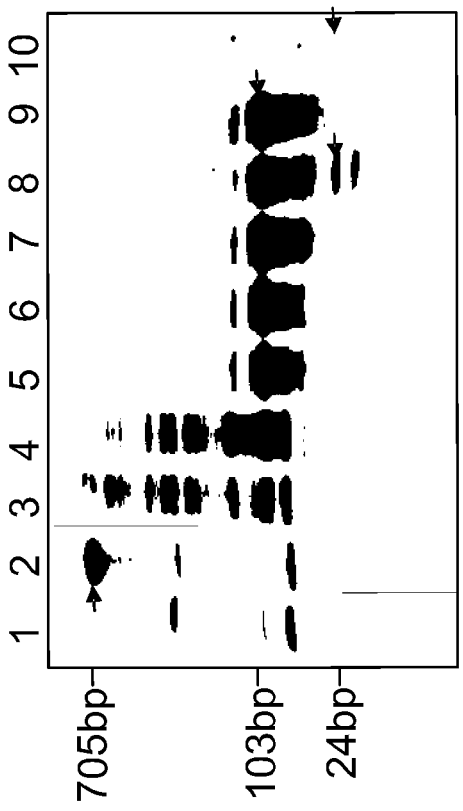

Reference is now made to FIGS. 15B, 15C and 15D, which are pictures of laboratory results, which when taken together demonstrate laboratory confirmation of expression of the bioinformatically-detected novel oligonucleotide of FIG. 15A.

In two parallel experiments, an enzymatically synthesized capped, EST72223 RNA transcript, was incubated with Hela S100 lysate for 0 minutes, 4 hours and 24 hours. RNA was subsequently harvested, run on a denaturing polyacrylamide gel, and reacted with either a 102 nt antisense MIR98 probe or a 145 nt antisenseGAM25 precursor transcript probe respectively. The Northern blot results of these experiments demonstrated processing of EST72223 RNA by Hela lysate (lanes 2-4, in FIGS. 15B and 15C), into ~80 bp and ~22 bp segments, which reacted with the MIR98 precursor probe (FIG. 15B), and into ~100 bp and ~24 bp segments, which reacted with the GAM25 precursor probe (FIG. 15C). These results demonstrate the processing of EST72223 by Hela lysate into MIR98 precursor and GAM25 precursor. It is also appreciated from FIG. 15C (lane 1) that Hela lysate itself reacted with the GAM25 precursor probe, in a number of bands, including a ~100 bp band, indicating that GAM25-precursor is endogenously expressed in Hela cells. The presence of additional bands, higher than 100 bp in lanes 5-9 probably corresponds to the presence of nucleotide sequences in Hela lysate, which contain the GAM25 sequence.

In addition, in order to demonstrate the kinetics and specificity of the processing of MIR98 and GAM25 precursors into their respective mature, "diced" segments, transcripts of MIR98 and of the bioinformatically predicted GAM25 precursors were similarly incubated with Hela S100 lysate, for 0 minutes, 30 minutes, 1 hour and 24 hours, and for 24 hours with the addition of EDTA, added to inhibit Dicer activity, following which RNA was harvested, run on a polyacrylamide gel and reacted with MIR98 and GAM25 precursor probes. Capped transcripts were prepared for in vitro RNA cleavage assays with T7 RNA polymerase, including a m7G (5') ppp (5') G-capping reaction using the T7-mMessage mMachine kit (Ambion). Purified PCR products were used as template for the reaction. These were amplified for each assay with specific primers containing a T7 promoter at the 5' end and a T3 RNA polymerase promoter at the 3' end. Capped RNA transcripts were incubated at 30 C in supplemented, dialysis concentrated, Hela S100 cytoplasmic extract (4C Biotech, Seneffe, Belgium). The Hela S100 was supplemented by dialysis to a final concentration of 20 mM Hepes, 100 mM KCl, 2.5 mM MgCl2, 0.5 mM DTT, 20% glycerol and protease inhibitor cocktail tablets (Complete mini Roche Molecular Biochemicals). After addition of all components, final concentrations were 100 mM capped target RNA, 2 mM ATP, 0.2 mM GTP, 500 U/ml RNasin, 25 microgram/ml creatine kinase, 25 mM creatine phosphate, 2.5 mM DTT and 50% S100 extract. Proteinase K, used to enhance Dicer activity (Zhang et al., EMBO J. 21, 5875-5885 (2002)) was dissolved in 50 mM Tris-HCl pH 8, 5 mM CaCl2, and 50% glycerol, was added to a final concentration of 0.6 mg/ml. Cleavage reactions were stopped by the addition of 8 volumes of proteinase K buffer 200 Mm Tris-Hcl, pH 7.5, 25 m M EDTA, 300 mM NaCl, and 2% SDS) and incubated at 65 C for 15 min at different time points (0, 0.5, 1, 4, 24 h) and subjected to phenol/chloroform extraction. Pellets were dissolved in water and kept frozen. Samples were analyzed on a segmented half 6%, half 13% polyacrylamide 1XTBE-7M Urea gel.

The Northern blot results of these experiments demonstrated an accumulation of a ~22 bp segment which reacted with the MIR98 precursor probe, and of a ~24 bp segment which reacted with the GAM25 precursor probe, over time (lanes 5-8). Absence of these segments when incubated with EDTA (lane 9), which is known to inhibit Dicer enzyme (Zhang et al., 2002), supports the notion that the processing of MIR98 and GAM25 precursors into their "diced" segments is mediated by Dicer enzyme, found in Hela lysate. Other RNases do not utilize divalent cations and are thus not inhibited by EDTA. The molecular sizes of EST72223, MIR-98 and GAM25 and their corresponding precursors are indicated by arrows.

FIG. 15D present Northern blot results of same above experiments with GAM25 probe (24 nt). The results clearly demonstrated the accumulation of mature GAM25 oligonucleotide after 24 h.

To validate the identity of the band shown by the lower arrow in FIGS. 15C and 15D, a RNA band parallel to a marker of 24 base was excised from the gel and cloned as in Elbashir et al (2001) and sequenced. Ninety clones corresponded to the sequence of mature GAM25 oligonucleotide, three corresponded to GAM25* (the opposite arm of the hairpin with a 1-3 nt 3' overhang) and two to the hairpin-loop.

GAM25 was also validated endogenously by sequencing from both sides from a HeLa YM100 total-RNA "ligation" libraries, utilizing hemispecific primers as described in FIG. 13.

Taken together, these results validate the presence and processing of a novel miRNA-like oligonucleotide, GAM25, which was predicted bioinformatically. The processing of this novel GAM oligonucleotide product, by Hela lysate from EST72223, through its precursor, to its final form was similar to that observed for known miRNA oligonucleotide, MIR98.

Transcript products were 705 nt (EST72223),102 nt (MIR98 precursor), 125 nt (GAM25 precursor)long. EST72223 was PCR-amplified with T7-EST 72223 forward primer: 5'-TAATACGACTC ACTATAGGCCCTTATTA-GAGGATTCTGCT-3' (SEQ ID NO: 4254796) and T3-EST72223 reverse primer: "-AATTAACCCTCAC-TAAAGGTTTTTTTTTCCTGAGACAGAGT-3' (SEQ ID NO: 4254797). MIR98 was PCR-amplified using EST72223 as a template with T7MIR98 forward primer: 5'-TAATAC-GACTCACTATAGGGTGAGGTAGTAAGTTGTATTGTT -3' (SEQ ID NO: 4254798) and T3MIR98 reverse primer: 5'-AATTAACCCTCACTAAAGGGAAAGTAG-TAAGTTGTATA GTT-3' (SEQ ID NO: 4254799). GAM25 was PCR-amplified using EST72223 as a template with GAM25 forward primer:

5'-AGGCAGGAGAATTGCTTGA-3' (SEQ ID NO: 4254800) and T3-EST72223 reverse primer: 5'-AATTAAC-CCTCACTAAAGGCC TGAGACAGAGTCTTGCTC- 3' (SEQ ID NO: 4254801).

It is appreciated that the data presented in FIGS. 15A, 15B, 15C and 15D when taken together validate the function of the bioinformatic oligonucleotide detection engine 100 of FIG. 2. FIG. 15A shows a novel GAM oligonucleotide bioinformatically-detected by the bioinformatic oligonucleotide detection engine 100, and FIGS. 15C and 15D show laboratory confirmation of the expression of this novel oligonucleotide. This is in accord with the engine training and validation methodology described hereinabove with reference to FIG. 2.

Figure 16A:
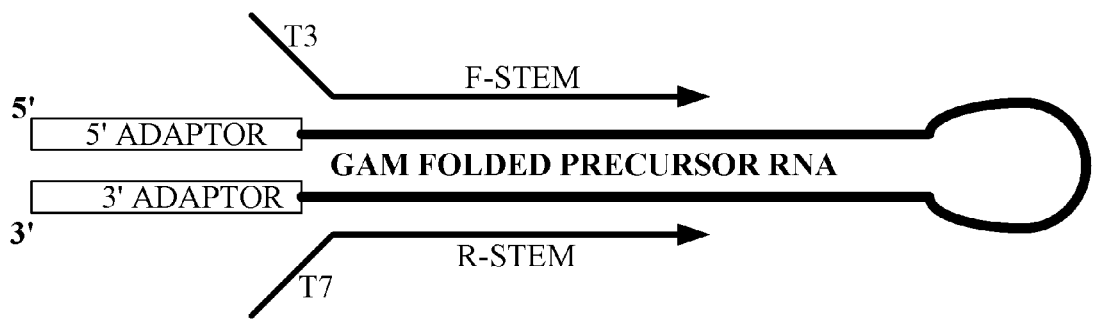
FIGS. 16A, 16B and 16C are schematic diagrams which, when taken together, represent methods of designing primers to identify specific hairpin oligonucleotides in accordance with a preferred embodiment of the present invention.
Figure 16B:
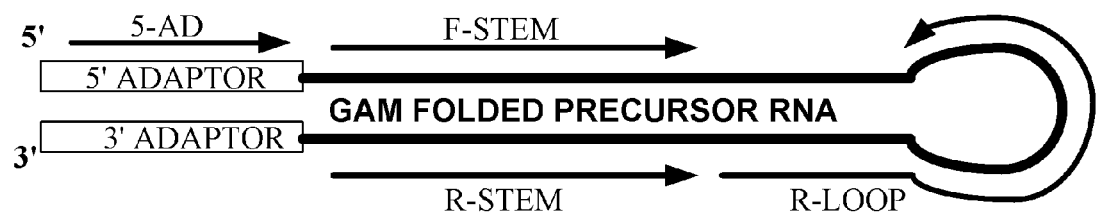
Figure 16C:
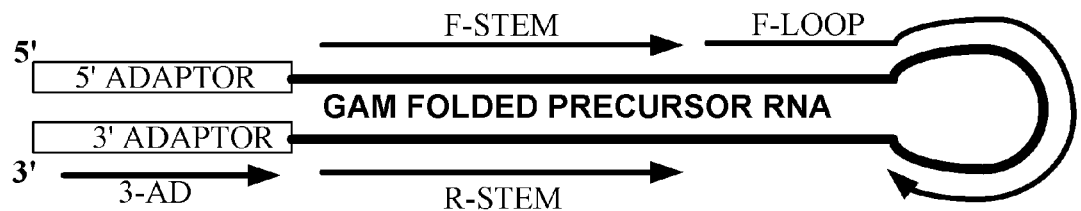

Reference is now made to FIGS. 16A-C, which schematically represent three methods that are employed to identify GAM FOLDED PRECURSOR RNA from libraries. Each method involves the design of specific primers for PCR amplification followed by sequencing. The libraries include hairpins as double-stranded DNA with two different adaptors ligated to their 5' and 3' ends.

Reference is now made to FIG. 16A, which depicts a first method that uses primers designed to the stems of the hairpins. Since the stem of the hairpins often has bulges, mismatches, as well as G-T pairing, which is less significant in DNA than is G-U pairing in the original RNA hairpin, the primer pairs were engineered to have the lowest possible match to the other strand of the stem. Thus, the F-Stem primer, derived from the 5' stem region of the hairpin, was chosen to have minimal match to the 3' stem region of the same hairpin. Similarly, the R-stem primer, derived from the 3' region of the hairpin (reverse complementary to its sequence), was chosen to have minimal match to the 5' stem region of the same hairpin. The F-Stem primer was extended in its 5' sequence with the T3 primer (5'-ATTAACCCTCAC-TAAAGGGA-3') (SEQ ID NO: 4254802) and the R-Stem primer was extended in its 5' sequence with the T7 primer (5'-TAATACGACTCACTATAGGG) (SEQ ID NO: 4254803).The extension is needed to obtain a large enough fragment for direct sequencing of the PCR product. Sequence data from the amplified hairpins is obtained in two ways. One way is the direct sequencing of the PCR products using the T3 primer that matches the extension of the F-Stem primer. Another way is the cloning of the PCR products into a plasmid, followed by PCR screening of individual bacterial colonies using a primer specific to the plasmid vector and either the R-Loop (FIG. 16B) or the F-Loop (FIG. 16C) primer. Positive PCR products are then sent for direct sequencing using the vector-specific primer.

Reference is now made to FIG. 16B, which depicts a second method in which R-Stem primer and R-Loop primers are used in a nested-PCR approach. First, PCR is performed with the R-Stem primer and the primer that matches the 5' adaptor sequence (5-ad primer). PCR products are then amplified in a second PCR using the R-Loop and 5-ad primers. As mentioned hereinabove, sequence data from the amplified hairpins is obtained in two ways. One way is the direct sequencing of the PCR products using the 5-ad primer. Another way is the cloning of the PCR products into a plasmid, followed by PCR screening of individual bacterial colonies using a primer specific to the plasmid vector and F-Stem primer. Positive PCR products are then sent for direct sequencing using the vector-specific primer. It should be noted that optionally an extended R-Loop primer is designed that includes a T7 sequence extension, as described hereinabove (FIG. 16A) for the R-Stem primer. This is important in the first sequencing option in cases where the PCR product is too short for sequencing.

Reference is now made to FIG. 16C, which depicts a third method, which is the exact reverse of the second method described hereinabove (FIG. 16B). F-Stem and F-Loop primers are used in a nested-PCR approach. First, PCR is performed with the F-Stem primer and the primer that matches the 3' adaptor sequence (3-ad primer). PCR products are then amplified in a second PCR using the F-Loop and 3-ad primers. As in the other two methods, sequence data from the amplified hairpins is obtained in two ways. One way is the direct sequencing of the PCR products using the F-Loop primer. Another way is the cloning of the PCR products into a plasmid, followed by PCR screening of individual bacterial colonies using a primer specific to the plasmid vector and R-Stem primer. Positive PCR products are then sent for direct sequencing using the vector-specific primer. It should be noted that optionally an extended F-Loop primer is designed that includes a T3 sequence extension, as described hereinabove (FIG. 16A) for the F-Stem primer. This is important in the first sequencing option in cases where the PCR product is too short for sequencing and also in order to enable the use of T3 primer.

In an embodiment of the present invention, the three methods mentioned hereinabove may be employed to validate the expression of GAM FOLDED PRECURSOR RNA.

Figure 17A:
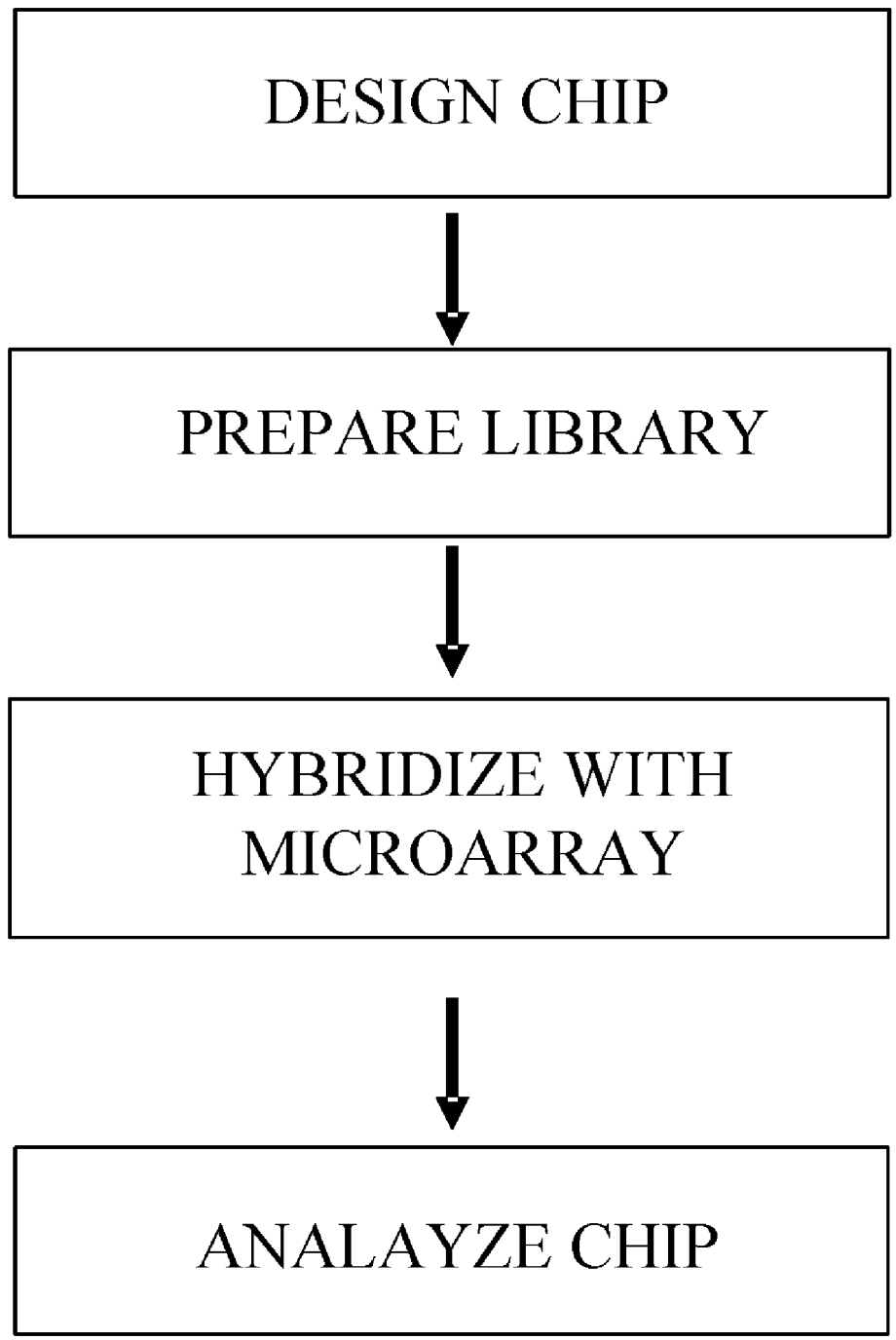
FIG. 17A is a simplified flowchart illustrating construction of a microarray constructed and operative to identify novel oligonucleotides of the present invention, in accordance with a preferred embodiment of the present invention.

Reference is now made to FIG. 17A, which is a flow chart with a general description of the design of the microarray to identify expression of published miRNA oligonucleotides, and of novel GAM oligonucleotides of the present invention.

Figure 17B:
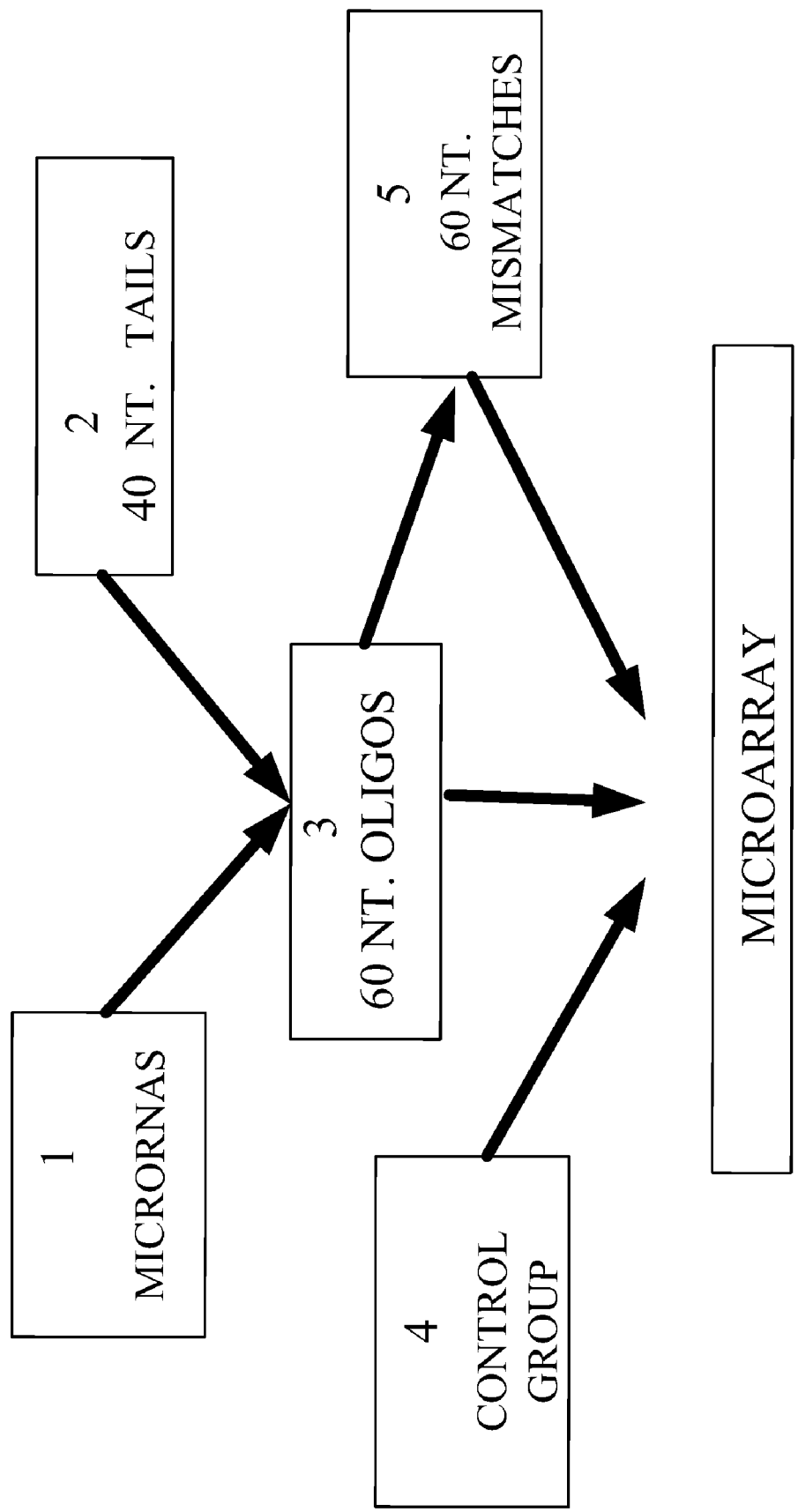
FIG. 17B is a simplified block diagram illustrating design of a microarray constructed and operative to identify novel oligonucleotides of the present invention, in accordance with a preferred embodiment of the present invention.
Figure 17C:
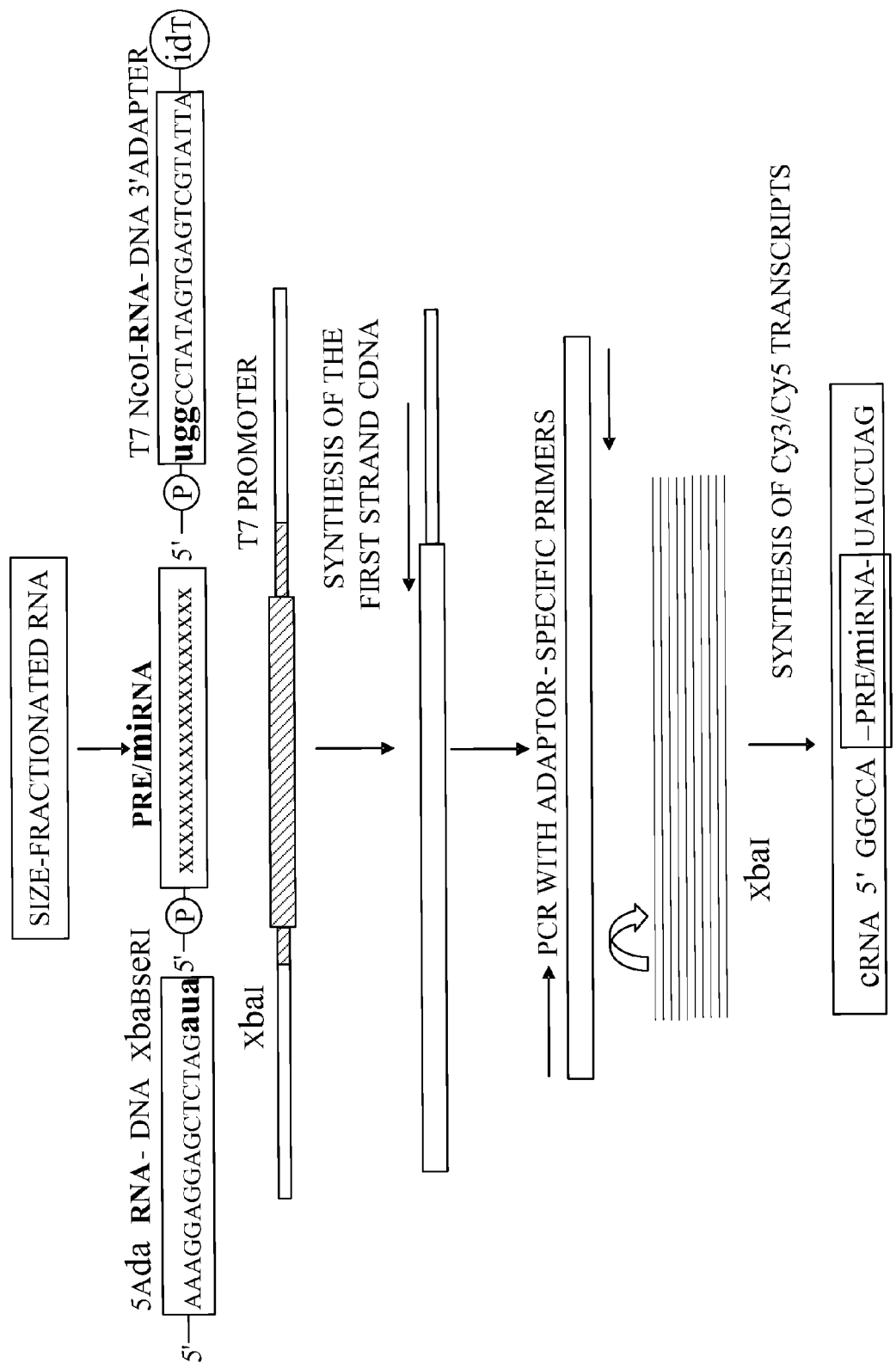
FIG. 17C is a flowchart illustrating a mode of preparation and amplification of a cDNA library in accordance with a preferred embodiment of the present invention. Shown in FIG. 17C are the following adapters: 5Ada RNA-DNA XbaBSerI (SEQ ID NO: 4254776) and T7 NcoI RNA-DNA 3' Adapator (SEQ ID NO: 4254777).

A microarray that identifies miRNA oligonucleotides is designed (FIG. 17B). The DNA microarray is prepared by Agilent according to their SurePrint Procedure (reference describing their technology can be obtained from the Agilent website, http://www.agilent.com). In this procedure, the oligonucleotide probes are synthesized on the glass surface. Other methods can also be used to prepare such microarray including the printing of pre-synthesized oligonucleotides on glass surface or using the photolithography method developed by Affymetrix (Lockhart D J et al., Nat Biotechnol. 14:1675-1680 (1996)). The 60-mer sequences from the design are synthesized on the DNA microarray. The oligonucleotides on the microarray, termed "probes" are of the exact sequence as the designed 60-mer sequences. Importantly, the 60-mer sequences and the probes are in the sense orientation with regards to the miRNA oligonucleotides. Next, a cDNA library is created from size-fractionated RNA, amplified, and converted back to RNA (FIG. 17C). The resulting RNA is termed "cRNA". The conversion to RNA is done using a T7 RNA polymerase promoter found on the 3' adaptor (FIG. 17C; T7 Ncol-RNA-DNA 3'Adaptor). Since the conversion to cRNA is done in the reverse direction compared to the orientation of the miRNA oligonucleotides, the cRNA is reverse complementary to the probes and is able to hybridize to it. This amplified RNA is hybridized with the microarray that identifies miRNA oligonucleotides, and the results are analyzed to indicate the relative level of miRNA oligonucleotides (and hairpins) that are present in the total RNA of the tissue (FIG. 18).

Reference is now made to FIG. 17B, which describes how the microarray to identify miRNA oligonucleotides is designed. miRNA oligonucleotide sequences or potential predicted miRNA oligonucleotides are generated by using known or predicted hairpins as input. Overlapping potential miRNA oligonucleotides are combined to form one larger sub-sequence within a hairpin.

To generate non-expressed sequences (tails), artificial sequences are generated that are 40 nts in length, which do not appear in the respective organism genome, do not have greater than 40% homology to sequences that appear in the genome, and with no 15-nucleotide window that has greater than 80% homology to sequences that appear in the genome.

To generate probe sequences, the most probable miRNA oligonucleotide sequences are placed at position 3 (from the 5' end) of the probe. Then, a tail sub-sequence to the miRNA oligonucleotide sequence was attached such that the combined sequence length will meet the required probe length (60 nts for Agilent microarrays).

The tails method provides better specificity compared to the triplet method. In the triplet method, it cannot be ascertained that the design sequence, and not an uncontrolled window from the triplet probe sequence, was responsible for hybridizing to the probe. Further, the tails method allows the use of different lengths for the potential predicted miRNA oligonucleotide (of combined, overlapping miRNA oligonucleotides).

Hundreds of control probes were examined in order to ensure the specificity of the microarray. Negative controls contain probes which should have low intensity signal. For other control groups, the concentration of certain specific groups of interest in the library are monitored. Negative controls include tail sequences and non-hairpin sequences. Other controls include mRNA for coding genes, tRNA, and snoRNA.

For each probe that represents known or predicted miRNA oligonucleotides, additional mismatch probes were assigned in order to verify that the probe intensity is due to perfect match (or as close as possible to a perfect match) binding between the target miRNA oligonucleotide cRNA and its respective complementary sequence on the probe. Mismatches are generated by changing nucleotides in different positions on the probe with their respective complementary nucleotides (A<->T, G<->C, and vice versa). Mismatches in the tail region should not generate a significant change in the intensity of the probe signal, while mismatches in the miRNA oligonucleotide sequences should induce a drastic decrease in the probe intensity signal. Mismatches at various positions within the miRNA oligonucleotide sequence enable us to detect whether the binding of the probe is a result of perfect match or, alternatively, nearly perfect match binding.

Based on the above scheme, we designed a DNA microarray prepared by Agilent using their SurePrint technology. Table 11 is a detailed list of microarray chip probes Known miRNA Oligonucleotides:

The miRNA oligonucleotides and their respective precursor sequences are taken from Sanger Database to yield a total of 186 distinct miRNA oligonucleotide and precursor pairs. The following different probes are constructed:

1. Single miRNA Oligonucleotide Probes:

From each precursor, 26-mer containing the miRNA oligonucleotide were taken, then assigned 3 probes for each extended miRNA oligonucleotide sequence: 1. the 26-mer are at the 5' of the 60-mer probe, 2. the 26-mer are at the 3' of the 60-mer probe, 3. the 26-mer are in the middle of the 60-mer probe. Two different 34-mer subsequences from the design tails are attached to the 26-mer to accomplish 60-mer probe. For a subset of 32 of Single miRNA oligonucleotide probes, six additional mismatches mutations probes were designed:

4 block mismatches at 5' end of the miRNA oligonucleotide;

6 block mismatches at 3' end of the miRNA oligonucleotide;

1 mismatch at position 10 of the miRNA oligonucleotide;

2 mismatches at positions 8 and 17 of the miRNA oligonucleotide;

3 mismatches at positions 6, 12 and 18 of the miRNA oligonucleotide; and 6 mismatches at different positions out of the miRNA oligonucleotide.

2. Duplex miRNA Oligonucleotide Probes:

From each precursor, a 30-mer containing the miRNA oligonucleotide was taken, then duplicated to obtain 60-mer probe. For a subset of 32 of probes, three additional mismatch mutation probes were designed:

2 mismatches on the first miRNA oligonucleotide;

2 mismatches on the second miRNA oligonucleotide; and 2 mismatches on each of the miRNA oligonucleotides.

3. Triplet miRNA Oligonucleotide Probes:

Following Krichevsky's work (Krichevsky et al., RNA 9:1274-1281 (2003)), head to tail ~22-mer length miRNA oligonucleotide sequences were attached to obtain 60-mer probes containing up to three repeats of the same miRNA oligonucleotide sequence. For a subset of 32 probes, three additional mismatch mutation probes were designed:

2 mismatches on the first miRNA oligonucleotide;

2 mismatches on the second miRNA oligonucleotide; and 2 mismatches on each of the miRNA oligonucleotides.

4. Precursor with miRNA Oligonucleotide Probes:

For each precursor, 60-mer containing the miRNA oligonucleotide were taken.

5. Precursor without miRNA Oligonucleotide Probes:

For each precursor, a 60-mer containing no more then 16-mer of the miRNA oligonucleotide was taken. For a subset of 32 probes, additional mismatch probes containing four mismatches were designed.

Control Groups:

1. 100 60-mer sequences from representative ribosomal RNAs.
2. 85 60-mer sequences from representatives tRNAs.
3. 19 60-mer sequences from representative snoRNA.
4. 294 random 26-mer sequences from human genome not contained in published or predicted precursor sequences, placing them at the probe's 5' and attached 34-mer tail described above.
5. Negative Control: 182 different 60-mer probes contained different combinations of 10 nt-long sequences, in which each 10 nt-long sequence is very rare in the human genome, and the 60-mer combination is extremely rare.

Predicted GAM RNAs:

There are 8642 pairs of predicted GAM RNA and their respective precursors. From each precursor, a 26-mer containing the GAM RNA was placed at the 5' of the 60-mer probe and a 34-mer tail was attached to it. For each predicted probe, a mutation probes with 2 mismatches at positions 10 and 15 of the GAM RNA were added.

For a subset of 661 predicted precursors, up to 2 probes each containing one side of the precursor including any possible GAM RNA in it were added.

Microarray Analysis:

Based on known miRNA oligonucleotide probes, a preferred position of the miRNA oligonucleotide on the probe was evaluated, and hybridization conditions adjusted and the amount of cRNA to optimize microarray sensitivity and specificity ascertained. Negative controls are used to calculate background signal mean and standard deviation. Different probes of the same miRNA oligonucleotide are used to calculate signal standard deviation as a function of the signal.

For each probe, BG_Z_Score=(log(probe signal)−mean of log(negative control signal))/(log(negative control signal) standard deviation) were calculated.

For a probe with a reference probe with 2 mismatches on the miRNA oligonucleotide, MM_Z_Score MM_Z_Score= (log(perfect match signal)−log(reference mismatch signal))/ (standard deviation of log(signals) as the reference mismatch log(signal)) were calculated.

BG_Z_Score and MM_Z_Score are used to decide whether the probe is on and its reliability.

Reference is now made to FIG. 17C, which is a flowchart describing how the cDNA library was prepared from RNA and amplified. The general procedure was performed as described previously (Elbashir S M, Lendeckel W, Tuschl T. RNA interference is mediated by 21- and 22-nucleotide RNAs. Genes Dev. 2001 15:188-200) with several modifications, which will be described hereinbelow.

First, the starting material is prepared. Instead of starting with standard total RNA, the total RNA was size-fractionated using an YM-100 Microcon column (Millipore Corporation, Billerica, Mass., USA) in the present protocol. Further, the present protocol uses human tissue or cell lines instead of a *Drosophila* in vitro system as starting materials. Finally, 3 micrograms of size-fractionated total RNA was used for the ligation of adaptor sequences.

Libraries used for microarray hybridization are listed hereinbelow: "A" library is composed of a mix of libraries from Total HeLa YM100 RNA and Nuclear HeLa YM100 RNA; "B" library is composed of a mix of libraries from Total HEK293 YM100 RNA and Nuclear HEK293 YM100 RNA; "C" library is composed of a mix of YM100 RNA libraries from Total PC3, Nuclear PC3 and from PC3 cells in which Dicer expression was transiently silenced by Dicer specific siRNA; "D" library is prepared from YM100 RNA from Total Human Brain (Ambion Cat#7962); "E" library is prepared from YM100 RNA from Total Human Liver (Ambion Cat#7960); "F" library is prepared from YM100 RNA from Total Human Thymus (Ambion Cat#7964); "G" library is prepared from YM100 RNA from Total Human Testis (Ambion Cat#7972); and "H" library is prepared from YM100 RNA from Total Human Placenta (Ambion Cat#7950).

Library letters appended by a numeral "1" or "2" are digested by XbaI (NEB); Library letters affixed by a numeral "3" are digested by Xba1 and Spel (NEB); Library letters appended by a numeral "4" are digested by Xba1 and the transcribed cRNA is then size-fractionated by YM30, retaining the upper fraction consisting of 60 nts and longer; Library letters affixed by a numeral "5" are digested by Xba1 and the transcribed cRNA is then size-fractionated by YM30 retaining the flow-through fraction consequently concentrated with YM10 consisting of 30 nts-60 nts; Library letters affixed by a numeral "6" are digested by Xba1 and the DNA is fractionated on a 13% native acrylamide gel from 40-60 nt, electroeluted on a GeBaFlex Maxi column (GeBa Israel), and lyophilized; Library letters affixed by a numeral "7" are digested by Xba1 and the DNA is fractionated on a 13% native acrylamide gel from 80-160 nt, electroeluted and lyophilized.

Next, unique RNA-DNA hybrid adaptor sequences with a T7 promoter were designed. This step is also different than other protocols that create libraries for microarrays. Most protocols use complements to the polyA tails of mRNA with a T7 promoter to amplify only mRNA. However, in the present invention, adaptors are used to amplify all of the RNA within the size-fractionated starting material. The adaptor sequences are ligated to the size-fractionated RNA as described in FIG. 13, with subsequent gel-fractionation steps. The RNA is then converted to first strand cDNA using reverse transcription.

Next, the cDNA is amplified using PCR with adaptor-specific primers. At this point, there is the optional step of removing the tRNA, which is likely to be present because of its low molecular weight, but may add background noise in the present experiments. All tRNA contain the sequence ACC at their 3' end, and the adaptor contains GGT at its 5' end. This sequence together (GGTACC) is the target site for NcoI restriction digestion. Thus, adding the restriction enzyme NcoI either before or during PCR amplification will effectively prevent the exponential amplification of the cDNA sequences that are complements of the tRNAs.

The amplified DNA is restriction enzyme-digested with Xba1 (and, optionally, with Pst or Spel) to remove the majority of the adaptor sequences that were initially added to the RNA. Using the first set of RNA-DNA hybrid adaptors listed below, the first two sets of primers listed below, and Xba1 restriction digest yields the following cRNA products: 5'GGCCA-PRE/miRNA-UAUCUAG, where PRE is defined as GAM PRECURSOR (palindrome). Using the second set of RNA-DNA hybrid adaptors listed below, the second set of primers listed below, and Xba1 and Pst restriction digest yields the following, smaller cRNA products: 5'GG-PRE/ miRNA-C*.

Then, cDNA is transcribed to cRNA utilizing an RNA polymerase e.g. T7 dictated by the promoter incorporated in the adaptor. cRNA may be labeled in the course of transcription with aminoallyl or fluorescent nucleotides such as Cy3- or Cy5-UTP and CTP among other labels, and cRNA sequences thus transcribed and labeled are hybridized with the microarray.

The following RNA-DNA hybrid adaptors are included in the present invention:

Name: T7 Ncol-RNA-DNA 3'Adapter
   Sequence: 5'(5phos)rUrGrGCCTATAGTGAGTCG-TATTA (SEQ ID NO: 4254806) (3InvdT)3'
2. Name: 5Ada RNA-DNA XbaBseRI
   Sequence: 5'AAAGGAGGAGCTCTAGrArUrA 3' (SEQ ID NO: 4254807) or optionally:
3. Name: 5Ada MC RNA-DNA PstAtaBser
   Sequence: 5'CCTAGGAGGAGGACGTCTGrCrArG 3' (SEQ ID NO: 4254808)
4. Name: 3'Ada nT7 MC RNA-DNA
   Sequence: 5'(5phos)rCrCrUATAGTGAGTCGTAT-TATCT (3InvdT) 3' (SEQ ID NO: 4254809)

The following DNA primers are included in the present invention:

1. Name: T7 Ncol-RT-PCR primer
   Sequence: 5'TAATACGACTCACTATAGGCCA 3' (SEQ ID NO: 4254810)
2. Name: T7Nhel Spel-RT-PCR primer
   Sequence: 5'GCTAGCACTAGTTAATACGACTCAC-TATAGGCCA 3' (SEQ ID NO: 4254811)
3. Name: 5Ada XbaBseRI Fwd
   Sequence: 5'AAAGGAGGAGCTCTAGATA 3' (SEQ ID NO: 4254812)
4. Name: Pst-5Ada XbaBseRI Fwd
   Sequence: 5'TGACCTGCAGAAAGGAGGAGCTCTA-GATA 3' (SEQ ID NO: 4254813)
   or optionally:
5. Name: 5Ada MC PstAtaBser fwd
   Sequence: 5'ATCCTAGGAGGAGGACGTCTGCAG 3' (SEQ ID NO: 4254814)
6. Name: RT nT7 MC Xbal
   Sequence: 5'GCTCTAGGATAATACGACTCACTAT-AGG 3' (SEQ ID NO: 4254815)

Figure 18A:
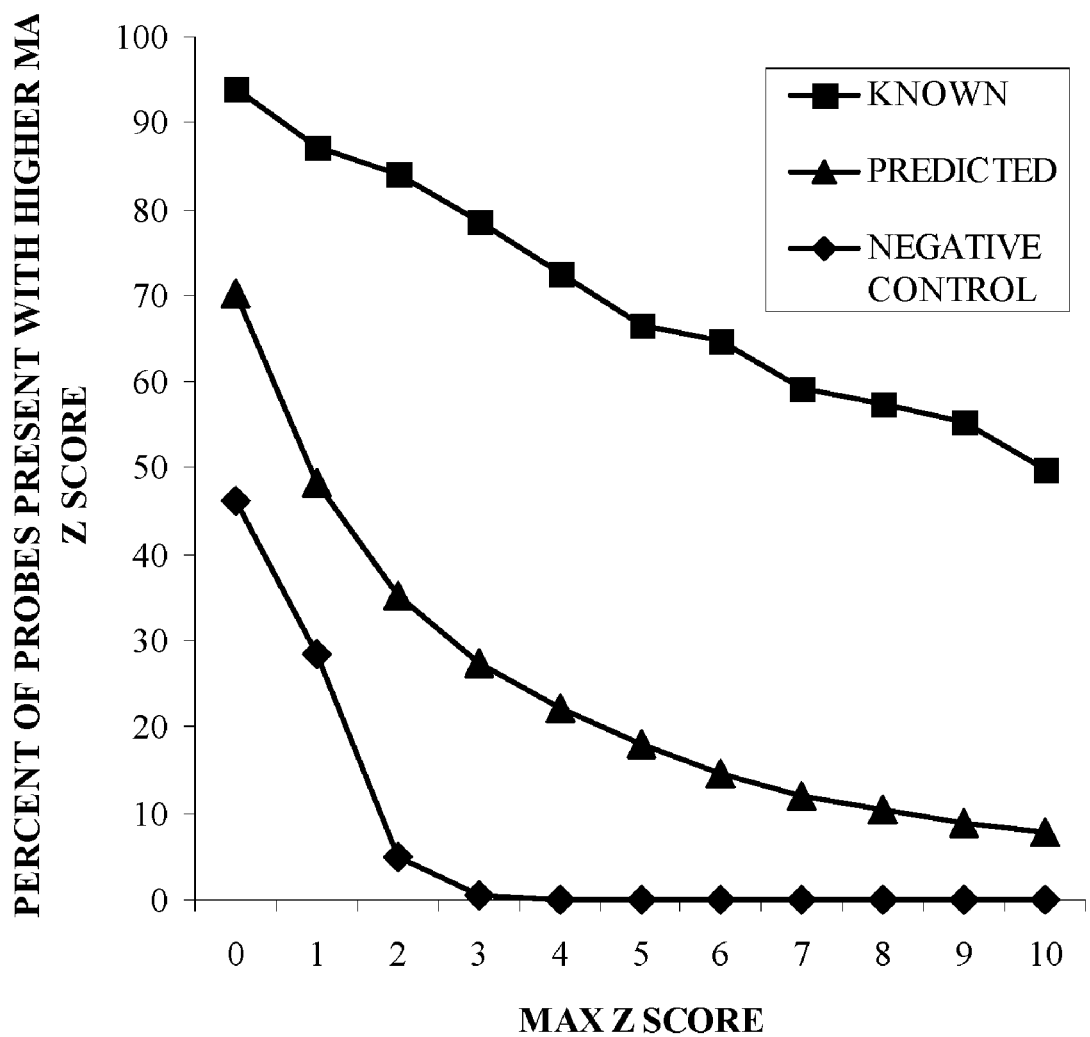
FIG. 18A is a line graph showing results of detection of known microRNA oligonucleotides and of novel GAM oligonucleotides, using a microarray constructed and operative in accordance with a preferred embodiment of the present invention.

Reference is now made to FIG. 18A, which demonstrates the detection of known miRNA oligonucleotides and of novel GAM oligonucleotides, using a microarray constructed and operative in accordance with a preferred embodiment of the present invention. Based on negative control probe intensity signals, we evaluated the background, non-specific, logarithmic intensity distribution, and extracted its mean, designated BG_mean, and standard deviation, designated BG_std. In order to normalize intensity signals between different microarray experiments, a Z score, which is a statistical measure that quantifies the distance (measured in standard deviations) that a data point is from the mean of a data set, was calculated for each probe with respect to the negative control using the following Z score formula: Z=(logarithm of probe signal BG_mean)/BG_std. We performed microarray experiments using RNA extracted from several different tissues and we calculated each probes maximum Z score. FIG. 18A shows the percentages of known, predicted and negative control groups that have a higher max Z score than a specified threshold as a function of max Z score threshold. The negative control group plot, included as a reference, considers probe with a max Z score greater then 4 as a reliable probe with meaningful signals. The sensitivity of our method was demonstrated by the detection of almost 80% of the known published miRNA oligonucleotides in at least one of the examined tissues. At a threshold of 4 for the max Z score, 28% of the predicted GAMs are present in at least one of the examined tissues.

Figure 18B:
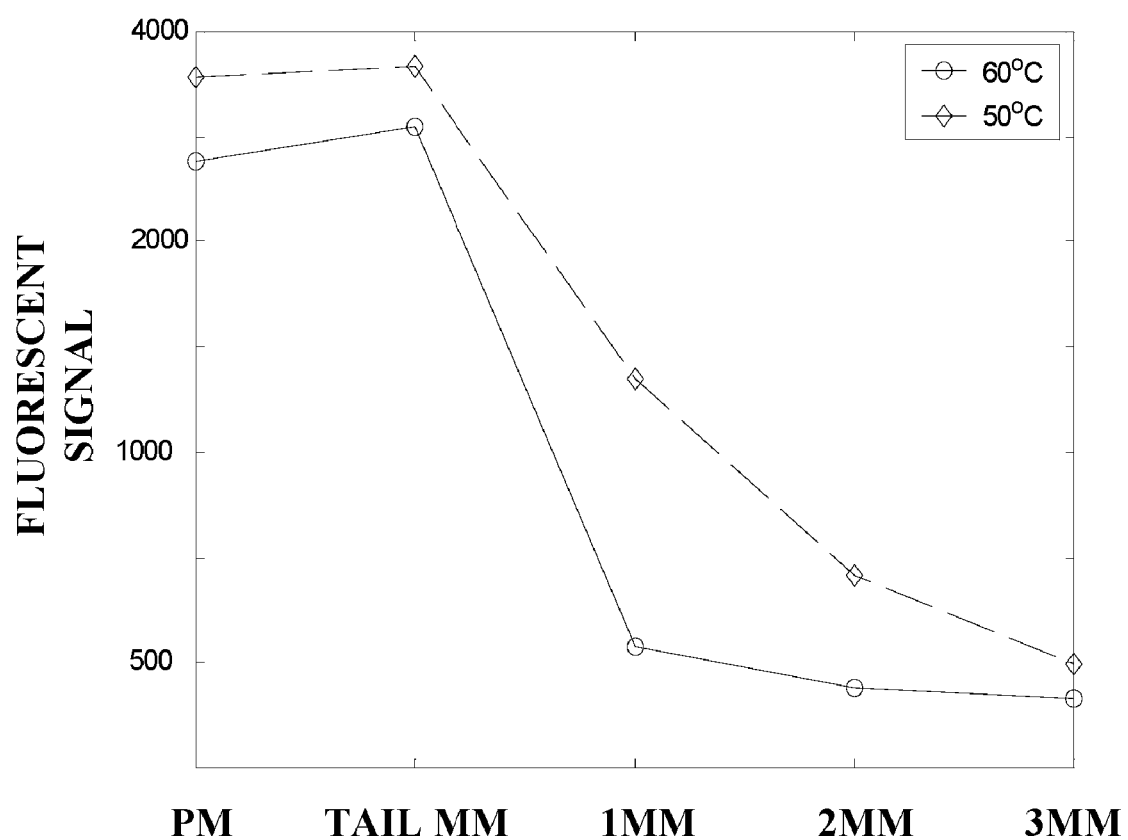
FIG. 18B is a line graph showing specificity of hybridization of a microarray constructed and operative in accordance with a preferred embodiment of the present invention.

Reference is now made to FIG. 18B, which is a line graph showing specificity of hybridization of a microarray constructed and operative in accordance with a preferred embodiment of the present invention and described hereinabove with reference to FIGS. 17A-17C.

The average signal of known miRNA oligonucleotides in Library A2 is presented on a logarithmic scale as a function of the following probe types under two different hybridization conditions: 50 C and 60 C: perfect match (PM), six mismatches on the tail (TAIL MM), one mismatch on the miRNA oligonucleotide (1 MM), two separate mismatches on the miRNA oligonucleotide (2 MM), three separate mismatches on the miRNA oligonucleotide (3 MM). The relative equality of perfect match probes and probes with the same miRNA oligonucleotide but many mismatches over the tail attest to the independence between the tail and the probe signal. At a hybridization temperature of 60 C, one mismatch in the middle of the miRNA oligonucleotide is enough to dramatically reduce the probe signal. Conducting chip hybridization at 60 C ensures that a probe has a very high specificity.

It is appreciated that these results demonstrate the specificity of the microarray of the present invention in detecting expression of miRNA oligonucleotides.

Reference is now made to FIG. 18C, which is a summary table demonstrating detection of known miRNA oligonucleotides using a microarray constructed and operative in accordance with a preferred embodiment of the present invention and described hereinabove with reference to FIGS. 17A-17C.

Labeled cRNA from HeLa cells and Human Liver, Brain, Thymus, Placenta, and Testes was used for 6 different hybridizations. The table contains the quantitative values obtained for each miRNA oligonucleotide probe. For each miRNA oligonucleotide, the highest value (or values) is given in bolded font while lower values are given in regular font size. Results for MIR-124A, MIR-9 and MIR-122A are exactly as expected from previous studies. The References column contains the relevant references in the published literature for each case. In addition to these miRNA oligonucleotides, the table shows other known miRNA oligonucleotides that are expressed in a tissue-specific manner. The results indicate that MIR-128A, MIR-129 and MIR-128B are highly enriched in Brain; MIR-194, MIR-148 and MIR-192 are highly enriched in Liver; mIR-96, MIR-150, MIR-205, MIR-182 and MIR-183 are highly enriched in Thymus; MIR-204, MIR-10B, MIR-154 and MIR134 are highly enriched in Testes; and MIR-122, MIR-210, MIR-221, MIR-141, MIR-23A, MIR-200C and MIR-136 are highly enriched in Placenta. In most cases, low but significant levels are observed in the other tissues. However, in some cases, miRNA oligonucleotides are also expressed at relative high levels in an additional tissue.

It is appreciated that these results reproduce previously published studies of expression of known miRNA oligonucleotides. These results demonstrate the reliability of the microarray of the present invention in detecting expression of published miRNA oligonucleotides, and of novel GAM oligonucleotides of the present invention.

DETAILED DESCRIPTION OF TABLES

Table 1 comprises data relating the SEQ ID NO of oligonucleotides of the present invention to their corresponding GAM NAME, and contains the following fields: GAM SEQ-ID: GAM SEQ ID NO, as in the Sequence Listing; GAM NAME: Rosetta Genomics Ltd. nomenclature (see below); GAM RNA SEQUENCE: Sequence (5' to 3') of the mature, "diced" GAM RNA; GAM ORGANISM: identity of the organism encoding the GAM oligonucleotide; GAM POS: Dicer-cut location (see below); and Table 2 comprises detailed textual description according to the description of FIG. 1 of each of a plurality of novel GAM oligonucleotides of the present invention, and contains the following fields: GAM NAME: Rosetta Genomics Ltd. nomenclature (see below); GAM ORGANISM: identity of the organism encoding the GAM oligonucleotide; PRECUR SEQ-ID:GAM precursor Seq-ID, as in the Sequence Listing; PRECURSOR SEQUENCE: Sequence (5' to 3') of the GAM precursor; GAM DESCRIPTION: Detailed description of GAM oligonucleotide with reference to FIG. 1; and Table 3 comprises data relating to the source and location of novel GAM oligonucleotides of the present invention, and contains the following fields: GAM NAME: Rosetta Genomics Ltd. nomenclature (see below); PRECUR SEQ-ID: GAM precursor SEQ ID NO, as in the Sequence Listing; GAM ORGANISM: identity of the organism encodes the GAM oligonucleotide; SOURCE: For human GAM—chromosome encoding the human GAM oligonucleotide, otherwise—accession ID (GenBank, NCBI); STRAND: Orientation of the strand, "+" for the plus strand, "−" for the minus strand; SRC-START OFFSET: Start offset of GAM precursor sequence relative to the SOURCE; SRC-END OFFSET: End offset of GAM precursor sequence relative to the SOURCE; and Table 4 comprises data relating to GAM precursors of novel GAM oligonucleotides of the present invention, and contains the following fields: GAM NAME: Rosetta Genomics Ltd. nomenclature (see below); PRECUR SEQ-ID: GAM precursor Seq-ID, as in the Sequence Listing; GAM ORGANISM: identity of the organism encoding the GAM oligonucleotide; PRECURSOR-SEQUENCE: GAM precursor nucleotide sequence (5' to 3'); GAM FOLDED PRECURSOR RNA: Schematic representation of the GAM folded precursor, beginning 5' end (beginning of upper row) to 3' end (beginning of lower row), where the hairpin loop is positioned at the right part of the draw; and Table 5 comprises data relating to GAM oligonucleotides of the present invention, and contains the following fields: GAM NAME: Rosetta Genomics Ltd. nomenclature (see below); GAM ORGANISM: identity of the organism encoding the GAM oligonucleotide; GAM RNA SEQUENCE: Sequence (5' to 3') of the mature, "diced" GAM RNA; PRECUR SEQ-ID: GAM precursor Seq-ID, as in the Sequence Listing; GAM POS: Dicer-cut location (see below); and Table 6 comprises data relating SEQ ID NO of the GAM target gene binding site sequence to TARGET gene name and target binding site sequence, and contains the following fields: TARGET BINDING SITE SEQ-ID: Target binding site SEQ ID NO, as in the Sequence Listing; TARGET ORGANISM: identity of organism encode the TARGET gene; TARGET: GAM target gene name; TARGET BINDING SITE SEQUENCE: Nucleotide sequence (5' to 3') of the target binding site; and Table 7 comprises data relating to target-genes and binding sites of GAM oligonucleotides of the present invention, and contains the following fields: GAM NAME: Rosetta Genomics Ltd. nomenclature (see below); GAM ORGANISM: identity of the organism encoding the GAM oligonucleotide; GAM RNA SEQUENCE: Sequence (5' to 3') of the mature, "diced" GAM RNA; TARGET: GAM target gene name; TARGET REF-ID: For human target genes—Target accession number (RefSeq, GenBank); Otherwise—the location of the target gene on the genome annotation. TARGET ORGANISM: identity of organism encode the TARGET gene; UTR: Untranslated region of binding site/s (3' or 5');

TARGET BS-SEQ: Nucleotide sequence (5' to 3') of the target binding site; BINDING SITE-DRAW: Schematic representation of the binding site, upper row represent 5' to 3' sequence of the TARGET, Lower row represent 3' to 5' Sequence of the GAM RNA; GAM POS: Dicer-cut location (see below); and Table 8 comprises data relating to functions and utilities of novel GAM oligonucleotides of the present invention, and contains the following fields: GAM NAME: Rosetta Genomics Ltd. nomenclature (see below); GAM RNA SEQUENCE: Sequence (5' to 3') of the mature, "diced" GAM RNA; GAM ORGANISM: identity of the organism encoding the GAM oligonucleotide; TARGET: GAM target gene name; TARGET ORGANISM: identity of organism encode the TARGET gene; GAM FUNCTION: Description of the GAM functions and utilities; GAM POS: Dicer-cut location (see below); and Table 9 comprises references of GAMs target genes and contains the following fields: TARGET: Target gene name; TARGET ORGANISM: identity of organism encode the TARGET gene; REFERENCES: reference relating to the target gene; and Table 10 comprises data relating to novel GR (Genomic Record) polynucleotides of the present invention, and contains the following fields: GR NAME: Rosetta Genomics Ltd. nomenclature (see below); GR ORGANISM: identity of the organism encoding the GR polynucleotide; GR DESCRIPTION: Detailed description of a GR polynucleotide, with reference to FIG. 9; and Table 11 comprises data of all sequences printed on the microarray of the microarray experiment, as described herein above with reference to FIG. 17 and include the following fields: PROBE SEQUENCE: the sequence that was printed on the chip PROBE TYPE: as described in detail in FIG. 17 in chip design section and summarized as follows: Known: published miRNA sequence; Known_mis1: similar to published miRNA sequence, but with 1 mismatch mutation on the miRNA sequence; Known_mis2: similar to published miRNA sequence, but with 2 mismatch mutations on the miRNA sequence; Known_mis3: similar to published miRNA sequence, but with 3 mismatch mutations on the miRNA sequence; Known_mis4: similar to published miRNA sequence, but with 6 mismatch mutations on regions other than the miRNA sequence; Predicted: predicted GAM RNA sequences; Mismatch: sequences that are similar to predicted GAM RNA sequences but with 2 mismatches; Edges 1: left half of GAM RNA sequences; Edges2: right half of GAM RNA sequences extended with its hairpin precursor (palindrome); Control1: negative control; Control2: random sequences; Control3: tRNA; Control4: snoRNA; Control5: mRNA; Control6: other; GAM RNA SEQ ID/MIR NAME: GAM oligonucleotide using Rosetta Genomics Ltd. Nomenclature (see below) or published miRNA oligonucleotide terminology; GAM RNA SEQUENCE: Sequence (5' to 3') of the mature, "diced" GAM RNA; LIBRARY: the library name as defined in FIG. 17C; SIGNAL: Raw signal data for library; BACKGROUND Z-SCORE: Z-score of probe signal with respect to background, negative control signals; MISMATCH Z-SCORE: Z-score of probe signal with respect to its mismatch probe signal; and Table 12 comprises data related to the GAM RNA SEQUENCEs included in the present invention that were validated by laboratory means. If the validated sequence appeared in more than one GAM precursor, the GAM RNA SEQ-ID indicated may be arbitrarily chosen. The table includes the following fields: VALIDATION METHOD: the type of validation performed on the sequence. The microarray validations are divided into four groups: a) "Chip strong" refers to GAM oligonucleotide sequences whose intensity (SIGNAL) on the microarray "chip" was more than 6 standard deviations above the background intensity, and the differential to the corresponding mismatch intensity was more than 2 standard deviations, where in this case the standard deviation is of the intensity of identical probes; b) "Chip" refers to GAM oligonucleotide sequences, whose intensity was more than 4 standard deviations above the background intensity; c) "Sequenced" refers to GAM oligonucleotide sequences that were sequenced; and d) "Chip strong, Sequenced" refers to miRNA oligonucleotide sequences that were both detected in the microarray as "Chip strong" and sequenced. "Sequenced" is described hereinabove with reference to FIG. 13. Other validations are from microarray experiments as described hereinabove with reference to FIGS. 17A-C and 18A-C; SIGNAL: a raw signal data; BACKGROUND Z-SCORE: a Z-score of probe signal with respect to background, negative control signals; MISMATCH Z-SCORE: a Z-score of probe signal with respect to its mismatch probe signal; and Table 13 comprises sequence data of GAMs associated with different bacterial infections. Each row refers to a specific bacterial infection, and lists the SEQ ID NOs of GAMs that target genes associated with that bacterial infection. The table contains the following fields: ROW#: index of the row number; INFECTION NAME: name of the infecting organism; and SEQ ID NOs OF GAMS ASSOCIATED WITH INFECTION: list of sequence listing IDs of GAMs targeting genes that are associated with the specified infection.

The following conventions and abbreviations are used in the tables: The nucleotide "U" is represented as "T" in the tables, and;

GAM NAME or GR NAME are names for nucleotide sequences of the present invention given by Rosetta Genomics Ltd. nomenclature method. All GAMs/GRs are designated by GAMx/GRx where x is a unique ID.

GAM POS is a position of the GAM RNA on the GAM PRECURSOR RNA sequence. This position is the Dicer-cut location: A indicates a probable Dicer-cut location; B indicates an alternative Dicer-cut location.

All human nucleotide sequences of the present invention as well as their chromosomal location and strand orientation are derived from sequence records of UCSC-hg16 version, which is based on NCBI, Build34 database (April, 2003).

All bacterial sequences of the present invention as well as their genomic location are derived from NCBI, RefSeq database.

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| ACTCACTGCAACCTCCACCTCC | Sequenced | | | | 323 |
| ACTGCACTCCAGCCTGGGCTAC | Sequenced | | | | 13 |
| AATCACTTGAACCCAAGAAGTG | Sequenced | | | | 5 |
| AATCGCTTGAACCCAGGAAGTG | Sequenced | | | | 6 |
| TTCAAGTGTTTAAGTTCTGCTT | Sequenced | | | | 305 |
| AGGCAGAGAGGACCAGAGACT | Sequenced | | | | 331 |
| CACTGCACTCCAGCCCGAGCAA | Sequenced | | | | 46 |
| CCCGGGTGGAGCCTGGGCTGTG | Sequenced | | | | 361 |
| GGGCGTGGAGCTGGAATGATGT | Sequenced | | | | 125 |
| TGATAGATCCATATTTTGGTAA | Sequenced | | | | 279 |
| AGCAAGACCAGGGTTTTGTGTT | Sequenced | | | | 326 |
| TCACTGCAACCTCCACCTCCCA | Sequenced | | | | 198 |
| ATTGTTGCCCATGTTTTTATTT | Sequenced | | | | 40 |
| CTGGACTGAGCTCCTTGAGGCC | Sequenced | | | | 383 |
| AGGCCAAGAAGGAAGCAGAGG | Sequenced | | | | 25 |
| ATTAGGAGAGTGGGTGCTAAGT | Sequenced | | | | 38 |
| AGTTTGTGTAAGAAAAGC | Sequenced | | | | 338 |
| AGGAAAAAAATTAATGTGAGTC | Sequenced | | | | 22 |
| TCACTGCAACCTCCACCAGCCT | Sequenced | | | | 197 |
| GTGACAGTGAATCTAGACAGAC | Sequenced | | | | 134 |
| TATTCATTGCCCATGTTTGTGA | Sequenced | | | | 262 |
| TGGGTTTTGTTTGTACAGTGTA | Sequenced | | | | 229 |
| CTCAGCTCATCCACTAAATCCC | Sequenced | | | | 377 |

-continued

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| TCACTGCAACCTCCACCTTCAG | Sequenced | | | | 263 |
| GGGAAATAATTAATGTGAAGTC | Sequenced | | | | 124 |
| TGGAGGAGAGTTTGTCAGTATAG | Sequenced | | | | 298 |
| GGAATGGTGGTTGTATGGTTG | Sequenced | | | | 116 |
| TCACTGCAACCTCCACCTTCCG | Sequenced | | | | 201 |
| TTCTGATGGTTAAGTTCTGTCA | Sequenced | | | | 306 |
| AGGGCAGGAGGTCCGTCCCTTC | Sequenced | | | | 27 |
| TCACTGCAACCTCCACCACGTG | Sequenced | | | | 196 |
| TCTAAGAGAAAGGAAGTTCAGA | Sequenced | | | | 272 |
| GAAGTTTGAAGCCTGTTGTTCA | Sequenced | | | | 95 |
| CTAGACTGAAGCTCCTTGAGGA | Sequenced | | | | 74 |
| AATTGCTTGAACCCAGGAAGTGGA | Sequenced | | | | 8 |
| CACTGCAACCTCCACCTCCTGG | Chip strong, Sequenced | 31393 | 19.150194 | 22.611071 | 45 |
| TCACTGCAACCTCCACCTCCCG | Chip strong, Sequenced | 31810 | 20.186802 | 16.772465 | 199 |
| TCACTGCAACCTCCACCTCCTG | Chip strong, Sequenced | 45662 | 20.504339 | 18.911047 | 200 |
| ATGGTAGCTGTCCACATCAGGA | Chip strong | 8208 | 25.85717 | 21.352978 | 36 |
| TCAGCTCCTACCCCGGCCCCAG | Chip strong | 8279.5 | 11.228731 | 17.399603 | 204 |
| GTTTCTCTGGGCTTGGCAT | Chip strong | 8298 | 10.689093 | 5.6611276 | 257 |
| TGGTCTGGCCCACATGGTC | Chip strong | 8349 | 13.022524 | 4.8629713 | 231 |
| GTGCTGGTGCTCGCTCCTCTGG | Chip strong | 8165 | 11.725875 | 9.7062302 | 251 |
| CTCAGGTGATCCACCCCTCTTG | Chip strong | 8190 | 8.7424583 | 3.9819176 | 75 |
| TGCAGGTTGCTGGTCTGATCTC | Chip strong | 8079 | 24.743416 | 17.869699 | 283 |
| AGTCATTATCTCCTGGACC | Chip strong | 7790 | 10.371323 | 17.396904 | 30 |
| GCTGCACCCCAGCCTGGGTAAC | Chip strong | 7858 | 6.2366548 | 20.271864 | 162 |
| CACTTCCCTTCTCTGCTCATGG | Chip strong | 7886.5 | 8.1030474 | 7.7415953 | 347 |
| TGCTGGCTATCCTGCGCCTTTC | Chip strong | 7903 | 10.469044 | 13.746831 | 225 |
| GGCTGCTGGTTTCTTGTTTTAG | Chip strong | 7926 | 12.94939 | 11.212504 | 176 |
| CTTCCTGCCTCTCGCCGCCCGC | Chip strong | 7982 | 10.846725 | 2.7860351 | 89 |
| CTGCTCTGGTTTCCTCTGTC | Chip strong | 7506.5 | 7.7015729 | 15.622507 | 86 |
| GCCTCCAGGTCGGTCTTTCTCT | Chip strong | 7529 | 13.077046 | 6.7496343 | 104 |
| CCCTCTTGGCTTCTATCCCACC | Chip strong | 7596 | 7.1978688 | 6.3785648 | 363 |
| CAGCTGGTGCTTGCCTGGCTAA | Chip strong | 7373 | 13.676201 | 7.9258513 | 351 |
| TCTCCCAGATCCTTTAGCCTCC | Chip strong | 7384.5 | 14.663905 | 2.166656 | 274 |
| TTTCTTGGGCCGTGTGCTGGT | Chip strong | 7386 | 8.0159159 | 10.662634 | 248 |
| ATCACTTTGAGTCCAGGAGTTT | Chip strong | 7335 | 6.5335536 | 19.718058 | 32 |
| GAGCCGCCCTCCACGATGTCCC | Chip strong | 7252 | 8.6663809 | 14.735928 | 142 |
| CCTCACTCAGGTTTGGACCCTG | Chip strong | 7301 | 15.895414 | 5.3846102 | 61 |

-continued

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| GGGTTACTCTGTGTTGGTCAGG | Chip strong | 7310 | 8.6937799 | 12.815997 | 129 |
| TGCTCTGATTTTTGCCCCAGC | Chip strong | 7060.5 | 10.413313 | 7.7476549 | 291 |
| GCTGTTTTCCCATAGCTGGTCA | Chip strong | 7061 | 19.803032 | 6.222959 | 164 |
| GCTAGGCTGCTGGCCACTGAGG | Chip strong | 6972.5 | 13.127683 | 19.686853 | 159 |
| TGCTTGCTGTGGTTGGCTGGTA | Chip strong | 6974 | 21.75724 | 11.332961 | 296 |
| TCAGCCTCCTCCACCCCAGAGT | Chip strong | 6996.5 | 14.03341 | 7.0927162 | 264 |
| GGGGAACGCGCTGGCCCGCGCC | Chip strong | 7005 | 6.2445078 | 11.806351 | 127 |
| CTCTGTGATATGGTTTGTAATA | Chip strong | 6862 | 19.265455 | 13.692534 | 84 |
| CATTCTGTGAGCTGCTGGCTTT | Chip strong | 6884 | 11.220102 | 9.6062307 | 52 |
| CTCGACTTCCCTGGCTTGCGTGA | Chip strong | 6890 | 6.5380254 | 11.584653 | 78 |
| GGCGGCCCAGGCGCTTGGAGAT | Chip strong | 6899.5 | 8.1672001 | 10.434432 | 172 |
| TGCCGCCCGGCCATCTCGGCTC | Chip strong | 6915.5 | 13.391404 | 5.9536037 | 220 |
| TCTCTATGCCATGCTGGCCT | Chip strong | 6926 | 17.665062 | 2.5852687 | 217 |
| ACATTCTCTGATTGGTGCCTCC | Chip strong | 6695 | 12.723179 | 6.4453721 | 319 |
| CTGTGCTCTTTCCACGGCCCCA | Chip strong | 6477.5 | 13.662484 | 9.3280506 | 139 |
| AAGGCCGCCCCTTCATGCTCCT | Chip strong | 6358.5 | 9.1175785 | 8.5895061 | 1 |
| CAGCAGCTCAGCCTCCTTCCCA | Chip strong | 6588 | 11.002058 | 9.0820408 | 349 |
| CAGTTTGTCCCCATGGCCATGT | Chip strong | 6591.5 | 13.401958 | 5.2375259 | 354 |
| TGGAGCTGGGTCTGGGCA | Chip strong | 6426 | 15.46969 | 17.843594 | 297 |
| CCTGGTCGGCGTGGTGACGGCG | Chip strong | 6434.5 | 6.2044091 | 6.2762375 | 369 |
| TCCTACGGTGGCCACAGTCTGG | Chip strong | 6256 | 7.9984035 | 3.2358623 | 210 |
| CGTTCACTCCCTTGCCCCTCGG | Chip strong | 6280.5 | 7.0008011 | 9.7373304 | 73 |
| TGTCTGGCTTTCTTCAGTTAGC | Chip strong | 6191 | 9.9906111 | 15.989508 | 236 |
| TGCTGCACCCTCTGCCTCCGGG | Chip strong | 6094.5 | 6.9428978 | 10.588869 | 293 |
| GCAGCATCCCGGCCTCCACTGT | Chip strong | 5995 | 7.2606683 | 11.881517 | 147 |
| TGTGGTAGTCACGGCCCGCCAC | Chip strong | 5909.5 | 23.027369 | 15.816967 | 304 |
| CTTGCCTGCCCTGTGTCATAAA | Chip strong | 5903.5 | 13.361271 | 3.0393276 | 91 |
| TTCACTGCTCTAGCCCTAATTT | Chip strong | 5739 | 15.599205 | 7.8376389 | 240 |
| TCCATTGGCCTTTTATCCTAGA | Chip strong | 5760 | 15.329782 | 8.1126537 | 209 |
| TGCCTAGCCAAGTCCAGTATTT | Chip strong | 5823 | 17.976177 | 16.478537 | 221 |
| TTCTGGCTTCTCCCAGGCGGCC | Chip strong | 5582 | 8.2352791 | 10.879703 | 243 |
| ATGGCCCTCTTATCACAGCTCC | Chip strong | 5586.5 | 21.480997 | 6.3762493 | 342 |
| ACTGCACTCCATCCAGCCTGGC | Chip strong | 5668 | 7.6480083 | 10.938603 | 324 |
| TGCCTGCCCCAGCTGAGATATC | Chip strong | 5686 | 10.380668 | 15.221783 | 287 |
| GCTCGCTGGGGTCTGCAGGCGG | Chip strong | 5502 | 7.7859778 | 10.874097 | 111 |
| GCAGCTCCTGGAGGTGAGAGGCG | Chip strong | 5368 | 7.8018293 | 15.956004 | 100 |
| CTCATTGTAGCCTCCAGTTCTTG | Chip strong | 5375 | 10.634505 | 9.6296253 | 379 |
| AGGCTGGTTAGATTTGTGGTCT | Chip strong | 5392 | 20.112637 | 16.324888 | 26 |
| GCTGCACTTCAGCCTGGGTGTC | Chip strong | 5310 | 7.5533419 | 15.940791 | 113 |

-continued

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| GCCCTTTGTGTCTGGCTGGGGT | Chip strong | 5320 | 11.978069 | 10.261797 | 152 |
| TTCTCTGTGCTGGGTCCTGAGG | Chip strong | 5272.5 | 8.1261625 | 9.2259359 | 242 |
| AGATTTCCCTTCCTGCTTGCCT | Chip strong | 5251 | 6.0291886 | 13.065763 | 17 |
| TGCGTTCCAGTTGCTGCCAGGC | Chip strong | 5079 | 11.194171 | 5.7294831 | 290 |
| CTGGCTAAGATCCAAGAAAGGC | Chip strong | 5036 | 14.178236 | 6.6532001 | 385 |
| TCATTGCAACCTCCTCCTGGGT | Chip strong | 5039.5 | 18.95397 | 9.7537737 | 207 |
| TTGACATGCCTCCTACATGATC | Chip strong | 5065 | 12.953059 | 10.809283 | 307 |
| CCTGCTCTCTGTTCTTAAGCTT | Chip strong | 5021 | 9.0648565 | 7.4354005 | 64 |
| TGCACCACTGCACCCCAGTCTG | Chip strong | 5009 | 7.3463378 | 16.848854 | 281 |
| TGCTGCCCTAAGACCACCTT | Chip strong | 4950 | 11.124713 | 13.249466 | 294 |
| GGGAGTTGTGGTTGGCTTCTGG | Chip strong | 4978 | 8.3206406 | 9.2158394 | 179 |
| GGCCGTGGTCGCTGACTCTCGT | Chip strong | 4980 | 6.9448657 | 12.094063 | 120 |
| TAGGTATGGCTTGTGGCACAGC | Chip strong | 4840 | 23.281979 | 15.36544 | 261 |
| GCGCCGCCATCCGCATCCTCGT | Chip strong | 4801 | 16.34218 | 9.281786 | 107 |
| CTGGTGTTGGGTCTTGCTTTTA | Chip strong | 4756 | 6.5764294 | 8.8639517 | 138 |
| ATGGGCCTCCTATTATCCCCAT | Chip strong | 4745.5 | 13.363207 | 5.1394033 | 34 |
| CGCCCAGGCTGGAGTGCCAGTG | Chip strong | 4722 | 9.6376123 | 13.758563 | 69 |
| CGACCTTGTGATCCTCCCGCCT | Chip strong | 4594 | 7.4134154 | 4.4487605 | 370 |
| CTCAGTGCAACCTCCGCCTACT | Chip strong | 4516 | 8.8905106 | 13.512998 | 76 |
| GGCTCTGGCTTTGGAGGAGCAG | Chip strong | 4483.5 | 6.8781896 | 14.473881 | 174 |
| GGGCTTTTGGAATGGTCTGT | Chip strong | 4463 | 9.6709318 | 2.0551727 | 126 |
| AGTCGCTGGACCATCAGAGCCT | Chip strong | 4419 | 12.240126 | 13.100382 | 335 |
| GGTGGTGGAGCGGGCCCAGGCC | Chip strong | 4320.5 | 7.4591732 | 12.328825 | 185 |
| TCCAGCTGTCCACGTCTTCCTG | Chip strong | 4070 | 6.5770264 | 7.9605851 | 265 |
| ATGGTACTCCAGCCTGGGTGAC | Chip strong | 4173 | 7.3957338 | 16.409479 | 35 |
| ATTCTGTGCTAACTGCAGGCCA | Chip strong | 4140 | 19.305922 | 11.530575 | 343 |
| GACCTCGTGATCCGCCTGCTTT | Chip strong | 4080.5 | 7.6009617 | 13.947659 | 97 |
| TGGTGCAGCGTGTGGTGGCTCT | Chip strong | 4082.5 | 9.6208868 | 12.887189 | 302 |
| TGGTCGGGCTGCATCTTCCGGC | Chip strong | 4093 | 8.0100813 | 2.1106353 | 230 |
| CACTGCAGCCTCCATCTCTGGG | Chip strong | 4050 | 6.9180322 | 10.574921 | 47 |
| ATGGTGCTGGTGGGAGTGTATT | Chip strong | 4053 | 18.971554 | 14.625937 | 37 |
| TGCCTGCCGTTAAATGTTACTT | Chip strong | 3936 | 12.749383 | 11.509386 | 222 |
| GACCTTGTGATCCGCCCACTTT | Chip strong | 3834 | 7.5950313 | 9.0545225 | 141 |
| CAACTCACTGCGGCCTCAACCT | Chip strong | 3783 | 9.680912 | 5.8278494 | 41 |
| CTGGAGGAGCTGCCATG | Chip strong | 3669 | 12.842446 | 14.933422 | 384 |
| TAGCTCCTCCCAGATCTCATCT | Chip strong | 3659 | 10.385338 | 3.9473054 | 192 |
| TTGGGGGAGGCCTGCTGCCCAT | Chip strong | 3549 | 9.3567915 | 8.3044834 | 310 |
| GTTGGTCTTCATTAAATGCTTT | Chip strong | 3499.5 | 17.153486 | 5.8892236 | 255 |

-continued

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| GGTGGCTATGGCTGTGCTCGC | Chip strong | 3426.5 | 15.917648 | 2.9563422 | 132 |
| GATGTCGTGATCCACCCGCCTT | Chip strong | 3425 | 7.313684 | 10.200798 | 145 |
| AGTGGCGTGATCTCGGCTCGGT | Chip strong | 3395 | 8.8775339 | 14.742507 | 336 |
| GTGCTTAAAGAATGGCTGTCCG | Chip strong | 3362 | 26.398634 | 13.195816 | 252 |
| TCACTGCAAGCTCCACCCTCCG | Chip strong | 3370 | 12.960393 | 9.7885542 | 202 |
| CGGCACTGTAGTCTGGCTGGGA | Chip strong | 3297 | 6.7212648 | 9.1534166 | 374 |
| CTGGCTAGATGTGTGGCCATGA | Chip strong | 3221 | 21.032122 | 14.058989 | 137 |
| AACCTTGTGATCCACCCACCTT | Chip strong | 3034 | 7.7903786 | 12.639959 | 313 |
| AGCTGGCTTACTTGAGATGCAT | Chip strong | 3049 | 8.8567095 | 7.4132333 | 329 |
| GGGGCTTCTAGGGTGCCAGATC | Chip strong | 3012.5 | 13.356146 | 7.901947 | 181 |
| GGCCCAGGTTGGAGTGCAGTGA | Chip strong | 2994 | 8.0930119 | 10.374014 | 168 |
| GGCCCAGTGCAAGCTCTTTCTG | Chip strong | 2960 | 7.6298795 | 6.4523926 | 118 |
| GCCCTTGAAGCTCTGACCCGCT | Chip strong | 2947 | 7.6962008 | 2.815666 | 151 |
| GCTGGCTCCACCTGCTGCCAGG | Chip strong | 2916 | 6.3332305 | 13.052609 | 115 |
| CCACTGAGGTAGCTGGTGACTG | Chip strong | 2861 | 16.719574 | 7.8953633 | 54 |
| CCTCCGGTCATTGTGCGGGCCT | Chip strong | 2835 | 12.644177 | 5.132216 | 366 |
| AGGATCTTGCTATGTTGGCCAG | Chip strong | 2784 | 10.949057 | 7.9714575 | 330 |
| TGGTGCTAGTTAAATCTTCAGG | Chip strong | 2715 | 17.999035 | 10.341267 | 232 |
| GCACTGCTGCCTCCTGG | Chip strong | 2627 | 6.3458524 | 7.414557 | 99 |
| TTATAATGTATAGCTGTGCCTG | Chip strong | 2566.5 | 15.056374 | 8.2182913 | 238 |
| TGCTTCTAGGGAGGCCGCAGGA | Chip strong | 2554 | 12.58359 | 11.930317 | 295 |
| TAGAACTATGGCTATGTGCCA | Chip strong | 2523.5 | 18.843672 | 7.4688845 | 259 |
| GACCCATCCTCCACTTGGCAGC | Chip strong | 2498 | 6.505065 | 6.8388047 | 96 |
| GCCTAGTGGATTTGAAGGGCC | Chip strong | 2352 | 20.613605 | 8.8114462 | 153 |
| TGCCCACTGCTGGCCACCACCC | Chip strong | 32112 | 15.630626 | 16.785101 | 219 |
| GGCTGGCCCCATCCAGGCTGGCA | Chip strong | 65518 | 10.117671 | 10.864906 | 121 |
| ACAAAGCGCTTCTCTTTAGAGT | Chip strong | 65518 | 11.238881 | 26.766436 | 9 |
| GGGGCTGGTCTTTCCACTTACT | Chip strong | 65518 | 11.24554 | 19.391401 | 180 |
| GGAGGCTGGCCTTCAGACGGGT | Chip strong | 65518 | 12.034198 | 25.266558 | 166 |
| ACGCGCTGGGCGCTGGCCAAT | Chip strong | 65518 | 13.337035 | 9.5484018 | 12 |
| ACAAAGTGCCTCCTTTTAGAGT | Chip strong | 65518 | 13.412503 | 32.421429 | 10 |
| CGCCTGGCCCCCAGTACTTTGT | Chip strong | 65518 | 14.386203 | 22.674049 | 373 |
| GCCTGGCCTAAATTAGTAATTT | Chip strong | 65518 | 14.47023 | 33.939186 | 155 |
| CCCTCTGGCCCCTGTGGTGGAT | Chip strong | 65518 | 14.648276 | 19.804953 | 362 |
| CTGCCTGCCTGGCCCAGGAACC | Chip strong | 65518 | 14.752467 | 36.164337 | 381 |
| CGCCCGCTGGCCCTGCGATCTC | Chip strong | 65518 | 15.196337 | 33.776985 | 70 |
| AGGACCTGTCCCCTGGCCCACT | Chip strong | 65518 | 15.796532 | 15.770715 | 24 |
| CAGCAGCACACTGTGGTTTGTA | Chip strong | 65518 | 16.623587 | 30.172779 | 348 |
| CCGCCTGGCCCATTGCAGGGCA | Chip strong | 65518 | 19.692606 | 29.045151 | 365 |

-continued

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| CACTGCACTCCAGCTCTGGGT | Chip strong | 65518 | 20.15584 | 31.571056 | 345 |
| ACAAAGTGCCTCCCTTTAGAGT | Chip strong | 65518 | 22.461653 | 34.028076 | 316 |
| CCCCACTGTCCCCGGAGCTGGC | Chip strong | 65518 | 22.799175 | 24.102064 | 358 |
| GGCGCTGGCCTGTGGGATCCCG | Chip strong | 65518 | 24.841112 | 31.449797 | 171 |
| GCGGCGGCGGTAGCAAAAATGA | Chip strong | 65518 | 27.5298 | 22.089998 | 109 |
| AGGGTTGTGTGCTGGCCGCTGG | Chip strong | 65518 | 29.01285 | 32.102142 | 28 |
| GGTGGCCCCTGGGAGATGCTGG | Chip strong | 65518 | 31.295538 | 14.111359 | 131 |
| CACTGCACTCCAGCCTGGGCAA | Chip strong | 65518 | 36.446095 | 33.140068 | 12852 |
| TGTGCTGGCCTTTGGTGACTTC | Chip strong | 65518 | 44.612064 | 26.016636 | 237 |
| CATGCTGGCCCACACCCGCTGC | Chip strong | 57891 | 37.069935 | 17.358248 | 50 |
| GGCTTCCTGCCTCGGGCTGGCC | Chip strong | 58372 | 13.006404 | 4.4936109 | 177 |
| GCCTGGCCTAATTCCAGCATTT | Chip strong | 62842.5 | 16.076189 | 31.293688 | 156 |
| GAAGGGGAAGAGAGCTGGCCG | Chip strong | 63993 | 20.677708 | 18.040138 | 94 |
| CCCGGCACCTCCGCTGCACAC | Chip strong | 50589.5 | 17.716768 | 10.848449 | 360 |
| ATGCCACTGCGCTCCAGCCTGA | Chip strong | 50941.5 | 15.106459 | 30.447573 | 341 |
| CCCCACTGTTTTCTTCATCCTA | Chip strong | 50957 | 32.576454 | 4.8442335 | 359 |
| CTTGGAGTAGGTCATTGGGTGG | Chip strong | 51071 | 16.39068 | 33.942337 | 92 |
| AGGTGCTGGGGCTTGGCCTGCT | Chip strong | 54992 | 14.781937 | 19.839622 | 333 |
| TGCCCGGATACCCCTGGCCTC | Chip strong | 46111 | 13.316625 | 10.030684 | 285 |
| ATTGCACTCCAGCCTGAGCAAA | Chip strong | 46579 | 22.505102 | 33.557095 | 39 |
| TCTCTTCGCTGGCCCTCGGGGA | Chip strong | 47791.5 | 15.379544 | 20.008915 | 276 |
| CCGTCCCCGGTGCTGCCTGCGC | Chip strong | 48514 | 9.4747534 | 7.9190497 | 60 |
| TGCTAGCTGCCCGAAGGTCTCA | Chip strong | 39989 | 47.058292 | 15.67876 | 223 |
| CCTGGCCGCTGTGCCCCCT | Chip strong | 40002 | 11.873036 | 10.703612 | 65 |
| ACACTTTGCCCCTGGCCGCCTT | Chip strong | 42189 | 12.009233 | 22.436626 | 317 |
| TGACCTCCTTTCTCGACTAATT | Chip strong | 43651 | 10.281033 | 24.914602 | 278 |
| CTGCTGCGCTGGCCGTCACGGT | Chip strong | 45168 | 18.758972 | 18.507338 | 382 |
| TTATTGCACTCCAGCCTGGGTA | Chip strong | 45303 | 21.338472 | 22.149384 | 239 |
| CTCAGTGCTGCTGGCTCCTGTC | Chip strong | 30057 | 40.88406 | 25.543219 | 378 |
| GACCCCTAAACCCGCTGGGCTG | Chip strong | 30088.5 | 13.552105 | 6.4749699 | 140 |
| CCTGGCTCTGGCTTCCTGTTGT | Chip strong | 34525 | 11.373339 | 6.4300051 | 368 |
| ACCCTGGCCGACTGCCCCTT | Chip strong | 35652 | 12.982363 | 11.41268 | 11 |
| GCCTGGCCTCCTACAGTACTTT | Chip strong | 35866 | 15.014146 | 23.263319 | 157 |
| GCCCTTCGGAAAGCGTCGCCTG | Chip strong | 37481 | 13.375318 | 6.6135831 | 150 |
| TGCCTGGCCTCCTGATTCCCTC | Chip strong | 37634.5 | 13.004288 | 2.9085336 | 288 |
| CCAGACCATTTTGCCTTACC | Chip strong | 38076 | 30.955603 | 11.095823 | 55 |
| CGTAAGTCACAGCGCCTGGCCC | Chip strong | 38826 | 11.506068 | 25.787857 | 72 |
| CAGGCTCTTCCCTCTGGCCAAG | Chip strong | 25089 | 10.865691 | 11.601097 | 352 |

-continued

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| GATGAGTTTGCCTGGCCTGCAG | Chip strong | 25445.5 | 12.297516 | 17.035336 | 143 |
| GCTGTAAGTCACCTGGCCCGAT | Chip strong | 26191 | 8.8471966 | 25.053482 | 163 |
| AGAAGGGCTGGCAGGAGTT | Chip strong | 26652 | 14.563484 | 25.132761 | 16 |
| TGCCTGGCCTCTTCAGCACTTC | Chip strong | 27021 | 10.873885 | 26.68429 | 289 |
| GGTGCCCCATCGCGGGTGGCTG | Chip strong | 27077 | 14.316696 | 22.61035 | 130 |
| GCTCCTGGCCGGGCTGCTCCTG | Chip strong | 27106 | 14.495318 | 9.280777 | 161 |
| AAGTGCTCATAGTGCAGGTAGT | Chip strong | 27166.5 | 9.1624584 | 28.31859 | 4 |
| CAGGAAAAGGCGGCTCGGGGCT | Chip strong | 27684.5 | 9.7338009 | 6.1309323 | 49 |
| TCACGCGCCCTCCTGGGCCCTG | Chip strong | 28630 | 10.411592 | 10.865385 | 195 |
| GGCGTGCCCTGGCCCCGAGGCT | Chip strong | 28813 | 10.987214 | 21.873014 | 173 |
| TCCTGGGGCTTGTCGCTGGCCA | Chip strong | 28926 | 12.960393 | 7.4913173 | 216 |
| GCTTCAGAGAGGGGTGAAGCTG | Chip strong | 21900 | 17.158428 | 13.963737 | 165 |
| CTCTCCTTGGCCACCTCCATGA | Chip strong | 23276 | 12.960393 | 7.0737572 | 81 |
| GGCTGGTGGCTGGTTCTGGACC | Chip strong | 20736.5 | 31.680035 | 17.914019 | 122 |
| CACCCGCTGGTCCCTGCAGTTC | Chip strong | 20816 | 8.5344362 | 27.261486 | 42 |
| CCCTGGCTCACTTTCTGTTGTG | Chip strong | 20839 | 26.185976 | 5.4283981 | 364 |
| GGTAGTCTTTGTCCCCTGGC | Chip strong | 20872 | 12.44091 | 3.1238594 | 182 |
| CATCACCCCAGACCTCAGTGC | Chip strong | 20958.5 | 35.708847 | 4.6072259 | 355 |
| GGCTGGTTAGATTTGTGGTCTT | Chip strong | 21258 | 33.569485 | 15.757149 | 123 |
| TTGGTCCCCTTCAACCAGCTAC | Chip strong | 20228 | 9.5504265 | 23.87529 | 246 |
| TCAGGGGTTGGCTTGTTGTGTT | Chip strong | 20519.5 | 8.8405285 | 21.048086 | 206 |
| TACTGCACTCCAGCCTTGCCAA | Chip strong | 18364 | 10.029301 | 16.731598 | 258 |
| AATTGCACGGTATCCATCTGTA | Chip strong | 18407 | 8.3120737 | 26.950815 | 7 |
| TGGTTCTTCGCTGGGCGGCTGC | Chip strong | 18451 | 17.683105 | 11.562138 | 234 |
| CCCTGCCTGTCCTGGTCCCGTT | Chip strong | 18466 | 9.747386 | 21.814604 | 59 |
| TCTCCACAGCTGGCCCCCAAGA | Chip strong | 19483.5 | 23.591568 | 26.742323 | 273 |
| CCTCGCTCTCCATTCGGCCCTC | Chip strong | 9378.5 | 6.9943829 | 8.7534571 | 367 |
| GGCCGGGTGCTCTGGAGGTGCT | Chip strong | 14393 | 11.734104 | 12.172738 | 119 |
| AGCTCCTGGCTTCAAGCAATCC | Chip strong | 14107 | 10.339123 | 18.669428 | 20 |
| TTTAAATCACAACTCTGCCCCT | Chip strong | 15129 | 15.825633 | 8.2785378 | 247 |
| GTAGCTGTGTTCATTCTGGATG | Chip strong | 15186.5 | 37.683685 | 11.412519 | 187 |
| AAGTGCTAGTGAGTCTATTGTA | Chip strong | 15263 | 30.581371 | 17.914198 | 3 |
| GCCCCAGCTCACCGGCTCACTG | Chip strong | 15345 | 20.667051 | 7.4258513 | 103 |
| GTGCGGCCTGGCCTTCAAGTGG | Chip strong | 15350 | 9.6908836 | 19.487803 | 250 |
| GTTGGTTTTAGCTTGGCCCATT | Chip strong | 15833 | 22.509586 | 7.6416044 | 256 |
| TTGATGCCCCGTCCTGTACACT | Chip strong | 16077 | 20.144415 | 22.335653 | 308 |
| GCAGGGAACTGGCTGGGCTTT | Chip strong | 16084 | 7.1124773 | 22.951672 | 102 |
| ACCATCTCCTGTGCCTCCAGCT | Chip strong | 16520 | 12.522655 | 19.197701 | 320 |
| AAGTGATACGCCTGCCTCGGCC | Chip strong | 16691 | 9.2873106 | 2.0918362 | 2 |

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| GCCTGGCCAACATAGTGGGACC | Chip strong | 16749 | 8.6138811 | 20.486101 | 154 |
| TCCTGGCCATCCAGCCTGGGA | Chip strong | 16778 | 7.2028656 | 18.973217 | 214 |
| TCCTCCAGAGCTTCATCCTGCC | Chip strong | 16927 | 20.0035 | 5.2284846 | 212 |
| GCGCCTGTGCCTCCTAA | Chip strong | 17094 | 12.760594 | 23.842529 | 108 |
| CTTGATTTTGTCTCTGGCCCTG | Chip strong | 17456.5 | 9.4672995 | 8.272316 | 90 |
| CCTGTGGTCCCTGTCTGTGCCT | Chip strong | 17748 | 13.149311 | 10.342139 | 66 |
| ACTTGGAACTGGCCCCTTTCAT | Chip strong | 17782 | 14.512917 | 23.881441 | 15 |
| TTCCCTGGGACTGGCCTGCACC | Chip strong | 17948.5 | 9.3010607 | 15.061718 | 241 |
| GATTACTGGTATTTGCTGGCTCC | Chip strong | 13394 | 25.892035 | 5.407784 | 146 |
| AGGTGGCCACAAGGTGGCTGGC | Chip strong | 13621 | 20.378857 | 17.680929 | 334 |
| GGCTGCTGGTCTTTCATAGTGGG | Chip strong | 12604.5 | 21.291653 | 18.561375 | 175 |
| CCCCTGCTGTGCTTGCATGGCT | Chip strong | 12605 | 18.076384 | 11.74684 | 57 |
| TGGCTTTAGTAATAAGTTTCTC | Chip strong | 12660 | 16.773508 | 11.141039 | 226 |
| TCTCTAGTCCTGCCTCCCC | Chip strong | 12753 | 19.169752 | 7.0407801 | 275 |
| TTGTCACTGCACTCCAGTCTGG | Chip strong | 12372.5 | 9.9857264 | 24.029345 | 311 |
| GGGAAGCTGGTCACCCACAGGC | Chip strong | 12450 | 11.913556 | 20.388573 | 178 |
| CTCCTTGCTGGTCTGGTGTAAT | Chip strong | 12887 | 13.768332 | 6.9087734 | 77 |
| TGGGTCTCTGGCCACCCCAGCC | Chip strong | 12948.5 | 8.0436459 | 19.699574 | 228 |
| CGGCGAGCGGGACCTGCGCCTG | Chip strong | 13179 | 8.3394403 | 5.5586901 | 375 |
| GCTCACAGCCTCCCCCGGCCTG | Chip strong | 13198 | 7.8765292 | 3.4258959 | 160 |
| TTTGGTCCCCTTCAACCAGCTA | Chip strong | 13310 | 7.6353297 | 18.880299 | 249 |
| TTGCTAGTGTTTGGTTGATGGT | Chip strong | 13321 | 29.278065 | 21.353354 | 309 |
| TGGGTCCTGGCTGAAGATCTCT | Chip strong | 13345 | 7.4858232 | 22.909485 | 227 |
| AGCAGAGCAGTCTCCGCTCA | Chip strong | 11919 | 6.4712315 | 22.303505 | 327 |
| TCTGCCTCCAGGAGCTGGCA | Chip strong | 12022.5 | 6.4897313 | 19.629604 | 218 |
| CTCTGATGTCTGCCCCTCACCT | Chip strong | 12084 | 23.231821 | 2.7038672 | 83 |
| TGGTGGAGGCGCTGCTGGCCAG | Chip strong | 11424 | 10.211181 | 12.62489 | 233 |
| CGCCTCCTCTCTGTCCTGATTT | Chip strong | 11564 | 15.306285 | 4.1242805 | 372 |
| AGGTGCTCTGTGTATGCATAGA | Chip strong | 11593 | 19.340197 | 19.182079 | 29 |
| GGCCGTCCCTAGAGATGGGGTT | Chip strong | 11689.5 | 8.4446125 | 7.2657032 | 170 |
| CATTATTCTCAGTTCTGTGCAG | Chip strong | 11732.5 | 27.869678 | 16.957344 | 51 |
| TGGTTTCCCTTTTGGCCTCTCC | Chip strong | 10935 | 11.08107 | 6.0971227 | 303 |
| CTGGCCCCTTTCATTCTGGAAG | Chip strong | 11008.5 | 19.356289 | 14.29258 | 87 |
| ATAGCAGCGCTGGCCCTCTGCC | Chip strong | 11135.5 | 8.3489428 | 16.26886 | 339 |
| TGCAGCCTCTTGTTTCAGCCCC | Chip strong | 11243 | 17.256807 | 2.5227482 | 282 |
| GGGTCTCTGTTGGCTTCTT | Chip strong | 11264.5 | 7.8554482 | 5.5741806 | 128 |
| AGCCTCTGGTCCTTTTTTCCCT | Chip strong | 11308.5 | 17.074085 | 5.3993454 | 328 |
| AGCTGGTTTAATATGCTGTCTG | Chip strong | 11390 | 14.25641 | 8.7015753 | 21 |

-continued

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| CACTGCCTTGGCCACCTATCCT | Chip strong | 10671 | 9.1234684 | 14.108407 | 346 |
| GCCTTGGTGGTTTTGGTAGT | Chip strong | 10696 | 15.110422 | 8.3110876 | 106 |
| GTGGTAGCTCCAGGCTGTCTGA | Chip strong | 10711 | 30.533655 | 22.150589 | 253 |
| TGCTCTGATTTTTGCCCCAGCT | Chip strong | 10768.5 | 14.230415 | 7.0602937 | 292 |
| TCCTGGGCTTTGGCTTGTTGGG | Chip strong | 10813.5 | 7.7058806 | 7.1675959 | 215 |
| TCCACTGTCCCTGGCACTTTT | Chip strong | 9134 | 6.4327211 | 12.8872 | 208 |
| CGCCATGTCCAGCGTCTTCGGG | Chip strong | 8765 | 20.334946 | 20.485155 | 68 |
| CATTGCACTCCAGCCTCCCATA | Chip strong | 10435 | 16.077471 | 9.6274853 | 53 |
| AGAGTCTCCCTGTGTTGCCCTG | Chip strong | 10467 | 7.4270558 | 12.602409 | 325 |
| TCCTTCCTCTGTCAGGCAGGCC | Chip strong | 10471 | 20.063852 | 2.295146 | 270 |
| ACTGCACTGCAGCCTGGCCAAC | Chip strong | 10584 | 7.3915148 | 12.856659 | 14 |
| TTCTTCTGCCCCTTGCCTGACA | Chip strong | 10593.5 | 16.647232 | 9.2061243 | 244 |
| CCAGTACGTTGCTCAGCTCCTC | Chip strong | 10610.5 | 11.484417 | 2.7025924 | 357 |
| CGCCGCCCTCCGAGGACTCCTT | Chip strong | 10614 | 8.6334085 | 6.5864415 | 371 |
| TTGCTCAGGCTGGCGTGCAATG | Chip strong | 9724 | 11.115126 | 19.742767 | 245 |
| CCCGCGATCTCCTTGTGGCCGT | Chip strong | 9728 | 11.945862 | 6.9863696 | 58 |
| CACCTGGCTGGCAATTTATAAT | Chip strong | 9852 | 8.0965796 | 17.484594 | 43 |
| TCAGGGCTGCACTGGCTGGTCT | Chip strong | 9852 | 10.620815 | 11.96568 | 205 |
| TGGAGTTGGCTGCAGATGAGTC | Chip strong | 9954 | 13.087917 | 15.585505 | 299 |
| TGCCTAGGTCTGGCCTCCTTGG | Chip strong | 10161 | 16.315468 | 2.7759731 | 286 |
| GCCAGCCTCCATCCTCCCTTG | Chip strong | 10191 | 21.391727 | 11.342846 | 149 |
| TCCCCTCTTGGCTTGGTCCAGA | Chip strong | 10285 | 8.0190945 | 16.142628 | 269 |
| GGTGCCCTCTGGCTCTACTCCC | Chip strong | 10302.5 | 7.4917507 | 16.076124 | 184 |
| AGGGAAGGACTGCTGGGTTGGC | Chip strong | 10310 | 6.749754 | 2.3204882 | 332 |
| GCTGAACGAGCTGGCCAAGTTC | Chip strong | 9451 | 6.6551905 | 19.321331 | 112 |
| CAGCCTCTATGCCCCCGTCACC | Chip strong | 9484 | 16.652414 | 11.957335 | 350 |
| ACCCCGCTCCTTGCAGCCTCTG | Chip strong | 9609 | 6.7912097 | 4.80404 | 321 |
| CTCTTTGGTTGGTTCCTGATGC | Chip strong | 9661 | 15.128378 | 18.743273 | 85 |
| AATGGTCTCTTTGTTCCCTGCT | Chip strong | 9183 | 7.6419687 | 3.2526188 | 315 |
| AGTGTTGGCTCGGCTGGCTGCC | Chip strong | 9220.5 | 15.521686 | 7.1320724 | 337 |
| ATTTACATACCCAGCAGCCTCC | Chip strong | 9344 | 14.651403 | 5.7202735 | 344 |
| ACCTTGTGATCCACCTGCTTTG | Chip strong | 9350 | 10.149202 | 4.1434402 | 322 |
| TGCCAGTATCCTTCTGAGACCC | Chip strong | 9374.5 | 18.697142 | 19.309006 | 284 |
| ATCTCAGCTCTGCCTCCTGGGT | Chip strong | 8963 | 12.361974 | 12.799247 | 33 |
| TCCTCCCTCACCTCAGTCTGGG | Chip strong | 8976.5 | 11.361602 | 9.0995693 | 213 |
| TAGCTGAGCCGCCTGGCTGGGG | Chip strong | 9026 | 6.8317003 | 8.4015751 | 193 |
| CCTCTTTCACCGTGCCTGTCCC | Chip strong | 8800 | 16.616077 | 5.438931 | 63 |
| TCCAGGCCCTCAATCCATTTCCA | Chip strong | 8934.5 | 13.815792 | 9.5553522 | 266 |
| CAGGCTGGCTCCCTGAAGGTTC | Chip strong | 8459.5 | 6.1472831 | 17.683357 | 353 |

-continued

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| TGCTCTGTTGGCTTCTTTTGTC | Chip strong | 8407 | 17.417171 | 17.734081 | 224 |
| CACTGTCTTCCTTTGGCTCCTC | Chip strong | 8497 | 10.860129 | 11.864268 | 48 |
| AGCACGGTGGGTTTGGCTGGCA | Chip strong | 8532 | 8.91047 | 7.0811062 | 18 |
| GTCCTCACTGGCCGACACGCTGA | Chip strong | 8536 | 7.1346483 | 19.281561 | 188 |
| CCAGGCTGGAGTGCAAGCAGCA | Chip strong | 8552.5 | 11.002619 | 19.600433 | 356 |
| CGGTGCCTCCTCCAGTGTTGCT | Chip strong | 8559 | 10.886886 | 9.833169 | 71 |
| GTCAGTCATTGAATGCTGGCCT | Chip strong | 8592.5 | 23.067156 | 11.230301 | 133 |
| CCTTTTATCCCCTAATTGGCCT | Chip strong | 8596 | 19.616385 | 9.8835402 | 67 |
| TGGTAGGTTGGGCAGTTC | Chip strong | 8731.5 | 31.377066 | 20.530041 | 301 |
| GTGTTCCTGTGCTGGATGGTCA | Chip strong | 2131 | 11.864914 | 6.3784571 | 191 |
| CCTCTGCACCAACCTGTCAAGA | Chip strong | 2057.5 | 11.429537 | 3.11975 | 62 |
| GGAGGTACTGTAGCTGGCGTT | Chip strong | 1877 | 10.634505 | 9.6884193 | 167 |
| GTGCTTTGCTGGAATCGAGGAA | Chip strong | 1710 | 10.403996 | 8.5636625 | 190 |
| AGCGTGTTGGGAGGAGCTGCAG | Chip strong | 1410 | 9.0065594 | 8.8227701 | 19 |
| TAGCATGGCTCTATGGAACA | Chip strong | 1393 | 10.196934 | 8.9662762 | 260 |
| GGCCAAGTGGATGCTGGTTTAGC | Chip strong | 1351 | 6.3048329 | 7.5876508 | 117 |
| AGGACCTGTAATCCCAGCACTT | Chip | 1119.5 | 4.0140038 | 5.6218853 | 23 |
| GTCTCGGACTCCTGATCTCAGG | Chip | 1380 | 4.1414785 | 3.9894354 | 189 |
| TCGCTCAGGCAGGAGTGCAGTG | Chip | 1902 | 5.7879028 | 8.7315207 | 271 |
| TGATCTCGTGATCTACCCGCCT | Chip | 1982 | 5.9927278 | 6.810081 | 280 |
| CACCTTGTGATCCACCCGCCTT | Chip | 2139 | 5.5668392 | 4.7121377 | 44 |
| AGTTCTCTTGCTTCAGCCTCCC | Chip | 8418 | 11.501246 | 1.3339518 | 31 |
| GCAGGGAACTGGCTGGGCTTTC | Chip | 9142.5 | 5.9037857 | 16.801399 | 148 |
| GCTCCCACTGCTGTCCTGCCAT | Chip | 9433 | 17.716768 | 1.6475885 | 110 |
| CCCCTCAGTTTGCTAGTATTTT | Chip | 11735 | 24.905746 | 1.1986766 | 56 |
| CTCGCCCCTCTCAGCCCTGCAA | Chip | 14248.5 | 19.352268 | 1.4588933 | 79 |
| GCCTGTCCTCTTCCGCCTGTCT | Chip | 14508 | 12.145576 | 1.6282115 | 105 |
| GGTTCTCAGCCTGAGCCGCCCC | Chip | 18192 | 21.105703 | 1.4826102 | 186 |
| CTGGCCTATCATAAGCATTTT | Chip | 65516 | 15.111923 | 1.4583727 | 88 |
| ACAGGCGATCCACCCGCCTCAG | Chip | 2228 | 5.9650521 | 8.9491081 | 318 |
| GAACTTGTGATCCGCCCACCTT | Chip | 2483 | 4.4610376 | 7.0900927 | 93 |
| GACCTTGTGATCCACCTGTTTT | Chip | 2612 | 4.8775668 | 12.335071 | 98 |
| CTCTGAGTCCTGCACTCACCCG | Chip | 2770 | 6.7869315 | 1.284364 | 82 |
| CTGCAGCCTCCACTTTCTGGGC | Chip | 2839 | 4.7054248 | 13.918253 | 380 |
| GTGTTGTCGCTGGGTTTTGAGGG | Chip | 3030 | 4.5279474 | 3.9595523 | 254 |
| TAGGAGGATTGCTTGTGGCCAG | Chip | 3154.5 | 4.6519237 | 4.9273152 | 194 |
| CGGTGGGTGCTTCAGGCGGTGG | Chip | 3999 | 5.0099111 | 5.715847 | 376 |
| GTGACTGTGGGTTTCTGGTTCC | Chip | 4025.5 | 5.8571658 | 7.4026732 | 136 |

-continued

| GAM RNA SEQUENCE | VALIDATION METHOD | SIGNAL | BACKGROUND Z-SCORE | MISMATCH Z-SCORE | GAM RNA SEQ-ID |
|---|---|---|---|---|---|
| GCTGCTGGGCCATTTGTTGG | Chip | 4101 | 7.7621112 | 1.3319389 | 114 |
| GCAGGCTCTGGCTTATTCTGGG | Chip | 4399 | 4.4706116 | 13.904231 | 101 |
| GCGGGCGGCTTCATCTTGCCCT | Chip | 5038 | 5.1213508 | 7.6892729 | 158 |
| TCCCAGCTCCTGGGCCCCACAG | Chip | 5372.5 | 4.9255114 | 7.1915674 | 267 |
| ATCTTTTATCACTCCCACTGCT | Chip | 5396 | 5.4679914 | 11.567021 | 340 |
| GATGGGTTTGTTGGAGAGGTC | Chip | 5425.5 | 4.8749881 | 17.533426 | 144 |
| GTGACCTGGCCGCCTAAACCCA | Chip | 5941.5 | 5.6531525 | 18.527802 | 135 |
| AAGACACCAGAGACTGGCCTCA | Chip | 6306 | 5.8909965 | 5.1631103 | 314 |
| TCCTCAGCTTGGCCACGGAGTT | Chip | 6478.5 | 5.8972673 | 17.989834 | 211 |
| TGTCTCCCCACTGGTCTTCCAG | Chip | 7039 | 5.6089306 | 15.167439 | 235 |
| AAACTGCTTCCTTGGCCT | Chip | 7436 | 5.6282043 | 5.6413546 | 312 |

| ROW# | INFECTION NAME | SEQ ID NOs OF GAMS ASSOCIATED WITH INFECTION |
|---|---|---|
| 2 | Bordetella pertussis | 1, 6, 10, 11, 12, 13, 16, 18, 19, 20, 21, 22, 23, 24, 25, 26, 27, 28, 29, 33, 34, 37, 41, 42, 43, 44, 47, 48, 49, 50, 52, 53, 54, 55, 57, 58, 59, 60, 63, 65, 66, 67, 68, 69, 70, 71, 75, 76, 77, 79, 84, 86, 87, 88, 89, 91, 94, 96, 97, 99, 100, 101, 102, 103, 104, 105, 106, 107, 108, 109, 110, 111, 112, 113, 114, 115, 117, 119, 120, 121, 122, 123, 125, 126, 127, 130, 131, 132, 133, 137, 138, 139, 140, 141, 142, 145, 147, 149, 150, 151, 154, 155, 156, 157, 158, 160, 161, 162, 164, 165, 166, 167, 168, 170, 171, 172, 173, 174, 175, 176, 177, 179, 180, 181, 183, 184, 185, 188, 191, 195, 196, 197, 204, 205, 211, 212, 214, 215, 216, 219, 220, 222, 225, 228, 230, 231, 233, 237, 239, 241, 242, 243, 244, 250, 251, 253, 262, 264, 265, 266, 268, 271, 272, 274, 276, 277, 280, 281, 282, 284, 285, 287, 288, 289, 290, 293, 294, 296, 297, 299, 300, 301, 302, 304, 306, 308, 310, 312, 317, 318, 321, 322, 324, 326, 327, 329, 330, 332, 333, 334, 335, 336, 339, 340, 342, 343, 345, 348, 349, 350, 351, 352, 353, 355, 356, 357, 358, 360, 361, 362, 364, 365, 366, 367, 368, 369, 370, 371, 372, 373, 374, 375, 376, 378, 380, 381, 382, 383, 384, 385 and 49788-55666. |
| 3 | Brucella suis 1330 | 1, 6, 10, 11, 12, 13, 14, 16, 18, 19, 21, 23, 27, 32, 35, 37, 39, 40, 42, 47, 48, 49, 50, 52, 53, 58, 62, 63, 65, 68, 70, 71, 77, 79, 80, 85, 86, 89, 90, 98, 102, 105, 107, 108, 109, 111, 112, 114, 115, 119, 120, 121, 122, 123, 124, 125, 126, 132, 138, 141, 142, 143, 150, 151, 152, 154, 155, 156, 157, 158, 160, 161, 162, 164, 166, 168, 171, 172, 173, 175, 176, 177, 180, 181, 183, 185, 186, 190, 195, 198, 199, 200, 201, 205, 207, 211, 212, 214, 215, 217, 218, 219, 220, 221, 222, 225, 229, 230, 231, 233, 236, 237, 240, 241, 243, 244, 250, 251, 256, 258, 263, 264, 265, 266, 270, 277, 279, 280, 281, 282, 285, 287, 289, 290, 293, 294, 295, 297, 300, 302, 303, 306, 308, 310, 312, 315, 318, 319, 320, 321, 330, 331, 333, 334, 335, 342, 343, 347, 348, 349, 353, 354, 356, 357, 360, 361, 364, 365, 366, 368, 369, 370, 371, 373, 374, 375, 377, 381, 382, 384 and 55667-60259. |
| 4 | Chlamydia trachomatis | 2, 3, 4, 6, 7, 8, 9, 10, 13, 14, 16, 18, 19, 20, 21, 22, 25, 26, 27, 30, 31, 32, 33, 36, 37, 38, 40, 45, 46, 47, 48, 49, 51, 52, 55, 62, 63, 64, 67, 73, 74, 75, 78, 81, 82, 84, 85, 86, 87, 88, 91, 94, 95, 98, 99, 104, 105, 106, 111, 113, 116, 122, 124, 126, 128, 132, 133, 136, 138, 146, 148, 149, 152, 154, 155, 156, 157, 160, 164, 166, 167, 177, 179, 180, 181, 187, 188, 190, 192, 194, 198, 199, 200, 205, 207, 208, 209, 210, 211, 213, 214, 217, 218, 222, 224, 225, 226, 229, 232, 233, 235, 236, 239, 241, 242, 243, 244, 245, 248, 251, 252, 253, 254, 256, 257, 259, 262, 264, 265, 269, 270, 271, 272, 273, 274, 278, 279, 287, 288, 289, 293, 295, 296, 297, 298, 299, 302, 303, 305, 306, 309, 311, 312, 316, 318, 319, 320, 322, 323, 324, 325, 326, 327, 328, 330, 332, 333, 335, 338, 340, 341, 343, 344, 345, 348, 349, 350, 353, 354, 356, 363, 373, 384 and 60260-67437. |
| 5 | Chlamydophila pneumoniae AR39 | 25, 27, 33, 46, 55, 62, 73, 105, 152, 160, 166, 177, 179, 180, 190, 205, 208, 213, 214, 218, 236, 242, 244, 262, 271, 274, 298, 323, 325, 327, 345, 353, 356 and 67438-68147. |
| 6 | Chlamydophila pneumoniae CWL029 | 3, 5, 6, 8, 9, 10, 13, 17, 20, 21, 22, 23, 25, 27, 28, 31, 32, 33, 37, 39, 45, 46, 47, 48, 50, 52, 55, 62, 63, 64, 66, 67, 69, 73, 74, 82, 84, 85, 88, 89, 90, 91, 92, 95, 101, 102, 104, 105, 111, 114, 124, 125, 126, 128, 143, 146, 148, 152, 159, 160, 161, 164, 165, 166, 168, 175, 176, 177, 178, 179, 180, 181, 187, 189, 190, 192, 194, 201, 203, 205, 207, 208, 209, 212, 213, 214, 217, 218, 221, 223, 224, 227, 232, 233, 234, 236, 238, 239, 241, 242, 243, 244, 245, 247, 248, |

| ROW# | INFECTION NAME | SEQ ID NOs OF GAMS ASSOCIATED WITH INFECTION |
|---|---|---|
|  |  | 252, 257, 258, 259, 260, 262, 263, 271, 272, 274, 275, 279, 281, 282, 283, 286, 289, 295, 297, 298, 299, 302, 305, 306, 309, 311, 312, 314, 319, 323, 324, 325, 326, 327, 330, 333, 338, 340, 343, 344, 345, 346, 348, 349, 350, 352, 353, 354, 356, 363, 377, 382, 383, 384 and 68148-75439. |
| 7 | Chlamydophila pneumoniae J138 | 3, 5, 6, 8, 9, 10, 17, 20, 21, 22, 23, 25, 27, 31, 32, 33, 37, 39, 45, 46, 47, 50, 52, 55, 62, 63, 64, 66, 67, 69, 73, 74, 82, 84, 85, 88, 89, 90, 92, 95, 101, 102, 104, 105, 111, 114, 125, 126, 128, 143, 146, 148, 152, 159, 160, 161, 164, 165, 166, 168, 175, 176, 177, 178, 179, 180, 181, 187, 189, 190, 192, 194, 201, 203, 205, 207, 208, 209, 212, 213, 214, 217, 218, 221, 223, 224, 227, 232, 233, 234, 236, 238, 239, 241, 242, 243, 244, 245, 247, 248, 252, 257, 259, 260, 262, 263, 271, 272, 274, 275, 279, 281, 282, 283, 286, 289, 295, 297, 298, 299, 302, 305, 306, 309, 311, 312, 314, 319, 323, 325, 326, 327, 330, 333, 338, 340, 343, 344, 345, 346, 348, 349, 350, 352, 353, 354, 356, 363, 377, 382, 383, 384 and 75440-82241. |
| 8 | Chlamydophila pneumoniae TW-183 | 20, 21, 22, 25, 27, 31, 33, 45, 46, 50, 55, 62, 64, 73, 82, 89, 92, 104, 105, 126, 143, 146, 152, 160, 161, 166, 175, 177, 178, 179, 180, 187, 190, 201, 205, 208, 209, 212, 213, 214, 217, 218, 221, 232, 236, 239, 242, 244, 248, 257, 262, 263, 271, 272, 274, 275, 279, 282, 289, 298, 299, 302, 306, 312, 323, 325, 327, 338, 340, 345, 346, 350, 352, 353, 356, 363, 382 and 82242-85213. |
| 9 | Coxiella burnetii RSA 493 | 1, 3, 5, 6, 7, 8, 10, 13, 22, 25, 27, 33, 36, 38, 40, 42, 45, 46, 48, 51, 52, 55, 62, 67, 73, 78, 80, 81, 84, 91, 105, 111, 116, 124, 126, 132, 141, 142, 146, 147, 152, 158, 160, 164, 166, 177, 179, 180, 186, 187, 190, 205, 208, 213, 214, 218, 227, 229, 232, 234, 236, 239, 241, 242, 244, 247, 248, 249, 252, 256, 259, 262, 268, 271, 272, 274, 279, 280, 281, 282, 285, 298, 299, 300, 303, 305, 306, 307, 312, 315, 316, 320, 323, 324, 325, 326, 327, 333, 340, 344, 345, 353, 354, 356, 365, 373, 374, 376, 379, 385 and 85214-90622. |
| 10 | Escherichia coli CFT 073 | 1, 2, 4, 5, 6, 7, 8, 9, 10, 11, 12, 13, 14, 16, 17, 18, 19, 21, 22, 23, 25, 26, 27, 28, 30, 31, 33, 34, 35, 36, 37, 39, 40, 42, 43, 45, 46, 47, 48, 49, 50, 51, 52, 53, 55, 56, 57, 58, 59, 62, 63, 64, 65, 66, 67, 68, 69, 70, 71, 72, 73, 75, 76, 78, 79, 80, 81, 82, 83, 84, 85, 86, 87, 88, 89, 90, 91, 92, 93, 94, 95, 96, 97, 99, 100, 101, 102, 103, 105, 106, 107, 108, 109, 110, 111, 112, 113, 114, 115, 116, 119, 120, 121, 122, 123, 124, 125, 126, 129, 131, 132, 133, 135, 136, 137, 138, 140, 141, 142, 143, 145, 146, 147, 148, 152, 154, 155, 156, 157, 158, 160, 161, 162, 163, 164, 165, 166, 167, 168, 171, 173, 174, 175, 176, 177, 179, 180, 181, 182, 184, 185, 186, 190, 191, 192, 193, 195, 196, 197, 203, 204, 205, 206, 207, 208, 209, 210, 211, 212, 213, 214, 215, 216, 217, 218, 220, 221, 222, 223, 224, 225, 229, 230, 231, 232, 233, 234, 235, 236, 237, 238, 239, 241, 242, 243, 244, 245, 246, 247, 248, 249, 250, 251, 252, 253, 254, 255, 256, 257, 258, 260, 261, 262, 265, 266, 267, 268, 270, 271, 272, 274, 276, 277, 278, 279, 280, 281, 282, 283, 284, 285, 287, 288, 289, 290, 291, 292, 293, 294, 295, 296, 297, 299, 300, 301, 302, 303, 305, 306, 307, 308, 309, 310, 311, 312, 314, 315, 316, 317, 318, 321, 322, 323, 324, 325, 326, 327, 329, 331, 332, 333, 334, 335, 336, 337, 338, 339, 340, 343, 344, 345, 347, 348, 349, 350, 351, 352, 353, 354, 355, 356, 357, 358, 359, 360, 361, 364, 365, 367, 368, 369, 370, 372, 373, 374, 375, 376, 378, 380, 381, 382, 383, 384, 385 and 90623-103607. |
| 11 | Haemophilus influenzae Rd | 2, 3, 5, 6, 7, 8, 9, 10, 13, 15, 19, 20, 21, 22, 25, 26, 27, 30, 31, 32, 33, 34, 37, 38, 40, 41, 45, 46, 48, 49, 50, 51, 52, 53, 55, 62, 63, 64, 66, 67, 68, 73, 78, 81, 83, 84, 85, 88, 90, 91, 92, 98, 101, 105, 106, 111, 116, 117, 119, 122, 123, 124, 125, 126, 134, 138, 144, 146, 149, 151, 152, 155, 156, 160, 161, 164, 165, 166, 169, 171, 172, 174, 176, 177, 179, 180, 183, 190, 197, 198, 199, 200, 201, 203, 205, 207, 208, 211, 213, 214, 218, 221, 223, 226, 228, 229, 234, 236, 239, 240, 242, 244, 247, 248, 251, 254, 255, 256, 259, 262, 263, 264, 271, 272, 274, 277, 279, 281, 282, 283, 295, 296, 299, 302, 305, 306, 308, 311, 312, 313, 316, 317, 318, 319, 322, 323, 324, 325, 326, 327, 329, 333, 335, 338, 339, 340, 343, 344, 345, 348, 351, 353, 354, 356, 365, 368, 371, 375, 377, 379, 380, 385 and 103608-111433. |
| 12 | Leptospira interrogans serovar lai str. 56601 | 1, 3, 5, 7, 8, 10, 13, 19, 22, 25, 32, 38, 39, 41, 48, 49, 52, 67, 71, 73, 84, 85, 90, 91, 93, 95, 117, 124, 128, 164, 174, 178, 179, 187, 190, 192, 193, 203, 207, 225, 226, 227, 229, 238, 244, 247, 250, 256, 257, 258, 259, 262, 272, 279, 295, 298, 299, 303, 306, 307, 316, 324, 327, 333, 338, 340, 344, 348, 376, 379, 384 and 111434-116384. |
| 13 | Listeria monocytogenes EGD-e | 5, 6, 7, 8, 9, 10, 13, 22, 36, 40, 48, 52, 67, 84, 90, 91, 95, 114, 116, 147, 185, 214, 244, 247, 248, 253, 254, 259, 262, 272, 276, 279, 299, 306, 308, 324, 333, 340, 355, 382 and 116385-119434. |
| 14 | Mycobacterium avium subsp. paratuberculosis | 1, 3, 4, 5, 6, 7, 10, 11, 12, 13, 14, 15, 16, 17, 18, 19, 20, 21, 22, 23, 24, 25, 26, 27, 29, 31, 32, 33, 34, 37, 42, 43, 44, 45, 46, 47, 50, 51, 53, 54, 55, 58, 59, 60, 61, 62, 64, 65, 66, 67, 68, 69, 70, 71, 72, 73, 75, 76, 77, 78, 79, 84, 86, 87, 88, 89, 90, 91, 94, 96, 97, 99, 100, 101, 102, 103, 105, 107, 108, 109, 110, 111, 112, 113, 114, 115, 116, 119, 120, 121, 122, 123, 125, 127, 130, 131, 132, 133, 135, 137, 138, 139, 140, 142, 143, 144, 146, 147, 148, 149, 150, 151, 152, 154, 155, 156, 157, 158, 160, 161, 162, 164, 165, 166, 167, 168, 170, 171, 172, 173, 174, 175, 176, 177, 179, 180, 181, 183, 184, 185, 188, 189, 190, 191, 195, 196, 197, 198, 199, 200, 201, 202, 203, 204, 207, 210, 211, 214, 215, 216, 218, 219, 220, 222, 225, 226, 230, 231, 233, 234, 236, 237, 239, 241, 242, 243, 244, 245, 248, 250, 251, 252, 253, 254, 257, 262, 263, 264, 265, 266, 268, 271, 272, 274, 277, 278, 280, 281, 282, 283, 285, 287, 288, 289, 290, 291, 292, 293, 294, 295, 296, 297, 298, 299, 300, 301, 302, 303, 305, 306, 310, 312, 313, 314, 318, 320, 321, 323, 324, 325, 327, 329, 331, 332, 333, 334, 335, 336, 337, |

-continued

| ROW# | INFECTION NAME | SEQ ID NOs OF GAMS ASSOCIATED WITH INFECTION |
|---|---|---|
| | | 341, 342, 345, 346, 347, 349, 351, 352, 353, 355, 356, 357, 358, 360, 361, 362, 364, 365, 366, 367, 368, 369, 370, 371, 372, 373, 374, 375, 376, 377, 378, 380, 381, 382, 383, 384 and 119435-127918. |
| 15 | Mycobacterium bovis subsp bovis AF2122/97 | 1, 3, 4, 5, 6, 7, 11, 12, 13, 14, 15, 16, 17, 18, 19, 20, 21, 22, 23, 24, 25, 26, 27, 28, 29, 31, 32, 33, 36, 37, 39, 41, 42, 43, 45, 46, 47, 48, 50, 51, 52, 53, 54, 55, 57, 58, 59, 60, 61, 62, 64, 65, 66, 67, 68, 69, 70, 71, 73, 75, 76, 77, 78, 79, 80, 83, 84, 86, 87, 88, 89, 90, 91, 93, 96, 97, 99, 100, 101, 102, 103, 104, 105, 106, 107, 108, 109, 110, 111, 112, 113, 114, 115, 116, 117, 118, 119, 120, 121, 122, 123, 125, 127, 130, 131, 132, 133, 134, 135, 137, 138, 139, 141, 142, 143, 144, 145, 146, 147, 148, 149, 150, 151, 152, 154, 155, 156, 157, 158, 159, 160, 161, 162, 163, 165, 166, 167, 168, 170, 171, 172, 173, 174, 175, 176, 177, 178, 179, 180, 181, 183, 184, 185, 188, 189, 190, 191, 193, 194, 195, 196, 197, 198, 199, 200, 201, 202, 203, 204, 205, 206, 207, 208, 210, 211, 212, 213, 214, 215, 216, 218, 219, 220, 222, 225, 230, 231, 233, 236, 237, 239, 240, 241, 242, 243, 244, 245, 246, 250, 251, 252, 253, 254, 255, 256, 257, 261, 262, 263, 264, 265, 266, 267, 268, 270, 271, 273, 276, 277, 278, 280, 281, 282, 283, 285, 286, 287, 288, 289, 290, 291, 292, 293, 294, 296, 297, 299, 300, 302, 303, 304, 305, 306, 308, 310, 312, 313, 314, 315, 318, 320, 321, 322, 323, 324, 325, 326, 327, 329, 330, 331, 332, 333, 334, 335, 336, 337, 341, 342, 345, 346, 347, 348, 349, 350, 351, 352, 353, 355, 356, 357, 358, 360, 361, 362, 364, 365, 366, 367, 369, 370, 371, 372, 373, 374, 375, 376, 378, 380, 381, 382, 383, 384, 385 and 127919-137561. |
| 16 | Mycobacterium leprae | 3, 4, 5, 6, 7, 12, 13, 14, 15, 18, 19, 21, 22, 23, 24, 26, 29, 31, 32, 33, 36, 37, 39, 41, 42, 43, 45, 46, 47, 48, 49, 50, 53, 54, 57, 59, 62, 65, 68, 69, 70, 71, 73, 74, 75, 76, 78, 81, 83, 84, 86, 90, 94, 96, 98, 101, 103, 106, 107, 109, 110, 111, 112, 113, 114, 115, 116, 118, 119, 120, 121, 123, 131, 133, 134, 135, 137, 142, 143, 144, 145, 146, 147, 149, 154, 156, 157, 158, 159, 161, 162, 163, 165, 166, 167, 171, 172, 173, 174, 175, 176, 179, 183, 184, 185, 187, 188, 189, 190, 193, 196, 197, 198, 199, 200, 201, 202, 204, 205, 206, 211, 212, 214, 215, 216, 218, 219, 220, 221, 223, 224, 225, 228, 230, 231, 232, 233, 234, 235, 236, 237, 241, 242, 243, 245, 249, 250, 251, 253, 254, 256, 258, 261, 263, 265, 267, 268, 269, 271, 274, 276, 277, 280, 281, 284, 288, 289, 290, 291, 293, 294, 295, 296, 297, 299, 300, 301, 302, 303, 305, 306, 307, 309, 310, 311, 312, 313, 314, 315, 318, 320, 321, 323, 324, 327, 329, 330, 331, 332, 333, 334, 335, 336, 337, 338, 339, 340, 341, 343, 345, 346, 347, 348, 349, 353, 355, 356, 357, 358, 360, 361, 364, 365, 368, 369, 370, 371, 372, 374, 375, 376, 377, 378, 380, 381, 382, 383 and 137562-144598. |
| 17 | Mycobacterium tuberculosis CDC1551 | 4, 5, 6, 7, 10, 13, 17, 20, 22, 23, 24, 25, 27, 31, 32, 33, 45, 46, 51, 53, 55, 62, 67, 69, 73, 84, 88, 90, 91, 99, 100, 102, 103, 105, 107, 113, 114, 116, 120, 137, 143, 146, 148, 149, 152, 155, 156, 160, 161, 165, 166, 168, 177, 179, 180, 185, 190, 198, 199, 200, 203, 205, 207, 208, 211, 213, 214, 215, 216, 218, 219, 225, 233, 236, 239, 242, 244, 257, 262, 264, 271, 272, 274, 281, 282, 289, 291, 292, 294, 299, 303, 305, 306, 312, 313, 323, 324, 325, 327, 329, 332, 333, 337, 341, 345, 346, 352, 353, 356, 381, 383 and 144599-146806. |
| 18 | Mycobacterium tuberculosis H37Rv | 1, 3, 4, 5, 6, 7, 10, 11, 12, 13, 14, 15, 16, 17, 18, 19, 20, 21, 22, 23, 24, 25, 26, 27, 28, 29, 31, 32, 33, 37, 39, 41, 42, 43, 45, 46, 47, 48, 50, 51, 52, 53, 54, 55, 57, 58, 59, 60, 61, 62, 63, 64, 65, 66, 67, 68, 69, 70, 71, 73, 75, 76, 77, 78, 79, 80, 83, 84, 86, 87, 88, 89, 90, 91, 93, 94, 96, 97, 99, 100, 101, 102, 103, 104, 105, 107, 108, 109, 110, 111, 112, 113, 114, 115, 116, 117, 118, 119, 120, 121, 122, 123, 125, 127, 130, 131, 132, 133, 134, 135, 137, 138, 139, 141, 142, 143, 144, 145, 146, 147, 148, 149, 150, 151, 152, 153, 154, 155, 156, 157, 158, 159, 160, 161, 162, 163, 165, 166, 167, 168, 170, 171, 172, 173, 174, 175, 176, 177, 178, 179, 180, 181, 183, 184, 185, 188, 189, 190, 191, 194, 195, 196, 197, 198, 199, 200, 201, 202, 203, 204, 205, 206, 207, 208, 210, 211, 212, 213, 214, 215, 216, 218, 219, 220, 222, 225, 230, 231, 233, 234, 236, 237, 239, 240, 241, 242, 243, 244, 245, 246, 250, 251, 252, 253, 254, 255, 256, 257, 261, 262, 263, 264, 265, 266, 267, 268, 270, 271, 272, 273, 274, 276, 277, 278, 280, 281, 282, 283, 284, 285, 286, 287, 288, 289, 290, 291, 292, 293, 294, 296, 297, 298, 299, 300, 302, 303, 304, 305, 306, 308, 310, 312, 313, 314, 315, 318, 320, 321, 323, 324, 325, 326, 327, 329, 330, 331, 332, 333, 334, 335, 336, 337, 341, 342, 345, 346, 347, 348, 349, 350, 351, 352, 353, 355, 356, 357, 358, 360, 361, 362, 364, 365, 366, 367, 368, 369, 370, 371, 372, 373, 374, 375, 376, 378, 380, 381, 382, 383, 384, 385 and 146807-155497. |
| 19 | Neisseria meningitidis MC58 | 56, 142, 218, 287, 316, 327, 351, 355, 365, 381 and 155498-155833. |
| 20 | Neisseria meningitidis Z2491 | 1, 6, 7, 8, 10, 12, 15, 17, 21, 22, 26, 28, 30, 37, 39, 40, 45, 49, 52, 56, 58, 60, 62, 63, 67, 70, 76, 86, 89, 90, 91, 96, 98, 102, 103, 105, 107, 108, 109, 111, 112, 113, 114, 115, 122, 123, 124, 125, 126, 127, 133, 138, 141, 142, 143, 145, 147, 148, 149, 152, 157, 158, 164, 165, 166, 170, 171, 175, 176, 178, 181, 183, 187, 189, 197, 203, 217, 218, 219, 220, 221, 222, 225, 229, 230, 231, 237, 239, 243, 245, 247, 248, 251, 253, 254, 256, 257, 258, 259, 264, 265, 268, 273, 281, 282, 283, 285, 287, 289, 290, 293, 294, 295, 297, 300, 302, 306, 308, 314, 315, 316, 319, 321, 322, 325, 327, 329, 332, 333, 334, 338, 340, 341, 344, 346, 348, 349, 350, 351, 354, 355, 356, 365, 371, 372, 375, 376, 380, 381, 382, 384 and 155834-160603. |
| 21 | Pseudomonas aeruginosa PA01 | 1, 2, 6, 10, 11, 12, 13, 14, 16, 17, 18, 19, 20, 21, 22, 23, 24, 25, 26, 27, 28, 29, 30, 31, 33, 34, 35, 36, 37, 41, 42, 43, 45, 46, 48, 49, 50, 52, 54, 55, 56, 57, 58, 59, 60, 62, 63, 64, 65, 66, 67, 68, 69, 70, 71, 73, 76, 77, 78, 79, 81, |

| ROW# | INFECTION NAME | SEQ ID NOs OF GAMS ASSOCIATED WITH INFECTION |
|---|---|---|
| | | 82, 83, 84, 86, 87, 88, 89, 90, 91, 94, 95, 96, 97, 99, 100, 101, 102, 103, 105, 106, 107, 108, 109, 110, 111, 112, 113, 114, 115, 116, 118, 119, 120, 121, 122, 123, 124, 125, 126, 127, 130, 131, 134, 137, 138, 139, 140, 141, 142, 144, 147, 149, 150, 151, 152, 154, 155, 156, 157, 158, 160, 161, 162, 163, 164, 165, 166, 167, 168, 169, 170, 171, 172, 173, 174, 175, 176, 177, 179, 180, 181, 183, 184, 185, 188, 190, 192, 193, 194, 195, 196, 197, 202, 204, 205, 208, 210, 211, 212, 213, 214, 215, 216, 218, 220, 222, 225, 228, 229, 230, 231, 232, 233, 236, 237, 241, 242, 243, 244, 250, 251, 253, 258, 262, 264, 265, 266, 267, 268, 270, 271, 272, 273, 274, 276, 277, 280, 281, 282, 283, 285, 286, 287, 288, 289, 290, 291, 292, 293, 294, 296, 297, 298, 299, 300, 301, 302, 306, 312, 314, 318, 319, 320, 321, 323, 324, 325, 327, 329, 330, 331, 333, 334, 335, 336, 339, 340, 341, 342, 343, 345, 347, 348, 349, 350, 351, 352, 353, 355, 356, 357, 358, 360, 361, 362, 364, 365, 366, 367, 368, 369, 370, 371, 372, 373, 374, 375, 376, 378, 380, 381, 382, 383, 384 and 160604-170274. |
| 22 | *Pseudomonas putida* KT2440 | 1, 5, 7, 9, 10, 11, 12, 13, 14, 16, 18, 19, 23, 24, 25, 26, 27, 28, 29, 31, 33, 34, 36, 37, 38, 39, 41, 42, 43, 44, 45, 46, 47, 49, 50, 51, 52, 53, 54, 55, 57, 58, 59, 61, 64, 65, 66, 68, 69, 70, 71, 73, 76, 84, 85, 86, 88, 89, 91, 94, 98, 99, 101, 102, 103, 105, 106, 107, 108, 109, 110, 111, 112, 113, 114, 115, 117, 118, 119, 120, 121, 122, 123, 125, 126, 131, 132, 133, 134, 135, 137, 138, 140, 141, 142, 143, 144, 145, 146, 147, 148, 149, 150, 151, 152, 153, 154, 155, 156, 157, 158, 159, 160, 161, 162, 163, 164, 166, 167, 168, 171, 172, 173, 174, 175, 176, 177, 179, 180, 181, 183, 184, 185, 187, 190, 191, 193, 195, 196, 197, 202, 204, 205, 207, 211, 212, 214, 215, 216, 220, 221, 222, 225, 228, 229, 230, 231, 232, 233, 234, 236, 237, 240, 241, 242, 243, 244, 248, 250, 251, 253, 255, 258, 264, 265, 266, 267, 270, 271, 272, 274, 276, 277, 280, 281, 282, 283, 284, 285, 287, 288, 289, 290, 291, 292, 293, 294, 295, 296, 297, 298, 299, 300, 301, 302, 303, 304, 305, 306, 308, 310, 312, 313, 314, 316, 317, 318, 320, 321, 322, 323, 324, 327, 329, 333, 334, 335, 336, 337, 342, 343, 345, 346, 347, 348, 349, 350, 351, 352, 353, 354, 355, 356, 357, 358, 360, 361, 364, 365, 366, 367, 368, 369, 370, 371, 373, 374, 375, 376, 377, 378, 380, 381, 382, 383, 384, 385 and 170275-178543. |
| 23 | *Rickettsia prowazekii* | 2, 10, 13, 25, 27, 31, 33, 45, 46, 48, 52, 55, 62, 67, 71, 73, 75, 81, 84, 91, 95, 99, 100, 105, 113, 124, 131, 152, 154, 155, 156, 157, 160, 162, 166, 177, 179, 180, 181, 190, 192, 204, 205, 208, 213, 214, 217, 218, 222, 231, 236, 239, 242, 244, 262, 265, 270, 271, 272, 274, 278, 287, 288, 289, 293, 294, 299, 305, 306, 323, 324, 325, 327, 333, 334, 340, 345, 353, 356, 373, 381 and 178544-179914. |
| 24 | *Salmonella enterica* enterica serovar Typhi | 1, 2, 3, 4, 6, 7, 8, 9, 10, 11, 12, 13, 16, 17, 18, 19, 20, 21, 22, 23, 25, 26, 27, 28, 30, 31, 32, 33, 35, 37, 38, 39, 40, 42, 43, 45, 46, 47, 48, 49, 50, 51, 52, 55, 56, 57, 58, 59, 60, 62, 63, 64, 65, 66, 67, 68, 69, 70, 72, 73, 75, 77, 79, 80, 81, 83, 84, 86, 88, 89, 90, 91, 92, 94, 95, 98, 99, 100, 101, 102, 105, 106, 107, 108, 109, 111, 112, 113, 114, 115, 116, 119, 120, 121, 122, 123, 124, 125, 126, 127, 129, 131, 132, 133, 135, 136, 137, 138, 142, 143, 144, 145, 146, 147, 148, 150, 152, 153, 154, 155, 156, 157, 158, 160, 161, 162, 163, 164, 165, 166, 167, 171, 172, 173, 174, 175, 176, 177, 179, 180, 181, 182, 183, 185, 187, 188, 189, 190, 191, 192, 193, 194, 195, 196, 197, 198, 199, 200, 201, 202, 203, 204, 205, 206, 208, 212, 213, 214, 215, 216, 217, 218, 219, 220, 221, 222, 223, 225, 226, 229, 230, 231, 232, 233, 234, 235, 236, 237, 238, 239, 240, 241, 242, 243, 244, 245, 247, 248, 250, 251, 252, 253, 254, 255, 256, 257, 260, 261, 262, 263, 265, 266, 269, 270, 271, 272, 274, 276, 277, 278, 280, 281, 282, 283, 284, 285, 287, 288, 289, 290, 291, 292, 293, 294, 295, 296, 297, 298, 299, 300, 301, 302, 303, 304, 305, 306, 308, 311, 312, 314, 315, 318, 319, 323, 324, 325, 327, 328, 329, 330, 331, 332, 333, 334, 335, 336, 337, 339, 340, 341, 342, 343, 344, 345, 346, 347, 348, 349, 351, 352, 353, 354, 355, 356, 357, 358, 360, 361, 364, 365, 366, 367, 369, 370, 371, 373, 374, 375, 376, 378, 379, 380, 381, 382, 383, 384, 385 and 179915-190940. |
| 25 | *Salmonella enterica* enterica serovar Typhi Ty2 | 1, 2, 3, 4, 6, 7, 8, 9, 10, 11, 12, 13, 14, 16, 17, 18, 19, 20, 21, 22, 23, 25, 26, 27, 28, 30, 31, 32, 33, 35, 37, 38, 39, 40, 42, 43, 45, 46, 47, 48, 49, 50, 51, 52, 55, 56, 57, 58, 59, 60, 62, 63, 64, 65, 66, 67, 68, 69, 70, 71, 72, 73, 75, 77, 79, 80, 81, 83, 84, 85, 86, 88, 89, 90, 91, 94, 95, 98, 99, 100, 101, 102, 105, 106, 107, 108, 109, 111, 112, 113, 114, 115, 116, 119, 120, 121, 122, 123, 124, 125, 126, 127, 129, 131, 132, 133, 135, 136, 137, 138, 142, 143, 144, 145, 146, 147, 148, 150, 152, 153, 154, 155, 156, 157, 158, 160, 161, 162, 163, 164, 165, 166, 167, 171, 172, 173, 174, 175, 176, 177, 179, 180, 181, 182, 183, 185, 187, 188, 189, 190, 191, 192, 193, 194, 195, 196, 197, 198, 199, 200, 201, 202, 203, 204, 205, 206, 208, 212, 213, 214, 215, 216, 217, 218, 219, 220, 221, 222, 223, 225, 226, 229, 230, 231, 232, 233, 234, 235, 236, 237, 238, 239, 240, 241, 242, 243, 244, 245, 247, 248, 250, 251, 252, 253, 254, 255, 256, 257, 260, 261, 262, 263, 265, 266, 269, 270, 271, 272, 274, 276, 277, 278, 280, 281, 282, 283, 284, 285, 287, 288, 289, 290, 291, 292, 293, 294, 295, 296, 297, 298, 299, 300, 301, 302, 303, 304, 305, 306, 308, 311, 312, 314, 315, 318, 319, 323, 324, 325, 327, 328, 329, 330, 331, 332, 333, 334, 335, 336, 337, 338, 339, 340, 341, 342, 343, 344, 345, 346, 347, 348, 349, 351, 352, 353, 354, 355, 356, 357, 358, 360, 361, 364, 365, 366, 367, 369, 370, 371, 373, 374, 375, 376, 378, 379, 380, 381, 382, 383, 384, 385 and 190941-201927. |
| 26 | *Salmonella typhimurium* LT2 | 1, 2, 3, 5, 6, 7, 8, 9, 10, 11, 12, 13, 14, 16, 17, 18, 19, 20, 21, 22, 23, 24, 25, 26, 27, 28, 29, 30, 31, 32, 33, 36, 37, 38, 39, 42, 43, 45, 46, 47, 48, 49, 50, 51, 52, 54, 55, 56, 57, 58, 59, 60, 62, 63, 64, 65, 66, 67, 68, 69, 70, 71, |

-continued

| ROW# | INFECTION NAME | SEQ ID NOs OF GAMS ASSOCIATED WITH INFECTION |
|---|---|---|
| | | 72, 73, 75, 77, 79, 82, 83, 84, 86, 88, 89, 90, 91, 94, 95, 96, 100, 101, 102, 103, 104, 105, 107, 108, 109, 111, 112, 113, 114, 115, 116, 119, 120, 121, 122, 123, 124, 125, 126, 127, 129, 131, 132, 133, 135, 137, 138, 142, 143, 144, 145, 146, 147, 148, 149, 150, 151, 152, 154, 155, 156, 157, 158, 160, 161, 162, 163, 164, 165, 166, 167, 168, 170, 171, 172, 173, 174, 175, 176, 177, 179, 180, 181, 182, 183, 185, 187, 188, 189, 190, 192, 193, 194, 195, 196, 197, 198, 199, 200, 201, 202, 203, 204, 205, 206, 207, 208, 211, 212, 213, 214, 215, 216, 217, 218, 219, 220, 221, 222, 225, 226, 227, 228, 229, 230, 231, 232, 233, 234, 235, 236, 237, 238, 239, 240, 241, 242, 243, 244, 245, 247, 248, 249, 250, 251, 252, 253, 255, 256, 257, 258, 260, 261, 262, 263, 266, 267, 268, 270, 271, 272, 273, 274, 275, 276, 279, 280, 281, 282, 283, 285, 287, 288, 289, 290, 291, 292, 293, 294, 296, 297, 298, 299, 300, 302, 303, 306, 307, 308, 309, 310, 311, 312, 314, 315, 317, 318, 319, 323, 324, 325, 326, 327, 328, 329, 330, 331, 332, 333, 334, 335, 336, 337, 338, 340, 341, 342, 343, 344, 345, 347, 348, 349, 350, 351, 352, 353, 354, 355, 356, 357, 358, 359, 360, 361, 362, 363, 364, 365, 366, 368, 369, 370, 371, 373, 374, 375, 376, 379, 380, 381, 382, 383, 384, 385 and 201928-215605. |
| 27 | *Shigella flexneri* 2a str. 2457T | 1, 2, 5, 6, 9, 10, 11, 12, 13, 14, 16, 17, 18, 19, 21, 22, 23, 24, 25, 26, 27, 28, 29, 30, 32, 33, 35, 36, 37, 38, 39, 40, 41, 42, 43, 46, 47, 48, 49, 50, 51, 52, 54, 55, 56, 57, 58, 59, 62, 63, 65, 66, 67, 68, 69, 70, 71, 73, 76, 78, 80, 83, 84, 85, 86, 87, 88, 89, 90, 91, 93, 94, 95, 97, 99, 101, 102, 103, 104, 105, 107, 108, 109, 110, 111, 112, 113, 114, 115, 116, 117, 119, 120, 121, 122, 123, 124, 125, 126, 129, 131, 132, 133, 134, 135, 136, 137, 138, 139, 141, 142, 143, 145, 146, 147, 148, 149, 150, 151, 152, 154, 155, 156, 157, 158, 160, 161, 162, 163, 164, 165, 166, 167, 171, 172, 173, 174, 175, 176, 177, 179, 180, 181, 182, 184, 185, 187, 190, 191, 195, 196, 197, 198, 199, 200, 201, 202, 203, 204, 205, 207, 208, 212, 213, 214, 216, 218, 220, 221, 222, 223, 224, 225, 229, 230, 231, 232, 233, 234, 236, 237, 238, 239, 240, 241, 242, 243, 244, 245, 247, 248, 250, 251, 252, 253, 254, 255, 256, 257, 260, 261, 262, 263, 265, 268, 270, 271, 272, 274, 276, 277, 278, 279, 280, 281, 282, 283, 284, 285, 287, 288, 289, 290, 291, 292, 293, 295, 296, 297, 298, 299, 300, 301, 302, 304, 306, 307, 308, 309, 310, 311, 312, 314, 315, 316, 317, 318, 320, 321, 322, 323, 324, 325, 327, 328, 329, 331, 332, 333, 334, 335, 336, 337, 338, 339, 340, 341, 343, 344, 345, 346, 347, 348, 349, 350, 351, 352, 353, 354, 356, 357, 358, 359, 360, 361, 362, 364, 365, 366, 367, 368, 369, 371, 373, 374, 375, 376, 379, 380, 381, 382, 383, 384, 385 and 215606-226197. |
| 28 | *Shigella flexneri* 2a str. 301 | 1, 2, 5, 6, 9, 10, 11, 12, 13, 14, 16, 17, 18, 19, 21, 22, 23, 24, 25, 26, 27, 28, 29, 30, 32, 33, 35, 36, 37, 39, 40, 41, 42, 43, 46, 47, 48, 49, 50, 51, 52, 54, 55, 56, 57, 58, 59, 62, 63, 64, 65, 66, 67, 68, 69, 70, 71, 73, 76, 77, 78, 80, 83, 84, 85, 86, 87, 88, 89, 90, 91, 92, 93, 94, 95, 97, 99, 101, 102, 103, 104, 105, 107, 108, 109, 110, 111, 112, 113, 114, 115, 116, 119, 120, 121, 122, 123, 124, 125, 126, 129, 132, 133, 134, 135, 136, 137, 138, 141, 142, 143, 144, 145, 146, 147, 148, 149, 150, 151, 152, 154, 155, 156, 157, 158, 159, 160, 161, 162, 163, 164, 165, 166, 167, 168, 171, 172, 173, 174, 175, 176, 177, 179, 180, 181, 182, 184, 185, 187, 190, 191, 195, 196, 197, 198, 199, 200, 201, 202, 203, 205, 207, 208, 210, 212, 213, 214, 216, 217, 218, 220, 221, 222, 223, 224, 225, 229, 230, 231, 232, 233, 234, 236, 237, 238, 239, 240, 241, 242, 243, 244, 245, 247, 248, 250, 251, 252, 253, 254, 255, 256, 257, 260, 262, 263, 264, 265, 266, 268, 269, 270, 271, 272, 274, 276, 277, 278, 279, 280, 281, 282, 283, 284, 285, 287, 288, 289, 290, 291, 292, 293, 295, 296, 297, 298, 299, 300, 301, 302, 304, 306, 308, 309, 311, 312, 314, 315, 316, 317, 318, 320, 321, 323, 324, 325, 327, 328, 329, 331, 333, 334, 335, 336, 337, 338, 339, 340, 341, 343, 344, 345, 346, 347, 348, 349, 350, 351, 352, 353, 354, 356, 357, 358, 359, 360, 361, 362, 364, 365, 366, 367, 368, 369, 371, 373, 374, 375, 376, 378, 379, 380, 381, 382, 383, 384, 385 and 226198-237003. |
| 29 | *Staphylococcus aureus* subsp. *aureus* Mu50 | 2, 5, 7, 8, 9, 10, 13, 16, 19, 22, 25, 27, 31, 32, 33, 35, 36, 38, 39, 40, 41, 45, 46, 47, 48, 50, 51, 52, 55, 62, 63, 67, 71, 73, 81, 83, 84, 85, 90, 91, 92, 93, 95, 98, 100, 101, 105, 106, 111, 113, 116, 119, 120, 124, 131, 133, 138, 139, 146, 147, 149, 152, 153, 156, 160, 161, 162, 165, 166, 169, 171, 172, 174, 177, 179, 180, 181, 190, 192, 203, 204, 205, 207, 208, 213, 214, 217, 218, 222, 228, 231, 232, 236, 238, 240, 242, 244, 245, 247, 248, 252, 254, 256, 259, 261, 262, 270, 271, 272, 274, 275, 287, 293, 294, 299, 301, 302, 305, 306, 308, 309, 311, 316, 317, 323, 324, 325, 326, 327, 332, 333, 334, 335, 337, 339, 340, 342, 343, 344, 345, 346, 348, 349, 351, 353, 354, 356, 363, 365, 368, 371, 375, 379, 381 and 237004-244310. |
| 30 | *Staphylococcus aureus* subsp. *aureus* MW2 | 2, 5, 7, 8, 10, 13, 16, 19, 22, 25, 27, 30, 31, 32, 33, 38, 39, 40, 41, 45, 46, 47, 48, 50, 51, 52, 55, 62, 63, 67, 71, 72, 73, 78, 81, 83, 84, 90, 91, 92, 93, 95, 98, 100, 101, 105, 106, 109, 111, 113, 117, 119, 120, 124, 126, 128, 130, 131, 133, 134, 138, 139, 143, 149, 152, 153, 156, 160, 161, 162, 166, 169, 171, 172, 174, 177, 179, 180, 181, 182, 190, 192, 203, 204, 205, 207, 208, 213, 214, 217, 218, 222, 228, 231, 232, 236, 238, 242, 244, 247, 248, 252, 254, 256, 257, 259, 261, 262, 271, 272, 274, 279, 287, 293, 294, 295, 299, 301, 302, 306, 307, 308, 309, 315, 316, 323, 324, 325, 326, 327, 332, 333, 334, 335, 337, 338, 339, 342, 343, 344, 345, 346, 348, 350, 351, 353, 356, 363, 365, 368, 371, 375, 379, 381 and 244311-250683. |
| 31 | *Staphylococcus aureus* subsp. *aureus* N315 | 2, 5, 7, 8, 9, 10, 13, 16, 19, 22, 25, 27, 31, 32, 33, 35, 36, 38, 39, 40, 41, 45, 46, 47, 48, 50, 51, 52, 55, 62, 63, 67, 71, 73, 81, 83, 84, 85, 90, 91, 92, 93, 95, 98, 100, 101, 105, 106, 111, 113, 117, 119, 120, 124, 131, 133, 134, 138, 139, 143, 146, 147, 149, 152, 153, 156, 160, 161, 162, 166, 169, 171, 172, |

-continued

| ROW# | INFECTION NAME | SEQ ID NOs OF GAMS ASSOCIATED WITH INFECTION |
|---|---|---|
|  |  | 174, 177, 179, 180, 181, 190, 192, 203, 204, 205, 207, 208, 213, 214, 217, 218, 222, 226, 228, 231, 232, 236, 238, 240, 242, 244, 245, 247, 248, 252, 254, 256, 259, 260, 261, 262, 270, 271, 272, 274, 275, 279, 287, 293, 294, 299, 301, 302, 305, 306, 307, 308, 309, 311, 316, 317, 323, 324, 325, 326, 327, 332, 333, 334, 335, 337, 339, 340, 342, 343, 344, 345, 346, 348, 349, 351, 353, 354, 356, 363, 365, 368, 371, 375, 379, 381 and 250684-257140. |
| 32 | *Streptococcus pneumoniae* R6 | 2, 3, 5, 6, 10, 13, 14, 17, 20, 21, 22, 23, 25, 26, 27, 30, 31, 32, 33, 35, 36, 37, 38, 39, 40, 41, 46, 47, 48, 49, 50, 52, 55, 56, 62, 63, 67, 73, 77, 81, 83, 84, 85, 87, 90, 91, 92, 94, 95, 100, 101, 102, 105, 106, 111, 112, 114, 115, 116, 117, 119, 123, 124, 126, 133, 136, 138, 143, 145, 146, 147, 149, 152, 156, 160, 161, 164, 166, 168, 169, 171, 172, 174, 175, 176, 177, 179, 180, 190, 192, 203, 204, 205, 208, 209, 213, 214, 217, 218, 223, 226, 228, 229, 232, 233, 235, 236, 238, 239, 242, 244, 245, 246, 247, 248, 249, 252, 255, 256, 257, 258, 259, 260, 261, 262, 264, 268, 271, 272, 274, 279, 282, 283, 284, 287, 295, 296, 297, 298, 299, 300, 302, 303, 305, 306, 307, 309, 311, 312, 314, 315, 316, 320, 321, 323, 324, 325, 326, 327, 329, 333, 335, 338, 340, 341, 344, 345, 348, 350, 351, 352, 353, 356, 357, 359, 365, 368, 371, 372, 373, 375, 377, 379, 380, 382, 384, 385 and 257141-265301. |
| 33 | *Streptococcus pneumoniae* TIGR4 | 2, 10, 13, 25, 27, 33, 46, 48, 50, 52, 55, 62, 63, 67, 73, 81, 84, 91, 101, 105, 106, 111, 119, 149, 152, 160, 161, 164, 166, 168, 169, 171, 172, 175, 176, 177, 179, 180, 190, 205, 208, 213, 214, 218, 228, 236, 242, 244, 246, 262, 268, 271, 272, 274, 297, 299, 306, 321, 323, 324, 325, 327, 329, 333, 340, 345, 348, 351, 353, 356, 359, 365, 368, 371, 372, 375, 380 and 265302-266788. |
| 34 | *Streptococcus pyogenes* M1 GAS | 3, 5, 8, 10, 21, 22, 25, 27, 32, 37, 38, 39, 40, 43, 49, 90, 95, 96, 106, 116, 126, 129, 138, 163, 164, 168, 175, 176, 180, 226, 232, 244, 246, 259, 261, 262, 268, 283, 295, 296, 297, 299, 306, 309, 316, 321, 329, 330, 333, 348, 349, 359, 372, 379, 380 and 266789-269521. |
| 35 | *Streptococcus pyogenes* MGAS315 | 3, 8, 10, 13, 20, 22, 25, 27, 31, 32, 33, 37, 38, 40, 46, 48, 52, 55, 62, 67, 73, 84, 90, 91, 105, 106, 113, 116, 129, 138, 152, 160, 164, 166, 168, 175, 176, 177, 179, 180, 186, 190, 192, 205, 208, 211, 213, 214, 218, 226, 229, 232, 236, 242, 244, 246, 262, 268, 271, 272, 274, 282, 283, 295, 296, 297, 299, 306, 309, 312, 321, 323, 324, 325, 327, 329, 333, 340, 345, 348, 349, 353, 356, 359, 372, 379, 380, 381 and 269522-272357. |
| 36 | *Streptococcus pyogenes* MGAS8232 | 3, 4, 8, 10, 13, 21, 22, 25, 27, 31, 33, 37, 38, 39, 40, 46, 48, 52, 55, 62, 67, 73, 84, 90, 91, 95, 105, 106, 113, 116, 129, 138, 152, 160, 163, 164, 166, 168, 175, 176, 177, 179, 180, 190, 205, 208, 213, 214, 218, 226, 232, 236, 242, 244, 246, 247, 259, 260, 261, 262, 268, 271, 272, 274, 295, 296, 297, 299, 306, 307, 309, 316, 321, 323, 324, 325, 327, 329, 330, 333, 337, 340, 344, 345, 348, 349, 353, 356, 359, 363, 372, 379, 380, 381 and 272358-275553. |
| 37 | *Streptococcus pyogenes* SSI-1 | 10, 13, 25, 27, 31, 33, 46, 48, 52, 55, 62, 67, 73, 84, 91, 105, 113, 152, 160, 164, 166, 168, 175, 176, 177, 179, 180, 190, 205, 208, 213, 214, 218, 236, 242, 244, 246, 262, 268, 271, 272, 274, 297, 299, 306, 321, 323, 324, 325, 327, 329, 333, 340, 345, 348, 353, 356, 359, 372, 380, 381 and 275554-276703. |
| 38 | *Treponema pallidum* subsp. *pallidum* str. Nichols | 3, 10, 13, 48, 52, 57, 59, 67, 81, 84, 86, 90, 91, 121, 131, 134, 174, 175, 176, 184, 218, 228, 231, 235, 236, 243, 261, 262, 269, 272, 289, 291, 295, 299, 306, 312, 324, 329, 332, 333, 340, 345, 356, 358 and 276704-277654. |
| 39 | *Yersinia pestis* | 1, 2, 3, 4, 5, 6, 7, 8, 9, 10, 12, 13, 16, 18, 19, 21, 22, 25, 26, 27, 28, 29, 30, 31, 32, 33, 34, 36, 37, 39, 40, 41, 42, 43, 45, 46, 47, 48, 51, 52, 53, 54, 55, 57, 58, 61, 62, 63, 67, 68, 70, 71, 73, 75, 76, 78, 82, 84, 85, 87, 88, 89, 90, 91, 93, 94, 95, 98, 99, 101, 102, 103, 105, 106, 107, 108, 111, 112, 113, 114, 115, 116, 117, 120, 121, 122, 123, 124, 125, 126, 129, 130, 131, 132, 133, 134, 135, 136, 138, 140, 141, 142, 143, 146, 148, 149, 151, 152, 153, 154, 155, 156, 160, 164, 165, 166, 167, 169, 171, 172, 174, 175, 176, 177, 178, 179, 180, 182, 184, 186, 187, 188, 190, 191, 192, 193, 196, 197, 198, 199, 200, 201, 202, 203, 205, 206, 208, 209, 211, 213, 214, 215, 217, 218, 219, 220, 221, 222, 224, 225, 226, 227, 229, 230, 232, 233, 234, 236, 237, 238, 239, 240, 241, 242, 243, 244, 245, 250, 251, 252, 253, 255, 256, 257, 258, 259, 260, 262, 263, 264, 270, 271, 272, 274, 276, 279, 280, 281, 282, 283, 286, 287, 289, 291, 292, 293, 295, 296, 298, 299, 300, 301, 302, 304, 306, 307, 308, 309, 311, 314, 315, 317, 319, 321, 322, 323, 324, 325, 326, 327, 329, 330, 331, 333, 334, 335, 336, 337, 340, 341, 342, 343, 344, 345, 346, 348, 349, 350, 351, 352, 353, 354, 355, 356, 357, 358, 359, 363, 364, 365, 367, 368, 370, 372, 373, 374, 376, 377, 378, 379, 380, 381, 382, 383, 384 and 277655-287825. |
| 40 | *Yersinia pestis* KIM | 1, 2, 3, 4, 5, 6, 7, 8, 9, 10, 12, 13, 16, 18, 19, 20, 21, 22, 25, 26, 27, 28, 29, 31, 32, 33, 34, 36, 37, 39, 40, 41, 42, 43, 45, 46, 47, 48, 51, 52, 53, 54, 55, 57, 58, 61, 62, 63, 65, 67, 68, 70, 71, 72, 73, 75, 76, 78, 84, 85, 87, 88, 89, 90, 91, 93, 94, 95, 97, 99, 101, 102, 103, 105, 106, 107, 108, 111, 112, 113, 114, 115, 117, 118, 120, 121, 122, 123, 124, 125, 126, 129, 130, 131, 132, 133, 134, 135, 136, 138, 140, 142, 143, 146, 147, 148, 149, 151, 152, 153, 154, 156, 158, 160, 164, 165, 166, 169, 171, 172, 174, 175, 176, 177, 178, 179, 180, 182, 186, 187, 188, 190, 191, 192, 193, 196, 197, 198, 199, 200, 201, 202, 203, 205, 206, 207, 208, 209, 211, 213, 214, 215, 217, 218, 220, 221, 222, 224, 225, 226, 227, 229, 230, 232, 233, 234, 235, 236, 237, 238, 239, 240, 241, 242, 243, 244, 247, 248, 250, 251, 252, 253, 255, 256, 257, 258, 260, 262, 263, 264, 270, 271, 272, 274, 276, 279, 281, 282, 283, 284, 286, 287, 288, 289, 291, 292, 293, 294, 295, 296, 298, 299, 300, 302, 303, 305, 306, 307, 308, 309, 311, 314, 315, |

| ROW# | INFECTION NAME | SEQ ID NOs OF GAMS ASSOCIATED WITH INFECTION |
|---|---|---|
| | | 317, 318, 319, 321, 322, 323, 324, 325, 327, 329, 330, 331, 333, 334, 335, 336, 337, 340, 341, 342, 343, 344, 345, 346, 348, 349, 350, 351, 352, 353, 354, 355, 356, 357, 358, 359, 362, 363, 364, 365, 367, 368, 370, 373, 374, 375, 376, 377, 378, 379, 380, 381, 382, 383, 384, 385 and 287826-298021. |

SEQUENCE LISTING (4254815 sequences)

SEQ ID NO: 1 - RNA, 22 nt, Human
aaggccgccccuucaugcuccu

SEQ ID NO: 2 - RNA, 22 nt, Human
aagugauacgccugccucggcc

SEQ ID NO: 3 - RNA, 22 nt, Human
aagugcuagugagucuauugua

SEQ ID NO: 4 - RNA, 22 nt, Human
aagugcucauagugcagguagu

SEQ ID NO: 5 - RNA, 22 nt, Human
aaucacuugaacccaagaagug

SEQ ID NO: 6 - RNA, 22 nt, Human
aaucgcuugaacccaggaagug

SEQ ID NO: 7 - RNA, 22 nt, Human
aauugcacgguauccaucugua

SEQ ID NO: 8 - RNA, 24 nt, Human
aauugcuugaacccaggaagugga

SEQ ID NO: 9 - RNA, 22 nt, Human
acaaagcgcuucucuuuagagu

SEQ ID NO: 10 - RNA, 22 nt, Human
acaaagugccuccuuuuagagu

SEQ ID NO: 11 - RNA, 20 nt, Human
acccuggccgacugccccuu

SEQ ID NO: 12 - RNA, 22 nt, Human
acgcgcuggggcgcuggccaau

SEQ ID NO: 13 - RNA, 22 nt, Human
acugcacuccagccugggcuac

SEQ ID NO: 14 - RNA, 22 nt, Human
acugcacugcagccuggccaac

SEQ ID NO: 15 - RNA, 22 nt, Human
acuuggaacuggccccuuucau

SEQ ID NO: 16 - RNA, 19 nt, Human
agaagggcuggcaggaguu

SEQ ID NO: 17 - RNA, 22 nt, Human
agauuucccuuccugcuugccu

SEQ ID NO: 18 - RNA, 22 nt, Human
agcacgguggguuuggcuggca

SEQ ID NO: 19 - RNA, 22 nt, Human
agcguguugggaggagcugcag

SEQ ID NO: 20 - RNA, 22 nt, Human
agcuccuggcuucaagcaaucc

SEQ ID NO: 21 - RNA, 22 nt, Human
agcugguuuaauaugcugucug

SEQ ID NO: 22 - RNA, 22 nt, Human
aggaaaaaaauuaaugugaguc

SEQ ID NO: 23 - RNA, 22 nt, Human
aggaccuguaaucccagcacuu

SEQ ID NO: 24 - RNA, 22 nt, Human
aggaccuguccccuggcccacu

SEQ ID NO: 25 - RNA, 21 nt, Human
aggccaagaaggaagcagagg

SEQ ID NO: 26 - RNA, 22 nt, Human
aggcugguuagauuuguggucu

SEQ ID NO: 27 - RNA, 22 nt, Human
agggcaggagguccgucccuuc

SEQ ID NO: 28 - RNA, 22 nt, Human
aggguugugugcuggccgcugg

SEQ ID NO: 29 - RNA, 22 nt, Human
aggugcucuguguaugcauaga

SEQ ID NO: 30 - RNA, 19 nt, Human
agucauuaucuccuggacc

SEQ ID NO: 31 - RNA, 22 nt, Human
aguucucuugcuucagccuccc

SEQ ID NO: 32 - RNA, 22 nt, Human
aucacuuugaguccaggaguuu

SEQ ID NO: 33 - RNA, 22 nt, Human
aucucagcucugccuccugggu

SEQ ID NO: 34 - RNA, 22 nt, Human
augggccuccuauuauccccau

SEQ ID NO: 35 - RNA, 22 nt, Human
augguacuccagccugggugac

SEQ ID NO: 36 - RNA, 22 nt, Human
augguagcuguccacaucagga

SEQ ID NO: 37 - RNA, 22 nt, Human
auggugcuggugggaguguauu

SEQ ID NO: 38 - RNA, 22 nt, Human
auuaggagagugggugcuaagu

SEQ ID NO: 39 - RNA, 22 nt, Human
auugcacuccagccugagcaaa

SEQ ID NO: 40 - RNA, 22 nt, Human
auuguugcccauguuuuuauuu

SEQ ID NO: 41 - RNA, 22 nt, Human
caacucacugcggccucaaccu

SEQ ID NO: 42 - RNA, 22 nt, Human
cacccgcuggucccugcaguuc

SEQ ID NO: 43 - RNA, 22 nt, Human
caccuggcuggcaauuuauaau

SEQ ID NO: 44 - RNA, 22 nt, Human
caccuugugauccacccgccuu

SEQ ID NO: 45 - RNA, 22 nt, Human
cacugcaaccuccaccuccugg

SEQ ID NO: 46 - RNA, 22 nt, Human
cacugcacuccagcccgagcaa

SEQ ID NO: 47 - RNA, 22 nt, Human
cacugcagccuccaucucuggg

SEQ ID NO: 48 - RNA, 22 nt, Human
cacugucuuccuuuggcuccuc

SEQ ID NO: 49 - RNA, 22 nt, Human
caggaaaaggcggcucggggcu

SEQ ID NO: 50 - RNA, 22 nt, Human
caugcuggcccacacccgcugc

SEQ ID NO: 51 - RNA, 22 nt, Human
cauuauucucaguucugugcag

SEQ ID NO: 52 - RNA, 22 nt, Human
cauucugugagcugcuggcuuu

SEQ ID NO: 53 - RNA, 22 nt, Human
cauugcacuccagccucccaua

SEQ ID NO: 54 - RNA, 22 nt, Human
ccacugagguagcuggugacug

SEQ ID NO: 55 - RNA, 20 nt, Human
ccagaccauuuugccuuacc

SEQ ID NO: 56 - RNA, 22 nt, Human
ccccucaguuugcuaguauuuu

SEQ ID NO: 57 - RNA, 22 nt, Human
ccccugcugugcuugcauggcu

SEQ ID NO: 58 - RNA, 22 nt, Human
cccgcgaucuccuuguggccgu

SEQ ID NO: 59 - RNA, 22 nt, Human
cccugccuguccuggucccguu

SEQ ID NO: 60 - RNA, 22 nt, Human
ccguccccggugcugccugcgc

SEQ ID NO: 61 - RNA, 22 nt, Human
ccucacucagguuuggacccug

SEQ ID NO: 62 - RNA, 22 nt, Human
ccucugcaccaaccugucaaga

SEQ ID NO: 63 - RNA, 22 nt, Human
ccucuuucaccgugccuguccc

SEQ ID NO: 64 - RNA, 22 nt, Human
ccugcucucuguucuuaagcuu

SEQ ID NO: 65 - RNA, 19 nt, Human
ccuggccgcugugcccccu

SEQ ID NO: 66 - RNA, 22 nt, Human
ccuguggucccugucugugccu

SEQ ID NO: 67 - RNA, 22 nt, Human
ccuuuuauccccuaauuggccu

SEQ ID NO: 68 - RNA, 22 nt, Human
cgccauguccagcgucuucggg

SEQ ID NO: 69 - RNA, 22 nt, Human
cgcccaggcuggagugccagug

SEQ ID NO: 70 - RNA, 22 nt, Human
cgcccgcuggcccugcgaucuc

SEQ ID NO: 71 - RNA, 22 nt, Human
cggugccuccuccaguguugcu

SEQ ID NO: 72 - RNA, 22 nt, Human
cguaagucacagcgccuggccc

SEQ ID NO: 73 - RNA, 22 nt, Human
cguucacucccuugccccucgg

SEQ ID NO: 74 - RNA, 22 nt, Human
cuagacugaagcuccuugagga

SEQ ID NO: 75 - RNA, 22 nt, Human
cucaggugauccaccccucuug

SEQ ID NO: 76 - RNA, 22 nt, Human
cucagugcaaccuccgccuacu

SEQ ID NO: 77 - RNA, 22 nt, Human
cuccuugcuggucugguguaau

SEQ ID NO: 78 - RNA, 23 nt, Human
cucgacuucccuggcuugcguga

SEQ ID NO: 79 - RNA, 22 nt, Human
cucgccccucucagcccugcaa

SEQ ID NO: 80 - RNA, 22 nt, Human
cucguauguaugugugcagcua

SEQ ID NO: 81 - RNA, 22 nt, Human
cucuccuuggccaccuccauga

SEQ ID NO: 82 - RNA, 22 nt, Human
cucugaguccugcacucacccg

SEQ ID NO: 83 - RNA, 22 nt, Human
cucugaugucugccccucaccu

SEQ ID NO: 84 - RNA, 22 nt, Human
cucugugauaugguuuguaaua

SEQ ID NO: 85 - RNA, 22 nt, Human
cucuuugguugguuccugaugc

SEQ ID NO: 86 - RNA, 20 nt, Human
cugcucugguuuccucuguc

SEQ ID NO: 87 - RNA, 22 nt, Human
cuggccccuuucauucuggaag

SEQ ID NO: 88 - RNA, 21 nt, Human
cuggccuaucauaagcauuuu

SEQ ID NO: 89 - RNA, 22 nt, Human
cuuccugccucucgccgcccgc

SEQ ID NO: 90 - RNA, 22 nt, Human
cuugauuuugucucuggcccug

SEQ ID NO: 91 - RNA, 22 nt, Human
cuugccugcccugugucauaaa

SEQ ID NO: 92 - RNA, 22 nt, Human
cuuggaguaggucauugggugg

SEQ ID NO: 93 - RNA, 22 nt, Human
gaacuugugauccgcccaccuu

SEQ ID NO: 94 - RNA, 22 nt, Human
gaagggggaagagagcuggccg

SEQ ID NO: 95 - RNA, 22 nt, Human
gaaguuugaagccuguuguuca

SEQ ID NO: 96 - RNA, 22 nt, Human
gacccauccuccacuuggcagc

SEQ ID NO: 97 - RNA, 22 nt, Human
gaccucgugauccgccugcuuu

SEQ ID NO: 98 - RNA, 22 nt, Human
gaccuugugauccaccuguuuu

SEQ ID NO: 99 - RNA, 17 nt, Human
gcacugcugccuccugg

SEQ ID NO: 100 - RNA, 23 nt, Human
gcagcuccuggaggugagaggcg

SEQ ID NO: 101 - RNA, 22 nt, Human
gcaggcucuggcuuauucuggg

SEQ ID NO: 102 - RNA, 21 nt, Human
gcagggaacuggcugggcuuu

SEQ ID NO: 103 - RNA, 22 nt, Human
gccccagcucaccggcucacug

SEQ ID NO: 104 - RNA, 22 nt, Human
gccuccaggucggucuuucucu

SEQ ID NO: 105 - RNA, 22 nt, Human
gccuguccucuuccgccugucu

SEQ ID NO: 106 - RNA, 20 nt, Human
gccuuggugguuuugguagu

SEQ ID NO: 107 - RNA, 22 nt, Human
gcgccgccauccgcauccucgu

SEQ ID NO: 108 - RNA, 17 nt, Human
gcgccugugccuccuaa

SEQ ID NO: 109 - RNA, 22 nt, Human
gcggcggcgguagcaaaaauga

SEQ ID NO: 110 - RNA, 22 nt, Human
gcucccacugcuguccugccau

SEQ ID NO: 111 - RNA, 22 nt, Human
gcucgcuggggucugcaggcgg

SEQ ID NO: 112 - RNA, 22 nt, Human
gcugaacgagcuggccaaguuc

SEQ ID NO: 113 - RNA, 22 nt, Human
gcugcacuucagccuggguguc

SEQ ID NO: 114 - RNA, 20 nt, Human
gcugcugggccauuuguugg

SEQ ID NO: 115 - RNA, 22 nt, Human
gcuggcuccaccugcugccagg

SEQ ID NO: 116 - RNA, 21 nt, Human
ggaauggugguuguaugguug

SEQ ID NO: 117 - RNA, 23 nt, Human
ggccaaguggaugcugguuuagc

SEQ ID NO: 118 - RNA, 22 nt, Human
ggcccagugcaagcucuuucug

SEQ ID NO: 119 - RNA, 22 nt, Human
ggccgggugcucuggaggugcu

SEQ ID NO: 120 - RNA, 22 nt, Human
ggccguggucgcugacucucgu

SEQ ID NO: 121 - RNA, 23 nt, Human
ggcuggccccauccaggcuggca

SEQ ID NO: 122 - RNA, 22 nt, Human
ggcugguggcugguucuggacc

SEQ ID NO: 123 - RNA, 22 nt, Human
ggcugguuagauuuguggucuu

SEQ ID NO: 124 - RNA, 22 nt, Human
gggaaauaauuaaugugaaguc

SEQ ID NO: 125 - RNA, 22 nt, Human
gggcguggagcuggaaugaugu

SEQ ID NO: 126 - RNA, 20 nt, Human
gggcuuuuggaauggucugu

SEQ ID NO: 127 - RNA, 22 nt, Human
ggggaacgcgcuggcccgcgcc

SEQ ID NO: 128 - RNA, 19 nt, Human
gggucucuguuggcuucuu

SEQ ID NO: 129 - RNA, 22 nt, Human
ggguuacucuguguuggucagg

SEQ ID NO: 130 - RNA, 22 nt, Human
ggugccccaucgcggguggcug

SEQ ID NO: 131 - RNA, 22 nt, Human
gguggccccugggagaugcugg

SEQ ID NO: 132 - RNA, 21 nt, Human
gguggcuauggcugugcucgc

SEQ ID NO: 133 - RNA, 22 nt, Human
gucagucauugaaugcuggccu

SEQ ID NO: 134 - RNA, 22 nt, Human
gugacagugaaucuagacagac

SEQ ID NO: 135 - RNA, 22 nt, Human
gugaccuggccgccuaaaccca

SEQ ID NO: 136 - RNA, 22 nt, Human
gugacuguggguuucugguucc

SEQ ID NO: 137 - RNA, 22 nt, Human
cuggcuagauguguggccauga

SEQ ID NO: 138 - RNA, 22 nt, Human
cugguguugggucuugcuuuua

SEQ ID NO: 139 - RNA, 22 nt, Human
cugugcucuuuccacggcccca

SEQ ID NO: 140 - RNA, 22 nt, Human
gaccccuaaacccgcugggcug

SEQ ID NO: 141 - RNA, 22 nt, Human
gaccuugugauccgcccacuuu

SEQ ID NO: 142 - RNA, 22 nt, Human
gagccgcccuccacgauguccc

SEQ ID NO: 143 - RNA, 22 nt, Human
gaugaguuugccuggccugcag

SEQ ID NO: 144 - RNA, 21 nt, Human
gauggguuuguuggagagguc

SEQ ID NO: 145 - RNA, 22 nt, Human
gaugucgugauccacccgccuu

SEQ ID NO: 146 - RNA, 23 nt, Human
gauuacugguauuugcuggcucc

SEQ ID NO: 147 - RNA, 22 nt, Human
gcagcaucccggccuccacugu

SEQ ID NO: 148 - RNA, 22 nt, Human
gcagggaacuggcugggcuuuc

SEQ ID NO: 149 - RNA, 21 nt, Human
gccagccuccauccucccuug

SEQ ID NO: 150 - RNA, 22 nt, Human
gcccuucggaaagcgucgccug

SEQ ID NO: 151 - RNA, 22 nt, Human
gcccuugaagcucugacccgcu

SEQ ID NO: 152 - RNA, 22 nt, Human
gcccuuugugucuggcuggggu

SEQ ID NO: 153 - RNA, 21 nt, Human
gccuaguggauuugaagggcc

SEQ ID NO: 154 - RNA, 22 nt, Human
gccuggccaacauagugggacc

SEQ ID NO: 155 - RNA, 22 nt, Human
gccuggccuaaauuaguaauuu

SEQ ID NO: 156 - RNA, 22 nt, Human
gccuggccuaauuccagcauuu

SEQ ID NO: 157 - RNA, 22 nt, Human
gccuggccuccuacaguacuuu

SEQ ID NO: 158 - RNA, 22 nt, Human
gcgggcggcuucaucuugcccu

SEQ ID NO: 159 - RNA, 22 nt, Human
gcuaggcugcuggccacugagg

SEQ ID NO: 160 - RNA, 22 nt, Human
gcucacagccucccccggccug

SEQ ID NO: 161 - RNA, 22 nt, Human
gcuccuggccgggcugcuccug

SEQ ID NO: 162 - RNA, 22 nt, Human
gcugcaccccagccuggguaac

SEQ ID NO: 163 - RNA, 22 nt, Human
gcuguaagucaccuggcccgau

SEQ ID NO: 164 - RNA, 22 nt, Human
gcuguuuucccauagcugguca

SEQ ID NO: 165 - RNA, 22 nt, Human
gcuucagagaggggugaagcug

SEQ ID NO: 166 - RNA, 22 nt, Human
ggaggcuggccuucagacgggu

SEQ ID NO: 167 - RNA, 21 nt, Human
ggagguacuguagcuggcguu

SEQ ID NO: 168 - RNA, 22 nt, Human
ggcccagguuggagugcaguga

SEQ ID NO: 169 - RNA, 22 nt, Human
ggccccucugagcuuacucugu

SEQ ID NO: 170 - RNA, 22 nt, Human
ggccgucccuagagaugggguu

SEQ ID NO: 171 - RNA, 22 nt, Human
ggcgcuggccugugggaucccg

SEQ ID NO: 172 - RNA, 22 nt, Human
ggcggcccaggcgcuuggagau

SEQ ID NO: 173 - RNA, 22 nt, Human
ggcgugcccuggccccgaggcu

SEQ ID NO: 174 - RNA, 22 nt, Human
ggcucuggcuuuggaggagcag

SEQ ID NO: 175 - RNA, 23 nt, Human
ggcugcuggucuuucauaguggg

SEQ ID NO: 176 - RNA, 22 nt, Human
ggcugcugguuucuuguuuuag

SEQ ID NO: 177 - RNA, 22 nt, Human
ggcuuccugccucgggcuggcc

SEQ ID NO: 178 - RNA, 22 nt, Human
gggaagcuggucacccacaggc

SEQ ID NO: 179 - RNA, 22 nt, Human
gggaguugugguuggcuucugg

SEQ ID NO: 180 - RNA, 22 nt, Human
ggggcuggucuuuccacuuacu

SEQ ID NO: 181 - RNA, 22 nt, Human
ggggcuucuagggugccagauc

SEQ ID NO: 182 - RNA, 20 nt, Human
gguagucuuuguccccuggc

SEQ ID NO: 183 - RNA, 19 nt, Human
ggucggcuccccuccauca

SEQ ID NO: 184 - RNA, 22 nt, Human
ggugcccucuggcucuacuccc

SEQ ID NO: 185 - RNA, 22 nt, Human
ggugguggagcgggcccaggcc

SEQ ID NO: 186 - RNA, 22 nt, Human
gguucucagccugagccgcccc

SEQ ID NO: 187 - RNA, 22 nt, Human
guagcuguguucauucuggaug

SEQ ID NO: 188 - RNA, 22 nt, Human
guccucacuggccgcacgcuga

SEQ ID NO: 189 - RNA, 22 nt, Human
gucucggacuccugaucucagg

SEQ ID NO: 190 - RNA, 22 nt, Human
gugcuuugcuggaaucgaggaa

SEQ ID NO: 191 - RNA, 22 nt, Human
guguuccugugcuggaugguca

SEQ ID NO: 192 - RNA, 22 nt, Human
uagcuccucccagaucucaucu

SEQ ID NO: 193 - RNA, 22 nt, Human
uagcugagccgccuggcugggg

SEQ ID NO: 194 - RNA, 22 nt, Human
uaggaggauugcuuguggccag

SEQ ID NO: 195 - RNA, 22 nt, Human
ucacgcgcccuccugggcccug

SEQ ID NO: 196 - RNA, 22 nt, Human
ucacugcaaccuccaccacgug

SEQ ID NO: 197 - RNA, 22 nt, Human
ucacugcaaccuccaccagccu

SEQ ID NO: 198 - RNA, 22 nt, Human
ucacugcaaccuccaccuccca

SEQ ID NO: 199 - RNA, 22 nt, Human
ucacugcaaccuccaccucccg

SEQ ID NO: 200 - RNA, 22 nt, Human
ucacugcaaccuccaccuccug

SEQ ID NO: 201 - RNA, 22 nt, Human
ucacugcaaccuccaccuuccg

SEQ ID NO: 202 - RNA, 22 nt, Human
ucacugcaagcuccacccuccg

SEQ ID NO: 203 - RNA, 22 nt, Human
ucagaauauggcuaggagugcu

SEQ ID NO: 204 - RNA, 22 nt, Human
ucagcuccuaccccggccccag

SEQ ID NO: 205 - RNA, 22 nt, Human
ucagggcugcacuggcuggucu

SEQ ID NO: 206 - RNA, 22 nt, Human
ucagggguuggcuuguuguguu

SEQ ID NO: 207 - RNA, 22 nt, Human
ucauugcaaccuccuccugggu

SEQ ID NO: 208 - RNA, 21 nt, Human
uccacugucccuggcacuuuu

SEQ ID NO: 209 - RNA, 22 nt, Human
uccauuggccuuuuauccuaga

SEQ ID NO: 210 - RNA, 22 nt, Human
uccuacgguggccacagucugg

SEQ ID NO: 211 - RNA, 22 nt, Human
uccucagcuuggccacggaguu

SEQ ID NO: 212 - RNA, 22 nt, Human
uccuccagagcuucauccugcc

SEQ ID NO: 213 - RNA, 22 nt, Human
uccucccucaccucagucuggg

SEQ ID NO: 214 - RNA, 22 nt, Human
uccuggccauccagccugggga

SEQ ID NO: 215 - RNA, 22 nt, Human
uccugggcuuuggcuuguuggg

SEQ ID NO: 216 - RNA, 22 nt, Human
uccuggggcuugucgcuggcca

SEQ ID NO: 217 - RNA, 20 nt, Human
ucucuaugccaugcuggccu

SEQ ID NO: 218 - RNA, 20 nt, Human
ucugccuccaggagcuggca

SEQ ID NO: 219 - RNA, 22 nt, Human
ugcccacugcuggccaccaccc

SEQ ID NO: 220 - RNA, 22 nt, Human
ugccgcccggccaucucggcuc

SEQ ID NO: 221 - RNA, 22 nt, Human
ugccuagccaaguccaguauuu

SEQ ID NO: 222 - RNA, 22 nt, Human
ugccugccguuaaauguuacuu

SEQ ID NO: 223 - RNA, 22 nt, Human
ugcuagcugcccgaaggucuca

SEQ ID NO: 224 - RNA, 22 nt, Human
ugcucuguuggcuucuuuuguc

SEQ ID NO: 225 - RNA, 22 nt, Human
ugcuggcuauccugcgccuuuc

SEQ ID NO: 226 - RNA, 22 nt, Human
uggcuuuaguaauaaguuucuc

SEQ ID NO: 227 - RNA, 22 nt, Human
uggguccuggcugaagaucucu

SEQ ID NO: 228 - RNA, 22 nt, Human
ugggucucuggccaccccagcc

SEQ ID NO: 229 - RNA, 22 nt, Human
uggguuuuguuuguacagugua

SEQ ID NO: 230 - RNA, 22 nt, Human
uggucgggcugcaucuuccggc

SEQ ID NO: 231 - RNA, 19 nt, Human
uggucuggcccacaugguc

SEQ ID NO: 232 - RNA, 22 nt, Human
uggugcuaguuaaaucuucagg

SEQ ID NO: 233 - RNA, 22 nt, Human
ugguggaggcgcugcuggccag

SEQ ID NO: 234 - RNA, 22 nt, Human
ugguucuucgcugggcggcugc

SEQ ID NO: 235 - RNA, 22 nt, Human
ugucuccccacuggucuuccag

SEQ ID NO: 236 - RNA, 22 nt, Human
ugucuggcuuucuucaguuagc

SEQ ID NO: 237 - RNA, 22 nt, Human
ugugcuggccuuuggugacuuc

SEQ ID NO: 238 - RNA, 22 nt, Human
uuauaauguauagcugugccug

SEQ ID NO: 239 - RNA, 22 nt, Human
uuauugcacuccagccugggua

SEQ ID NO: 240 - RNA, 22 nt, Human
uucacugcucuagcccuaauuu

SEQ ID NO: 241 - RNA, 22 nt, Human
uucccugggacuggccugcacc

SEQ ID NO: 242 - RNA, 22 nt, Human
uucucugugcuggguccugagg

SEQ ID NO: 243 - RNA, 22 nt, Human
uucuggcuucucccaggcggcc

SEQ ID NO: 244 - RNA, 22 nt, Human
uucuucugccccuugccugaca

SEQ ID NO: 245 - RNA, 22 nt, Human
uugcucaggcuggcgugcaaug

SEQ ID NO: 246 - RNA, 22 nt, Human
uugguccccuucaaccagcuac

SEQ ID NO: 247 - RNA, 22 nt, Human
uuuaaaucacaacucugccccu

SEQ ID NO: 248 - RNA, 21 nt, Human
uuucuugggccgugugcuggu

SEQ ID NO: 249 - RNA, 22 nt, Human
uuugguccccuucaaccagcua

SEQ ID NO: 250 - RNA, 22 nt, Human
gugcggccuggccuucaagugg

SEQ ID NO: 251 - RNA, 22 nt, Human
gugcuggugcucgcuccucugg

SEQ ID NO: 252 - RNA, 22 nt, Human
gugcuuaaagaauggcuguccg

SEQ ID NO: 253 - RNA, 22 nt, Human
gugguagcuccaggcugucuga

SEQ ID NO: 254 - RNA, 23 nt, Human
guguugucgcuggguuuugaggg

SEQ ID NO: 255 - RNA, 22 nt, Human
guuggucuucauuaaaugcuuu

SEQ ID NO: 256 - RNA, 22 nt, Human
guugguuuuagcuuggcccauu

SEQ ID NO: 257 - RNA, 19 nt, Human
guuucucugggcuuggcau

SEQ ID NO: 258 - RNA, 22 nt, Human
uacugcacuccagccuugccaa

SEQ ID NO: 259 - RNA, 21 nt, Human
uagaacuauggcuaugugcca

SEQ ID NO: 260 - RNA, 20 nt, Human
uagcauggcucuauggaaca

SEQ ID NO: 261 - RNA, 22 nt, Human
uagguauggcuuguggcacagc

SEQ ID NO: 262 - RNA, 22 nt, Human
uauucauugcccauguuuguga

SEQ ID NO: 263 - RNA, 22 nt, Human
ucacugcaaccuccaccuucag

SEQ ID NO: 264 - RNA, 22 nt, Human
ucagccuccuccaccccagagu

SEQ ID NO: 265 - RNA, 22 nt, Human
uccagcuguccacgucuuccug

SEQ ID NO: 266 - RNA, 23 nt, Human
uccaggcccucaauccauuucca

SEQ ID NO: 267 - RNA, 22 nt, Human
ucccagcuccugggccccacag

SEQ ID NO: 268 - RNA, 22 nt, Human
ucccauggggccagccgccauc

SEQ ID NO: 269 - RNA, 22 nt, Human
uccccucuuggcuugguccaga

SEQ ID NO: 270 - RNA, 22 nt, Human
uccuuccucugucaggcaggcc

SEQ ID NO: 271 - RNA, 22 nt, Human
ucgcucaggcaggagugcagug

SEQ ID NO: 272 - RNA, 22 nt, Human
ucuaagagaaaggaaguucaga

SEQ ID NO: 273 - RNA, 22 nt, Human
ucuccacagcuggcccccaaga

SEQ ID NO: 274 - RNA, 22 nt, Human
ucucccagauccuuuagccucc

SEQ ID NO: 275 - RNA, 19 nt, Human
ucucuaguccugccucccc

SEQ ID NO: 276 - RNA, 22 nt, Human
ucucuucgcuggcccucgggga

SEQ ID NO: 277 - RNA, 22 nt, Human
ucugcagcagagcagcucccug

SEQ ID NO: 278 - RNA, 22 nt, Human
ugaccuccuuucucgacuaauu

SEQ ID NO: 279 - RNA, 22 nt, Human
ugauagauccauauuuugguaa

SEQ ID NO: 280 - RNA, 22 nt, Human
ugaucucgugaucuacccgccu

SEQ ID NO: 281 - RNA, 22 nt, Human
ugcaccacugcaccccagucug

SEQ ID NO: 282 - RNA, 22 nt, Human
ugcagccucuuguuucagcccc

SEQ ID NO: 283 - RNA, 22 nt, Human
ugcagguugcuggucugaucuc

SEQ ID NO: 284 - RNA, 22 nt, Human
ugccaguauccuucugagaccc

SEQ ID NO: 285 - RNA, 21 nt, Human
ugcccggauaccccuggccuc

SEQ ID NO: 286 - RNA, 22 nt, Human
ugccuaggucuggccuccuugg

SEQ ID NO: 287 - RNA, 22 nt, Human
ugccugccccagcugagauauc

SEQ ID NO: 288 - RNA, 22 nt, Human
ugccuggccuccugauucccuc

SEQ ID NO: 289 - RNA, 22 nt, Human
ugccuggccucuucagcacuuc

SEQ ID NO: 290 - RNA, 22 nt, Human
ugcguuccaguugcugccaggc

SEQ ID NO: 291 - RNA, 21 nt, Human
ugcucugauuuuugccccagc

SEQ ID NO: 292 - RNA, 22 nt, Human
ugcucugauuuuugccccagcu

SEQ ID NO: 293 - RNA, 22 nt, Human
ugcugcacccucugccuccggg

SEQ ID NO: 294 - RNA, 20 nt, Human
ugcugcccuaagaccaccuu

SEQ ID NO: 295 - RNA, 22 nt, Human
ugcuucuagggaggccgcagga

SEQ ID NO: 296 - RNA, 22 nt, Human
ugcuugcugugguuggcuggua

SEQ ID NO: 297 - RNA, 19 nt, Human
uggagcugggucuggggca

SEQ ID NO: 298 - RNA, 23 nt, Human
uggaggagaguuugucaguauag

SEQ ID NO: 299 - RNA, 22 nt, Human
uggaguuggcugcagaugaguc

SEQ ID NO: 300 - RNA, 22 nt, Human
uggcggaucuuuccugccuccc

SEQ ID NO: 301 - RNA, 18 nt, Human
ugguagguugggcaguuc

SEQ ID NO: 302 - RNA, 22 nt, Human
uggugcagcgugugguggcucu

SEQ ID NO: 303 - RNA, 22 nt, Human
ugguuucccuuuuggccucucc

SEQ ID NO: 304 - RNA, 22 nt, Human
ugugguagucacggcccgccac

SEQ ID NO: 305 - RNA, 22 nt, Human
uucaaguguuuaaguucugcuu

SEQ ID NO: 306 - RNA, 22 nt, Human
uucugaugguuaaguucuguca

SEQ ID NO: 307 - RNA, 22 nt, Human
uugacaugccuccuacaugauc

SEQ ID NO: 308 - RNA, 22 nt, Human
uugaugccccguccuguacacu

SEQ ID NO: 309 - RNA, 22 nt, Human
uugcuaguguuugguugauggu

SEQ ID NO: 310 - RNA, 22 nt, Human
uugggggaggccugcugcccau

SEQ ID NO: 311 - RNA, 22 nt, Human
uugucacugcacuccagucugg

SEQ ID NO: 312 - RNA, 18 nt, Human
aaacugcuuccuuggccu

SEQ ID NO: 313 - RNA, 22 nt, Human
aaccuugugauccacccaccuu

SEQ ID NO: 314 - RNA, 22 nt, Human
aagacaccagagacuggccuca

SEQ ID NO: 315 - RNA, 22 nt, Human
aauggucucuuuguucccugcu

SEQ ID NO: 316 - RNA, 22 nt, Human
acaaagugccucccuuuagagu

SEQ ID NO: 317 - RNA, 22 nt, Human
acacuuugccccuggccgccuu

SEQ ID NO: 318 - RNA, 22 nt, Human
acaggcgauccacccgccucag

SEQ ID NO: 319 - RNA, 22 nt, Human
acauucucugauuggugccucc

SEQ ID NO: 320 - RNA, 22 nt, Human
accaucuccugugccuccagcu

SEQ ID NO: 321 - RNA, 22 nt, Human
accccgcuccuugcagccucug

SEQ ID NO: 322 - RNA, 22 nt, Human
accuugugauccaccugcuuug

SEQ ID NO: 323 - RNA, 22 nt, Human
acucacugcaaccuccaccucc

SEQ ID NO: 324 - RNA, 22 nt, Human
acugcacuccauccagccuggc

SEQ ID NO: 325 - RNA, 22 nt, Human
agagucucccuguguugcccug

SEQ ID NO: 326 - RNA, 22 nt, Human
agcaagaccaggguuuuguguu

SEQ ID NO: 327 - RNA, 20 nt, Human
agcagagcagucuccgcuca

SEQ ID NO: 328 - RNA, 22 nt, Human
agccucugguccuuuuuucccu

SEQ ID NO: 329 - RNA, 22 nt, Human
agcuggcuuacuugagaugcau

SEQ ID NO: 330 - RNA, 22 nt, Human
aggaucuugcuauguuggccag

SEQ ID NO: 331 - RNA, 21 nt, Human
aggcagagaggaccagagacu

SEQ ID NO: 332 - RNA, 22 nt, Human
agggaaggacugcuggguuggc

SEQ ID NO: 333 - RNA, 22 nt, Human
aggugcuggggcuuggccugcu

SEQ ID NO: 334 - RNA, 22 nt, Human
agguggccacaagguggcuggc

SEQ ID NO: 335 - RNA, 22 nt, Human
agucgcuggaccaucagagccu

SEQ ID NO: 336 - RNA, 22 nt, Human
aguggcgugaucucggcucggu

SEQ ID NO: 337 - RNA, 22 nt, Human
aguguuggcucggcuggcugcc

SEQ ID NO: 338 - RNA, 18 nt, Human
aguuuguguaagaaaagc

SEQ ID NO: 339 - RNA, 22 nt, Human
auagcagcgcuggcccucugcc

SEQ ID NO: 340 - RNA, 22 nt, Human
aucuuuuaucacucccacugcu

SEQ ID NO: 341 - RNA, 22 nt, Human
augccacugcgcuccagccuga

SEQ ID NO: 342 - RNA, 22 nt, Human
auggcccucuuaucacagcucc

SEQ ID NO: 343 - RNA, 22 nt, Human
auucugugcuaacugcaggcca

SEQ ID NO: 344 - RNA, 22 nt, Human
auuuacauacccagcagccucc

SEQ ID NO: 345 - RNA, 21 nt, Human
cacugcacuccagcucugggu

SEQ ID NO: 346 - RNA, 22 nt, Human
cacugccuuggccaccuauccu

SEQ ID NO: 347 - RNA, 22 nt, Human
cacuucccuucucugcucaugg

SEQ ID NO: 348 - RNA, 22 nt, Human
cagcagcacacugugguuugua

SEQ ID NO: 349 - RNA, 22 nt, Human
cagcagcucagccuccuuccca

SEQ ID NO: 350 - RNA, 22 nt, Human
cagccucuaugcccccgucacc

SEQ ID NO: 351 - RNA, 22 nt, Human
cagcuggugcuugccuggcuaa

SEQ ID NO: 352 - RNA, 22 nt, Human
caggcucuucccucuggccaag

SEQ ID NO: 353 - RNA, 22 nt, Human
caggcuggcucccugaagguuc

SEQ ID NO: 354 - RNA, 22 nt, Human
caguuuguccccauggccaugu

SEQ ID NO: 355 - RNA, 22 nt, Human
caucacccccagaccucagugc

SEQ ID NO: 356 - RNA, 22 nt, Human
ccaggcuggagugcaagcagca

SEQ ID NO: 357 - RNA, 22 nt, Human
ccaguacguugcucagcuccuc

SEQ ID NO: 358 - RNA, 22 nt, Human
ccccacuguccccggagcuggc

SEQ ID NO: 359 - RNA, 22 nt, Human
ccccacuguuuucuucauccua

SEQ ID NO: 360 - RNA, 21 nt, Human
cccggcaccuccgcugcacac

SEQ ID NO: 361 - RNA, 22 nt, Human
cccggguggagccugggcugug

SEQ ID NO: 362 - RNA, 22 nt, Human
cccucuggccccugugguggau

SEQ ID NO: 363 - RNA, 22 nt, Human
cccucuuggcuucuaucccacc

SEQ ID NO: 364 - RNA, 22 nt, Human
cccuggcucacuuucuguugug

SEQ ID NO: 365 - RNA, 22 nt, Human
ccgccuggcccauugcagggca

SEQ ID NO: 366 - RNA, 22 nt, Human
ccuccggucauugugcgggccu

SEQ ID NO: 367 - RNA, 22 nt, Human
ccucgcucuccauucggcccuc

SEQ ID NO: 368 - RNA, 22 nt, Human
ccuggcucuggcuuccuguugu

SEQ ID NO: 369 - RNA, 22 nt, Human
ccuggucggcguggugacggcg

SEQ ID NO: 370 - RNA, 22 nt, Human
cgaccuugugauccucccgccu

SEQ ID NO: 371 - RNA, 22 nt, Human
cgccgcccuccgaggacuccuu

SEQ ID NO: 372 - RNA, 22 nt, Human
cgccuccucucuguccugauuu

SEQ ID NO: 373 - RNA, 22 nt, Human
cgccuggcccccaguacuuugu

SEQ ID NO: 374 - RNA, 22 nt, Human
cggcacuguagucuggcuggga

SEQ ID NO: 375 - RNA, 22 nt, Human
cggcgagcgggaccugcgccug

SEQ ID NO: 376 - RNA, 22 nt, Human
cggugggugcuucaggcggugg

SEQ ID NO: 377 - RNA, 22 nt, Human
cucagcucauccacuaaauccc

SEQ ID NO: 378 - RNA, 22 nt, Human
cucagugcugcuggcuccuguc

SEQ ID NO: 379 - RNA, 23 nt, Human
cucauuguagccuccaguucuug

SEQ ID NO: 380 - RNA, 22 nt, Human
cugcagccuccacuuucugggc

SEQ ID NO: 381 - RNA, 22 nt, Human
cugccugccuggcccaggaacc

SEQ ID NO: 382 - RNA, 22 nt, Human
cugcugcgcuggccgucacggu

SEQ ID NO: 383 - RNA, 22 nt, Human
cuggacugagcuccuugaggcc

SEQ ID NO: 384 - RNA, 17 nt, Human
cuggaggagcugccaug

SEQ ID NO: 385 - RNA, 22 nt, Human
cuggcuaagauccaagaaaggc

SEQ ID NO: 386 - RNA, 22 nt, Bordetella pertussis
aagggcagcgugcuggccauca

SEQ ID NO: 387 - RNA, 22 nt, Bordetella pertussis
aagucgcguaccgcgcuggccg

SEQ ID NO: 388 - RNA, 22 nt, Bordetella pertussis
aagugcgcaauacgcagcucga

SEQ ID NO: 389 - RNA, 22 nt, Bordetella pertussis
aaguggcgcgugccggucagga

SEQ ID NO: 390 - RNA, 22 nt, Bordetella pertussis
aauccgcaggccgcggcgcuga

SEQ ID NO: 391 - RNA, 22 nt, Bordetella pertussis
aauccugcuugccgcugcauuc

SEQ ID NO: 392 - RNA, 22 nt, Bordetella pertussis
aaucgcgugccgacggcgucuu

SEQ ID NO: 393 - RNA, 22 nt, Bordetella pertussis
aaucguucgaucucgccacgau

SEQ ID NO: 394 - RNA, 22 nt, Bordetella pertussis
acagcggcguguacguggcgcc

SEQ ID NO: 395 - RNA, 22 nt, Bordetella pertussis
acaggcacaucgccguacgccg

SEQ ID NO: 396 - RNA, 23 nt, Bordetella pertussis
accaccaggcccguggagaucgg

SEQ ID NO: 397 - RNA, 22 nt, Bordetella pertussis
accacgccaucgcgccgcucga

SEQ ID NO: 398 - RNA, 22 nt, Bordetella pertussis
accagcgccugcaggccgccga

SEQ ID NO: 399 - RNA, 22 nt, Bordetella pertussis
accaggucgucguagcgggcgg

SEQ ID NO: 400 - RNA, 22 nt, Bordetella pertussis
accauguucugcggcgcguuga

SEQ ID NO: 401 - RNA, 22 nt, Bordetella pertussis
acccugauggcgcugaccaucg

SEQ ID NO: 402 - RNA, 22 nt, Bordetella pertussis
accgccaacaucgucggcgugc

SEQ ID NO: 403 - RNA, 22 nt, Bordetella pertussis
accgccaagaaucugcugcucg

SEQ ID NO: 404 - RNA, 22 nt, Bordetella pertussis
accgcgcuggucuuuuucggcu

SEQ ID NO: 405 - RNA, 18 nt, Bordetella pertussis
accgcgucgccuauggcc

SEQ ID NO: 406 - RNA, 22 nt, Bordetella pertussis
accgcguugaagggcggcacgc

SEQ ID NO: 407 - RNA, 22 nt, Bordetella pertussis
accggcgugcugaucggcaugg

SEQ ID NO: 408 - RNA, 20 nt, Bordetella pertussis
accggcguguggcuggucgu

SEQ ID NO: 409 - RNA, 22 nt, Bordetella pertussis
accgucaugaucugcgacugcu

SEQ ID NO: 410 - RNA, 22 nt, Bordetella pertussis
accugguccauggcggggaauu

SEQ ID NO: 411 - RNA, 22 nt, Bordetella pertussis
accugugcagccggaaaaugau

SEQ ID NO: 412 - RNA, 22 nt, Bordetella pertussis
acgaggcggggcggauugcgcu

SEQ ID NO: 413 - RNA, 22 nt, Bordetella pertussis
acgaucaaggcaugucaaucug

SEQ ID NO: 414 - RNA, 22 nt, Bordetella pertussis
acgauccgcaggccggcgugcg

SEQ ID NO: 415 - RNA, 20 nt, Bordetella pertussis
acgcagcaaugugcuggccg

SEQ ID NO: 416 - RNA, 22 nt, Bordetella pertussis
acgcagcagcaccuggacaucc

SEQ ID NO: 417 - RNA, 22 nt, Bordetella pertussis
acgcaguuccugcccuaugccc

SEQ ID NO: 418 - RNA, 22 nt, Bordetella pertussis
acgcccaggguagccaguuuuu

SEQ ID NO: 419 - RNA, 21 nt, Bordetella pertussis
acgcccgccagcgcggccagg

SEQ ID NO: 420 - RNA, 22 nt, Bordetella pertussis
acgcccuggguguucugcgcgg

SEQ ID NO: 421 - RNA, 22 nt, Bordetella pertussis
acgccgauggugcgcuugagcu

SEQ ID NO: 422 - RNA, 22 nt, Bordetella pertussis
acgccgggcaggccgaugcccg

SEQ ID NO: 423 - RNA, 22 nt, Bordetella pertussis
acgccugggucgucgaagccgc

SEQ ID NO: 424 - RNA, 22 nt, Bordetella pertussis
acgccuucuugaugaggaccgu

SEQ ID NO: 425 - RNA, 22 nt, Bordetella pertussis
acgcgcgcggccuccuucaagu

SEQ ID NO: 426 - RNA, 22 nt, Bordetella pertussis
acgcgcgucaagguggaucugc

SEQ ID NO: 427 - RNA, 22 nt, Bordetella pertussis
acgcuggcccgcaucgaagcgg

SEQ ID NO: 428 - RNA, 22 nt, Bordetella pertussis
acgcuguucgccuugcucggcc

SEQ ID NO: 429 - RNA, 22 nt, Bordetella pertussis
acggcgcgcaggcacaucagcu

SEQ ID NO: 430 - RNA, 22 nt, Bordetella pertussis
acgggcaaguucacgcgguugg

SEQ ID NO: 431 - RNA, 22 nt, Bordetella pertussis
acgggccaccggaucgagcggc

SEQ ID NO: 432 - RNA, 22 nt, Bordetella pertussis
acgggcuuuggcauggggcuga

SEQ ID NO: 433 - RNA, 23 nt, Bordetella pertussis
acggugggcucgauacugggcgg

SEQ ID NO: 434 - RNA, 22 nt, Bordetella pertussis
acguccuucugcggaucgaugc

SEQ ID NO: 435 - RNA, 22 nt, Bordetella pertussis
acgucgacgaagagguggccga

SEQ ID NO: 436 - RNA, 22 nt, Bordetella pertussis
acgucggcgaggucgaacugug

SEQ ID NO: 437 - RNA, 22 nt, Bordetella pertussis
acgugcacaacggcgcgguguu

SEQ ID NO: 438 - RNA, 22 nt, Bordetella pertussis
acgugcugaccgggcuguacgu

SEQ ID NO: 439 - RNA, 21 nt, Bordetella pertussis
acuacgccaaggcuggcgcgg

SEQ ID NO: 440 - RNA, 22 nt, Bordetella pertussis
acugcagcguauuggucugggc

SEQ ID NO: 441 - RNA, 22 nt, Bordetella pertussis
acuggccggcgccgagcgcauc

SEQ ID NO: 442 - RNA, 22 nt, Bordetella pertussis
agaccguggccucgucgucguc

SEQ ID NO: 443 - RNA, 20 nt, Bordetella pertussis
agagccgcaugucggcgcgc

SEQ ID NO: 444 - RNA, 22 nt, Bordetella pertussis
agaugggcgucgaugcgcguga

SEQ ID NO: 445 - RNA, 22 nt, Bordetella pertussis
agcacggccuggucuugccgcg

SEQ ID NO: 446 - RNA, 22 nt, Bordetella pertussis
agcagcgggcgcgucccuuccu

SEQ ID NO: 447 - RNA, 22 nt, Bordetella pertussis
agcagcguggcgcucaauggcg

SEQ ID NO: 448 - RNA, 23 nt, Bordetella pertussis
agcaggaugacgucgccgucgca

SEQ ID NO: 449 - RNA, 22 nt, Bordetella pertussis
agcaggugcgccuggucagcuc

SEQ ID NO: 450 - RNA, 22 nt, Bordetella pertussis
agccauguccugcaggccuuug

SEQ ID NO: 451 - RNA, 22 nt, Bordetella pertussis
agcccggcaguucuucgagcac

SEQ ID NO: 452 - RNA, 22 nt, Bordetella pertussis
agccgcgcuggucgaacagcag

SEQ ID NO: 453 - RNA, 22 nt, Bordetella pertussis
agccgcugcgccucgaguaugc

SEQ ID NO: 454 - RNA, 22 nt, Bordetella pertussis
agccggugggcguggugggcau

SEQ ID NO: 455 - RNA, 22 nt, Bordetella pertussis
agccuguuucuguccuaccggc

SEQ ID NO: 456 - RNA, 22 nt, Bordetella pertussis
agcgaugaaagaagagccgcgc

SEQ ID NO: 457 - RNA, 22 nt, Bordetella pertussis
agcgcaucaccgagcuggucga

SEQ ID NO: 458 - RNA, 22 nt, Bordetella pertussis
agcgcccgaugaugcguccgau

SEQ ID NO: 459 - RNA, 22 nt, Bordetella pertussis
agcgcgacgaugugggccaggc

SEQ ID NO: 460 - RNA, 22 nt, Bordetella pertussis
agcgcgaugagcuucaccggcc

SEQ ID NO: 461 - RNA, 22 nt, Bordetella pertussis
agcgcgucacgcauuacauggg

SEQ ID NO: 462 - RNA, 22 nt, Bordetella pertussis
aacagggccugauagaccgguu

SEQ ID NO: 463 - RNA, 22 nt, Bordetella pertussis
aacaucaccgucaugggcaucu

SEQ ID NO: 464 - RNA, 22 nt, Bordetella pertussis
aacugguguggcgcaugcugcc

SEQ ID NO: 465 - RNA, 22 nt, Bordetella pertussis
aagaacaagggcgucaacaggg

SEQ ID NO: 466 - RNA, 22 nt, Bordetella pertussis
aagagcgacuggcuggacgggc

SEQ ID NO: 467 - RNA, 22 nt, Bordetella pertussis
aagcggagaacugcugcggcgu

SEQ ID NO: 468 - RNA, 22 nt, Bordetella pertussis
aagcugaccgugaucgaccugg

SEQ ID NO: 469 - RNA, 22 nt, Bordetella pertussis
aagcugcucaagcagggcgugc

SEQ ID NO: 470 - RNA, 22 nt, Bordetella pertussis
aaggccgaggucggccuguucc

SEQ ID NO: 471 - RNA, 22 nt, Bordetella pertussis
aaggcgcaggcgugcgauggcc

SEQ ID NO: 472 - RNA, 22 nt, Bordetella pertussis
aaguggucagcgcauacucggu

SEQ ID NO: 473 - RNA, 22 nt, Bordetella pertussis
aauggcguucuuguugaccgug

SEQ ID NO: 474 - RNA, 22 nt, Bordetella pertussis
acaccgcugccgccuugcugaa

SEQ ID NO: 475 - RNA, 22 nt, Bordetella pertussis
acagcagcuggcuggucaccau

SEQ ID NO: 476 - RNA, 22 nt, Bordetella pertussis
aggcaccuuggcccggcgggaa

SEQ ID NO: 477 - RNA, 22 nt, Bordetella pertussis
aggccgacgccgccgguaacga

SEQ ID NO: 478 - RNA, 22 nt, Bordetella pertussis
aggccgauguugccuuccugga

SEQ ID NO: 479 - RNA, 22 nt, Bordetella pertussis
aggcgccguuacgguucacgcg

SEQ ID NO: 480 - RNA, 22 nt, Bordetella pertussis
aggcgcgaagugggguugaucg

SEQ ID NO: 481 - RNA, 22 nt, Bordetella pertussis
aggcugccgccgccguggccga

SEQ ID NO: 482 - RNA, 22 nt, Bordetella pertussis
agggcaccgauaucacguucga

SEQ ID NO: 483 - RNA, 22 nt, Bordetella pertussis
agggccugcguuucgcuggcau

SEQ ID NO: 484 - RNA, 22 nt, Bordetella pertussis
agggcguacagcuuccugucgu

SEQ ID NO: 485 - RNA, 22 nt, Bordetella pertussis
agggcugucugcugggcgcgcg

SEQ ID NO: 486 - RNA, 22 nt, Bordetella pertussis
aggggucggccaucugccguug

SEQ ID NO: 487 - RNA, 22 nt, Bordetella pertussis
agguccacaucgaagucgccga

SEQ ID NO: 488 - RNA, 22 nt, Bordetella pertussis
aggugcgcaccgcccuggcggu

SEQ ID NO: 489 - RNA, 20 nt, Bordetella pertussis
aggugcgcgcgcugucgccc

SEQ ID NO: 490 - RNA, 22 nt, Bordetella pertussis
agguguccgcgcggcucgagcg

SEQ ID NO: 491 - RNA, 22 nt, Bordetella pertussis
agucaggcuacaggaaucauuc

SEQ ID NO: 492 - RNA, 22 nt, Bordetella pertussis
agucccccaguggggacaggca

SEQ ID NO: 493 - RNA, 22 nt, Bordetella pertussis
agugccuucaugcagcaggcgc

SEQ ID NO: 494 - RNA, 22 nt, Bordetella pertussis
aguucgcguucgaucgacggca

SEQ ID NO: 495 - RNA, 22 nt, Bordetella pertussis
aguugcuggcggccggcuugug

SEQ ID NO: 496 - RNA, 22 nt, Bordetella pertussis
auaccgcccuacuggaagccgc

SEQ ID NO: 497 - RNA, 22 nt, Bordetella pertussis
auacgcgcgaugccugacgaau

SEQ ID NO: 498 - RNA, 22 nt, Bordetella pertussis
auagacuuuggcgcuugauucc

SEQ ID NO: 499 - RNA, 22 nt, Bordetella pertussis
auagcgggcuguucgggccccg

SEQ ID NO: 500 - RNA, 22 nt, Bordetella pertussis
auauggcgcgauacgacgguau

SEQ ID NO: 501 - RNA, 22 nt, Bordetella pertussis
aucaaggaagucgugugggacg

SEQ ID NO: 502 - RNA, 22 nt, Bordetella pertussis
aucaaggucgagcggccgggcg

SEQ ID NO: 503 - RNA, 22 nt, Bordetella pertussis
aucaccgggccggcuucaugca

SEQ ID NO: 504 - RNA, 18 nt, Bordetella pertussis
aucagcagaaugccgugc

SEQ ID NO: 505 - RNA, 21 nt, Bordetella pertussis
aucagcgcgaucagggugaac

SEQ ID NO: 506 - RNA, 22 nt, Bordetella pertussis
aucagcggccuguugcgcgugg

SEQ ID NO: 507 - RNA, 20 nt, Bordetella pertussis
aucaggccaucgccagcggc

SEQ ID NO: 508 - RNA, 22 nt, Bordetella pertussis
aucauggcgguacgggucacgc

SEQ ID NO: 509 - RNA, 22 nt, Bordetella pertussis
auccaguuucgcgacgugggcg

SEQ ID NO: 510 - RNA, 22 nt, Bordetella pertussis
auccgagagcaugcccacgacg

SEQ ID NO: 511 - RNA, 23 nt, Bordetella pertussis
auccucaagcaugcgcgagcgcg

SEQ ID NO: 512 - RNA, 22 nt, Bordetella pertussis
aucgaagucggauucgcgcauc

SEQ ID NO: 513 - RNA, 22 nt, Bordetella pertussis
aucgaugagcacgguuccguca

SEQ ID NO: 514 - RNA, 22 nt, Bordetella pertussis
aucgcaggaauugcguguacca

SEQ ID NO: 515 - RNA, 22 nt, Bordetella pertussis
aucgcgcugguagcgguaggcc

SEQ ID NO: 516 - RNA, 22 nt, Bordetella pertussis
aucgugcugaaguacggcgagc

SEQ ID NO: 517 - RNA, 22 nt, Bordetella pertussis
aucgugcugaucggauugggcg

SEQ ID NO: 518 - RNA, 22 nt, Bordetella pertussis
aucugguccaucaggaugcggg

SEQ ID NO: 519 - RNA, 22 nt, Bordetella pertussis
augaccaggguggcgucggcgg

SEQ ID NO: 520 - RNA, 21 nt, Bordetella pertussis
augaccgcaucgggcguccug

SEQ ID NO: 521 - RNA, 22 nt, Bordetella pertussis
augacgguggcgcccagcgccc

SEQ ID NO: 522 - RNA, 22 nt, Bordetella pertussis
augaugcgguugcuuucgcgca

SEQ ID NO: 523 - RNA, 22 nt, Bordetella pertussis
augauggcgaacaucaacuccu

SEQ ID NO: 524 - RNA, 22 nt, Bordetella pertussis
augcgccuggauucgggugucg

SEQ ID NO: 525 - RNA, 22 nt, Bordetella pertussis
augcugcugcugaucggcguau

SEQ ID NO: 526 - RNA, 22 nt, Bordetella pertussis
augcuguccagcgcguuccauu

SEQ ID NO: 527 - RNA, 22 nt, Bordetella pertussis
augcuguuguacgccaccgauu

SEQ ID NO: 528 - RNA, 22 nt, Bordetella pertussis
auggagaaugaaccgucagcga

SEQ ID NO: 529 - RNA, 22 nt, Bordetella pertussis
auggccgucaucgccgccugca

SEQ ID NO: 530 - RNA, 22 nt, Bordetella pertussis
auggcgaugcuuguuauugugg

SEQ ID NO: 531 - RNA, 18 nt, Bordetella pertussis
auggcgcugacggcccgc

SEQ ID NO: 532 - RNA, 22 nt, Bordetella pertussis
auggcgcuggagaugcuguugc

SEQ ID NO: 533 - RNA, 22 nt, Bordetella pertussis
auggcgggcaaaaaccuucagg

SEQ ID NO: 534 - RNA, 22 nt, Bordetella pertussis
auggcggugcagcgccaggucg

SEQ ID NO: 535 - RNA, 22 nt, Bordetella pertussis
auggcguugcccaccggcaggu

SEQ ID NO: 536 - RNA, 22 nt, Bordetella pertussis
auggcucagcucgcgcagcaug

SEQ ID NO: 537 - RNA, 22 nt, Bordetella pertussis
augggaucgugcaccgccggcg

SEQ ID NO: 538 - RNA, 22 nt, Bordetella pertussis
augggccagaugagcggcgagg

SEQ ID NO: 539 - RNA, 22 nt, Bordetella pertussis
auggggaugcaccaacuggcgc

SEQ ID NO: 540 - RNA, 22 nt, Bordetella pertussis
auggguaucgcgcaccaguugg

SEQ ID NO: 541 - RNA, 22 nt, Bordetella pertussis
auggucacgccgucauccggcu

SEQ ID NO: 542 - RNA, 22 nt, Bordetella pertussis
auggucaugccgucgcgcgcca

SEQ ID NO: 543 - RNA, 22 nt, Bordetella pertussis
augguggaccagcucgggcugg

SEQ ID NO: 544 - RNA, 22 nt, Bordetella pertussis
augucgaagcuggcgcaggccg

SEQ ID NO: 545 - RNA, 22 nt, Bordetella pertussis
augucugauacagccgccagug

SEQ ID NO: 546 - RNA, 22 nt, Bordetella pertussis
augugcagcgccaccaggcugg

SEQ ID NO: 547 - RNA, 22 nt, Bordetella pertussis
augugcgguuggccgaggcgcc

SEQ ID NO: 548 - RNA, 22 nt, Bordetella pertussis
auucgcgcaugggcgaugggcg

SEQ ID NO: 549 - RNA, 22 nt, Bordetella pertussis
auucugggccuaucugcccggg

SEQ ID NO: 550 - RNA, 22 nt, Bordetella pertussis
auugcccguucugccgccaugc

SEQ ID NO: 551 - RNA, 22 nt, Bordetella pertussis
caagccuguccuggacacgguc

SEQ ID NO: 552 - RNA, 22 nt, Bordetella pertussis
caagggccagguugguuuuccc

SEQ ID NO: 553 - RNA, 22 nt, Bordetella pertussis
caaggugccgucggccucgaug

SEQ ID NO: 554 - RNA, 22 nt, Bordetella pertussis
aggagcgcugcaucgcgugcaa

SEQ ID NO: 555 - RNA, 22 nt, Bordetella pertussis
aggauguugaagauggugcgca

SEQ ID NO: 556 - RNA, 22 nt, Bordetella pertussis
aggcaguucguacgcgcggccg

SEQ ID NO: 557 - RNA, 22 nt, Bordetella pertussis
aggccaccaagaauucgaugcc

SEQ ID NO: 558 - RNA, 22 nt, Bordetella pertussis
aggccacgacuucggcgcccag

SEQ ID NO: 559 - RNA, 22 nt, Bordetella pertussis
aggccgaagcggcgcugcuggc

SEQ ID NO: 560 - RNA, 22 nt, Bordetella pertussis
aggccgcgacauccaccgacca

SEQ ID NO: 561 - RNA, 22 nt, Bordetella pertussis
aggccgcgcccgggcauguccg

SEQ ID NO: 562 - RNA, 22 nt, Bordetella pertussis
aggccggcgcggccgggucuuc

SEQ ID NO: 563 - RNA, 22 nt, Bordetella pertussis
aggccgucaucgcggcgcaucc

SEQ ID NO: 564 - RNA, 22 nt, Bordetella pertussis
agggacgcggucugcgccuuga

SEQ ID NO: 565 - RNA, 22 nt, Bordetella pertussis
agggcgccgguguaauaggcau

SEQ ID NO: 566 - RNA, 22 nt, Bordetella pertussis
cagaucgacgaccucgcgcaug

SEQ ID NO: 567 - RNA, 22 nt, Bordetella pertussis
cagcagcgauggcccgcuggcg

SEQ ID NO: 568 - RNA, 23 nt, Bordetella pertussis
cagccuggcgaugaucacgcugg

SEQ ID NO: 569 - RNA, 22 nt, Bordetella pertussis
cagcgcggcgaacauggugcug

SEQ ID NO: 570 - RNA, 22 nt, Bordetella pertussis
cagcgcgucaacgcggugaccg

SEQ ID NO: 571 - RNA, 22 nt, Bordetella pertussis
cagcgggagccuguccccgcgg

SEQ ID NO: 572 - RNA, 22 nt, Bordetella pertussis
cagcgucuccaggaagccggcg

SEQ ID NO: 573 - RNA, 22 nt, Bordetella pertussis
caggccagguuccugggcgcgc

SEQ ID NO: 574 - RNA, 22 nt, Bordetella pertussis
caggcccugcugcuggaauugc

SEQ ID NO: 575 - RNA, 22 nt, Bordetella pertussis
caggcccuggccgaccgguauc

SEQ ID NO: 576 - RNA, 22 nt, Bordetella pertussis
cagggcaucgaggaagcccugg

SEQ ID NO: 577 - RNA, 22 nt, Bordetella pertussis
cagguagucgcacagcgcccgc

SEQ ID NO: 578 - RNA, 22 nt, Bordetella pertussis
caggucaaggugcgcgcggagc

SEQ ID NO: 579 - RNA, 22 nt, Bordetella pertussis
caggucgacgaagcguucgaug

SEQ ID NO: 580 - RNA, 22 nt, Bordetella pertussis
caguccgucggucgagcaggau

SEQ ID NO: 581 - RNA, 22 nt, Bordetella pertussis
cagucgaucuacgccggcaucc

SEQ ID NO: 582 - RNA, 22 nt, Bordetella pertussis
caucgacacgcucagcgccgug

SEQ ID NO: 583 - RNA, 22 nt, Bordetella pertussis
caucgccucgcucgacgcgcug

SEQ ID NO: 584 - RNA, 22 nt, Bordetella pertussis
caucgucaagcuggcgcuggac

SEQ ID NO: 585 - RNA, 22 nt, Bordetella pertussis
caucuggaccuugcagaucgcc

SEQ ID NO: 586 - RNA, 22 nt, Bordetella pertussis
caugccuaugucaaccgccuga

SEQ ID NO: 587 - RNA, 22 nt, Bordetella pertussis
caugcgcgaggucgucgaucug

SEQ ID NO: 588 - RNA, 22 nt, Bordetella pertussis
cauggcagaccgucacgcgcag

SEQ ID NO: 589 - RNA, 21 nt, Bordetella pertussis
cauggcggccagguuggucag

SEQ ID NO: 590 - RNA, 22 nt, Bordetella pertussis
cauguucgaagagcagcgcgcc

SEQ ID NO: 591 - RNA, 22 nt, Bordetella pertussis
ccaaaugacccuugccuauccc

SEQ ID NO: 592 - RNA, 22 nt, Bordetella pertussis
ccaccaggaugcuggcgaugau

SEQ ID NO: 593 - RNA, 22 nt, Bordetella pertussis
ccacccgggccgcggucgacgc

SEQ ID NO: 594 - RNA, 22 nt, Bordetella pertussis
ccacccuggccagacugcgcgc

SEQ ID NO: 595 - RNA, 22 nt, Bordetella pertussis
ccacgcccgaguucguccgguu

SEQ ID NO: 596 - RNA, 22 nt, Bordetella pertussis
ccacgccgcuguccaggcagau

SEQ ID NO: 597 - RNA, 22 nt, Bordetella pertussis
ccacggacacgggcauggccac

SEQ ID NO: 598 - RNA, 22 nt, Bordetella pertussis
ccacggcuuccauggccgcacg

SEQ ID NO: 599 - RNA, 22 nt, Bordetella pertussis
ccagacgcggcgcuacgccgac

SEQ ID NO: 600 - RNA, 22 nt, Bordetella pertussis
ccagcagcagcgcguggcgcug

SEQ ID NO: 601 - RNA, 22 nt, Bordetella pertussis
ccagcgccugauccaugaauug

SEQ ID NO: 602 - RNA, 22 nt, Bordetella pertussis
ccagcgugcaugagcagggaca

SEQ ID NO: 603 - RNA, 22 nt, Bordetella pertussis
ccaggcacggaaggccggcguu

SEQ ID NO: 604 - RNA, 22 nt, Bordetella pertussis
ccaggcccagcaguccggcggu

SEQ ID NO: 605 - RNA, 19 nt, Bordetella pertussis
ccaggccggccuggccaug

SEQ ID NO: 606 - RNA, 22 nt, Bordetella pertussis
ccaggcggccagcacggcggga

SEQ ID NO: 607 - RNA, 22 nt, Bordetella pertussis
ccagggacgggagggugccgaa

SEQ ID NO: 608 - RNA, 22 nt, Bordetella pertussis
ccagggcuuccucgaugcccug

SEQ ID NO: 609 - RNA, 22 nt, Bordetella pertussis
ccauccucaacgagccguucgu

SEQ ID NO: 610 - RNA, 22 nt, Bordetella pertussis
ccaucgaacuguuccagcccga

SEQ ID NO: 611 - RNA, 22 nt, Bordetella pertussis
ccaugcugagucgguaguucug

SEQ ID NO: 612 - RNA, 22 nt, Bordetella pertussis
ccaugcuguaucgcgacuacag

SEQ ID NO: 613 - RNA, 22 nt, Bordetella pertussis
ccauggcgaucugcgcgccuuc

SEQ ID NO: 614 - RNA, 22 nt, Bordetella pertussis
ccaugguggaaggcaauccgga

SEQ ID NO: 615 - RNA, 22 nt, Bordetella pertussis
cccagcgugucguugaggccca

SEQ ID NO: 616 - RNA, 22 nt, Bordetella pertussis
cccagcuggccgagcugauccg

SEQ ID NO: 617 - RNA, 22 nt, Bordetella pertussis
cccaguucgggggucaggucca

SEQ ID NO: 618 - RNA, 22 nt, Bordetella pertussis
cccaucucgaagaagcguccca

SEQ ID NO: 619 - RNA, 21 nt, Bordetella pertussis
ccccggcaacccgcugggcgc

SEQ ID NO: 620 - RNA, 22 nt, Bordetella pertussis
cccgccuggaagcgcuugcgcg

SEQ ID NO: 621 - RNA, 22 nt, Bordetella pertussis
cccggaaaucgcggcagucggg

SEQ ID NO: 622 - RNA, 22 nt, Bordetella pertussis
cccggccgaacugcugggugua

SEQ ID NO: 623 - RNA, 22 nt, Bordetella pertussis
cccggcgcuaagcaccccggug

SEQ ID NO: 624 - RNA, 20 nt, Bordetella pertussis
cccuggucggugugcacgcc

SEQ ID NO: 625 - RNA, 22 nt, Bordetella pertussis
cccuggugugguucgcccaggg

SEQ ID NO: 626 - RNA, 22 nt, Bordetella pertussis
ccgaccagcagccgguauaugg

SEQ ID NO: 627 - RNA, 19 nt, Bordetella pertussis
ccgaccuggcgcuauggcu

SEQ ID NO: 628 - RNA, 22 nt, Bordetella pertussis
ccgacgaauugcagcgccagcu

SEQ ID NO: 629 - RNA, 22 nt, Bordetella pertussis
ccgagcugugcgucuugccgcg

SEQ ID NO: 630 - RNA, 22 nt, Bordetella pertussis
ccgaucuucagcuugugcucgc

SEQ ID NO: 631 - RNA, 22 nt, Bordetella pertussis
ccgcagccguugaucugguuca

SEQ ID NO: 632 - RNA, 22 nt, Bordetella pertussis
ccgccgagcaguucauccaggc

SEQ ID NO: 633 - RNA, 22 nt, Bordetella pertussis
ccgcgcagccguaggcgcucag

SEQ ID NO: 634 - RNA, 22 nt, Bordetella pertussis
ccgcgccgggguccggauacug

SEQ ID NO: 635 - RNA, 22 nt, Bordetella pertussis
ccgcgccugguauuucucgagg

SEQ ID NO: 636 - RNA, 22 nt, Bordetella pertussis
ccgcggauugcagggccaguac

SEQ ID NO: 637 - RNA, 22 nt, Bordetella pertussis
ccgcuggucacgaagggcuuuu

SEQ ID NO: 638 - RNA, 22 nt, Bordetella pertussis
ccgcugugcagcgaugugacgc

SEQ ID NO: 639 - RNA, 22 nt, Bordetella pertussis
ccggaucauaagcaauugccgg

SEQ ID NO: 640 - RNA, 22 nt, Bordetella pertussis
ccggauggcggaagucgaucga

SEQ ID NO: 641 - RNA, 22 nt, Bordetella pertussis
ccggccggugcucgaugccgcc

SEQ ID NO: 642 - RNA, 22 nt, Bordetella pertussis
ccggccugaggcccgauggcgg

SEQ ID NO: 643 - RNA, 20 nt, Bordetella pertussis
ccggcugaaggccgcgcccg

SEQ ID NO: 644 - RNA, 22 nt, Bordetella pertussis
ccgggccggcuacagcucgccg

SEQ ID NO: 645 - RNA, 22 nt, Bordetella pertussis
ccgggugccggccgaggcgcug

SEQ ID NO: 646 - RNA, 22 nt, Bordetella pertussis
caccaucgucacgcugcugugc

SEQ ID NO: 647 - RNA, 22 nt, Bordetella pertussis
caccgguccgcaaugggcggga

SEQ ID NO: 648 - RNA, 22 nt, Bordetella pertussis
caccucgagcguggccggauug

SEQ ID NO: 649 - RNA, 22 nt, Bordetella pertussis
caccuggcuggagccggcgcgg

SEQ ID NO: 650 - RNA, 22 nt, Bordetella pertussis
cacgcccgggccgcugugccac

SEQ ID NO: 651 - RNA, 20 nt, Bordetella pertussis
cacgcgcgccgaauucggcc

SEQ ID NO: 652 - RNA, 22 nt, Bordetella pertussis
cacgcgggucgagguauugugc

SEQ ID NO: 653 - RNA, 22 nt, Bordetella pertussis
cacgggcauccucgaagcccag

SEQ ID NO: 654 - RNA, 22 nt, Bordetella pertussis
cacgguggugccccacagcgcc

SEQ ID NO: 655 - RNA, 22 nt, Bordetella pertussis
cacgucaucguggccggcgccg

SEQ ID NO: 656 - RNA, 22 nt, Bordetella pertussis
ccugaaccaccugaugucgcug

SEQ ID NO: 657 - RNA, 22 nt, Bordetella pertussis
ccugaugaugaucgcgcuguac

SEQ ID NO: 658 - RNA, 22 nt, Bordetella pertussis
ccugcggcgccagccucacgcu

SEQ ID NO: 659 - RNA, 22 nt, Bordetella pertussis
ccugcugcagucgcccuauggc

SEQ ID NO: 660 - RNA, 22 nt, Bordetella pertussis
ccugcuggcgcacgaugaacug

SEQ ID NO: 661 - RNA, 22 nt, Bordetella pertussis
ccuggccacgcugcuggccgag

SEQ ID NO: 662 - RNA, 22 nt, Bordetella pertussis
ccugggcgaaguagcgcuggug

SEQ ID NO: 663 - RNA, 22 nt, Bordetella pertussis
ccuguauggcgcugauggccgg

SEQ ID NO: 664 - RNA, 22 nt, Bordetella pertussis
ccuguccucaugcgggacaggc

SEQ ID NO: 665 - RNA, 22 nt, Bordetella pertussis
ccugugccagcgccucgucgaa

SEQ ID NO: 666 - RNA, 22 nt, Bordetella pertussis
cgaacgccgaugucgacccgcu

SEQ ID NO: 667 - RNA, 22 nt, Bordetella pertussis
cgacaggccgcucuuggugaug

SEQ ID NO: 668 - RNA, 22 nt, Bordetella pertussis
cgaccagaucaugcgcuugggu

SEQ ID NO: 669 - RNA, 22 nt, Bordetella pertussis
cgaccuugaucuugcuggcguc

SEQ ID NO: 670 - RNA, 22 nt, Bordetella pertussis
cgacgaaguugccgugccccug

SEQ ID NO: 671 - RNA, 22 nt, Bordetella pertussis
cgacgcgggcgcguuggugcug

SEQ ID NO: 672 - RNA, 22 nt, Bordetella pertussis
cgacggcgccggacaccaguug

SEQ ID NO: 673 - RNA, 22 nt, Bordetella pertussis
cgagaacaucuucuuguacggu

SEQ ID NO: 674 - RNA, 22 nt, Bordetella pertussis
cgagaacgggcaggugguuccg

SEQ ID NO: 675 - RNA, 22 nt, Bordetella pertussis
cgagcagcaugacguugugccg

SEQ ID NO: 676 - RNA, 18 nt, Bordetella pertussis
cgagccagucgcgcccgu

SEQ ID NO: 677 - RNA, 22 nt, Bordetella pertussis
cgaggaaaucgccuggugcagg

SEQ ID NO: 678 - RNA, 22 nt, Bordetella pertussis
cgaggccgaggucgaguacgcc

SEQ ID NO: 679 - RNA, 22 nt, Bordetella pertussis
cgaggcucgccuugaacgcugc

SEQ ID NO: 680 - RNA, 22 nt, Bordetella pertussis
cgaguggguggcgucgcugucg

SEQ ID NO: 681 - RNA, 22 nt, Bordetella pertussis
cgcaauguagccaagcccgcuu

SEQ ID NO: 682 - RNA, 20 nt, Bordetella pertussis
cgcaccgagggccuguccgc

SEQ ID NO: 683 - RNA, 22 nt, Bordetella pertussis
cgcacgcugaugcgccuugucg

SEQ ID NO: 684 - RNA, 22 nt, Bordetella pertussis
cgcagcucgugcgagacguugg

SEQ ID NO: 685 - RNA, 22 nt, Bordetella pertussis
cgccacggauugauguccagcc

SEQ ID NO: 686 - RNA, 22 nt, Bordetella pertussis
cgccacguggaugccggugaag

SEQ ID NO: 687 - RNA, 22 nt, Bordetella pertussis
cgccauccaguauugcacgcag

SEQ ID NO: 688 - RNA, 22 nt, Bordetella pertussis
cgccaugugcgacgaauccauc

SEQ ID NO: 689 - RNA, 22 nt, Bordetella pertussis
cgcccgacaacagcgugcccag

SEQ ID NO: 690 - RNA, 22 nt, Bordetella pertussis
cgcccgaguugcgcgaagcccu

SEQ ID NO: 691 - RNA, 22 nt, Bordetella pertussis
cgcccgcgccaucgcucccuuu

SEQ ID NO: 692 - RNA, 20 nt, Bordetella pertussis
cgccgacuuccugugcgcca

SEQ ID NO: 693 - RNA, 22 nt, Bordetella pertussis
cgccgcagugcugaccggcgac

SEQ ID NO: 694 - RNA, 22 nt, Bordetella pertussis
cgccgccccguaccgcaucagu

SEQ ID NO: 695 - RNA, 22 nt, Bordetella pertussis
cgccgcgucgaccuugaccgcg

SEQ ID NO: 696 - RNA, 22 nt, Bordetella pertussis
cgccggcaugggcgaggucacg

SEQ ID NO: 697 - RNA, 22 nt, Bordetella pertussis
cgccggccugcgccagcuucga

SEQ ID NO: 698 - RNA, 22 nt, Bordetella pertussis
cgccggugcgcagcuugguuuc

SEQ ID NO: 699 - RNA, 22 nt, Bordetella pertussis
cgccuggauccgcuuggccacg

SEQ ID NO: 700 - RNA, 18 nt, Bordetella pertussis
cgcgaucgaccucgcuga

SEQ ID NO: 701 - RNA, 23 nt, Bordetella pertussis
cgcgccagcuugauggcgccuuc

SEQ ID NO: 702 - RNA, 22 nt, Bordetella pertussis
cgcgcgacuucaacggcuuggu

SEQ ID NO: 703 - RNA, 22 nt, Bordetella pertussis
cgcgcgcuuguaggccuuguug

SEQ ID NO: 704 - RNA, 22 nt, Bordetella pertussis
cgcgcucaauccggagaucgcc

SEQ ID NO: 705 - RNA, 22 nt, Bordetella pertussis
cgcggccuacaucgacacggcc

SEQ ID NO: 706 - RNA, 22 nt, Bordetella pertussis
cgcggcgucguucggcauggug

SEQ ID NO: 707 - RNA, 22 nt, Bordetella pertussis
cgcggcgucuccagcgagccgg

SEQ ID NO: 708 - RNA, 22 nt, Bordetella pertussis
cgcggggucgucgagcugcgcc

SEQ ID NO: 709 - RNA, 22 nt, Bordetella pertussis
cgcggugguguagaugaaaccg

SEQ ID NO: 710 - RNA, 22 nt, Bordetella pertussis
cgcgucgaccuggcggugcgga

SEQ ID NO: 711 - RNA, 22 nt, Bordetella pertussis
cgcgucgaccuuggaauggacc

SEQ ID NO: 712 - RNA, 22 nt, Bordetella pertussis
cgcgucgaugccuucgccggcc

SEQ ID NO: 713 - RNA, 22 nt, Bordetella pertussis
cgcgugaacgugauccgcgacc

SEQ ID NO: 714 - RNA, 22 nt, Bordetella pertussis
cgcguguugcgcaggucggggc

SEQ ID NO: 715 - RNA, 22 nt, Bordetella pertussis
cgcucagcgggccgagcgacag

SEQ ID NO: 716 - RNA, 22 nt, Bordetella pertussis
cgcucgucggugcgcgaguauc

SEQ ID NO: 717 - RNA, 22 nt, Bordetella pertussis
cgcugaccgauaugcuggagca

SEQ ID NO: 718 - RNA, 22 nt, Bordetella pertussis
cgcugccggaaacccgggcuuu

SEQ ID NO: 719 - RNA, 22 nt, Bordetella pertussis
cgcugcgcuuuggcgacggcag

SEQ ID NO: 720 - RNA, 22 nt, Bordetella pertussis
cgcugcucaaucgucuggugca

SEQ ID NO: 721 - RNA, 21 nt, Bordetella pertussis
cgcuggacgacaucgccgcgc

SEQ ID NO: 722 - RNA, 22 nt, Bordetella pertussis
cgcuggugacgggcucggccgu

SEQ ID NO: 723 - RNA, 22 nt, Bordetella pertussis
cgcugugggccagcuugaggua

SEQ ID NO: 724 - RNA, 22 nt, Bordetella pertussis
cggauuccauacaagggcgcgg

SEQ ID NO: 725 - RNA, 22 nt, Bordetella pertussis
cggcagcaucgucagcggcgug

SEQ ID NO: 726 - RNA, 22 nt, Bordetella pertussis
cggcaggauaucgauguagcgc

SEQ ID NO: 727 - RNA, 22 nt, Bordetella pertussis
cggcaggcguacggccagcgca

SEQ ID NO: 728 - RNA, 22 nt, Bordetella pertussis
cggccgaaggucaugcgguucu

SEQ ID NO: 729 - RNA, 22 nt, Bordetella pertussis
cggccgagucggccggcgugca

SEQ ID NO: 730 - RNA, 22 nt, Bordetella pertussis
cggccgcagcucgaggcgcugg

SEQ ID NO: 731 - RNA, 22 nt, Bordetella pertussis
cggccgcgaaggugaacgggcc

SEQ ID NO: 732 - RNA, 22 nt, Bordetella pertussis
cggccuggaagucggcguggac

SEQ ID NO: 733 - RNA, 22 nt, Bordetella pertussis
cggccuuguucgccgaccggcg

SEQ ID NO: 734 - RNA, 22 nt, Bordetella pertussis
cggcgacaggccggccagaugg

SEQ ID NO: 735 - RNA, 19 nt, Bordetella pertussis
cggcgacgggcugucggug

SEQ ID NO: 736 - RNA, 22 nt, Bordetella pertussis
cggcgagugcgccgccagcagg

SEQ ID NO: 737 - RNA, 22 nt, Bordetella pertussis
cggcgauaugauggaagacggu

SEQ ID NO: 738 - RNA, 22 nt, Bordetella pertussis
cggcgcgcugaccucgcuggcc

SEQ ID NO: 739 - RNA, 22 nt, Bordetella pertussis
cggcgcgcuggccauggacgcc

SEQ ID NO: 740 - RNA, 22 nt, Bordetella pertussis
cggcggcggccaacuggcgcca

SEQ ID NO: 741 - RNA, 22 nt, Bordetella pertussis
cggcuugagcgucggauccagg

SEQ ID NO: 742 - RNA, 22 nt, Bordetella pertussis
cgggcgcgacaucagcgccgug

SEQ ID NO: 743 - RNA, 22 nt, Bordetella pertussis
cgggcgguuucuucaagcgcga

SEQ ID NO: 744 - RNA, 22 nt, Bordetella pertussis
cgggcguggccaucagucggcc

SEQ ID NO: 745 - RNA, 22 nt, Bordetella pertussis
cgggcuugagcacgaccuggua

SEQ ID NO: 746 - RNA, 22 nt, Bordetella pertussis
ccggucaggaaggcugugggaa

SEQ ID NO: 747 - RNA, 22 nt, Bordetella pertussis
ccggucuauaccgugcccaugc

SEQ ID NO: 748 - RNA, 22 nt, Bordetella pertussis
ccgguggauuucgggcgccugc

SEQ ID NO: 749 - RNA, 22 nt, Bordetella pertussis
ccgguguugaagucgcgcggcg

SEQ ID NO: 750 - RNA, 22 nt, Bordetella pertussis
ccgucgccucccagcuccaugg

SEQ ID NO: 751 - RNA, 22 nt, Bordetella pertussis
ccgucgcgcccuggugcgcguc

SEQ ID NO: 752 - RNA, 22 nt, Bordetella pertussis
ccgugcacgcacaugggcaacc

SEQ ID NO: 753 - RNA, 22 nt, Bordetella pertussis
ccguucggaauguccagcgaca

SEQ ID NO: 754 - RNA, 22 nt, Bordetella pertussis
ccguugcagcaccgccuggccg

SEQ ID NO: 755 - RNA, 22 nt, Bordetella pertussis
ccguuguccagcacgcgcaggc

SEQ ID NO: 756 - RNA, 22 nt, Bordetella pertussis
ccguuguggaaauugaaggccu

SEQ ID NO: 757 - RNA, 22 nt, Bordetella pertussis
ccucgaggccacgcaggggccc

SEQ ID NO: 758 - RNA, 22 nt, Bordetella pertussis
ccucgggcaccacggcagcgac

SEQ ID NO: 759 - RNA, 22 nt, Bordetella pertussis
ccugaucccgcuggucgaccau

SEQ ID NO: 760 - RNA, 22 nt, Bordetella pertussis
ccugcgcgucgauugggaugag

SEQ ID NO: 761 - RNA, 23 nt, Bordetella pertussis
ccugcgucaaaggggaggcggcc

SEQ ID NO: 762 - RNA, 22 nt, Bordetella pertussis
ccugcucggcggucaguucgcc

SEQ ID NO: 763 - RNA, 18 nt, Bordetella pertussis
ccugcugcgccagcgcgc

SEQ ID NO: 764 - RNA, 22 nt, Bordetella pertussis
ccuggccgacggcgauggcguc

SEQ ID NO: 765 - RNA, 22 nt, Bordetella pertussis
ccuggccgggcuguucgagcgg

SEQ ID NO: 766 - RNA, 22 nt, Bordetella pertussis
ccuggccucgagcaugagccug

SEQ ID NO: 767 - RNA, 22 nt, Bordetella pertussis
ccuggcgcaggacccgucguuc

SEQ ID NO: 768 - RNA, 22 nt, Bordetella pertussis
ccuggcugcccacuucgcggua

SEQ ID NO: 769 - RNA, 22 nt, Bordetella pertussis
ccuggcuguacuuggacaucga

SEQ ID NO: 770 - RNA, 23 nt, Bordetella pertussis
ccugggccggcgcgauuuccuug

SEQ ID NO: 771 - RNA, 22 nt, Bordetella pertussis
ccugggcgaagucuucguucuc

SEQ ID NO: 772 - RNA, 22 nt, Bordetella pertussis
ccugggcgcccuugggcgagac

SEQ ID NO: 773 - RNA, 22 nt, Bordetella pertussis
ccugguggcgcuggcgaugcug

SEQ ID NO: 774 - RNA, 22 nt, Bordetella pertussis
ccuguccccgcggggacggaua

SEQ ID NO: 775 - RNA, 22 nt, Bordetella pertussis
ccuguccgacccgcagguggug

SEQ ID NO: 776 - RNA, 22 nt, Bordetella pertussis
ccuguucggcaacggcgagcgc

SEQ ID NO: 777 - RNA, 22 nt, Bordetella pertussis
ccuguucggucagcaguuccau

SEQ ID NO: 778 - RNA, 22 nt, Bordetella pertussis
ccuuccgcauacagcgugucga

SEQ ID NO: 779 - RNA, 22 nt, Bordetella pertussis
cgaacuggccaucgucaucggc

SEQ ID NO: 780 - RNA, 21 nt, Bordetella pertussis
cgaagaauacgcugacgucgu

SEQ ID NO: 781 - RNA, 22 nt, Bordetella pertussis
cgaagcacaugauggacaggcc

SEQ ID NO: 782 - RNA, 22 nt, Bordetella pertussis
cgaccagcaucgcaugcguacc

SEQ ID NO: 783 - RNA, 23 nt, Bordetella pertussis
cgacgccacccuggaggcggccg

SEQ ID NO: 784 - RNA, 14 nt, Bordetella pertussis
cgacgccaucguca

SEQ ID NO: 785 - RNA, 22 nt, Bordetella pertussis
cgacggccagacgcguuacgcg

SEQ ID NO: 786 - RNA, 21 nt, Bordetella pertussis
cgacuccgagaugaccguggu

SEQ ID NO: 787 - RNA, 22 nt, Bordetella pertussis
cgacuucggcgaucucaucggu

SEQ ID NO: 788 - RNA, 22 nt, Bordetella pertussis
cgagaucacccugcugacggug

SEQ ID NO: 789 - RNA, 22 nt, Bordetella pertussis
cgagccgaccagcggcgugggg

SEQ ID NO: 790 - RNA, 22 nt, Bordetella pertussis
cgagcggcgcuccauggugggc

SEQ ID NO: 791 - RNA, 22 nt, Bordetella pertussis
cgagcuguucgucgacgcggug

SEQ ID NO: 792 - RNA, 22 nt, Bordetella pertussis
cgaggccagccaauugcgggcc

SEQ ID NO: 793 - RNA, 22 nt, Bordetella pertussis
cgaguugccgaccgacaugguc

SEQ ID NO: 794 - RNA, 22 nt, Bordetella pertussis
cgaucgccuguuacauggccga

SEQ ID NO: 795 - RNA, 22 nt, Bordetella pertussis
cgaugccgaugccgcagccgcc

SEQ ID NO: 796 - RNA, 22 nt, Bordetella pertussis
cgauggcggccaccguggcuuc

SEQ ID NO: 797 - RNA, 22 nt, Bordetella pertussis
cgcacaccacccugcagccggg

SEQ ID NO: 798 - RNA, 22 nt, Bordetella pertussis
cgcacccuggaagucgaggcca

SEQ ID NO: 799 - RNA, 22 nt, Bordetella pertussis
cgcacgaugucguggccgucgg

SEQ ID NO: 800 - RNA, 22 nt, Bordetella pertussis
cgcagcguggugcucucggugc

SEQ ID NO: 801 - RNA, 22 nt, Bordetella pertussis
cgcaguggaauccaacgaugcc

SEQ ID NO: 802 - RNA, 22 nt, Bordetella pertussis
cgcaguggcccagcguguugac

SEQ ID NO: 803 - RNA, 19 nt, Bordetella pertussis
cgcauggugacgaucugua

SEQ ID NO: 804 - RNA, 23 nt, Bordetella pertussis
cgccaaccugcuguauucgccgc

SEQ ID NO: 805 - RNA, 21 nt, Bordetella pertussis
cgccaaggacguggugcugca

SEQ ID NO: 806 - RNA, 22 nt, Bordetella pertussis
cgccaaggccggccugggccag

SEQ ID NO: 807 - RNA, 22 nt, Bordetella pertussis
cgccaccacccugaucgcccug

SEQ ID NO: 808 - RNA, 22 nt, Bordetella pertussis
cgccaccucggacggcuacgug

SEQ ID NO: 809 - RNA, 22 nt, Bordetella pertussis
cgccagcgggccaucgcugcug

SEQ ID NO: 810 - RNA, 22 nt, Bordetella pertussis
cgccauccgcuuccagggcagc

SEQ ID NO: 811 - RNA, 22 nt, Bordetella pertussis
cgccauccuccagcuccagcag

SEQ ID NO: 812 - RNA, 22 nt, Bordetella pertussis
cgccaugaguuucgauccgcgg

SEQ ID NO: 813 - RNA, 22 nt, Bordetella pertussis
cgccauugagcgccacgcugcu

SEQ ID NO: 814 - RNA, 22 nt, Bordetella pertussis
cgcccugguacgugccuugcca

SEQ ID NO: 815 - RNA, 22 nt, Bordetella pertussis
cgcccuguauccguaucucgau

SEQ ID NO: 816 - RNA, 22 nt, Bordetella pertussis
cgccgacggcacgaucucgggc

SEQ ID NO: 817 - RNA, 22 nt, Bordetella pertussis
cgccgacggccagcccauccgc

SEQ ID NO: 818 - RNA, 22 nt, Bordetella pertussis
cgccgcuucggcugcgaucugu

SEQ ID NO: 819 - RNA, 22 nt, Bordetella pertussis
cgccgguucggcaggcguggcg

SEQ ID NO: 820 - RNA, 22 nt, Bordetella pertussis
cgccucgccgcugaacaguuuc

SEQ ID NO: 821 - RNA, 22 nt, Bordetella pertussis
cgccucguagguguggcgguuc

SEQ ID NO: 822 - RNA, 22 nt, Bordetella pertussis
cgccugagcgagcccagcgugc

SEQ ID NO: 823 - RNA, 22 nt, Bordetella pertussis
cgccugcaguccaugcgcggau

SEQ ID NO: 824 - RNA, 22 nt, Bordetella pertussis
cgccuggcccacaucgucgcgc

SEQ ID NO: 825 - RNA, 22 nt, Bordetella pertussis
cgccuucucgacguugagcacc

SEQ ID NO: 826 - RNA, 22 nt, Bordetella pertussis
cgcgacgacgaguauggcggca

SEQ ID NO: 827 - RNA, 22 nt, Bordetella pertussis
cgcgacgucuggcugacggcuu

SEQ ID NO: 828 - RNA, 22 nt, Bordetella pertussis
cgcgagaucgucgacauggcgc

SEQ ID NO: 829 - RNA, 22 nt, Bordetella pertussis
cgcgaugaaucccgaccgacug

SEQ ID NO: 830 - RNA, 22 nt, Bordetella pertussis
gaggccgucuuuggcguauggg

SEQ ID NO: 831 - RNA, 22 nt, Bordetella pertussis
gagugccugcugcagcggcugg

SEQ ID NO: 832 - RNA, 22 nt, Bordetella pertussis
gaguucagccccccggcuugcc

SEQ ID NO: 833 - RNA, 22 nt, Bordetella pertussis
gaucuccaucagccauugcggu

SEQ ID NO: 834 - RNA, 22 nt, Bordetella pertussis
gaucuguugcuggucgaucgcg

SEQ ID NO: 835 - RNA, 22 nt, Bordetella pertussis
gaugaagaucgacagcacgccg

SEQ ID NO: 836 - RNA, 22 nt, Bordetella pertussis
cgcgcgcugaccggcaggucuu

SEQ ID NO: 837 - RNA, 22 nt, Bordetella pertussis
cgcgcgggucggacuggccgcc

SEQ ID NO: 838 - RNA, 22 nt, Bordetella pertussis
cgcggcaucccguacgccgccu

SEQ ID NO: 839 - RNA, 22 nt, Bordetella pertussis
cgcggccucguggacgcgcugg

SEQ ID NO: 840 - RNA, 22 nt, Bordetella pertussis
cgcguccuccgucgcugcgcuc

SEQ ID NO: 841 - RNA, 21 nt, Bordetella pertussis
cgcgucuugcgauccagggcg

SEQ ID NO: 842 - RNA, 22 nt, Bordetella pertussis
cgcguucguuggaguacgacca

SEQ ID NO: 843 - RNA, 16 nt, Bordetella pertussis
cgcucgaucauggugc

SEQ ID NO: 844 - RNA, 22 nt, Bordetella pertussis
cgcuggcgguuucggcgggcag

SEQ ID NO: 845 - RNA, 22 nt, Bordetella pertussis
cgcugggcaucgccaagcugga

SEQ ID NO: 846 - RNA, 22 nt, Bordetella pertussis
cgcuggucggcaccggcgucga

SEQ ID NO: 847 - RNA, 22 nt, Bordetella pertussis
cgcugguggccacgccacgcag

SEQ ID NO: 848 - RNA, 22 nt, Bordetella pertussis
cgcuguuccugcugacgcuggc

SEQ ID NO: 849 - RNA, 22 nt, Bordetella pertussis
cgcuugcugggugacgacuuca

SEQ ID NO: 850 - RNA, 22 nt, Bordetella pertussis
cggacugcgggaccaguaucgc

SEQ ID NO: 851 - RNA, 22 nt, Bordetella pertussis
cggagggguaucguuuaccugg

SEQ ID NO: 852 - RNA, 17 nt, Bordetella pertussis
cggcacgcuucaccugu

SEQ ID NO: 853 - RNA, 22 nt, Bordetella pertussis
cggcagguugaaguugcucggc

SEQ ID NO: 854 - RNA, 22 nt, Bordetella pertussis
cggcaucgucaccgccgacaug

SEQ ID NO: 855 - RNA, 23 nt, Bordetella pertussis
cggcaugucauagcccaggucca

SEQ ID NO: 856 - RNA, 22 nt, Bordetella pertussis
cggccaggggauuggauucggu

SEQ ID NO: 857 - RNA, 22 nt, Bordetella pertussis
cggccagguugccgaucuuguc

SEQ ID NO: 858 - RNA, 22 nt, Bordetella pertussis
cggcccaguucuuggggaugag

SEQ ID NO: 859 - RNA, 21 nt, Bordetella pertussis
cggccgcgaagaccuggcgau

SEQ ID NO: 860 - RNA, 22 nt, Bordetella pertussis
cggccggccaaucuguucgucg

SEQ ID NO: 861 - RNA, 22 nt, Bordetella pertussis
cggccgggcuacugcgcgaccg

SEQ ID NO: 862 - RNA, 22 nt, Bordetella pertussis
cggccgugauggucgugcugcg

SEQ ID NO: 863 - RNA, 22 nt, Bordetella pertussis
cggccuguccaucaugugcuuc

SEQ ID NO: 864 - RNA, 22 nt, Bordetella pertussis
cggcgccaagcugaucagcgcc

SEQ ID NO: 865 - RNA, 22 nt, Bordetella pertussis
cggcgccaguugcgauggcggu

SEQ ID NO: 866 - RNA, 22 nt, Bordetella pertussis
cggcgccgauccggccggccag

SEQ ID NO: 867 - RNA, 22 nt, Bordetella pertussis
cggcgcgaacaaggucagcguc

SEQ ID NO: 868 - RNA, 22 nt, Bordetella pertussis
cggcgcugaugucgcgcccgug

SEQ ID NO: 869 - RNA, 22 nt, Bordetella pertussis
cggcggccgcguucucgugguu

SEQ ID NO: 870 - RNA, 21 nt, Bordetella pertussis
cggcgguggugcugugccagg

SEQ ID NO: 871 - RNA, 22 nt, Bordetella pertussis
cggcugguucauguggcguccg

SEQ ID NO: 872 - RNA, 22 nt, Bordetella pertussis
cgggcaagggcgggguguccua

SEQ ID NO: 873 - RNA, 19 nt, Bordetella pertussis
cgggccagcugcaggucga

SEQ ID NO: 874 - RNA, 22 nt, Bordetella pertussis
cgggccuggcccgccauccgcg

SEQ ID NO: 875 - RNA, 22 nt, Bordetella pertussis
cgggcguggugggcgcguccau

SEQ ID NO: 876 - RNA, 22 nt, Bordetella pertussis
cggggugccugucccagcgggg

SEQ ID NO: 877 - RNA, 22 nt, Bordetella pertussis
cggguugccgcugcaugggcgg

SEQ ID NO: 878 - RNA, 22 nt, Bordetella pertussis
cgguauucggcauuggcguugc

SEQ ID NO: 879 - RNA, 22 nt, Bordetella pertussis
cggucgucacaucggugaucgu

SEQ ID NO: 880 - RNA, 22 nt, Bordetella pertussis
cgguggucgccucgucgguggg

SEQ ID NO: 881 - RNA, 22 nt, Bordetella pertussis
cggugucggggguuaccgaggc

SEQ ID NO: 882 - RNA, 22 nt, Bordetella pertussis
cgguugcccgauucauuguggg

SEQ ID NO: 883 - RNA, 22 nt, Bordetella pertussis
cgguugcuccgcggaaucgggc

SEQ ID NO: 884 - RNA, 21 nt, Bordetella pertussis
cgguuucgucacggccugcgu

SEQ ID NO: 885 - RNA, 22 nt, Bordetella pertussis
cgucaugcgccuuguacuuggc

SEQ ID NO: 886 - RNA, 22 nt, Bordetella pertussis
cgucgaagaacggcgccacgac

SEQ ID NO: 887 - RNA, 22 nt, Bordetella pertussis
cgucgagcuggucggcgaagac

SEQ ID NO: 888 - RNA, 22 nt, Bordetella pertussis
cgucgccgcccaggcggaucga

SEQ ID NO: 889 - RNA, 22 nt, Bordetella pertussis
cgucgcggcugaguucggccac

SEQ ID NO: 890 - RNA, 22 nt, Bordetella pertussis
cgucgucggugaucagguagcg

SEQ ID NO: 891 - RNA, 22 nt, Bordetella pertussis
cgugaucggcaccugcucgcca

SEQ ID NO: 892 - RNA, 22 nt, Bordetella pertussis
cgugccgcgcgauccggacugc

SEQ ID NO: 893 - RNA, 22 nt, Bordetella pertussis
cgugcgucugcagugccagcuc

SEQ ID NO: 894 - RNA, 22 nt, Bordetella pertussis
cgugcuggccgauagaaaggcc

SEQ ID NO: 895 - RNA, 22 nt, Bordetella pertussis
cguggaugauggccucggcgcg

SEQ ID NO: 896 - RNA, 20 nt, Bordetella pertussis
cguggcauggccaucgccgc

SEQ ID NO: 897 - RNA, 22 nt, Bordetella pertussis
cguggcguucgugccggugggc

SEQ ID NO: 898 - RNA, 21 nt, Bordetella pertussis
cguggcuggcgcugccggugg

SEQ ID NO: 899 - RNA, 22 nt, Bordetella pertussis
cguguggaugcguucgucggcc

SEQ ID NO: 900 - RNA, 22 nt, Bordetella pertussis
cguguucaaggagcuggaagcc

SEQ ID NO: 901 - RNA, 22 nt, Bordetella pertussis
cguguugucgaucugguucaug

SEQ ID NO: 902 - RNA, 22 nt, Bordetella pertussis
cguucagcucgauggcgcggug

SEQ ID NO: 903 - RNA, 20 nt, Bordetella pertussis
cguuccuguaccagggcgcc

SEQ ID NO: 904 - RNA, 22 nt, Bordetella pertussis
cguucgcgcugcagcagcagcu

SEQ ID NO: 905 - RNA, 22 nt, Bordetella pertussis
cuacaacaugaagcugccgcca

SEQ ID NO: 906 - RNA, 22 nt, Bordetella pertussis
cuacgagugcgccgauggcgcc

SEQ ID NO: 907 - RNA, 22 nt, Bordetella pertussis
cuauggccguaguccugaccgg

SEQ ID NO: 908 - RNA, 22 nt, Bordetella pertussis
cuaugugcuggucaaggcggug

SEQ ID NO: 909 - RNA, 22 nt, Bordetella pertussis
cuauuguuuugguaaauggaaa

SEQ ID NO: 910 - RNA, 22 nt, Bordetella pertussis
cucaccauggugauuccgcugg

SEQ ID NO: 911 - RNA, 22 nt, Bordetella pertussis
cuccauggaaacgcccaucggu

SEQ ID NO: 912 - RNA, 22 nt, Bordetella pertussis
cuccgguggcgcaggcaugguu

SEQ ID NO: 913 - RNA, 22 nt, Bordetella pertussis
cucggccaccagcuugcgggca

SEQ ID NO: 914 - RNA, 22 nt, Bordetella pertussis
cucggcgauccacagccccucg

SEQ ID NO: 915 - RNA, 22 nt, Bordetella pertussis
cucgggcgucagcugcucgacc

SEQ ID NO: 916 - RNA, 22 nt, Bordetella pertussis
cucgggcucgccggaggcgccg

SEQ ID NO: 917 - RNA, 22 nt, Bordetella pertussis
cucgugcggcgugccgccguga

SEQ ID NO: 918 - RNA, 22 nt, Bordetella pertussis
cugaacuacugccaccugcuga

SEQ ID NO: 919 - RNA, 22 nt, Bordetella pertussis
cugaaguccuucgccgacaauu

SEQ ID NO: 920 - RNA, 22 nt, Bordetella pertussis
cugacggccaugauccagaagc

SEQ ID NO: 921 - RNA, 22 nt, Bordetella pertussis
cugaugucgccgaugccgccau

SEQ ID NO: 922 - RNA, 22 nt, Bordetella pertussis
gcgcccaggucggccaccaggu

SEQ ID NO: 923 - RNA, 22 nt, Bordetella pertussis
gcgcccgagaaaauguugauga

SEQ ID NO: 924 - RNA, 22 nt, Bordetella pertussis
gcgccgcccgagaagucgcuca

SEQ ID NO: 925 - RNA, 22 nt, Bordetella pertussis
gcgccgcuccccuuucgucccu

SEQ ID NO: 926 - RNA, 22 nt, Bordetella pertussis
cugcgccggcgacagcggcugg

SEQ ID NO: 927 - RNA, 22 nt, Bordetella pertussis
cugcgguuccggcuugggcugc

SEQ ID NO: 928 - RNA, 22 nt, Bordetella pertussis
cugcgugcaauacuggauggcg

SEQ ID NO: 929 - RNA, 22 nt, Bordetella pertussis
cugcucgagcagugccuuguca

SEQ ID NO: 930 - RNA, 22 nt, Bordetella pertussis
cugcugaucuggucggcgccgc

SEQ ID NO: 931 - RNA, 22 nt, Bordetella pertussis
cugcuggagcuggaggauggcg

SEQ ID NO: 932 - RNA, 22 nt, Bordetella pertussis
cugcugggcagcucuggcagcg

SEQ ID NO: 933 - RNA, 22 nt, Bordetella pertussis
cugcugucgaugcgcgccuggc

SEQ ID NO: 934 - RNA, 22 nt, Bordetella pertussis
cuggccaucaacggacgcagcg

SEQ ID NO: 935 - RNA, 22 nt, Bordetella pertussis
cuggcccagcggcagguaggug

SEQ ID NO: 936 - RNA, 22 nt, Bordetella pertussis
cuggccggcaaccaggcgccca

SEQ ID NO: 937 - RNA, 22 nt, Bordetella pertussis
cuggcgauccugcacgaugugc

SEQ ID NO: 938 - RNA, 22 nt, Bordetella pertussis
cuggcgccggcccggcgucaau

SEQ ID NO: 939 - RNA, 22 nt, Bordetella pertussis
cuggcgcgcguaugccgacagg

SEQ ID NO: 940 - RNA, 22 nt, Bordetella pertussis
cuggcgggugccggcggccacg

SEQ ID NO: 941 - RNA, 22 nt, Bordetella pertussis
cuggcguucggcaugcuggccg

SEQ ID NO: 942 - RNA, 22 nt, Bordetella pertussis
cugggcaccgacgugcugcgga

SEQ ID NO: 943 - RNA, 22 nt, Bordetella pertussis
cugggccuguguaucguggcgg

SEQ ID NO: 944 - RNA, 22 nt, Bordetella pertussis
cugggcuucgaggaugcccgug

SEQ ID NO: 945 - RNA, 22 nt, Bordetella pertussis
cugggcuugcgcuucggccgcc

SEQ ID NO: 946 - RNA, 22 nt, Bordetella pertussis
cuggugcucaagcugaucgacc

SEQ ID NO: 947 - RNA, 22 nt, Bordetella pertussis
cugguguuucgacuguggcucg

SEQ ID NO: 948 - RNA, 22 nt, Bordetella pertussis
cugguuguacuucgccaugcgg

SEQ ID NO: 949 - RNA, 22 nt, Bordetella pertussis
cugguuuuacgcugcgcggauu

SEQ ID NO: 950 - RNA, 22 nt, Bordetella pertussis
cugugccugcaggaggacagcg

SEQ ID NO: 951 - RNA, 22 nt, Bordetella pertussis
cuuauauaaugcgucacgcgcu

SEQ ID NO: 952 - RNA, 22 nt, Bordetella pertussis
cuucggccacgguaugcccagg

SEQ ID NO: 953 - RNA, 22 nt, Bordetella pertussis
cuugcgcagguccaccugcacc

SEQ ID NO: 954 - RNA, 22 nt, Bordetella pertussis
cuuggacaucgaauggcgcaac

SEQ ID NO: 955 - RNA, 22 nt, Bordetella pertussis
gaaaccgagaucguggaggucg

SEQ ID NO: 956 - RNA, 22 nt, Bordetella pertussis
gaaaccgucaugcggcaggccg

SEQ ID NO: 957 - RNA, 22 nt, Bordetella pertussis
gaacagaaccacggcuugcggu

SEQ ID NO: 958 - RNA, 22 nt, Bordetella pertussis
gaacucuuccgcaaagcggucg

SEQ ID NO: 959 - RNA, 22 nt, Bordetella pertussis
gaacugcagcguuucguggcgc

SEQ ID NO: 960 - RNA, 21 nt, Bordetella pertussis
gaagaugacgcgaucggcgac

SEQ ID NO: 961 - RNA, 22 nt, Bordetella pertussis
gaaggcccaagcaaaagcgccc

SEQ ID NO: 962 - RNA, 23 nt, Bordetella pertussis
gacaggccucguguucggcggcg

SEQ ID NO: 963 - RNA, 22 nt, Bordetella pertussis
gacaugaucgauugcucgucgg

SEQ ID NO: 964 - RNA, 22 nt, Bordetella pertussis
gaccacgcuggcauugccgccc

SEQ ID NO: 965 - RNA, 22 nt, Bordetella pertussis
gaccaugaccguaggcaugaug

SEQ ID NO: 966 - RNA, 22 nt, Bordetella pertussis
gaccgccagggccaccgcauuu

SEQ ID NO: 967 - RNA, 22 nt, Bordetella pertussis
gacgcugcuggacguggugcgc

SEQ ID NO: 968 - RNA, 22 nt, Bordetella pertussis
gacggcacggcacaggucgacg

SEQ ID NO: 969 - RNA, 22 nt, Bordetella pertussis
gacggccgcgugccgcugaucg

SEQ ID NO: 970 - RNA, 22 nt, Bordetella pertussis
gacgguggcguggcgcacgaug

SEQ ID NO: 971 - RNA, 22 nt, Bordetella pertussis
gacgucguagaugcugaugucg

SEQ ID NO: 972 - RNA, 22 nt, Bordetella pertussis
gacuggauugauggccggcgcc

SEQ ID NO: 973 - RNA, 22 nt, Bordetella pertussis
gagcagaccgaguucaccguug

SEQ ID NO: 974 - RNA, 22 nt, Bordetella pertussis
gagcauggucgaauuccacaau

SEQ ID NO: 975 - RNA, 22 nt, Bordetella pertussis
gagccugguacccguggggcau

SEQ ID NO: 976 - RNA, 22 nt, Bordetella pertussis
gagcgcgacaucaccgcgcuca

SEQ ID NO: 977 - RNA, 22 nt, Bordetella pertussis
gagcgguaccagcgccagcagc

SEQ ID NO: 978 - RNA, 22 nt, Bordetella pertussis
gagcuguuggugcugcccacga

SEQ ID NO: 979 - RNA, 22 nt, Bordetella pertussis
gaggucgcgcagcgugccgcug

SEQ ID NO: 980 - RNA, 22 nt, Bordetella pertussis
gaguccugggugcgcggcguca

SEQ ID NO: 981 - RNA, 22 nt, Bordetella pertussis
gaucagcgucaggggguucucg

SEQ ID NO: 982 - RNA, 22 nt, Bordetella pertussis
gaucgacguggcggugaccuau

SEQ ID NO: 983 - RNA, 22 nt, Bordetella pertussis
gaucgacucgaugaugucguug

SEQ ID NO: 984 - RNA, 22 nt, Bordetella pertussis
gaucggcacgauuuuucgcugu

SEQ ID NO: 985 - RNA, 22 nt, Bordetella pertussis
gaugaucaauggcucgcugggc

SEQ ID NO: 986 - RNA, 22 nt, Bordetella pertussis
gaugccaagcugcgcgagcacc

SEQ ID NO: 987 - RNA, 22 nt, Bordetella pertussis
gaugccggcguagaucgacugc

SEQ ID NO: 988 - RNA, 22 nt, Bordetella pertussis
gaugcggugaugaacgaguucg

SEQ ID NO: 989 - RNA, 22 nt, Bordetella pertussis
gaugcguucgauggcgcgcgug

SEQ ID NO: 990 - RNA, 22 nt, Bordetella pertussis
gaugcugaucagguugccggcc

SEQ ID NO: 991 - RNA, 22 nt, Bordetella pertussis
gauggcguugucgaccagguug

SEQ ID NO: 992 - RNA, 22 nt, Bordetella pertussis
gauggucuggccggggccgccg

SEQ ID NO: 993 - RNA, 22 nt, Bordetella pertussis
gauguccaggccgcgcagcauc

SEQ ID NO: 994 - RNA, 22 nt, Bordetella pertussis
gaugucgggcaggcgcagggcc

SEQ ID NO: 995 - RNA, 20 nt, Bordetella pertussis
gauguucgucgagaagccgg

SEQ ID NO: 996 - RNA, 22 nt, Bordetella pertussis
gcaagcagcauccggaauucgc

SEQ ID NO: 997 - RNA, 22 nt, Bordetella pertussis
gcaaggaagcccgcuucggcgu

SEQ ID NO: 998 - RNA, 22 nt, Bordetella pertussis
gcaccaugaucgagcgcacauc

SEQ ID NO: 999 - RNA, 22 nt, Bordetella pertussis
gcacggucuccaggaagaccag

SEQ ID NO: 1000 - RNA, 22 nt, Bordetella pertussis
gcagcgcgugcgccaguugcag

SEQ ID NO: 1001 - RNA, 22 nt, Bordetella pertussis
gcagcgucugggggcugcagac

SEQ ID NO: 1002 - RNA, 22 nt, Bordetella pertussis
gcagggcuggcagacgcgccgu

SEQ ID NO: 1003 - RNA, 22 nt, Bordetella pertussis
gcaggggccgcuggcgcaguuc

SEQ ID NO: 1004 - RNA, 22 nt, Bordetella pertussis
gcaggggccguuguggcuggcu

SEQ ID NO: 1005 - RNA, 22 nt, Bordetella pertussis
gcaugccaucgagcguauccgc

SEQ ID NO: 1006 - RNA, 22 nt, Bordetella pertussis
gcauggacucgaucucgauggc

SEQ ID NO: 1007 - RNA, 22 nt, Bordetella pertussis
gcauggcgcggcaugacgccgg

SEQ ID NO: 1008 - RNA, 22 nt, Bordetella pertussis
gccaccaggccgucggccaggg

SEQ ID NO: 1009 - RNA, 22 nt, Bordetella pertussis
gccacgaugcguccgccgugcg

SEQ ID NO: 1010 - RNA, 22 nt, Bordetella pertussis
gccagcagcuugucgaagcggg

SEQ ID NO: 1011 - RNA, 23 nt, Bordetella pertussis
gccagccuggagaacaacaccac

SEQ ID NO: 1012 - RNA, 22 nt, Bordetella pertussis
gccagcgugcgcugcauggcgu

SEQ ID NO: 1013 - RNA, 20 nt, Bordetella pertussis
gccaguccagcggcucgcuc

SEQ ID NO: 1014 - RNA, 20 nt, Bordetella pertussis
ggcgccgagcuguaucgcga

SEQ ID NO: 1015 - RNA, 22 nt, Bordetella pertussis
ggcgccgugguccauggccgcg

SEQ ID NO: 1016 - RNA, 22 nt, Bordetella pertussis
guucggcaacggcucggacgaa

SEQ ID NO: 1017 - RNA, 22 nt, Bordetella pertussis
guucggcgauucgacggugcuc

SEQ ID NO: 1018 - RNA, 22 nt, Bordetella pertussis
guucuggcccagcgcgaguuca

SEQ ID NO: 1019 - RNA, 22 nt, Bordetella pertussis
guugcaugcgcugcgccgcuau

SEQ ID NO: 1020 - RNA, 22 nt, Bordetella pertussis
guugccgcaagucgcgcguaua

SEQ ID NO: 1021 - RNA, 22 nt, Bordetella pertussis
guugcuugcucaucggcgcagg

SEQ ID NO: 1022 - RNA, 20 nt, Bordetella pertussis
uacaggcgcuucauguggcg

SEQ ID NO: 1023 - RNA, 22 nt, Bordetella pertussis
uacaucaucguggcccugguga

SEQ ID NO: 1024 - RNA, 22 nt, Bordetella pertussis
uaccagcgcuucaugccggccg

SEQ ID NO: 1025 - RNA, 22 nt, Bordetella pertussis
uaccaguacauccccguggcgc

SEQ ID NO: 1026 - RNA, 22 nt, Bordetella pertussis
uaccugaccgaggcggugcgcc

SEQ ID NO: 1027 - RNA, 22 nt, Bordetella pertussis
uaccuggacucggucucgcugc

SEQ ID NO: 1028 - RNA, 22 nt, Bordetella pertussis
uacgccgcaucaaaccccggcu

SEQ ID NO: 1029 - RNA, 22 nt, Bordetella pertussis
uacgccgccuggcuccauaugc

SEQ ID NO: 1030 - RNA, 22 nt, Bordetella pertussis
uacgcgucgacgaccaggccgg

SEQ ID NO: 1031 - RNA, 22 nt, Bordetella pertussis
uacggcgccagccccgaccugg

SEQ ID NO: 1032 - RNA, 22 nt, Bordetella pertussis
uacugccaggugcgcgugucgc

SEQ ID NO: 1033 - RNA, 22 nt, Bordetella pertussis
uagcggccguugcgcucggugg

SEQ ID NO: 1034 - RNA, 22 nt, Bordetella pertussis
uagcggucguagcaaucgccau

SEQ ID NO: 1035 - RNA, 22 nt, Bordetella pertussis
uaggcgauggcgcgcugguugu

SEQ ID NO: 1036 - RNA, 22 nt, Bordetella pertussis
uaguugcccguggcgccauuga

SEQ ID NO: 1037 - RNA, 22 nt, Bordetella pertussis
uaugacggggagccugucccgg

SEQ ID NO: 1038 - RNA, 22 nt, Bordetella pertussis
uauuacgugcggcugcuggccg

SEQ ID NO: 1039 - RNA, 22 nt, Bordetella pertussis
ucaacgccgccgccugccacgu

SEQ ID NO: 1040 - RNA, 22 nt, Bordetella pertussis
ucaauggcgauuucgugaucgg

SEQ ID NO: 1041 - RNA, 22 nt, Bordetella pertussis
ucaccacgaaaccgagcagcau

SEQ ID NO: 1042 - RNA, 22 nt, Bordetella pertussis
ucagcaccuucugguucggcau

SEQ ID NO: 1043 - RNA, 22 nt, Bordetella pertussis
ucagcgccaacgccgucgccaa

SEQ ID NO: 1044 - RNA, 22 nt, Bordetella pertussis
ucaggcgagcugcugucgcugg

SEQ ID NO: 1045 - RNA, 21 nt, Bordetella pertussis
ucauccaggccuguugcgagc

SEQ ID NO: 1046 - RNA, 22 nt, Bordetella pertussis
ucaugaacugcacguucguguc

SEQ ID NO: 1047 - RNA, 22 nt, Bordetella pertussis
uccaccgacgccuggcaggaau

SEQ ID NO: 1048 - RNA, 22 nt, Bordetella pertussis
uccaccgucaucugcaccggca

SEQ ID NO: 1049 - RNA, 22 nt, Bordetella pertussis
uccagcuggcgcgcaucgagcc

SEQ ID NO: 1050 - RNA, 22 nt, Bordetella pertussis
uccaggucaaucuuugcggcua

SEQ ID NO: 1051 - RNA, 22 nt, Bordetella pertussis
uccaugccgcccuuggcggcgg

SEQ ID NO: 1052 - RNA, 22 nt, Bordetella pertussis
uccccgccagcccagcgaucug

SEQ ID NO: 1053 - RNA, 22 nt, Bordetella pertussis
ucccggcguucgcccugggcau

SEQ ID NO: 1054 - RNA, 22 nt, Bordetella pertussis
uccgccgccgcgaucacuucgu

SEQ ID NO: 1055 - RNA, 22 nt, Bordetella pertussis
uccgccuucgaggcugguuucg

SEQ ID NO: 1056 - RNA, 22 nt, Bordetella pertussis
uccgcucguaguccuugaccau

SEQ ID NO: 1057 - RNA, 22 nt, Bordetella pertussis
uccgguggcugcgggcccagcc

SEQ ID NO: 1058 - RNA, 22 nt, Bordetella pertussis
uccugcgggggcaggcaccccg

SEQ ID NO: 1059 - RNA, 22 nt, Bordetella pertussis
ucgaauucgcggcggaguauag

SEQ ID NO: 1060 - RNA, 22 nt, Bordetella pertussis
ucgaccugcuugccggccuggu

SEQ ID NO: 1061 - RNA, 21 nt, Bordetella pertussis
ucgacgagaacgacgugcguc

SEQ ID NO: 1062 - RNA, 22 nt, Bordetella pertussis
ucgacucgggcacgaccgugca

SEQ ID NO: 1063 - RNA, 22 nt, Bordetella pertussis
ucgagcacgaguaccggcugga

SEQ ID NO: 1064 - RNA, 22 nt, Bordetella pertussis
ucgaucagcaugcgcgauucca

SEQ ID NO: 1065 - RNA, 22 nt, Bordetella pertussis
ucgaugaccaggauggucuggc

SEQ ID NO: 1066 - RNA, 21 nt, Bordetella pertussis
ucgaugaucugcucauccugc

SEQ ID NO: 1067 - RNA, 23 nt, Bordetella pertussis
ucgcacuccggcgccagcagcuu

SEQ ID NO: 1068 - RNA, 22 nt, Bordetella pertussis
ucgccaucaucaaggcggcgcc

SEQ ID NO: 1069 - RNA, 22 nt, Bordetella pertussis
ucgccgaugcuguucggcaucu

SEQ ID NO: 1070 - RNA, 21 nt, Bordetella pertussis
ucgccgccuuccucgagcugg

SEQ ID NO: 1071 - RNA, 22 nt, Bordetella pertussis
ucgccgucggggccggucaguu

SEQ ID NO: 1072 - RNA, 17 nt, Bordetella pertussis
ucgcgcacauucagccg

SEQ ID NO: 1073 - RNA, 22 nt, Bordetella pertussis
ucgcgcacguccugcaugaagc

SEQ ID NO: 1074 - RNA, 22 nt, Bordetella pertussis
ucgcgccugaucgaccguccgc

SEQ ID NO: 1075 - RNA, 22 nt, Bordetella pertussis
ucgcgcgcgaagcccaucucgu

SEQ ID NO: 1076 - RNA, 22 nt, Bordetella pertussis
ucgcggaucgcuaggaugcggg

SEQ ID NO: 1077 - RNA, 22 nt, Bordetella pertussis
ucgcgggaaagaaggcggcggu

SEQ ID NO: 1078 - RNA, 22 nt, Bordetella pertussis
ucgcgggucgaugccggggcuu

SEQ ID NO: 1079 - RNA, 22 nt, Bordetella pertussis
ucgcggugucgcugggcaugcg

SEQ ID NO: 1080 - RNA, 22 nt, Bordetella pertussis
ucgcugucggccaacgagcggc

SEQ ID NO: 1081 - RNA, 22 nt, Bordetella pertussis
ucggacagcgcgaaaggcuugg

SEQ ID NO: 1082 - RNA, 22 nt, Bordetella pertussis
ucggcaucgccagcaucaaaca

SEQ ID NO: 1083 - RNA, 22 nt, Bordetella pertussis
ucggccagcagaaugccgucgg

SEQ ID NO: 1084 - RNA, 22 nt, Bordetella pertussis
ucggccucgggcacgcgcccuu

SEQ ID NO: 1085 - RNA, 22 nt, Bordetella pertussis
ucggcgccauaggcggucaugg

SEQ ID NO: 1086 - RNA, 22 nt, Bordetella pertussis
ucggcggugacgaugccggugc

SEQ ID NO: 1087 - RNA, 22 nt, Bordetella pertussis
ucggcggugcgcucggagguau

SEQ ID NO: 1088 - RNA, 22 nt, Bordetella pertussis
ucggcguaggccggcucgaccg

SEQ ID NO: 1089 - RNA, 22 nt, Bordetella pertussis
ucggcgugaacgugccguaguc

SEQ ID NO: 1090 - RNA, 22 nt, Bordetella pertussis
ucggcuaugcccugcuggcggc

SEQ ID NO: 1091 - RNA, 22 nt, Bordetella pertussis
ucggcuucgaaccggugcgcga

SEQ ID NO: 1092 - RNA, 22 nt, Bordetella pertussis
ucgggauguugcggcgcgccgg

SEQ ID NO: 1093 - RNA, 22 nt, Bordetella pertussis
ucgggccaguugcgggcccugg

SEQ ID NO: 1094 - RNA, 19 nt, Bordetella pertussis
ucgggccugcgcguggcca

SEQ ID NO: 1095 - RNA, 22 nt, Bordetella pertussis
ucgggcgggugcgcauggagcu

SEQ ID NO: 1096 - RNA, 22 nt, Bordetella pertussis
ucgggcuuucgcagcgccgucg

SEQ ID NO: 1097 - RNA, 22 nt, Bordetella pertussis
ucggggccuguuccucggugcg

SEQ ID NO: 1098 - RNA, 22 nt, Bordetella pertussis
ucggugcugguggcggccgcgc

SEQ ID NO: 1099 - RNA, 22 nt, Bordetella pertussis
ucgucauugaacagcuugagca

SEQ ID NO: 1100 - RNA, 22 nt, Bordetella pertussis
ucgucggagugcgccugggcgg

SEQ ID NO: 1101 - RNA, 22 nt, Bordetella pertussis
ucgucggcaugggcgaaucgcg

SEQ ID NO: 1102 - RNA, 22 nt, Bordetella pertussis
ucgucggcccaugucggcgcga

SEQ ID NO: 1103 - RNA, 22 nt, Bordetella pertussis
ucgugcaagagcaugcauaucg

SEQ ID NO: 1104 - RNA, 22 nt, Bordetella pertussis
ucgugcgccgcaaggugccgcu

SEQ ID NO: 1105 - RNA, 22 nt, Bordetella pertussis
ucguucaucccgcugcugaccc

SEQ ID NO: 1106 - RNA, 20 nt, Bordetella pertussis
gcgcuugaccagcuugaugu

SEQ ID NO: 1107 - RNA, 22 nt, Bordetella pertussis
ucguugcgcuguugguccagcu

SEQ ID NO: 1108 - RNA, 17 nt, Bordetella pertussis
ucugaucgguaugcagu

SEQ ID NO: 1109 - RNA, 22 nt, Bordetella pertussis
ucugcucgcuggcgaugaggcg

SEQ ID NO: 1110 - RNA, 22 nt, Bordetella pertussis
ucuggcucugggacaccggcga

SEQ ID NO: 1111 - RNA, 22 nt, Bordetella pertussis
ucuggcugacgcacgacccgca

SEQ ID NO: 1112 - RNA, 22 nt, Bordetella pertussis
ucuuccagguagugcgucagga

SEQ ID NO: 1113 - RNA, 22 nt, Bordetella pertussis
ucuucggcggcgcgcuugaccc

SEQ ID NO: 1114 - RNA, 22 nt, Bordetella pertussis
ucuucggugagcucccguuccg

SEQ ID NO: 1115 - RNA, 22 nt, Bordetella pertussis
ugaacaccggguucucgggaua

SEQ ID NO: 1116 - RNA, 19 nt, Bordetella pertussis
ugaacauguuaugcagcgu

SEQ ID NO: 1117 - RNA, 22 nt, Bordetella pertussis
ugaacccgaucgaucacccgca

SEQ ID NO: 1118 - RNA, 23 nt, Bordetella pertussis
ugaacgagacgucggccagcucg

SEQ ID NO: 1119 - RNA, 22 nt, Bordetella pertussis
ugaccgaagcggaucuggcgcg

SEQ ID NO: 1120 - RNA, 19 nt, Bordetella pertussis
ugaccgcgcgcuugaucgc

SEQ ID NO: 1121 - RNA, 22 nt, Bordetella pertussis
ugaccuugaucugcgccaugcc

SEQ ID NO: 1122 - RNA, 21 nt, Bordetella pertussis
ugacgaacacguugucgcgcc

SEQ ID NO: 1123 - RNA, 22 nt, Bordetella pertussis
ugagcuacugauccgggcugca

SEQ ID NO: 1124 - RNA, 22 nt, Bordetella pertussis
ugaucgagcacgacgauguggu

SEQ ID NO: 1125 - RNA, 22 nt, Bordetella pertussis
ugaucgaucaguugcggcgcga

SEQ ID NO: 1126 - RNA, 22 nt, Bordetella pertussis
ugaugcuggccgauggcagccg

SEQ ID NO: 1127 - RNA, 22 nt, Bordetella pertussis
ugauggccgccuccagcgccug

SEQ ID NO: 1128 - RNA, 22 nt, Bordetella pertussis
ugauggcgcccaggcugcgcaa

SEQ ID NO: 1129 - RNA, 21 nt, Bordetella pertussis
ugcaccccuacgaagugccgg

SEQ ID NO: 1130 - RNA, 22 nt, Bordetella pertussis
ugcaccccuacgugcugguuuc

SEQ ID NO: 1131 - RNA, 22 nt, Bordetella pertussis
ugcaccuguccguacuaucccu

SEQ ID NO: 1132 - RNA, 22 nt, Bordetella pertussis
ugcagaucaacgucgagggcga

SEQ ID NO: 1133 - RNA, 22 nt, Bordetella pertussis
ugcagcacauggaucaucaggc

SEQ ID NO: 1134 - RNA, 23 nt, Bordetella pertussis
ugcagcggaaucggcauaucgga

SEQ ID NO: 1135 - RNA, 20 nt, Bordetella pertussis
ugcaggcccuuguccacgcu

SEQ ID NO: 1136 - RNA, 22 nt, Bordetella pertussis
ugccagccgggccuuuuccgcc

SEQ ID NO: 1137 - RNA, 22 nt, Bordetella pertussis
ugccagucccccuguggggaca

SEQ ID NO: 1138 - RNA, 22 nt, Bordetella pertussis
ugcccauggcguauggggcgcc

SEQ ID NO: 1139 - RNA, 22 nt, Bordetella pertussis
ugccgcagacgaugaucucgcc

SEQ ID NO: 1140 - RNA, 22 nt, Bordetella pertussis
ugccggcgccgguuucgccuug

SEQ ID NO: 1141 - RNA, 22 nt, Bordetella pertussis
ugccgggcgucaaggugucgcu

SEQ ID NO: 1142 - RNA, 22 nt, Bordetella pertussis
ugccgguguccuucacccacgg

SEQ ID NO: 1143 - RNA, 22 nt, Bordetella pertussis
ugccguccuugucgaugcgguc

SEQ ID NO: 1144 - RNA, 22 nt, Bordetella pertussis
ugccgucgcgcaagucggugcu

SEQ ID NO: 1145 - RNA, 22 nt, Bordetella pertussis
ugccugucccccugcggggaca

SEQ ID NO: 1146 - RNA, 22 nt, Bordetella pertussis
ugcgccagcgagucgggcaagg

SEQ ID NO: 1147 - RNA, 22 nt, Bordetella pertussis
ugcgccggcgacagcggcuggu

SEQ ID NO: 1148 - RNA, 22 nt, Bordetella pertussis
ugcgccugaugccgccgguguu

SEQ ID NO: 1149 - RNA, 22 nt, Bordetella pertussis
ugcgccuggucgccccgcacac

SEQ ID NO: 1150 - RNA, 22 nt, Bordetella pertussis
ugcgcgucgacggccagcucga

SEQ ID NO: 1151 - RNA, 22 nt, Bordetella pertussis
ugcgcgugacggucugccaugc

SEQ ID NO: 1152 - RNA, 22 nt, Bordetella pertussis
ugcggaucucguacucuuugac

SEQ ID NO: 1153 - RNA, 22 nt, Bordetella pertussis
ugcggcugguaggccgacuuga

SEQ ID NO: 1154 - RNA, 22 nt, Bordetella pertussis
ugcgucaugcccaucagccggg

SEQ ID NO: 1155 - RNA, 22 nt, Bordetella pertussis
ugcguuuccaggaaaccccuac

SEQ ID NO: 1156 - RNA, 23 nt, Bordetella pertussis
ugcucgauugccugucguccugg

SEQ ID NO: 1157 - RNA, 22 nt, Bordetella pertussis
ugcugcgcauccugcaggaggu

SEQ ID NO: 1158 - RNA, 22 nt, Bordetella pertussis
ugcugcgccgcuggcugucguc

SEQ ID NO: 1159 - RNA, 20 nt, Bordetella pertussis
ugcugcggcugcugcccgau

SEQ ID NO: 1160 - RNA, 22 nt, Bordetella pertussis
ugcuggacaagcccgugaccug

SEQ ID NO: 1161 - RNA, 22 nt, Bordetella pertussis
ugcuggaguugcuggcgcgcuu

SEQ ID NO: 1162 - RNA, 22 nt, Bordetella pertussis
ugcuggccacgacggccacgcu

SEQ ID NO: 1163 - RNA, 20 nt, Bordetella pertussis
ugcuggcgcuguccugcguc

SEQ ID NO: 1164 - RNA, 22 nt, Bordetella pertussis
ugcugggcgagccguccggcua

SEQ ID NO: 1165 - RNA, 22 nt, Bordetella pertussis
ugcugguaauucgacagcgccg

SEQ ID NO: 1166 - RNA, 22 nt, Bordetella pertussis
ugcugucggcgcuggccgcggu

SEQ ID NO: 1167 - RNA, 22 nt, Bordetella pertussis
ugcuuuuguaauccaccgacuc

SEQ ID NO: 1168 - RNA, 22 nt, Bordetella pertussis
uggaauucgacccgcaugcggu

SEQ ID NO: 1169 - RNA, 22 nt, Bordetella pertussis
uggaccagcucgcgggcgcgau

SEQ ID NO: 1170 - RNA, 23 nt, Bordetella pertussis
uggacgcgccgucggccagcacg

SEQ ID NO: 1171 - RNA, 22 nt, Bordetella pertussis
uggacgugcgcgagaacggcgu

SEQ ID NO: 1172 - RNA, 20 nt, Bordetella pertussis
uggacuggaaguggcuguuc

SEQ ID NO: 1173 - RNA, 22 nt, Bordetella pertussis
uggagacgaaagcgcuguugcu

SEQ ID NO: 1174 - RNA, 22 nt, Bordetella pertussis
uggaucaguuugauguuguccu

SEQ ID NO: 1175 - RNA, 22 nt, Bordetella pertussis
uggaugaaggcaccgccgcggc

SEQ ID NO: 1176 - RNA, 20 nt, Bordetella pertussis
uggcaacgccgcccgcguuc

SEQ ID NO: 1177 - RNA, 22 nt, Bordetella pertussis
uggcagcagaucgacuacggcu

SEQ ID NO: 1178 - RNA, 22 nt, Bordetella pertussis
uggccacgcgcuugaucagauc

SEQ ID NO: 1179 - RNA, 22 nt, Bordetella pertussis
uggccaggucgauggccuggug

SEQ ID NO: 1180 - RNA, 22 nt, Bordetella pertussis
uggcccagcgaauuguugcgcg

SEQ ID NO: 1181 - RNA, 22 nt, Bordetella pertussis
uggcccgcuggagcgccaucgc

SEQ ID NO: 1182 - RNA, 22 nt, Bordetella pertussis
uggcccgguugguggcgauucc

SEQ ID NO: 1183 - RNA, 23 nt, Bordetella pertussis
uggccgagcuggugcgccgccac

SEQ ID NO: 1184 - RNA, 22 nt, Bordetella pertussis
uggccgcacgcagcccgacgac

SEQ ID NO: 1185 - RNA, 22 nt, Bordetella pertussis
uggccgccgggcugucgcgcuc

SEQ ID NO: 1186 - RNA, 23 nt, Bordetella pertussis
uggccgcugcugucggccucggc

SEQ ID NO: 1187 - RNA, 22 nt, Bordetella pertussis
uggccggcgaugucgggcgccg

SEQ ID NO: 1188 - RNA, 22 nt, Bordetella pertussis
uggccgugcugccggacgcgcc

SEQ ID NO: 1189 - RNA, 22 nt, Bordetella pertussis
uggccugcuucccagcgggcga

SEQ ID NO: 1190 - RNA, 22 nt, Bordetella pertussis
uggccuggcugagcggcagccu

SEQ ID NO: 1191 - RNA, 22 nt, Bordetella pertussis
uggcgaggugcuggccgugguu

SEQ ID NO: 1192 - RNA, 22 nt, Bordetella pertussis
uggcgcgcguacuccauggccu

SEQ ID NO: 1193 - RNA, 22 nt, Bordetella pertussis
uggcgcuggcggugcuggagac

SEQ ID NO: 1194 - RNA, 22 nt, Bordetella pertussis
uggcggccaggcgcugcaggau

SEQ ID NO: 1195 - RNA, 22 nt, Bordetella pertussis
uggcugcgggucaugacggcgc

SEQ ID NO: 1196 - RNA, 22 nt, Bordetella pertussis
ggcugcgcaacggcuaucgcaa

SEQ ID NO: 1197 - RNA, 20 nt, Bordetella pertussis
ggcuggacccggguccgugg

SEQ ID NO: 1198 - RNA, 22 nt, Bordetella pertussis
ggcugguggcgucgcccgcggc

SEQ ID NO: 1199 - RNA, 22 nt, Bordetella pertussis
ggcugugcuacugaugcggcaa

SEQ ID NO: 1200 - RNA, 22 nt, Bordetella pertussis
gggccgcuguugcccugggacu

SEQ ID NO: 1201 - RNA, 22 nt, Bordetella pertussis
gggcgacgagcugguucugacg

SEQ ID NO: 1202 - RNA, 22 nt, Bordetella pertussis
gggcgcccagcgcgucggccag

SEQ ID NO: 1203 - RNA, 22 nt, Bordetella pertussis
gggcgcugcugauccaggccug

SEQ ID NO: 1204 - RNA, 22 nt, Bordetella pertussis
gggcgcuuuugcuugggccuca

SEQ ID NO: 1205 - RNA, 22 nt, Bordetella pertussis
gggcuucaugcaggacgugcgc

SEQ ID NO: 1206 - RNA, 22 nt, Bordetella pertussis
ggggcugucggucagcagcaug

SEQ ID NO: 1207 - RNA, 22 nt, Bordetella pertussis
ggggucgacaaaggcguugucu

SEQ ID NO: 1208 - RNA, 22 nt, Bordetella pertussis
ggggucgaccaugcgcagcgug

SEQ ID NO: 1209 - RNA, 22 nt, Bordetella pertussis
ggggugcuggucgucggcguac

SEQ ID NO: 1210 - RNA, 19 nt, Bordetella pertussis
gggguugaucgccagcacc

SEQ ID NO: 1211 - RNA, 20 nt, Bordetella pertussis
ggucaaggucucgucguggu

SEQ ID NO: 1212 - RNA, 22 nt, Bordetella pertussis
gguccuucggcggcacguccgu

SEQ ID NO: 1213 - RNA, 22 nt, Bordetella pertussis
ggucggauugaagcgcaggucg

SEQ ID NO: 1214 - RNA, 22 nt, Bordetella pertussis
ggucgucacccugggcgccggc

SEQ ID NO: 1215 - RNA, 22 nt, Bordetella pertussis
ggucucgaugaugguggcgagc

SEQ ID NO: 1216 - RNA, 22 nt, Bordetella pertussis
ggugcccaacaucgugaucccg

SEQ ID NO: 1217 - RNA, 22 nt, Bordetella pertussis
ggugccuguccccgcggggaca

SEQ ID NO: 1218 - RNA, 22 nt, Bordetella pertussis
ggugcgcgugggcacccggccg

SEQ ID NO: 1219 - RNA, 22 nt, Bordetella pertussis
ggugcucgcgcagcuuggcauc

SEQ ID NO: 1220 - RNA, 22 nt, Bordetella pertussis
gguggccgcugagccaggugcc

SEQ ID NO: 1221 - RNA, 22 nt, Bordetella pertussis
gguggcgcauagcgugcuggcc

SEQ ID NO: 1222 - RNA, 22 nt, Bordetella pertussis
gguguccauguaggacugcgaa

SEQ ID NO: 1223 - RNA, 22 nt, Bordetella pertussis
ggugugcugcaaucucacuggu

SEQ ID NO: 1224 - RNA, 22 nt, Bordetella pertussis
ggugugcugccgcccagggcga

SEQ ID NO: 1225 - RNA, 22 nt, Bordetella pertussis
gguuguccggguccaccaggcu

SEQ ID NO: 1226 - RNA, 22 nt, Bordetella pertussis
gguuguugaugcugaagccggc

SEQ ID NO: 1227 - RNA, 22 nt, Bordetella pertussis
guacaggcuguaccgcggcggc

SEQ ID NO: 1228 - RNA, 22 nt, Bordetella pertussis
guacggcacuucgacauggugc

SEQ ID NO: 1229 - RNA, 22 nt, Bordetella pertussis
guagcgccggcacagcucgacc

SEQ ID NO: 1230 - RNA, 22 nt, Bordetella pertussis
guauuucggccgcagccugugg

SEQ ID NO: 1231 - RNA, 22 nt, Bordetella pertussis
gucaagaacaggcugacugccg

SEQ ID NO: 1232 - RNA, 22 nt, Bordetella pertussis
gucagcgagcugugccagucgg

SEQ ID NO: 1233 - RNA, 22 nt, Bordetella pertussis
gucaugccauauccguccgugu

SEQ ID NO: 1234 - RNA, 22 nt, Bordetella pertussis
guccaggccauagccggucucg

SEQ ID NO: 1235 - RNA, 22 nt, Bordetella pertussis
guccaggucggcuucggaggcg

SEQ ID NO: 1236 - RNA, 22 nt, Bordetella pertussis
guccccgcggggacaggcacac

SEQ ID NO: 1237 - RNA, 22 nt, Bordetella pertussis
guccggcucagcggcucagcgg

SEQ ID NO: 1238 - RNA, 22 nt, Bordetella pertussis
guccgggcaccgccguggugua

SEQ ID NO: 1239 - RNA, 22 nt, Bordetella pertussis
gucgaugcggccggccuccacc

SEQ ID NO: 1240 - RNA, 22 nt, Bordetella pertussis
gucgccucgucgaggaucagga

SEQ ID NO: 1241 - RNA, 22 nt, Bordetella pertussis
gucgcgcagcaauuguuccaau

SEQ ID NO: 1242 - RNA, 22 nt, Bordetella pertussis
gucgcggucgucuucguagacc

SEQ ID NO: 1243 - RNA, 22 nt, Bordetella pertussis
gucggcaaguucgaccugcuca

SEQ ID NO: 1244 - RNA, 22 nt, Bordetella pertussis
gucggccagccagccgcuguuc

SEQ ID NO: 1245 - RNA, 22 nt, Bordetella pertussis
gucgggcaggcgcaccaggugg

SEQ ID NO: 1246 - RNA, 22 nt, Bordetella pertussis
gucggguuggccugcgccaugg

SEQ ID NO: 1247 - RNA, 22 nt, Bordetella pertussis
gucggucagggugccgggcgug

SEQ ID NO: 1248 - RNA, 22 nt, Bordetella pertussis
gucgguccgggcagcgguugau

SEQ ID NO: 1249 - RNA, 22 nt, Bordetella pertussis
gucggugcgcauggaacugcag

SEQ ID NO: 1250 - RNA, 21 nt, Bordetella pertussis
gucgucggcgaccagcucgcg

SEQ ID NO: 1251 - RNA, 22 nt, Bordetella pertussis
gucgucguugcggcagucuucg

SEQ ID NO: 1252 - RNA, 22 nt, Bordetella pertussis
gucucgccgcccggcgccaggu

SEQ ID NO: 1253 - RNA, 22 nt, Bordetella pertussis
gugaccgacaccgugccguccu

SEQ ID NO: 1254 - RNA, 22 nt, Bordetella pertussis
gugaucgucgaggguuucaucg

SEQ ID NO: 1255 - RNA, 22 nt, Bordetella pertussis
gugcccgcgucgcgggucacgg

SEQ ID NO: 1256 - RNA, 23 nt, Bordetella pertussis
gugcccggggagccaggcaccgg

SEQ ID NO: 1257 - RNA, 22 nt, Bordetella pertussis
gugcgagccgcucaggcccgcg

SEQ ID NO: 1258 - RNA, 22 nt, Bordetella pertussis
gugcgccaguugccgcuggccg

SEQ ID NO: 1259 - RNA, 22 nt, Bordetella pertussis
gugcgcgucucgauggcgaacu

SEQ ID NO: 1260 - RNA, 22 nt, Bordetella pertussis
gugcgggugaucgaucggguuc

SEQ ID NO: 1261 - RNA, 22 nt, Bordetella pertussis
gugcggucguucaaggauccgu

SEQ ID NO: 1262 - RNA, 22 nt, Bordetella pertussis
gugcguuggcugcgccggcugg

SEQ ID NO: 1263 - RNA, 22 nt, Bordetella pertussis
gugcucgggcaugggauucgug

SEQ ID NO: 1264 - RNA, 22 nt, Bordetella pertussis
gugcugggucugaccauggugg

SEQ ID NO: 1265 - RNA, 22 nt, Bordetella pertussis
guggauggaggcgcgcgacgag

SEQ ID NO: 1266 - RNA, 22 nt, Bordetella pertussis
guggccuaucuauuggcgcgcg

SEQ ID NO: 1267 - RNA, 22 nt, Bordetella pertussis
guggccuggguggccagcugcg

SEQ ID NO: 1268 - RNA, 22 nt, Bordetella pertussis
guggcgauggcgaugucgucga

SEQ ID NO: 1269 - RNA, 22 nt, Bordetella pertussis
guggcgccguccucgaguauga

SEQ ID NO: 1270 - RNA, 22 nt, Bordetella pertussis
guggcgcgcaugcagcgccuug

SEQ ID NO: 1271 - RNA, 22 nt, Bordetella pertussis
guggcggcccuggucgccuucc

SEQ ID NO: 1272 - RNA, 22 nt, Bordetella pertussis
gugggcuuguccuugcugucca

SEQ ID NO: 1273 - RNA, 21 nt, Bordetella pertussis
guggggcuucaucggcgccau

SEQ ID NO: 1274 - RNA, 22 nt, Bordetella pertussis
guguucucggugaaccugggcu

SEQ ID NO: 1275 - RNA, 18 nt, Bordetella pertussis
guucagcagcuuuuuugu

SEQ ID NO: 1276 - RNA, 22 nt, Bordetella pertussis
guucgagcgagcuggcauucca

SEQ ID NO: 1277 - RNA, 22 nt, Bordetella pertussis
ugagcgacuacgguuucggcgc

SEQ ID NO: 1278 - RNA, 22 nt, Bordetella pertussis
ugaucgaggcggguuuccagcg

SEQ ID NO: 1279 - RNA, 22 nt, Bordetella pertussis
ugaugaucagcagcggcgccga

SEQ ID NO: 1280 - RNA, 22 nt, Bordetella pertussis
ugaugcuggugacugcgcucaa

SEQ ID NO: 1281 - RNA, 22 nt, Bordetella pertussis
ugcacgcugggcucgcucaggc

SEQ ID NO: 1282 - RNA, 22 nt, Bordetella pertussis
ugcacggccuggcggccgacau

SEQ ID NO: 1283 - RNA, 23 nt, Bordetella pertussis
ugcacgugggcgagcgggccauc

SEQ ID NO: 1284 - RNA, 19 nt, Bordetella pertussis
ugcagcaggaucugcuggu

SEQ ID NO: 1285 - RNA, 22 nt, Bordetella pertussis
ugcagcgucuugucgagguucc

SEQ ID NO: 1286 - RNA, 22 nt, Bordetella pertussis
ugcaguccaucaagaccggcca

SEQ ID NO: 1287 - RNA, 22 nt, Bordetella pertussis
ugccaucgucgaaacggcgcgc

SEQ ID NO: 1288 - RNA, 22 nt, Bordetella pertussis
ugccaugccuggcgcaccagcg

SEQ ID NO: 1289 - RNA, 22 nt, Bordetella pertussis
ggcggcgcgaucuugugguucu

SEQ ID NO: 1290 - RNA, 22 nt, Bordetella pertussis
ggcggguggugguuucgcagca

SEQ ID NO: 1291 - RNA, 22 nt, Bordetella pertussis
ggcgguuccggcuggcgagcuc

SEQ ID NO: 1292 - RNA, 22 nt, Bordetella pertussis
ggcguaaugccaggugccgcug

SEQ ID NO: 1293 - RNA, 22 nt, Bordetella pertussis
ggcgugcuggguagugcaagua

SEQ ID NO: 1294 - RNA, 22 nt, Bordetella pertussis
ggcguggacaaggugaucauug

SEQ ID NO: 1295 - RNA, 22 nt, Bordetella pertussis
ggcugcgacacgaacaggagcu

SEQ ID NO: 1296 - RNA, 20 nt, Bordetella pertussis
uguugcgcgugaugccgagc

SEQ ID NO: 1297 - RNA, 22 nt, Bordetella pertussis
uuccagcauccgcuggcggccg

SEQ ID NO: 1298 - RNA, 22 nt, Bordetella pertussis
uuccugcgugacgaagccgauc

SEQ ID NO: 1299 - RNA, 22 nt, Bordetella pertussis
uucgaaauccauucccuucucg

SEQ ID NO: 1300 - RNA, 22 nt, Bordetella pertussis
uucgauggccaccggcgagguc

SEQ ID NO: 1301 - RNA, 22 nt, Bordetella pertussis
uucgcgcgugaugcccuggucg

SEQ ID NO: 1302 - RNA, 22 nt, Bordetella pertussis
uucgucgccauagaggaugcgg

SEQ ID NO: 1303 - RNA, 22 nt, Bordetella pertussis
uugacgggcaauuucgugacga

SEQ ID NO: 1304 - RNA, 22 nt, Bordetella pertussis
uugaugcuggacgacgcgcugu

SEQ ID NO: 1305 - RNA, 19 nt, Bordetella pertussis
uugccagacgaucagcgac

SEQ ID NO: 1306 - RNA, 22 nt, Bordetella pertussis
uugccgaugcccugugcgaacu

SEQ ID NO: 1307 - RNA, 22 nt, Bordetella pertussis
uugccgcaugucugacucugcu

SEQ ID NO: 1308 - RNA, 22 nt, Bordetella pertussis
uugccgcuggugcgcgguucgg

SEQ ID NO: 1309 - RNA, 20 nt, Bordetella pertussis
uugccggcgccauuggcgcc

SEQ ID NO: 1310 - RNA, 22 nt, Bordetella pertussis
uugccgucggucaggucugcgc

SEQ ID NO: 1311 - RNA, 19 nt, Bordetella pertussis
uugcgcaacggacgaucga

SEQ ID NO: 1312 - RNA, 22 nt, Bordetella pertussis
uugcgcaggguuucgaugucgu

SEQ ID NO: 1313 - RNA, 22 nt, Bordetella pertussis
uugcgcaguaucucggugucga

SEQ ID NO: 1314 - RNA, 22 nt, Bordetella pertussis
uugcgccaguccaggcggggcc

SEQ ID NO: 1315 - RNA, 22 nt, Bordetella pertussis
uugcgcuuguggcgaaggggcg

SEQ ID NO: 1316 - RNA, 22 nt, Bordetella pertussis
uugcuguggcuguucuggacgc

SEQ ID NO: 1317 - RNA, 22 nt, Bordetella pertussis
uuggcgccuucgaucgacacgc

SEQ ID NO: 1318 - RNA, 22 nt, Bordetella pertussis
uugucgccaugggcgcauagcc

SEQ ID NO: 1319 - RNA, 22 nt, Bordetella pertussis
uuguggcgcgucgcgcucaugc

SEQ ID NO: 1320 - RNA, 22 nt, Bordetella pertussis
uuucgccgaucugggccugguu

SEQ ID NO: 1321 - RNA, 22 nt, Bordetella pertussis
uuugccacgaccgcccaggccu

SEQ ID NO: 1322 - RNA, 22 nt, Bordetella pertussis
aaaagcugcucuagcaucaacg

SEQ ID NO: 1323 - RNA, 22 nt, Bordetella pertussis
aaagccugacgcuggucgagcu

SEQ ID NO: 1324 - RNA, 22 nt, Bordetella pertussis
aaaucccaagaaccgcauggau

SEQ ID NO: 1325 - RNA, 22 nt, Bordetella pertussis
aaaucguuguacaugaccgggu

SEQ ID NO: 1326 - RNA, 22 nt, Bordetella pertussis
aaccgccacaccuacgaggcgg

SEQ ID NO: 1327 - RNA, 22 nt, Bordetella pertussis
aacgccaccggcccguccggcu

SEQ ID NO: 1328 - RNA, 22 nt, Bordetella pertussis
aacgccggcugaagcacggcgg

SEQ ID NO: 1329 - RNA, 22 nt, Bordetella pertussis
aacggcccagcucggacagcuu

SEQ ID NO: 1330 - RNA, 22 nt, Bordetella pertussis
aacgugcggcugcgcaucaugg

SEQ ID NO: 1331 - RNA, 22 nt, Bordetella pertussis
aacugggccuugaagucggucu

SEQ ID NO: 1332 - RNA, 22 nt, Bordetella pertussis
aagaaggccgggcugacgcuca

SEQ ID NO: 1333 - RNA, 22 nt, Bordetella pertussis
aagcaguaccgaagcggcuuga

SEQ ID NO: 1334 - RNA, 22 nt, Bordetella pertussis
aagcugcuggucaggccgguuu

SEQ ID NO: 1335 - RNA, 22 nt, Bordetella pertussis
aaggcagcgccucgaucaccuc

SEQ ID NO: 1336 - RNA, 22 nt, Bordetella pertussis
aaggcgcgcagaucgccauggc

SEQ ID NO: 1337 - RNA, 22 nt, Bordetella pertussis
acagcaggaugucggcggccau

SEQ ID NO: 1338 - RNA, 23 nt, Bordetella pertussis
acagcgcuugcgcgauuucggcc

SEQ ID NO: 1339 - RNA, 22 nt, Bordetella pertussis
acaggcucuuuucauuuggcgu

SEQ ID NO: 1340 - RNA, 19 nt, Bordetella pertussis
acaucucgugcaccagccc

SEQ ID NO: 1341 - RNA, 22 nt, Bordetella pertussis
acaucugcugcucgccgcgcca

SEQ ID NO: 1342 - RNA, 22 nt, Bordetella pertussis
accaccaugcggaucgggcguu

SEQ ID NO: 1343 - RNA, 21 nt, Bordetella pertussis
accaccuugccguugcggcgg

SEQ ID NO: 1344 - RNA, 18 nt, Bordetella pertussis
accaggaugagcaugcgu

SEQ ID NO: 1345 - RNA, 22 nt, Bordetella pertussis
accaguucaccggcgcugucgc

SEQ ID NO: 1346 - RNA, 22 nt, Bordetella pertussis
accauggcggccaagcagcccg

SEQ ID NO: 1347 - RNA, 22 nt, Bordetella pertussis
accgccggguuggcgcugaggc

SEQ ID NO: 1348 - RNA, 22 nt, Bordetella pertussis
accggcguggucagcggcgcau

SEQ ID NO: 1349 - RNA, 22 nt, Bordetella pertussis
accgguuuccugggcgggcuga

SEQ ID NO: 1350 - RNA, 22 nt, Bordetella pertussis
accugcggcuuggcguugccgu

SEQ ID NO: 1351 - RNA, 22 nt, Bordetella pertussis
accugcgucauggcggcguccg

SEQ ID NO: 1352 - RNA, 22 nt, Bordetella pertussis
accuggccgacgugccgaucac

SEQ ID NO: 1353 - RNA, 22 nt, Bordetella pertussis
accuggccgggccgcugacgcc

SEQ ID NO: 1354 - RNA, 22 nt, Bordetella pertussis
accugggcgauuucaucgaaga

SEQ ID NO: 1355 - RNA, 22 nt, Bordetella pertussis
accuugugcugggcgcucgguc

SEQ ID NO: 1356 - RNA, 22 nt, Bordetella pertussis
acgaccaccggagcggcggcgg

SEQ ID NO: 1357 - RNA, 22 nt, Bordetella pertussis
acgaccacgcugccacgcgugg

SEQ ID NO: 1358 - RNA, 22 nt, Bordetella pertussis
acgaccuugccggucgacgcau

SEQ ID NO: 1359 - RNA, 22 nt, Bordetella pertussis
acgacugcguucaguuguccau

SEQ ID NO: 1360 - RNA, 22 nt, Bordetella pertussis
acgaucuggccgccgagcuggc

SEQ ID NO: 1361 - RNA, 22 nt, Bordetella pertussis
acgaugcguuccagcucgucgg

SEQ ID NO: 1362 - RNA, 22 nt, Bordetella pertussis
acgauggacaggccgaccgcca

SEQ ID NO: 1363 - RNA, 20 nt, Bordetella pertussis
acgcaugcgcagguaaagcc

SEQ ID NO: 1364 - RNA, 22 nt, Bordetella pertussis
acgccaugaaucgggucagccu

SEQ ID NO: 1365 - RNA, 22 nt, Bordetella pertussis
acgcccggcccguuguccagca

SEQ ID NO: 1366 - RNA, 22 nt, Bordetella pertussis
acgccgucgaacagucgcugcu

SEQ ID NO: 1367 - RNA, 22 nt, Bordetella pertussis
acgcgaugucucgauagugauc

SEQ ID NO: 1368 - RNA, 22 nt, Bordetella pertussis
acgcgcggccugccgggcaugg

SEQ ID NO: 1369 - RNA, 22 nt, Bordetella pertussis
acgcggaaucggccccucagcg

SEQ ID NO: 1370 - RNA, 22 nt, Bordetella pertussis
acggccugauugaaucgugcga

SEQ ID NO: 1371 - RNA, 22 nt, Bordetella pertussis
acggccuugcgccaauccaugg

SEQ ID NO: 1372 - RNA, 22 nt, Bordetella pertussis
acggcgaucucgguaucgccca

SEQ ID NO: 1373 - RNA, 22 nt, Bordetella pertussis
acggcggucaaccuggcgcugg

SEQ ID NO: 1374 - RNA, 22 nt, Bordetella pertussis
acgggcagucguaggggugcga

SEQ ID NO: 1375 - RNA, 22 nt, Bordetella pertussis
acgggcuugagguugguuucca

SEQ ID NO: 1376 - RNA, 22 nt, Bordetella pertussis
acggugcuggccgacuggugca

SEQ ID NO: 1377 - RNA, 19 nt, Bordetella pertussis
acgguugcagcgcaucguc

SEQ ID NO: 1378 - RNA, 19 nt, Bordetella pertussis
acguacggauaggacggca

SEQ ID NO: 1379 - RNA, 22 nt, Bordetella pertussis
acgugcuggucaaccugcuggu

SEQ ID NO: 1380 - RNA, 22 nt, Bordetella pertussis
acuccaucaggcagcucaugcg

SEQ ID NO: 1381 - RNA, 22 nt, Bordetella pertussis
acuggaccagggccgugcccag

SEQ ID NO: 1382 - RNA, 22 nt, Bordetella pertussis
acuggaccaggugacauucggc

SEQ ID NO: 1383 - RNA, 22 nt, Bordetella pertussis
acuguaaaccuuuuagaagugc

SEQ ID NO: 1384 - RNA, 22 nt, Bordetella pertussis
acuuccagaauuucgugcuguu

SEQ ID NO: 1385 - RNA, 22 nt, Bordetella pertussis
acuucgacgcgacccugaccaa

SEQ ID NO: 1386 - RNA, 22 nt, Bordetella pertussis
agaaggcgcucgccgcggucgg

SEQ ID NO: 1387 - RNA, 22 nt, Bordetella pertussis
agaucgucgggaugccggcguu

SEQ ID NO: 1388 - RNA, 22 nt, Bordetella pertussis
agcacgcauaucgacagcagcg

SEQ ID NO: 1389 - RNA, 17 nt, Bordetella pertussis
agcagcgccgcacgcug

SEQ ID NO: 1390 - RNA, 22 nt, Bordetella pertussis
agcagcggcucgaagcggucgc

SEQ ID NO: 1391 - RNA, 22 nt, Bordetella pertussis
agcaggcaggcuuuggcagccu

SEQ ID NO: 1392 - RNA, 22 nt, Bordetella pertussis
agcaggcuggcgcgggguucuc

SEQ ID NO: 1393 - RNA, 22 nt, Bordetella pertussis
agccagacgaaguucacgcuug

SEQ ID NO: 1394 - RNA, 22 nt, Bordetella pertussis
agccgcaugcccaccggaaagc

SEQ ID NO: 1395 - RNA, 22 nt, Bordetella pertussis
agccgcgccagcaggaugccgg

SEQ ID NO: 1396 - RNA, 22 nt, Bordetella pertussis
agccgcgucaggucgggccgcu

SEQ ID NO: 1397 - RNA, 22 nt, Bordetella pertussis
agccgcugcacaucggcgucgu

SEQ ID NO: 1398 - RNA, 22 nt, Bordetella pertussis
agccgcuggugaccgagggcgc

SEQ ID NO: 1399 - RNA, 22 nt, Bordetella pertussis
agccggcacgcgcagcugaauu

SEQ ID NO: 1400 - RNA, 22 nt, Bordetella pertussis
agccggccgaacagacgccggc

SEQ ID NO: 1401 - RNA, 22 nt, Bordetella pertussis
agccggucuggaucaggaccug

SEQ ID NO: 1402 - RNA, 22 nt, Bordetella pertussis
agccugcugcauccgcgcguca

SEQ ID NO: 1403 - RNA, 22 nt, Bordetella pertussis
agccuugguauagauccggcac

SEQ ID NO: 1404 - RNA, 22 nt, Bordetella pertussis
agcgccggcucgauggcgggau

SEQ ID NO: 1405 - RNA, 22 nt, Bordetella pertussis
agcgccuucaggaugucgcgca

SEQ ID NO: 1406 - RNA, 22 nt, Bordetella pertussis
agcgcgcagcugaccacgcugg

SEQ ID NO: 1407 - RNA, 22 nt, Bordetella pertussis
agcggcacgcgcuggaauuggc

SEQ ID NO: 1408 - RNA, 22 nt, Bordetella pertussis
agcggcgccgagacgaucguca

SEQ ID NO: 1409 - RNA, 22 nt, Bordetella pertussis
agcggcucugcgccuggucgga

SEQ ID NO: 1410 - RNA, 22 nt, Bordetella pertussis
agcggcuggaaaucgcgcugcg

SEQ ID NO: 1411 - RNA, 22 nt, Bordetella pertussis
agcgggccgcgguucaggcugc

SEQ ID NO: 1412 - RNA, 22 nt, Bordetella pertussis
agcgugugcauggccagcggca

SEQ ID NO: 1413 - RNA, 22 nt, Bordetella pertussis
agcugguggcucaggccgcugu

SEQ ID NO: 1414 - RNA, 22 nt, Bordetella pertussis
agcgcuccgcgcuguugccuga

SEQ ID NO: 1415 - RNA, 22 nt, Bordetella pertussis
agcgcugcugcagggccgcaug

SEQ ID NO: 1416 - RNA, 20 nt, Bordetella pertussis
agcgucagccagaacguggc

SEQ ID NO: 1417 - RNA, 22 nt, Bordetella pertussis
agcgucagguccuugccgacga

SEQ ID NO: 1418 - RNA, 22 nt, Bordetella pertussis
agcgugacggcgcgcugccaug

SEQ ID NO: 1419 - RNA, 22 nt, Bordetella pertussis
agcgugcuggccaggcccaccc

SEQ ID NO: 1420 - RNA, 22 nt, Bordetella pertussis
agcugcaggauuugcgccugga

SEQ ID NO: 1421 - RNA, 22 nt, Bordetella pertussis
agcugccagccguccacgaugu

SEQ ID NO: 1422 - RNA, 22 nt, Bordetella pertussis
agcuggcuuccaugaaguucau

SEQ ID NO: 1423 - RNA, 22 nt, Bordetella pertussis
agcuggucaacgcgccgucgcc

SEQ ID NO: 1424 - RNA, 22 nt, Bordetella pertussis
agcuggugcaccgcaucggcaa

SEQ ID NO: 1425 - RNA, 22 nt, Bordetella pertussis
aggacgcucgccgagguccggg

SEQ ID NO: 1426 - RNA, 22 nt, Bordetella pertussis
aggacgugcaggacgcgcuggg

SEQ ID NO: 1427 - RNA, 22 nt, Bordetella pertussis
agggcuugccuucgcgcuugaa

SEQ ID NO: 1428 - RNA, 22 nt, Bordetella pertussis
agggugccuguccccgcggaga

SEQ ID NO: 1429 - RNA, 22 nt, Bordetella pertussis
agguagccgauguucagccccg

SEQ ID NO: 1430 - RNA, 22 nt, Bordetella pertussis
aggucgaacgucaggcgcacgg

SEQ ID NO: 1431 - RNA, 22 nt, Bordetella pertussis
aggucggguggaaugcugagcg

SEQ ID NO: 1432 - RNA, 22 nt, Bordetella pertussis
aggucguagcgcugcggcuccu

SEQ ID NO: 1433 - RNA, 22 nt, Bordetella pertussis
agguugacgucguugcccaggg

SEQ ID NO: 1434 - RNA, 22 nt, Bordetella pertussis
agguuggccaccagcaccguca

SEQ ID NO: 1435 - RNA, 22 nt, Bordetella pertussis
aguccuggccgcgcacgaucag

SEQ ID NO: 1436 - RNA, 22 nt, Bordetella pertussis
agugcgucaaccugcccgugcg

SEQ ID NO: 1437 - RNA, 23 nt, Bordetella pertussis
agugggcagggugcaugcgcgcc

SEQ ID NO: 1438 - RNA, 22 nt, Bordetella pertussis
aguucacguauaucggcggcau

SEQ ID NO: 1439 - RNA, 20 nt, Bordetella pertussis
aguuugccucggagcuggcc

SEQ ID NO: 1440 - RNA, 22 nt, Bordetella pertussis
auaugcccaugucgcgccagcu

SEQ ID NO: 1441 - RNA, 22 nt, Bordetella pertussis
aucaaccgugcgcggauugcgc

SEQ ID NO: 1442 - RNA, 22 nt, Bordetella pertussis
aucacgacguugcgcaggucca

SEQ ID NO: 1443 - RNA, 22 nt, Bordetella pertussis
aucacggugugcucggccuuga

SEQ ID NO: 1444 - RNA, 23 nt, Bordetella pertussis
aucagcaucuuuucgggcauguu

SEQ ID NO: 1445 - RNA, 21 nt, Bordetella pertussis
aucagcgcguaggcguggccc

SEQ ID NO: 1446 - RNA, 22 nt, Bordetella pertussis
aucaggcgcgaggucagcguuu

SEQ ID NO: 1447 - RNA, 22 nt, Bordetella pertussis
aucaugagguucuugaugcgca

SEQ ID NO: 1448 - RNA, 23 nt, Bordetella pertussis
aucaugcugaauuuguacagguc

SEQ ID NO: 1449 - RNA, 22 nt, Bordetella pertussis
auccagggggugauccugcugu

SEQ ID NO: 1450 - RNA, 22 nt, Bordetella pertussis
auccgcaucggcgaccgugacg

SEQ ID NO: 1451 - RNA, 18 nt, Bordetella pertussis
auccgccagggacugcaa

SEQ ID NO: 1452 - RNA, 22 nt, Bordetella pertussis
auccggcucgugguccagcgcg

SEQ ID NO: 1453 - RNA, 22 nt, Bordetella pertussis
auccgucggccacgaauuucuc

SEQ ID NO: 1454 - RNA, 22 nt, Bordetella pertussis
auccugccggugaucaacgaag

SEQ ID NO: 1455 - RNA, 22 nt, Bordetella pertussis
aucgagccguggcguaaugcgc

SEQ ID NO: 1456 - RNA, 22 nt, Bordetella pertussis
aucgauggugccgaucuccacg

SEQ ID NO: 1457 - RNA, 22 nt, Bordetella pertussis
aucgccguacuucucgccgaac

SEQ ID NO: 1458 - RNA, 22 nt, Bordetella pertussis
aucggaugagauccaugcgcaa

SEQ ID NO: 1459 - RNA, 22 nt, Bordetella pertussis
aucggcggugucgguauugguc

SEQ ID NO: 1460 - RNA, 22 nt, Bordetella pertussis
aucggcguccugcgcguuccag

SEQ ID NO: 1461 - RNA, 22 nt, Bordetella pertussis
aucgggcagcagccgcagcagg

SEQ ID NO: 1462 - RNA, 22 nt, Bordetella pertussis
aucuggcaucccuggcugccug

SEQ ID NO: 1463 - RNA, 22 nt, Bordetella pertussis
aucuugcgcggcaaggccgccg

SEQ ID NO: 1464 - RNA, 22 nt, Bordetella pertussis
augacgauuucguggccccauu

SEQ ID NO: 1465 - RNA, 22 nt, Bordetella pertussis
augacgugcgauacgcccggua

SEQ ID NO: 1466 - RNA, 22 nt, Bordetella pertussis
augagcucguugccagcucauc

SEQ ID NO: 1467 - RNA, 22 nt, Bordetella pertussis
augaggcccaugccaugcgugc

SEQ ID NO: 1468 - RNA, 22 nt, Bordetella pertussis
augcccagcgguugcgcggcca

SEQ ID NO: 1469 - RNA, 22 nt, Bordetella pertussis
augcccgaagccagcgccaggc

SEQ ID NO: 1470 - RNA, 22 nt, Bordetella pertussis
augccgagguccugcuggcgca

SEQ ID NO: 1471 - RNA, 17 nt, Bordetella pertussis
augcgaggcguugaucg

SEQ ID NO: 1472 - RNA, 22 nt, Bordetella pertussis
augcgcaucgauucgugcguca

SEQ ID NO: 1473 - RNA, 22 nt, Bordetella pertussis
augcgcauuuccuccugcagcu

SEQ ID NO: 1474 - RNA, 22 nt, Bordetella pertussis
augcgccagaugcagggcggcg

SEQ ID NO: 1475 - RNA, 22 nt, Bordetella pertussis
augcgcucgaggacgucgaugg

SEQ ID NO: 1476 - RNA, 22 nt, Bordetella pertussis
augcgcucgugccggucggcgg

SEQ ID NO: 1477 - RNA, 22 nt, Bordetella pertussis
augcugaccggcucgaugaacg

SEQ ID NO: 1478 - RNA, 22 nt, Bordetella pertussis
augcugaucgaucccgaugcga

SEQ ID NO: 1479 - RNA, 22 nt, Bordetella pertussis
augcugaucgcccgccugccgu

SEQ ID NO: 1480 - RNA, 22 nt, Bordetella pertussis
augcuggcggugaacgugaacu

SEQ ID NO: 1481 - RNA, 22 nt, Bordetella pertussis
auggagaagcagugugcgggca

SEQ ID NO: 1482 - RNA, 22 nt, Bordetella pertussis
auggaugccguaggcugcguac

SEQ ID NO: 1483 - RNA, 22 nt, Bordetella pertussis
auggcauggcacucguucggcg

SEQ ID NO: 1484 - RNA, 22 nt, Bordetella pertussis
auggccgugcucgccgcaugca

SEQ ID NO: 1485 - RNA, 22 nt, Bordetella pertussis
auggccuguugcgaacccugca

SEQ ID NO: 1486 - RNA, 22 nt, Bordetella pertussis
auggccuuggcggcgguggcga

SEQ ID NO: 1487 - RNA, 22 nt, Bordetella pertussis
auggcgcgcaucacgauggccu

SEQ ID NO: 1488 - RNA, 22 nt, Bordetella pertussis
auggcgucgggcgugcccuugg

SEQ ID NO: 1489 - RNA, 22 nt, Bordetella pertussis
auggcguuccaucugccuggua

SEQ ID NO: 1490 - RNA, 22 nt, Bordetella pertussis
auggcugggcgacuacggcagc

SEQ ID NO: 1491 - RNA, 22 nt, Bordetella pertussis
augggcgcgucgcuggcgucga

SEQ ID NO: 1492 - RNA, 22 nt, Bordetella pertussis
augucggcaaacgaggcgcgca

SEQ ID NO: 1493 - RNA, 23 nt, Bordetella pertussis
auguggccaccucgcguggcgcu

SEQ ID NO: 1494 - RNA, 22 nt, Bordetella pertussis
auucggcccgcgccaugcucug

SEQ ID NO: 1495 - RNA, 22 nt, Bordetella pertussis
auuggccaggcuggcgccggug

SEQ ID NO: 1496 - RNA, 22 nt, Bordetella pertussis
caaccuggaauucaccgacaug

SEQ ID NO: 1497 - RNA, 20 nt, Bordetella pertussis
caagccggugcugugcuggg

SEQ ID NO: 1498 - RNA, 22 nt, Bordetella pertussis
caaggacgaaaccugggccgac

SEQ ID NO: 1499 - RNA, 22 nt, Bordetella pertussis
caagggcgugggagagugcgcc

SEQ ID NO: 1500 - RNA, 22 nt, Bordetella pertussis
caaugggccuauuucgcgcgcg

SEQ ID NO: 1501 - RNA, 22 nt, Bordetella pertussis
cacagcuaguucuccgccuggc

SEQ ID NO: 1502 - RNA, 22 nt, Bordetella pertussis
cacaggcugcucguucuucauc

SEQ ID NO: 1503 - RNA, 22 nt, Bordetella pertussis
caccagauacugcgccuggccc

SEQ ID NO: 1504 - RNA, 22 nt, Bordetella pertussis
caccagguugaacaucuccugg

SEQ ID NO: 1505 - RNA, 22 nt, Bordetella pertussis
caccaguuccuggcccuugcgc

SEQ ID NO: 1506 - RNA, 22 nt, Bordetella pertussis
caccgccgcgcccugggacgag

SEQ ID NO: 1507 - RNA, 22 nt, Bordetella pertussis
caccuguuccaugccgcgucca

SEQ ID NO: 1508 - RNA, 20 nt, Bordetella pertussis
cacgaagacgugcucggcgc

SEQ ID NO: 1509 - RNA, 22 nt, Bordetella pertussis
cacgacacgcaaaggaugucgc

SEQ ID NO: 1510 - RNA, 22 nt, Bordetella pertussis
cacgaugcggcgcucgaccggc

SEQ ID NO: 1511 - RNA, 22 nt, Bordetella pertussis
cacgccaccacgcgauccggag

SEQ ID NO: 1512 - RNA, 22 nt, Bordetella pertussis
cacgccgaacugcuggccggca

SEQ ID NO: 1513 - RNA, 22 nt, Bordetella pertussis
cacgccgccaugcaggucauuc

SEQ ID NO: 1514 - RNA, 22 nt, Bordetella pertussis
cacggaauuccgggugucuguc

SEQ ID NO: 1515 - RNA, 22 nt, Bordetella pertussis
cacguuggcgacgaucaggccg

SEQ ID NO: 1516 - RNA, 22 nt, Bordetella pertussis
cagaacgauguuggccugcuug

SEQ ID NO: 1517 - RNA, 19 nt, Bordetella pertussis
cacguccugcuugcgcuug

SEQ ID NO: 1518 - RNA, 22 nt, Bordetella pertussis
cacguggcggccggcaagcugg

SEQ ID NO: 1519 - RNA, 22 nt, Bordetella pertussis
cagcaaggccugcucggugggc

SEQ ID NO: 1520 - RNA, 22 nt, Bordetella pertussis
cagccacucgacagccuguacc

SEQ ID NO: 1521 - RNA, 22 nt, Bordetella pertussis
cagccccgccgcuucgaugacg

SEQ ID NO: 1522 - RNA, 22 nt, Bordetella pertussis
cagccgguggucggcagcgcga

SEQ ID NO: 1523 - RNA, 22 nt, Bordetella pertussis
cagccguuggacguggccagcu

SEQ ID NO: 1524 - RNA, 22 nt, Bordetella pertussis
cagcgugacgccgcguccggcc

SEQ ID NO: 1525 - RNA, 22 nt, Bordetella pertussis
cagcgugccggcggcggucgua

SEQ ID NO: 1526 - RNA, 22 nt, Bordetella pertussis
cagcguggucgucgccgcguug

SEQ ID NO: 1527 - RNA, 22 nt, Bordetella pertussis
cagcugcccaucgaacgcgugc

SEQ ID NO: 1528 - RNA, 22 nt, Bordetella pertussis
cagcugcuggccgucggcgccg

SEQ ID NO: 1529 - RNA, 22 nt, Bordetella pertussis
cagcuggccgagcagggcgugg

SEQ ID NO: 1530 - RNA, 22 nt, Bordetella pertussis
cagcuggcggugcaccggcgag

SEQ ID NO: 1531 - RNA, 22 nt, Bordetella pertussis
caggaaggggugaccgccggca

SEQ ID NO: 1532 - RNA, 22 nt, Bordetella pertussis
caggccgacgaacgcagcaugu

SEQ ID NO: 1533 - RNA, 22 nt, Bordetella pertussis
caggcgaugccgccguucuggu

SEQ ID NO: 1534 - RNA, 22 nt, Bordetella pertussis
caggcgggcgaauucggccugg

SEQ ID NO: 1535 - RNA, 22 nt, Bordetella pertussis
caggcgguccaggucgaugcgc

SEQ ID NO: 1536 - RNA, 22 nt, Bordetella pertussis
cagggacauggcagugccgggu

SEQ ID NO: 1537 - RNA, 22 nt, Bordetella pertussis
cagggcguagcuuugaaagacc

SEQ ID NO: 1538 - RNA, 22 nt, Bordetella pertussis
caggucgucggccagcgugucg

SEQ ID NO: 1539 - RNA, 22 nt, Bordetella pertussis
caguccccgccggggacaggca

SEQ ID NO: 1540 - RNA, 22 nt, Bordetella pertussis
cagucgcuguucgugcaggugc

SEQ ID NO: 1541 - RNA, 22 nt, Bordetella pertussis
cagugcgaguucaacggcaugu

SEQ ID NO: 1542 - RNA, 22 nt, Bordetella pertussis
caguucaucgugcgccagcagg

SEQ ID NO: 1543 - RNA, 22 nt, Bordetella pertussis
caguugaucggccagcgccugg

SEQ ID NO: 1544 - RNA, 22 nt, Bordetella pertussis
caucaccugcugaugucggcgg

SEQ ID NO: 1545 - RNA, 22 nt, Bordetella pertussis
caucagcacgcugcugugggcg

SEQ ID NO: 1546 - RNA, 22 nt, Bordetella pertussis
caucguauggcggggugccugu

SEQ ID NO: 1547 - RNA, 22 nt, Bordetella pertussis
caucuugcgccgaaaacgcgca

SEQ ID NO: 1548 - RNA, 22 nt, Bordetella pertussis
caugcgcgacguggauuucaag

SEQ ID NO: 1549 - RNA, 22 nt, Bordetella pertussis
caugcggcccugcagcagcgcu

SEQ ID NO: 1550 - RNA, 22 nt, Bordetella pertussis
caugcucuugccgcugcccgac

SEQ ID NO: 1551 - RNA, 22 nt, Bordetella pertussis
caugcugguugucaccggccag

SEQ ID NO: 1552 - RNA, 22 nt, Bordetella pertussis
cauggauguugaccagcacggg

SEQ ID NO: 1553 - RNA, 22 nt, Bordetella pertussis
cauggcgaugggauacuucgcc

SEQ ID NO: 1554 - RNA, 22 nt, Bordetella pertussis
cauguccagcgucacgcccacc

SEQ ID NO: 1555 - RNA, 22 nt, Bordetella pertussis
ccacauagcgcuggcagcgcuc

SEQ ID NO: 1556 - RNA, 22 nt, Bordetella pertussis
ccacgcguagauggccuggucg

SEQ ID NO: 1557 - RNA, 22 nt, Bordetella pertussis
ccacggcacugcucaccacgca

SEQ ID NO: 1558 - RNA, 19 nt, Bordetella pertussis
ccagaucgcgcuggcgcgc

SEQ ID NO: 1559 - RNA, 22 nt, Bordetella pertussis
ccagcacggccugcgccuggcu

SEQ ID NO: 1560 - RNA, 22 nt, Bordetella pertussis
ccagcaggugcgugucggcaaa

SEQ ID NO: 1561 - RNA, 22 nt, Bordetella pertussis
ccagcgcauggucgaggaugcg

SEQ ID NO: 1562 - RNA, 22 nt, Bordetella pertussis
ccagcggccagaugccuggcgc

SEQ ID NO: 1563 - RNA, 22 nt, Bordetella pertussis
ccagcgucagccccaccacggc

SEQ ID NO: 1564 - RNA, 22 nt, Bordetella pertussis
ccagcguggcguccaggcuggc

SEQ ID NO: 1565 - RNA, 22 nt, Bordetella pertussis
ccaggccaggucgccauggccg

SEQ ID NO: 1566 - RNA, 22 nt, Bordetella pertussis
ccaggcccuugacgcgcuguuc

SEQ ID NO: 1567 - RNA, 22 nt, Bordetella pertussis
ccagggagaaauccuggcggcc

SEQ ID NO: 1568 - RNA, 22 nt, Bordetella pertussis
ccaggucggcggccuggccggc

SEQ ID NO: 1569 - RNA, 22 nt, Bordetella pertussis
ccagguucaugggcguacggaa

SEQ ID NO: 1570 - RNA, 22 nt, Bordetella pertussis
ccaucgaagcguucgggcucga

SEQ ID NO: 1571 - RNA, 22 nt, Bordetella pertussis
ccaugcaggaauaccgccggcu

SEQ ID NO: 1572 - RNA, 22 nt, Bordetella pertussis
ccaugccgacaccggcacggug

SEQ ID NO: 1573 - RNA, 22 nt, Bordetella pertussis
ccaugcugaccaacaugcuggg

SEQ ID NO: 1574 - RNA, 21 nt, Bordetella pertussis
cccaugaaauccgcgagccgc

SEQ ID NO: 1575 - RNA, 22 nt, Bordetella pertussis
ccccgcugcggcaagggugccu

SEQ ID NO: 1576 - RNA, 22 nt, Bordetella pertussis
cccgccuuggacgcggcauacg

SEQ ID NO: 1577 - RNA, 22 nt, Bordetella pertussis
cccggcuggaagucggugaccu

SEQ ID NO: 1578 - RNA, 22 nt, Bordetella pertussis
cccggcugguggcgaccugggg

SEQ ID NO: 1579 - RNA, 22 nt, Bordetella pertussis
cccgugcaccgagauggcguag

SEQ ID NO: 1580 - RNA, 22 nt, Bordetella pertussis
cccuggugcagcacggcacgca

SEQ ID NO: 1581 - RNA, 21 nt, Bordetella pertussis
ccgaaccggcguaguacucga

SEQ ID NO: 1582 - RNA, 22 nt, Bordetella pertussis
ccgaacgcauuaccagggcuau

SEQ ID NO: 1583 - RNA, 21 nt, Bordetella pertussis
ccgacgccgacccgcaguucg

SEQ ID NO: 1584 - RNA, 22 nt, Bordetella pertussis
ccgagaucaagacgccgaugau

SEQ ID NO: 1585 - RNA, 22 nt, Bordetella pertussis
ccgaggccaggaucucgcgcgc

SEQ ID NO: 1586 - RNA, 22 nt, Bordetella pertussis
ccgauaccucggucguguacug

SEQ ID NO: 1587 - RNA, 22 nt, Bordetella pertussis
ccgccgacggcuuucgugucgc

SEQ ID NO: 1588 - RNA, 22 nt, Bordetella pertussis
ccgccgccggcguacugauccg

SEQ ID NO: 1589 - RNA, 22 nt, Bordetella pertussis
ccgcgcauguuucaaucggucu

SEQ ID NO: 1590 - RNA, 22 nt, Bordetella pertussis
ccgcgccacgcgcguggucaag

SEQ ID NO: 1591 - RNA, 22 nt, Bordetella pertussis
ccgcgcucaugcugaaauccgc

SEQ ID NO: 1592 - RNA, 22 nt, Bordetella pertussis
ccggagagcccgucgaagugcc

SEQ ID NO: 1593 - RNA, 22 nt, Bordetella pertussis
ccggaucgagcggguugcccuu

SEQ ID NO: 1594 - RNA, 22 nt, Bordetella pertussis
ccggcaccaggcgguggugcag

SEQ ID NO: 1595 - RNA, 22 nt, Bordetella pertussis
ccggccagcggcaacuggcgca

SEQ ID NO: 1596 - RNA, 22 nt, Bordetella pertussis
ccggccguggccgucgugcagc

SEQ ID NO: 1597 - RNA, 22 nt, Bordetella pertussis
ccggccugacccguauccgcug

SEQ ID NO: 1598 - RNA, 22 nt, Bordetella pertussis
ccggucgugaugggcuugccgu

SEQ ID NO: 1599 - RNA, 22 nt, Bordetella pertussis
ccggugcgcggaaucagcgccg

SEQ ID NO: 1600 - RNA, 22 nt, Bordetella pertussis
ccgguggccgcaauugcccgau

SEQ ID NO: 1601 - RNA, 22 nt, Bordetella pertussis
ccggugggcaaggacucgcugu

SEQ ID NO: 1602 - RNA, 22 nt, Bordetella pertussis
ccgucagccgcuguucgccgac

SEQ ID NO: 1603 - RNA, 22 nt, Bordetella pertussis
ccguccacgugagguccaucgu

SEQ ID NO: 1604 - RNA, 22 nt, Bordetella pertussis
ccgucgggcgcggccuuggcca

SEQ ID NO: 1605 - RNA, 22 nt, Bordetella pertussis
ccgugcgcaaggcauggcccag

SEQ ID NO: 1606 - RNA, 22 nt, Bordetella pertussis
ccuagccauaacagugcucuac

SEQ ID NO: 1607 - RNA, 22 nt, Bordetella pertussis
cggggacaggcgccccgucaug

SEQ ID NO: 1608 - RNA, 22 nt, Bordetella pertussis
cggggcugaccagcccguuuuc

SEQ ID NO: 1609 - RNA, 22 nt, Bordetella pertussis
cggucugcuugugcagcgaacg

SEQ ID NO: 1610 - RNA, 22 nt, Bordetella pertussis
cggugcgcgaccagcccgucac

SEQ ID NO: 1611 - RNA, 22 nt, Bordetella pertussis
cggugcucgacggcgccagccu

SEQ ID NO: 1612 - RNA, 18 nt, Bordetella pertussis
cguagucgaucugcugcc

SEQ ID NO: 1613 - RNA, 21 nt, Bordetella pertussis
cgucaacgugucgguguccag

SEQ ID NO: 1614 - RNA, 22 nt, Bordetella pertussis
cgucaucacgauguaugucgaa

SEQ ID NO: 1615 - RNA, 21 nt, Bordetella pertussis
cgucauccaggucgacggcga

SEQ ID NO: 1616 - RNA, 22 nt, Bordetella pertussis
cguccaggccaucggucagguu

SEQ ID NO: 1617 - RNA, 18 nt, Bordetella pertussis
cgucccgagcugaucgaa

SEQ ID NO: 1618 - RNA, 22 nt, Bordetella pertussis
cgucccguacaagggcagcgcc

SEQ ID NO: 1619 - RNA, 22 nt, Bordetella pertussis
cguccuugaccucggccagggg

SEQ ID NO: 1620 - RNA, 22 nt, Bordetella pertussis
cgucgaucucgacccaggcgcc

SEQ ID NO: 1621 - RNA, 20 nt, Bordetella pertussis
cgugaugcgcaccguaucca

SEQ ID NO: 1622 - RNA, 22 nt, Bordetella pertussis
cgugcagggcuuccagcgucac

SEQ ID NO: 1623 - RNA, 22 nt, Bordetella pertussis
cguggccgccaaccaguacggc

SEQ ID NO: 1624 - RNA, 21 nt, Bordetella pertussis
cguggccgccgugcugggcgu

SEQ ID NO: 1625 - RNA, 22 nt, Bordetella pertussis
cgugucgagcugggcauggcgc

SEQ ID NO: 1626 - RNA, 22 nt, Bordetella pertussis
cgugugggccguggccgguacg

SEQ ID NO: 1627 - RNA, 22 nt, Bordetella pertussis
cguuccgccccgaguuccugaa

SEQ ID NO: 1628 - RNA, 22 nt, Bordetella pertussis
cguugcgguccagcguggcgcc

SEQ ID NO: 1629 - RNA, 22 nt, Bordetella pertussis
cuccccgcgcuuccggggcgag

SEQ ID NO: 1630 - RNA, 22 nt, Bordetella pertussis
cucgaucggcuguaccaggcgc

SEQ ID NO: 1631 - RNA, 22 nt, Bordetella pertussis
cucgcuggcgcagcccaggcag

SEQ ID NO: 1632 - RNA, 22 nt, Bordetella pertussis
cucgggcaggaagaaggcgucg

SEQ ID NO: 1633 - RNA, 22 nt, Bordetella pertussis
cucgggcggcuacggcaccucg

SEQ ID NO: 1634 - RNA, 22 nt, Bordetella pertussis
cucguacaccacgcgcgagccg

SEQ ID NO: 1635 - RNA, 22 nt, Bordetella pertussis
cucgucgguggucagcaucaag

SEQ ID NO: 1636 - RNA, 22 nt, Bordetella pertussis
cugaccgaucccgaagugcugg

SEQ ID NO: 1637 - RNA, 22 nt, Bordetella pertussis
cugaucauguuccagcugggcg

SEQ ID NO: 1638 - RNA, 22 nt, Bordetella pertussis
cugcaccggcuggacugcugcg

SEQ ID NO: 1639 - RNA, 22 nt, Bordetella pertussis
cugcauggcguugguagccacc

SEQ ID NO: 1640 - RNA, 22 nt, Bordetella pertussis
cugccaggauacccgccugccc

SEQ ID NO: 1641 - RNA, 22 nt, Bordetella pertussis
cugccggauuucgaccagagca

SEQ ID NO: 1642 - RNA, 22 nt, Bordetella pertussis
cugccgguauagccgacggccu

SEQ ID NO: 1643 - RNA, 22 nt, Bordetella pertussis
cugcgccuuggacagcgggccg

SEQ ID NO: 1644 - RNA, 22 nt, Bordetella pertussis
cugcgcgguaucgcgaucgauc

SEQ ID NO: 1645 - RNA, 22 nt, Bordetella pertussis
cugcgcgugcugggcacggcca

SEQ ID NO: 1646 - RNA, 22 nt, Bordetella pertussis
cugcuggugcugggcuuugcca

SEQ ID NO: 1647 - RNA, 22 nt, Bordetella pertussis
cuggaucggcaacggcggcgcg

SEQ ID NO: 1648 - RNA, 22 nt, Bordetella pertussis
cuggccgugcugcggcgcauca

SEQ ID NO: 1649 - RNA, 22 nt, Bordetella pertussis
cuggcgaucgugcugggcauga

SEQ ID NO: 1650 - RNA, 22 nt, Bordetella pertussis
cuggcgauggccugaugggugu

SEQ ID NO: 1651 - RNA, 22 nt, Bordetella pertussis
cuggcgauuucgguguguguga

SEQ ID NO: 1652 - RNA, 22 nt, Bordetella pertussis
cuggcgcugucguucgccuugc

SEQ ID NO: 1653 - RNA, 22 nt, Bordetella pertussis
cuggcugcagccgcaagccagc

SEQ ID NO: 1654 - RNA, 22 nt, Bordetella pertussis
cugggcguacgcgcggauauga

SEQ ID NO: 1655 - RNA, 22 nt, Bordetella pertussis
cugggcgugcugcugcuggacc

SEQ ID NO: 1656 - RNA, 22 nt, Bordetella pertussis
cugggucugcucgaucugcagg

SEQ ID NO: 1657 - RNA, 22 nt, Bordetella pertussis
cugguaggcauuucggccggcg

SEQ ID NO: 1658 - RNA, 20 nt, Bordetella pertussis
cuggucaacgacaccaugau

SEQ ID NO: 1659 - RNA, 22 nt, Bordetella pertussis
cuguacggccagcggccggcag

SEQ ID NO: 1660 - RNA, 22 nt, Bordetella pertussis
cugucccgcaugaggacaggcg

SEQ ID NO: 1661 - RNA, 22 nt, Bordetella pertussis
cugucccggcggggacaggcac

SEQ ID NO: 1662 - RNA, 22 nt, Bordetella pertussis
cugucguacgcuugccagagaa

SEQ ID NO: 1663 - RNA, 17 nt, Bordetella pertussis
cugucguaugucgagca

SEQ ID NO: 1664 - RNA, 22 nt, Bordetella pertussis
cugugggcgcgacgcgccgacc

SEQ ID NO: 1665 - RNA, 22 nt, Bordetella pertussis
cuugccggaacggucggugacg

SEQ ID NO: 1666 - RNA, 22 nt, Bordetella pertussis
cuugggccggcgguucuggcac

SEQ ID NO: 1667 - RNA, 22 nt, Bordetella pertussis
cuuggucaggaagcgcaugcgc

SEQ ID NO: 1668 - RNA, 19 nt, Bordetella pertussis
cuugucggucgggccgguc

SEQ ID NO: 1669 - RNA, 22 nt, Bordetella pertussis
cuuguugcgcgaaccgccgcga

SEQ ID NO: 1670 - RNA, 22 nt, Bordetella pertussis
gaacaugccgaugccgguauag

SEQ ID NO: 1671 - RNA, 22 nt, Bordetella pertussis
gacaccuacgagccggcgccgc

SEQ ID NO: 1672 - RNA, 22 nt, Bordetella pertussis
gaccacgauguacugguccagc

SEQ ID NO: 1673 - RNA, 22 nt, Bordetella pertussis
gaccaggagcugcgccagcagc

SEQ ID NO: 1674 - RNA, 22 nt, Bordetella pertussis
gacccagggguucgggccgcag

SEQ ID NO: 1675 - RNA, 22 nt, Bordetella pertussis
gaccgcuacggggauuuccugg

SEQ ID NO: 1676 - RNA, 22 nt, Bordetella pertussis
gaccggcacccacggaguugcc

SEQ ID NO: 1677 - RNA, 20 nt, Bordetella pertussis
gaccggcgaucccgccacga

SEQ ID NO: 1678 - RNA, 22 nt, Bordetella pertussis
gaccgggucuucguuggcgaag

SEQ ID NO: 1679 - RNA, 18 nt, Bordetella pertussis
gacgacaucgccaucgcc

SEQ ID NO: 1680 - RNA, 22 nt, Bordetella pertussis
gacggcagcuucggcuucaccg

SEQ ID NO: 1681 - RNA, 22 nt, Bordetella pertussis
gacgggucuugggcuucaugcg

SEQ ID NO: 1682 - RNA, 22 nt, Bordetella pertussis
gacguugacgaugaugccgcaa

SEQ ID NO: 1683 - RNA, 22 nt, Bordetella pertussis
gacuucgacgaacagggcgaua

SEQ ID NO: 1684 - RNA, 23 nt, Bordetella pertussis
gagaacugacggcggcgccuagu

SEQ ID NO: 1685 - RNA, 22 nt, Bordetella pertussis
gagcacaugcugacgcaggccg

SEQ ID NO: 1686 - RNA, 22 nt, Bordetella pertussis
gagccgcccaccgcgguggugg

SEQ ID NO: 1687 - RNA, 22 nt, Bordetella pertussis
gagcguguagccgucgggcagc

SEQ ID NO: 1688 - RNA, 22 nt, Bordetella pertussis
gagcucgaagucgacaacuggg

SEQ ID NO: 1689 - RNA, 21 nt, Bordetella pertussis
gagcuggugaucaugaucgca

SEQ ID NO: 1690 - RNA, 22 nt, Bordetella pertussis
ccggccugcucaagcccucggc

SEQ ID NO: 1691 - RNA, 22 nt, Bordetella pertussis
ccggcggugcccagcagguccc

SEQ ID NO: 1692 - RNA, 22 nt, Bordetella pertussis
ccggcgguggugucgcccggcg

SEQ ID NO: 1693 - RNA, 22 nt, Bordetella pertussis
ccggcgugcugcagcgccugca

SEQ ID NO: 1694 - RNA, 22 nt, Bordetella pertussis
ccggcugaggccgcgcggccug

SEQ ID NO: 1695 - RNA, 22 nt, Bordetella pertussis
ccggcuggcauccgcgggccgg

SEQ ID NO: 1696 - RNA, 22 nt, Bordetella pertussis
ccggguuucaucgaugugcacg

SEQ ID NO: 1697 - RNA, 22 nt, Bordetella pertussis
gaugauggcgggugcguugaag

SEQ ID NO: 1698 - RNA, 22 nt, Bordetella pertussis
gaugauguagcgcgugacgcgc

SEQ ID NO: 1699 - RNA, 22 nt, Bordetella pertussis
gauggccggaucggccaggaaa

SEQ ID NO: 1700 - RNA, 22 nt, Bordetella pertussis
gauggccugcauggcgucgcgc

SEQ ID NO: 1701 - RNA, 22 nt, Bordetella pertussis
gaugucgccuucaccacgcucg

SEQ ID NO: 1702 - RNA, 22 nt, Bordetella pertussis
gauugccaucgccggcauggaa

SEQ ID NO: 1703 - RNA, 22 nt, Bordetella pertussis
gcacagcugcaugagcgcgggu

SEQ ID NO: 1704 - RNA, 22 nt, Bordetella pertussis
gcacgcccugcacgccguccag

SEQ ID NO: 1705 - RNA, 22 nt, Bordetella pertussis
gcacuacgcggugucgaucgcg

SEQ ID NO: 1706 - RNA, 22 nt, Bordetella pertussis
gcagcaugaagcggucgcggua

SEQ ID NO: 1707 - RNA, 22 nt, Bordetella pertussis
gcagcgccgccgaugugaucga

SEQ ID NO: 1708 - RNA, 22 nt, Bordetella pertussis
gcagcuggacgugcgcagcaug

SEQ ID NO: 1709 - RNA, 22 nt, Bordetella pertussis
gcaggcggcggaagucggccua

SEQ ID NO: 1710 - RNA, 22 nt, Bordetella pertussis
gcauacaaccuauugaaucuuc

SEQ ID NO: 1711 - RNA, 22 nt, Bordetella pertussis
gcauacuccgcguagcuggcga

SEQ ID NO: 1712 - RNA, 22 nt, Bordetella pertussis
gcaucgcaauaucaacaacgaa

SEQ ID NO: 1713 - RNA, 22 nt, Bordetella pertussis
gcaugcaggugguugaagcgca

SEQ ID NO: 1714 - RNA, 22 nt, Bordetella pertussis
gcaugccgagaucacgucguuc

SEQ ID NO: 1715 - RNA, 19 nt, Bordetella pertussis
gcaugcuguucauguggcc

SEQ ID NO: 1716 - RNA, 22 nt, Bordetella pertussis
gccaacgaggagcugcgccacc

SEQ ID NO: 1717 - RNA, 22 nt, Bordetella pertussis
gccaagguguauuucacggugu

SEQ ID NO: 1718 - RNA, 22 nt, Bordetella pertussis
gccaccguggugcugguggcgu

SEQ ID NO: 1719 - RNA, 22 nt, Bordetella pertussis
gccacgggucgggacaggcacc

SEQ ID NO: 1720 - RNA, 22 nt, Bordetella pertussis
gccagccggugccggccgacca

SEQ ID NO: 1721 - RNA, 22 nt, Bordetella pertussis
gccaggccgagcaggcguucga

SEQ ID NO: 1722 - RNA, 22 nt, Bordetella pertussis
gccaggcgcccggcgaggucuu

SEQ ID NO: 1723 - RNA, 22 nt, Bordetella pertussis
gccagguagguggugauggcgg

SEQ ID NO: 1724 - RNA, 22 nt, Bordetella pertussis
gccaggucaagagcguggcgua

SEQ ID NO: 1725 - RNA, 22 nt, Bordetella pertussis
gccaucugcauggcaagggcaa

SEQ ID NO: 1726 - RNA, 22 nt, Bordetella pertussis
gccauggucaacucgcugaucg

SEQ ID NO: 1727 - RNA, 22 nt, Bordetella pertussis
gccauggugacuaccgaccccg

SEQ ID NO: 1728 - RNA, 22 nt, Bordetella pertussis
gccauggugccgcguuuucucg

SEQ ID NO: 1729 - RNA, 21 nt, Bordetella pertussis
gccaugucacggccuugccuu

SEQ ID NO: 1730 - RNA, 22 nt, Bordetella pertussis
gcccaagaucucgucgucgcug

SEQ ID NO: 1731 - RNA, 22 nt, Bordetella pertussis
gcccaccccuucaugcguuggc

SEQ ID NO: 1732 - RNA, 22 nt, Bordetella pertussis
gcccaucuucacgcauuugugg

SEQ ID NO: 1733 - RNA, 22 nt, Bordetella pertussis
gcccaugcucgacgccaucgcc

SEQ ID NO: 1734 - RNA, 22 nt, Bordetella pertussis
gcccgcaucaagcgccugcugg

SEQ ID NO: 1735 - RNA, 22 nt, Bordetella pertussis
gcccgcugcuuccggcaagacg

SEQ ID NO: 1736 - RNA, 22 nt, Bordetella pertussis
gcccgucaccgugaugcgaccg

SEQ ID NO: 1737 - RNA, 22 nt, Bordetella pertussis
gccgagcgucaauucgucaaca

SEQ ID NO: 1738 - RNA, 22 nt, Bordetella pertussis
gccgagcugcgcgggcaggcca

SEQ ID NO: 1739 - RNA, 22 nt, Bordetella pertussis
gccgaucgcguggcggugaugu

SEQ ID NO: 1740 - RNA, 22 nt, Bordetella pertussis
gccgaucugcugcgucaggccg

SEQ ID NO: 1741 - RNA, 22 nt, Bordetella pertussis
gccgaugaagacgaugccggcg

SEQ ID NO: 1742 - RNA, 22 nt, Bordetella pertussis
gccgaugacgauggccaguucg

SEQ ID NO: 1743 - RNA, 22 nt, Bordetella pertussis
gccgaugcggauccggccggag

SEQ ID NO: 1744 - RNA, 22 nt, Bordetella pertussis
gccgcaaugccgaaggccgcga

SEQ ID NO: 1745 - RNA, 22 nt, Bordetella pertussis
gccgcagagcacggucaugaug

SEQ ID NO: 1746 - RNA, 22 nt, Bordetella pertussis
gccgcagaucugggggucgggc

SEQ ID NO: 1747 - RNA, 22 nt, Bordetella pertussis
gccgccaugagcgauguggacc

SEQ ID NO: 1748 - RNA, 22 nt, Bordetella pertussis
gccgcccacgccuagcgucguc

SEQ ID NO: 1749 - RNA, 22 nt, Bordetella pertussis
gccgccuacgggcaauggcugg

SEQ ID NO: 1750 - RNA, 22 nt, Bordetella pertussis
gccgcgccggacagcugguacc

SEQ ID NO: 1751 - RNA, 22 nt, Bordetella pertussis
gccgcgucggcaugauguucca

SEQ ID NO: 1752 - RNA, 22 nt, Bordetella pertussis
gccgcguuguuugccggcggcc

SEQ ID NO: 1753 - RNA, 22 nt, Bordetella pertussis
gccgcugcaacugcuggcugac

SEQ ID NO: 1754 - RNA, 22 nt, Bordetella pertussis
gccggaggucacguaccgcggc

SEQ ID NO: 1755 - RNA, 22 nt, Bordetella pertussis
gccggccguuccgaucggggcc

SEQ ID NO: 1756 - RNA, 22 nt, Bordetella pertussis
gccggcgguggugcugcugacg

SEQ ID NO: 1757 - RNA, 22 nt, Bordetella pertussis
gccgggauccgcuugccguugu

SEQ ID NO: 1758 - RNA, 22 nt, Bordetella pertussis
gccgggcagcacggccgaggcg

SEQ ID NO: 1759 - RNA, 22 nt, Bordetella pertussis
gccgggccgccuggugcauguc

SEQ ID NO: 1760 - RNA, 22 nt, Bordetella pertussis
gccgggccugcuguucggcugg

SEQ ID NO: 1761 - RNA, 22 nt, Bordetella pertussis
gccggucgagacauagugcauc

SEQ ID NO: 1762 - RNA, 22 nt, Bordetella pertussis
gccggugaacaugauguuccag

SEQ ID NO: 1763 - RNA, 22 nt, Bordetella pertussis
gccggugcucagguagcggacg

SEQ ID NO: 1764 - RNA, 22 nt, Bordetella pertussis
gccguccugguggcggugacgc

SEQ ID NO: 1765 - RNA, 22 nt, Bordetella pertussis
gccgucgaccgggccgguggcg

SEQ ID NO: 1766 - RNA, 22 nt, Bordetella pertussis
gccgugcagcacgccgcguauc

SEQ ID NO: 1767 - RNA, 22 nt, Bordetella pertussis
gccgugcugcugucgaccgaca

SEQ ID NO: 1768 - RNA, 22 nt, Bordetella pertussis
gccucgucgcuggucucgccca

SEQ ID NO: 1769 - RNA, 22 nt, Bordetella pertussis
gccugaaggugaucugcugcag

SEQ ID NO: 1770 - RNA, 22 nt, Bordetella pertussis
gccuuuuccucgucgcgccggg

SEQ ID NO: 1771 - RNA, 22 nt, Bordetella pertussis
gcgacaccuugacgcccggcag

SEQ ID NO: 1772 - RNA, 22 nt, Bordetella pertussis
gcgacagcagggucggccccau

SEQ ID NO: 1773 - RNA, 22 nt, Bordetella pertussis
gcgaccucggccacccagaugg

SEQ ID NO: 1774 - RNA, 22 nt, Bordetella pertussis
gcgacgauuuccggcugauggc

SEQ ID NO: 1775 - RNA, 22 nt, Bordetella pertussis
gcgacgucaugccgcugcugac

SEQ ID NO: 1776 - RNA, 22 nt, Bordetella pertussis
gcgagcgccucggcguaggccu

SEQ ID NO: 1777 - RNA, 22 nt, Bordetella pertussis
gcgcaagguguugacggcgcgc

SEQ ID NO: 1778 - RNA, 20 nt, Bordetella pertussis
gcgcaccgcggcaacguucu

SEQ ID NO: 1779 - RNA, 22 nt, Bordetella pertussis
gcgcacgcggguguccuguugc

SEQ ID NO: 1780 - RNA, 22 nt, Bordetella pertussis
gcgccacgacgucgguaaugcu

SEQ ID NO: 1781 - RNA, 22 nt, Bordetella pertussis
gcgccagcaaggccgcggucaa

SEQ ID NO: 1782 - RNA, 22 nt, Bordetella pertussis
cgcgaugaugggcauggccggc

SEQ ID NO: 1783 - RNA, 22 nt, Bordetella pertussis
cgcgaugucccuugguggcccg

SEQ ID NO: 1784 - RNA, 22 nt, Bordetella pertussis
cgcgauucgagcucgccuugcu

SEQ ID NO: 1785 - RNA, 22 nt, Bordetella pertussis
cgcgcacgaccuuguugaucga

SEQ ID NO: 1786 - RNA, 22 nt, Bordetella pertussis
cgcgccgggaaaaagagccugu

SEQ ID NO: 1787 - RNA, 22 nt, Bordetella pertussis
gcgccggacaaccuggucgacg

SEQ ID NO: 1788 - RNA, 22 nt, Bordetella pertussis
gcgcgacccggacaggaacagg

SEQ ID NO: 1789 - RNA, 22 nt, Bordetella pertussis
gcgcgaucaccaggucuggccc

SEQ ID NO: 1790 - RNA, 22 nt, Bordetella pertussis
gcgcgcauucgaucgaagacau

SEQ ID NO: 1791 - RNA, 22 nt, Bordetella pertussis
gcgcgccaccggacuggugucg

SEQ ID NO: 1792 - RNA, 22 nt, Bordetella pertussis
gcgcgcccggcgacgaggugga

SEQ ID NO: 1793 - RNA, 22 nt, Bordetella pertussis
gcgcgccggauagggguggauc

SEQ ID NO: 1794 - RNA, 21 nt, Bordetella pertussis
gcgcggcaccauggcggcgua

SEQ ID NO: 1795 - RNA, 22 nt, Bordetella pertussis
gcgcggccugauggcgccggug

SEQ ID NO: 1796 - RNA, 22 nt, Bordetella pertussis
gcgcgguugagcaccacgucgu

SEQ ID NO: 1797 - RNA, 22 nt, Bordetella pertussis
gcgcgucugggcaugggugcgc

SEQ ID NO: 1798 - RNA, 22 nt, Bordetella pertussis
gcgcucaggccagcagcgacac

SEQ ID NO: 1799 - RNA, 22 nt, Bordetella pertussis
gcgcuccgaggugcgccccagc

SEQ ID NO: 1800 - RNA, 22 nt, Bordetella pertussis
gcgcugcagcagguggccgacg

SEQ ID NO: 1801 - RNA, 22 nt, Bordetella pertussis
gcgcugcugacggugcugccca

SEQ ID NO: 1802 - RNA, 22 nt, Bordetella pertussis
gcgcuucgaggcaucgcagugg

SEQ ID NO: 1803 - RNA, 19 nt, Bordetella pertussis
gcgcuucgagggcgugcug

SEQ ID NO: 1804 - RNA, 22 nt, Bordetella pertussis
gcggaugcccaugaguucgguc

SEQ ID NO: 1805 - RNA, 22 nt, Bordetella pertussis
gcggcccauuggcagcgccagg

SEQ ID NO: 1806 - RNA, 22 nt, Bordetella pertussis
gcggcgcucaguacacgucgcg

SEQ ID NO: 1807 - RNA, 22 nt, Bordetella pertussis
gcggcuaccuucccgaacgcgu

SEQ ID NO: 1808 - RNA, 22 nt, Bordetella pertussis
gcgggccaggcgcgcaucgaca

SEQ ID NO: 1809 - RNA, 22 nt, Bordetella pertussis
gcggucgacuacguggggguau

SEQ ID NO: 1810 - RNA, 20 nt, Bordetella pertussis
gcggucgugaaguagguguu

SEQ ID NO: 1811 - RNA, 22 nt, Bordetella pertussis
gcgguuccggaggcaggcgccu

SEQ ID NO: 1812 - RNA, 22 nt, Bordetella pertussis
gcgguuguugccgguggcagaa

SEQ ID NO: 1813 - RNA, 23 nt, Bordetella pertussis
gcgguuuuucaggcugcaucguc

SEQ ID NO: 1814 - RNA, 22 nt, Bordetella pertussis
gcguaucgauuaucccgggcgc

SEQ ID NO: 1815 - RNA, 22 nt, Bordetella pertussis
gcgucaccgccaccaggacggc

SEQ ID NO: 1816 - RNA, 22 nt, Bordetella pertussis
gcguccucgguggugagcacgc

SEQ ID NO: 1817 - RNA, 22 nt, Bordetella pertussis
gcgucgauggcgcgggcgugac

SEQ ID NO: 1818 - RNA, 22 nt, Bordetella pertussis
gcgugaggcuggcgccgcaggc

SEQ ID NO: 1819 - RNA, 22 nt, Bordetella pertussis
gcgugcccgaccagaccgucag

SEQ ID NO: 1820 - RNA, 22 nt, Bordetella pertussis
gcguuguugaguacgaagccua

SEQ ID NO: 1821 - RNA, 23 nt, Bordetella pertussis
gcuaccuggcgucuucgggcaug

SEQ ID NO: 1822 - RNA, 22 nt, Bordetella pertussis
gcucagcgugguggcgcugcug

SEQ ID NO: 1823 - RNA, 22 nt, Bordetella pertussis
gcugaaaucgaugugcugccgg

SEQ ID NO: 1824 - RNA, 22 nt, Bordetella pertussis
gcugaaggggucgguaucgcuc

SEQ ID NO: 1825 - RNA, 22 nt, Bordetella pertussis
gcugauggccuucguggcucgc

SEQ ID NO: 1826 - RNA, 22 nt, Bordetella pertussis
gcugcuguucgaccagcgcggc

SEQ ID NO: 1827 - RNA, 19 nt, Bordetella pertussis
gcuggccgcgaaccagugc

SEQ ID NO: 1828 - RNA, 22 nt, Bordetella pertussis
gcuggcggaaggcgaguucuag

SEQ ID NO: 1829 - RNA, 22 nt, Bordetella pertussis
gcugguacggugaaaccggggu

SEQ ID NO: 1830 - RNA, 22 nt, Bordetella pertussis
gcugguacuacguggacggcga

SEQ ID NO: 1831 - RNA, 22 nt, Bordetella pertussis
gcuggucgacgauuccaucgug

SEQ ID NO: 1832 - RNA, 22 nt, Bordetella pertussis
gcuguagcugaagccgucggcc

SEQ ID NO: 1833 - RNA, 22 nt, Bordetella pertussis
gcuucgagaccuugaaccugcu

SEQ ID NO: 1834 - RNA, 22 nt, Bordetella pertussis
gcuugagcaggaaguugccgaa

SEQ ID NO: 1835 - RNA, 21 nt, Bordetella pertussis
gcuugccguugucgaucgacu

SEQ ID NO: 1836 - RNA, 22 nt, Bordetella pertussis
gcuuggcuggcggcaggucggu

SEQ ID NO: 1837 - RNA, 22 nt, Bordetella pertussis
gcuuggucagggccucggcggg

SEQ ID NO: 1838 - RNA, 18 nt, Bordetella pertussis
ggaagcgcugccgccggc

SEQ ID NO: 1839 - RNA, 22 nt, Bordetella pertussis
ggacccggguuguugcgcagcc

SEQ ID NO: 1840 - RNA, 22 nt, Bordetella pertussis
ggacgcccgcaugagcggcacc

SEQ ID NO: 1841 - RNA, 22 nt, Bordetella pertussis
ggacgcgacaucacgggcgcca

SEQ ID NO: 1842 - RNA, 19 nt, Bordetella pertussis
ggacggacgucuccauggc

SEQ ID NO: 1843 - RNA, 22 nt, Bordetella pertussis
ggagaucccgucgccgcuggac

SEQ ID NO: 1844 - RNA, 22 nt, Bordetella pertussis
ggaugaucuugaacguggcggu

SEQ ID NO: 1845 - RNA, 22 nt, Bordetella pertussis
ggcaccgugaugucgccgucgg

SEQ ID NO: 1846 - RNA, 22 nt, Bordetella pertussis
ggcaggaaggccgcuggugcga

SEQ ID NO: 1847 - RNA, 18 nt, Bordetella pertussis
ggcaggccuucggccagu

SEQ ID NO: 1848 - RNA, 22 nt, Bordetella pertussis
ggcaggcucuacaauacgcgcc

SEQ ID NO: 1849 - RNA, 22 nt, Bordetella pertussis
ggcauccugcacaguccggacg

SEQ ID NO: 1850 - RNA, 22 nt, Bordetella pertussis
ggcauggagcucggucugccga

SEQ ID NO: 1851 - RNA, 22 nt, Bordetella pertussis
ggccaucggcguaugggccgcc

SEQ ID NO: 1852 - RNA, 22 nt, Bordetella pertussis
ggccauguucgucauguuggcg

SEQ ID NO: 1853 - RNA, 22 nt, Bordetella pertussis
ggccccaucgaggcgcgcuucu

SEQ ID NO: 1854 - RNA, 22 nt, Bordetella pertussis
ggccccgaacgugggcaccagc

SEQ ID NO: 1855 - RNA, 22 nt, Bordetella pertussis
ggcccggccgcauugggacgcg

SEQ ID NO: 1856 - RNA, 22 nt, Bordetella pertussis
ggcccguugaugguguagagca

SEQ ID NO: 1857 - RNA, 20 nt, Bordetella pertussis
ggccgccagcgaggcggcca

SEQ ID NO: 1858 - RNA, 22 nt, Bordetella pertussis
ggccggaucggccggguugugg

SEQ ID NO: 1859 - RNA, 22 nt, Bordetella pertussis
ggccggcaaccugaucagcauc

SEQ ID NO: 1860 - RNA, 22 nt, Bordetella pertussis
ggccggcaacuacggcaugugc

SEQ ID NO: 1861 - RNA, 22 nt, Bordetella pertussis
ggccggggugcugcgcuuugcc

SEQ ID NO: 1862 - RNA, 22 nt, Bordetella pertussis
ggccggugcuguacgcccgcuu

SEQ ID NO: 1863 - RNA, 22 nt, Bordetella pertussis
ggccgguguuguugcccugcau

SEQ ID NO: 1864 - RNA, 22 nt, Bordetella pertussis
ggccgugggcgccgacgugcgu

SEQ ID NO: 1865 - RNA, 22 nt, Bordetella pertussis
ggccguugcgccaccccuacga

SEQ ID NO: 1866 - RNA, 20 nt, Bordetella pertussis
ggccuggauaauugggcgcg

SEQ ID NO: 1867 - RNA, 22 nt, Bordetella pertussis
ggccuggguugcggucaugccg

SEQ ID NO: 1868 - RNA, 22 nt, Bordetella pertussis
ggccuugagauaggcguccgac

SEQ ID NO: 1869 - RNA, 22 nt, Bordetella pertussis
ggccuugcccgcgccgaugucg

SEQ ID NO: 1870 - RNA, 22 nt, Bordetella pertussis
ggcgacacgcgcaccuggcagu

SEQ ID NO: 1871 - RNA, 22 nt, Bordetella pertussis
ggcgccaguucgccggccagcg

SEQ ID NO: 1872 - RNA, 22 nt, Bordetella pertussis
ggcgccaguuggccgccgccgg

SEQ ID NO: 1873 - RNA, 22 nt, Bordetella pertussis
ggcgcccuugcaugcgcgucaa

SEQ ID NO: 1874 - RNA, 22 nt, Bordetella pertussis
cugcaggucgcucugggcgcgc

SEQ ID NO: 1875 - RNA, 22 nt, Bordetella pertussis
cugcgcaccgacucgggcccgu

SEQ ID NO: 1876 - RNA, 22 nt, Bordetella pertussis
cugcgcccuccuugaccagcgu

SEQ ID NO: 1877 - RNA, 19 nt, Bordetella pertussis
ggcgccuacuacgcccagg

SEQ ID NO: 1878 - RNA, 22 nt, Bordetella pertussis
ggcgccuugaccugcgacgugg

SEQ ID NO: 1879 - RNA, 22 nt, Bordetella pertussis
ggcgcgccaggaauugauggcg

SEQ ID NO: 1880 - RNA, 22 nt, Bordetella pertussis
ggcgcgcggcuuaauccaguuu

SEQ ID NO: 1881 - RNA, 22 nt, Bordetella pertussis
ggcgcggccuuccugcaucugc

SEQ ID NO: 1882 - RNA, 22 nt, Bordetella pertussis
ggcgcuguuccuggacggaucg

SEQ ID NO: 1883 - RNA, 22 nt, Bordetella pertussis
ggcgcuuggacaacgcauugcu

SEQ ID NO: 1884 - RNA, 22 nt, Bordetella pertussis
ggcggccggcuugaugcgcuug

SEQ ID NO: 1885 - RNA, 19 nt, Bordetella pertussis
ggcggcuuccugcgcggcc

SEQ ID NO: 1886 - RNA, 22 nt, Bordetella pertussis
ggcgggaggcgccgaguauggc

SEQ ID NO: 1887 - RNA, 22 nt, Bordetella pertussis
ggcgggguuacucuugcagcug

SEQ ID NO: 1888 - RNA, 22 nt, Bordetella pertussis
ggcggucagccacagcggcgug

SEQ ID NO: 1889 - RNA, 22 nt, Bordetella pertussis
ggcguaccgcgaucaucugcug

SEQ ID NO: 1890 - RNA, 22 nt, Bordetella pertussis
ggcgugauggagcugggcaugc

SEQ ID NO: 1891 - RNA, 22 nt, Bordetella pertussis
ggcgugcuggccauugcgcugg

SEQ ID NO: 1892 - RNA, 22 nt, Bordetella pertussis
ggcgugguguaugaccgcgcgu

SEQ ID NO: 1893 - RNA, 22 nt, Bordetella pertussis
ggcuggaggugucgcauggcgu

SEQ ID NO: 1894 - RNA, 22 nt, Bordetella pertussis
ggcuggucaugauggugcgcga

SEQ ID NO: 1895 - RNA, 23 nt, Bordetella pertussis
ggcuggucuggccaaucacguac

SEQ ID NO: 1896 - RNA, 22 nt, Bordetella pertussis
gggacaggcgcagauccggcag

SEQ ID NO: 1897 - RNA, 22 nt, Bordetella pertussis
gggaugcgcgucgacgagguca

SEQ ID NO: 1898 - RNA, 22 nt, Bordetella pertussis
gggcaacgcggugauggcgcug

SEQ ID NO: 1899 - RNA, 20 nt, Bordetella pertussis
gggcaugcgccaggcgcgcc

SEQ ID NO: 1900 - RNA, 22 nt, Bordetella pertussis
gggcaugcuggagcuguccgcg

SEQ ID NO: 1901 - RNA, 22 nt, Bordetella pertussis
gggccacgcccagcagcagggu

SEQ ID NO: 1902 - RNA, 22 nt, Bordetella pertussis
gggccacguccaugccggcgcg

SEQ ID NO: 1903 - RNA, 22 nt, Bordetella pertussis
gggccguacuuuccaggagucg

SEQ ID NO: 1904 - RNA, 22 nt, Bordetella pertussis
gggcgacgaucugccguuucgu

SEQ ID NO: 1905 - RNA, 22 nt, Bordetella pertussis
gggcgccugggucgagaucgac

SEQ ID NO: 1906 - RNA, 22 nt, Bordetella pertussis
gggcgugggccagauccggccg

SEQ ID NO: 1907 - RNA, 22 nt, Bordetella pertussis
gggcguugcaugcugcccaccc

SEQ ID NO: 1908 - RNA, 22 nt, Bordetella pertussis
gggcuggccguaucggcccugc

SEQ ID NO: 1909 - RNA, 22 nt, Bordetella pertussis
gggcuggucgauggcaugcuug

SEQ ID NO: 1910 - RNA, 22 nt, Bordetella pertussis
ggggacgagcuccuggagucug

SEQ ID NO: 1911 - RNA, 22 nt, Bordetella pertussis
ggggcgcgcacgagcucgaagu

SEQ ID NO: 1912 - RNA, 22 nt, Bordetella pertussis
gggguacucguguucaaccgug

SEQ ID NO: 1913 - RNA, 22 nt, Bordetella pertussis
gggugccuguccccgccgggac

SEQ ID NO: 1914 - RNA, 22 nt, Bordetella pertussis
gggugcgucagggcagcgugga

SEQ ID NO: 1915 - RNA, 22 nt, Bordetella pertussis
gguacggcuggacgggccgcga

SEQ ID NO: 1916 - RNA, 22 nt, Bordetella pertussis
gguaucgucgaccuggaucacg

SEQ ID NO: 1917 - RNA, 22 nt, Bordetella pertussis
ggucagcgugcgcggccaguuc

SEQ ID NO: 1918 - RNA, 22 nt, Bordetella pertussis
ggucaggcggaacugcucggcg

SEQ ID NO: 1919 - RNA, 22 nt, Bordetella pertussis
ggucaugcgggccgauggcgug

SEQ ID NO: 1920 - RNA, 22 nt, Bordetella pertussis
ggucgaucgccagcggcagguc

SEQ ID NO: 1921 - RNA, 22 nt, Bordetella pertussis
ggucgcgguuguacggcgcguc

SEQ ID NO: 1922 - RNA, 22 nt, Bordetella pertussis
ggucggcgauguucugguccgg

SEQ ID NO: 1923 - RNA, 22 nt, Bordetella pertussis
ggucugucagcgccacggccgg

SEQ ID NO: 1924 - RNA, 22 nt, Bordetella pertussis
ggucuucgacgccgugcugcgc

SEQ ID NO: 1925 - RNA, 22 nt, Bordetella pertussis
ggugauguggcugacggccgcc

SEQ ID NO: 1926 - RNA, 22 nt, Bordetella pertussis
ggugcgcgacgaccucgacccg

SEQ ID NO: 1927 - RNA, 22 nt, Bordetella pertussis
ggugcucgaugauugauuguuu

SEQ ID NO: 1928 - RNA, 22 nt, Bordetella pertussis
ggugcuggccggggccgaacgg

SEQ ID NO: 1929 - RNA, 22 nt, Bordetella pertussis
ggugggcgucgcauuccauguu

SEQ ID NO: 1930 - RNA, 22 nt, Bordetella pertussis
gguggggccgaacuggucgauc

SEQ ID NO: 1931 - RNA, 22 nt, Bordetella pertussis
gucaagguggccggccgcauga

SEQ ID NO: 1932 - RNA, 22 nt, Bordetella pertussis
gucaggcccaucagcagcacgc

SEQ ID NO: 1933 - RNA, 22 nt, Bordetella pertussis
guccgggcgaugagcgccaggc

SEQ ID NO: 1934 - RNA, 22 nt, Bordetella pertussis
guccuggauccgccagugcgcg

SEQ ID NO: 1935 - RNA, 22 nt, Bordetella pertussis
guccuugccgcugcucaauggc

SEQ ID NO: 1936 - RNA, 22 nt, Bordetella pertussis
gucgaucucggacugcucgaug

SEQ ID NO: 1937 - RNA, 22 nt, Bordetella pertussis
gucgccaucgcgcugcaggucg

SEQ ID NO: 1938 - RNA, 22 nt, Bordetella pertussis
gucgccggccuugaccggcgug

SEQ ID NO: 1939 - RNA, 22 nt, Bordetella pertussis
gucgcgaggacuuagcgcugau

SEQ ID NO: 1940 - RNA, 22 nt, Bordetella pertussis
gucggccagcgcuucgacgcgg

SEQ ID NO: 1941 - RNA, 22 nt, Bordetella pertussis
gucggccauacgcugggccucg

SEQ ID NO: 1942 - RNA, 22 nt, Bordetella pertussis
gucggccgaucagcgucgacuu

SEQ ID NO: 1943 - RNA, 22 nt, Bordetella pertussis
gucggccugcacgaaggccugu

SEQ ID NO: 1944 - RNA, 22 nt, Bordetella pertussis
gucggccugcucggccaucgcg

SEQ ID NO: 1945 - RNA, 22 nt, Bordetella pertussis
gucgggcagcggcaagagcaug

SEQ ID NO: 1946 - RNA, 22 nt, Bordetella pertussis
gucgggucagcucggccuaugg

SEQ ID NO: 1947 - RNA, 22 nt, Bordetella pertussis
gugaaguugaugcgcuggcggc

SEQ ID NO: 1948 - RNA, 22 nt, Bordetella pertussis
gugauauccguugccguggugc

SEQ ID NO: 1949 - RNA, 22 nt, Bordetella pertussis
gugcagcgcuucgaccuggugg

SEQ ID NO: 1950 - RNA, 22 nt, Bordetella pertussis
gugcccggugcccggcguggcg

SEQ ID NO: 1951 - RNA, 22 nt, Bordetella pertussis
gugccgucggccagccuggcca

SEQ ID NO: 1952 - RNA, 22 nt, Bordetella pertussis
gugccuguccccgcagggggac

SEQ ID NO: 1953 - RNA, 22 nt, Bordetella pertussis
gugcgcagcuaccucaaccugc

SEQ ID NO: 1954 - RNA, 22 nt, Bordetella pertussis
gugcuggaugcccgcguuguug

SEQ ID NO: 1955 - RNA, 22 nt, Bordetella pertussis
gugcugugaacgucaguugcgg

SEQ ID NO: 1956 - RNA, 22 nt, Bordetella pertussis
guggccggcauccgcaagcugc

SEQ ID NO: 1957 - RNA, 22 nt, Bordetella pertussis
guggcgccauggcgggcgucau

SEQ ID NO: 1958 - RNA, 22 nt, Bordetella pertussis
guggcgggcugguccauguaug

SEQ ID NO: 1959 - RNA, 22 nt, Bordetella pertussis
gugggcgugcgcuucgagcuga

SEQ ID NO: 1960 - RNA, 22 nt, Bordetella pertussis
guggugcgcgaccggcugcgcc

SEQ ID NO: 1961 - RNA, 22 nt, Bordetella pertussis
gugguguucguccgacgguucg

SEQ ID NO: 1962 - RNA, 22 nt, Bordetella pertussis
guguccuggaugccgcgcacga

SEQ ID NO: 1963 - RNA, 22 nt, Bordetella pertussis
guguuccaggugggcuggggca

SEQ ID NO: 1964 - RNA, 22 nt, Bordetella pertussis
guguuguucuccaggcuggcgu

SEQ ID NO: 1965 - RNA, 22 nt, Bordetella pertussis
guucgauuuauaaaugaggagg

SEQ ID NO: 1966 - RNA, 22 nt, Bordetella pertussis
guucgcgcgaaaaaccgauguc

SEQ ID NO: 1967 - RNA, 20 nt, Bordetella pertussis
gccaucgugggugcacgccu

SEQ ID NO: 1968 - RNA, 22 nt, Bordetella pertussis
gccaucuggaacucguacucga

SEQ ID NO: 1969 - RNA, 20 nt, Bordetella pertussis
gcccacgucccagcguucgc

SEQ ID NO: 1970 - RNA, 22 nt, Bordetella pertussis
gcccauauggugcaugccgcgu

SEQ ID NO: 1971 - RNA, 22 nt, Bordetella pertussis
gccccgggcggucugccugggc

SEQ ID NO: 1972 - RNA, 22 nt, Bordetella pertussis
gccccugcugcuuggcguccag

SEQ ID NO: 1973 - RNA, 22 nt, Bordetella pertussis
gccccuggccgacggccuggug

SEQ ID NO: 1974 - RNA, 22 nt, Bordetella pertussis
gcccgagauuccgcgcguggug

SEQ ID NO: 1975 - RNA, 22 nt, Bordetella pertussis
gcccggaccgcgcugggccggc

SEQ ID NO: 1976 - RNA, 22 nt, Bordetella pertussis
gcccggccagcagguccugcgc

SEQ ID NO: 1977 - RNA, 22 nt, Bordetella pertussis
gcccggcgagaacagcgagccc

SEQ ID NO: 1978 - RNA, 22 nt, Bordetella pertussis
gcccucggccagcggcaucacg

SEQ ID NO: 1979 - RNA, 22 nt, Bordetella pertussis
gcccuggcggccgucgaucucg

SEQ ID NO: 1980 - RNA, 22 nt, Bordetella pertussis
gcccugguagcaggcauggugc

SEQ ID NO: 1981 - RNA, 22 nt, Bordetella pertussis
gcccuugcggaagaagugccgg

SEQ ID NO: 1982 - RNA, 22 nt, Bordetella pertussis
gccgagcaaggcgaacagcguc

SEQ ID NO: 1983 - RNA, 22 nt, Bordetella pertussis
gccgaucacgaaaucgccauug

SEQ ID NO: 1984 - RNA, 22 nt, Bordetella pertussis
gccgaucagcgacagcggcacc

SEQ ID NO: 1985 - RNA, 22 nt, Bordetella pertussis
gccgauguccugcaggcgcugg

SEQ ID NO: 1986 - RNA, 22 nt, Bordetella pertussis
gccgcacguugaggucaccguc

SEQ ID NO: 1987 - RNA, 22 nt, Bordetella pertussis
gccgccaugagccuggucgcgg

SEQ ID NO: 1988 - RNA, 22 nt, Bordetella pertussis
gccgccgcaucgccgucauggc

SEQ ID NO: 1989 - RNA, 22 nt, Bordetella pertussis
gccgccucaccgaggagcagga

SEQ ID NO: 1990 - RNA, 22 nt, Bordetella pertussis
gccgccuguacgucgauccgga

SEQ ID NO: 1991 - RNA, 22 nt, Bordetella pertussis
gccgcgauggccggcacgucgu

SEQ ID NO: 1992 - RNA, 22 nt, Bordetella pertussis
gccgcggcagccguucguccag

SEQ ID NO: 1993 - RNA, 22 nt, Bordetella pertussis
gccgcgggccagcagauugcuc

SEQ ID NO: 1994 - RNA, 22 nt, Bordetella pertussis
gccgcgguagggaaucacgcgg

SEQ ID NO: 1995 - RNA, 22 nt, Bordetella pertussis
gccgcucgaaccggugcgcgug

SEQ ID NO: 1996 - RNA, 22 nt, Bordetella pertussis
gccgcugucgcuguucgcgcug

SEQ ID NO: 1997 - RNA, 22 nt, Bordetella pertussis
gccggcaccgcggucggcgucu

SEQ ID NO: 1998 - RNA, 20 nt, Bordetella pertussis
gccggccggcggccguacag

SEQ ID NO: 1999 - RNA, 22 nt, Bordetella pertussis
gccggccugcgugcuggccgac

SEQ ID NO: 2000 - RNA, 22 nt, Bordetella pertussis
gccggcguugaccaggcgauug

SEQ ID NO: 2001 - RNA, 22 nt, Bordetella pertussis
gccgggccgaucagguugcggc

SEQ ID NO: 2002 - RNA, 22 nt, Bordetella pertussis
gccgggcgccaccgugcuggcg

SEQ ID NO: 2003 - RNA, 22 nt, Bordetella pertussis
gccgguuuccaugcugcucugu

SEQ ID NO: 2004 - RNA, 22 nt, Bordetella pertussis
gccgucagcgccgauguggcgc

SEQ ID NO: 2005 - RNA, 20 nt, Bordetella pertussis
gccgucaugcaggugccagc

SEQ ID NO: 2006 - RNA, 22 nt, Bordetella pertussis
gccgucccagcuuugcgccggc

SEQ ID NO: 2007 - RNA, 18 nt, Bordetella pertussis
gccgucgcggaacaccgg

SEQ ID NO: 2008 - RNA, 22 nt, Bordetella pertussis
gccgucgugcagcgugggcucg

SEQ ID NO: 2009 - RNA, 22 nt, Bordetella pertussis
gccgucuucggugauggcagcc

SEQ ID NO: 2010 - RNA, 22 nt, Bordetella pertussis
gccguggaccaccgauccguuc

SEQ ID NO: 2011 - RNA, 22 nt, Bordetella pertussis
gccgugugcuugaugaauggag

SEQ ID NO: 2012 - RNA, 23 nt, Bordetella pertussis
gccguuuucccaaucgcucucgg

SEQ ID NO: 2013 - RNA, 22 nt, Bordetella pertussis
gccuacuuuucuacgccagauc

SEQ ID NO: 2014 - RNA, 22 nt, Bordetella pertussis
gccugcucgaacugccggccgc

SEQ ID NO: 2015 - RNA, 22 nt, Bordetella pertussis
gccugcucggccugcuugcggu

SEQ ID NO: 2016 - RNA, 22 nt, Bordetella pertussis
gccuggacuccgaugacggcca

SEQ ID NO: 2017 - RNA, 22 nt, Bordetella pertussis
gccuggccgcgcguggcaugac

SEQ ID NO: 2018 - RNA, 22 nt, Bordetella pertussis
gccuggcgaggucggcgcgcau

SEQ ID NO: 2019 - RNA, 22 nt, Bordetella pertussis
gccuggcgcgggcgagaucguc

SEQ ID NO: 2020 - RNA, 22 nt, Bordetella pertussis
gccugggcugcgccagcgagcg

SEQ ID NO: 2021 - RNA, 22 nt, Bordetella pertussis
gccugggguugcaggcgguccc

SEQ ID NO: 2022 - RNA, 22 nt, Bordetella pertussis
gccuugauguugcucagcacgu

SEQ ID NO: 2023 - RNA, 22 nt, Bordetella pertussis
gcgacagcgcguugucgggcac

SEQ ID NO: 2024 - RNA, 22 nt, Bordetella pertussis
gcgacccgggcagcagcgccau

SEQ ID NO: 2025 - RNA, 22 nt, Bordetella pertussis
gcgacggugggcgacaccggcc

SEQ ID NO: 2026 - RNA, 21 nt, Bordetella pertussis
gcgagaaauacucgacgcgcc

SEQ ID NO: 2027 - RNA, 21 nt, Bordetella pertussis
gcgagguaugcguaucgggcg

SEQ ID NO: 2028 - RNA, 22 nt, Bordetella pertussis
gcgaucaggcaaaaaacgccaa

SEQ ID NO: 2029 - RNA, 22 nt, Bordetella pertussis
gcgaucauggugccggucggcg

SEQ ID NO: 2030 - RNA, 22 nt, Bordetella pertussis
gcgaugcgcucgggcaggccgu

SEQ ID NO: 2031 - RNA, 22 nt, Bordetella pertussis
gcgauggggcccgggccgaugg

SEQ ID NO: 2032 - RNA, 22 nt, Bordetella pertussis
gcgcaggcgcuucuugccguac

SEQ ID NO: 2033 - RNA, 22 nt, Bordetella pertussis
gcgcaugaucgccgggcuggau

SEQ ID NO: 2034 - RNA, 22 nt, Bordetella pertussis
gcgccacuuucauucccauggc

SEQ ID NO: 2035 - RNA, 22 nt, Bordetella pertussis
gcgccagggccgugcuggaagg

SEQ ID NO: 2036 - RNA, 22 nt, Bordetella pertussis
gcgccaggugcaggccgcgcug

SEQ ID NO: 2037 - RNA, 22 nt, Bordetella pertussis
gcgccaguucgcgcagggcgau

SEQ ID NO: 2038 - RNA, 22 nt, Bordetella pertussis
gcgccaucucgucgcuggucau

SEQ ID NO: 2039 - RNA, 22 nt, Bordetella pertussis
gcgcccgacuacaagcgaccgg

SEQ ID NO: 2040 - RNA, 22 nt, Bordetella pertussis
gcgccggcuccagccaggugga

SEQ ID NO: 2041 - RNA, 22 nt, Bordetella pertussis
gcgccucgaugcccuugcggau

SEQ ID NO: 2042 - RNA, 22 nt, Bordetella pertussis
gcgccuguccccgccguucaug

SEQ ID NO: 2043 - RNA, 22 nt, Bordetella pertussis
gcgcgcaugcacccugcccacu

SEQ ID NO: 2044 - RNA, 22 nt, Bordetella pertussis
gcgcgcccgucuggugcugaua

SEQ ID NO: 2045 - RNA, 22 nt, Bordetella pertussis
gcgcgcguucggcauggaggug

SEQ ID NO: 2046 - RNA, 22 nt, Bordetella pertussis
gcgcgcugaccugggucagcac

SEQ ID NO: 2047 - RNA, 22 nt, Bordetella pertussis
gcgcgcuuucacucgccgcagg

SEQ ID NO: 2048 - RNA, 22 nt, Bordetella pertussis
gcgcggcuggaucaggcgcgug

SEQ ID NO: 2049 - RNA, 22 nt, Bordetella pertussis
gcgcgggcguacagcagcaggg

SEQ ID NO: 2050 - RNA, 22 nt, Bordetella pertussis
gcgcgguaucgcgaucgaucgg

SEQ ID NO: 2051 - RNA, 22 nt, Bordetella pertussis
gcgcguucuggagcacgggccu

SEQ ID NO: 2052 - RNA, 22 nt, Bordetella pertussis
gcgcguugagcgccuugaccac

SEQ ID NO: 2053 - RNA, 22 nt, Bordetella pertussis
gcgcugccagcgcuaugugguc

SEQ ID NO: 2054 - RNA, 22 nt, Bordetella pertussis
gcgcugcuucuggccgcccgag

SEQ ID NO: 2055 - RNA, 22 nt, Bordetella pertussis
gcgcuucgaccugucgucgguc

SEQ ID NO: 2056 - RNA, 22 nt, Bordetella pertussis
gcgcuucgaggcgaucgaccag

SEQ ID NO: 2057 - RNA, 22 nt, Bordetella pertussis
uggcuggagcugaccggccauc

SEQ ID NO: 2058 - RNA, 22 nt, Bordetella pertussis
uggcuguguauuaugccaagcc

SEQ ID NO: 2059 - RNA, 22 nt, Bordetella pertussis
ugggcacgccaagggcaguggc

SEQ ID NO: 2060 - RNA, 22 nt, Bordetella pertussis
ugggccugcugggcaaccuggu

SEQ ID NO: 2061 - RNA, 22 nt, Bordetella pertussis
ugggcgagcgcugcacggccgu

SEQ ID NO: 2062 - RNA, 22 nt, Bordetella pertussis
ugggcgagucgaucuacgccgc

SEQ ID NO: 2063 - RNA, 22 nt, Bordetella pertussis
ugggcgcugcccugcuggcggu

SEQ ID NO: 2064 - RNA, 22 nt, Bordetella pertussis
ugggcugguacuucacgccggc

SEQ ID NO: 2065 - RNA, 22 nt, Bordetella pertussis
ugggcuucgugcagaugccgga

SEQ ID NO: 2066 - RNA, 22 nt, Bordetella pertussis
uggggcuggcgcugcuggucgu

SEQ ID NO: 2067 - RNA, 22 nt, Bordetella pertussis
uggucaacgccguacucgaagc

SEQ ID NO: 2068 - RNA, 22 nt, Bordetella pertussis
uggucgccaucgcgcugcugcu

SEQ ID NO: 2069 - RNA, 22 nt, Bordetella pertussis
uggucguggucaugauggucgu

SEQ ID NO: 2070 - RNA, 22 nt, Bordetella pertussis
uggugccgcugccguucaucau

SEQ ID NO: 2071 - RNA, 22 nt, Bordetella pertussis
uggugcucggcaugccggugcg

SEQ ID NO: 2072 - RNA, 22 nt, Bordetella pertussis
ugguggcgcccgugguguagcc

SEQ ID NO: 2073 - RNA, 22 nt, Bordetella pertussis
ugguggcggugcugucggcggu

SEQ ID NO: 2074 - RNA, 22 nt, Bordetella pertussis
ugguggcuucgguggcggucug

SEQ ID NO: 2075 - RNA, 22 nt, Bordetella pertussis
uggugggcggcauccgcgccuc

SEQ ID NO: 2076 - RNA, 22 nt, Bordetella pertussis
uggugguggugaugucccacgg

SEQ ID NO: 2077 - RNA, 22 nt, Bordetella pertussis
ugguguacggccugucgcgcgc

SEQ ID NO: 2078 - RNA, 22 nt, Bordetella pertussis
uguacgaugcgccgggcgucgg

SEQ ID NO: 2079 - RNA, 22 nt, Bordetella pertussis
uguccaccggcgcgaucauccu

SEQ ID NO: 2080 - RNA, 22 nt, Bordetella pertussis
uguccccgcagggggacaggca

SEQ ID NO: 2081 - RNA, 22 nt, Bordetella pertussis
uguccccgccgggacagauacc

SEQ ID NO: 2082 - RNA, 22 nt, Bordetella pertussis
uguccccgcggagacaggcgcc

SEQ ID NO: 2083 - RNA, 22 nt, Bordetella pertussis
uguccggguucacaggcuaucc

SEQ ID NO: 2084 - RNA, 20 nt, Bordetella pertussis
uguccucgacgaaggugccg

SEQ ID NO: 2085 - RNA, 22 nt, Bordetella pertussis
ugucgaccguaucgguauaggc

SEQ ID NO: 2086 - RNA, 22 nt, Bordetella pertussis
ugucgacgacugggacguccac

SEQ ID NO: 2087 - RNA, 22 nt, Bordetella pertussis
ugucgcugauucccggcaagca

SEQ ID NO: 2088 - RNA, 23 nt, Bordetella pertussis
ugucggagcaggaacucuccgau

SEQ ID NO: 2089 - RNA, 22 nt, Bordetella pertussis
ugucggugcccuggccggucuc

SEQ ID NO: 2090 - RNA, 22 nt, Bordetella pertussis
ugucgucgaccgaguagaucuc

SEQ ID NO: 2091 - RNA, 22 nt, Bordetella pertussis
ugugccggcguggaucgcgcca

SEQ ID NO: 2092 - RNA, 22 nt, Bordetella pertussis
ugugccugucccagcggggaca

SEQ ID NO: 2093 - RNA, 22 nt, Bordetella pertussis
uguuccauugccuucugaaccg

SEQ ID NO: 2094 - RNA, 23 nt, Bordetella pertussis
uguucgaucgggguuaugccgag

SEQ ID NO: 2095 - RNA, 22 nt, Bordetella pertussis
uguucgucucgcagccggcggu

SEQ ID NO: 2096 - RNA, 22 nt, Bordetella pertussis
uucagguggugcgcgacccgcg

SEQ ID NO: 2097 - RNA, 22 nt, Bordetella pertussis
uuccaucugcucgauggcgcca

SEQ ID NO: 2098 - RNA, 22 nt, Bordetella pertussis
uuccugguggauguccagcgug

SEQ ID NO: 2099 - RNA, 22 nt, Bordetella pertussis
uucgacaugcgugccuuccgga

SEQ ID NO: 2100 - RNA, 22 nt, Bordetella pertussis
uucgccacgcgugcaagggccu

SEQ ID NO: 2101 - RNA, 22 nt, Bordetella pertussis
uucgcugggccaguuccuggug

SEQ ID NO: 2102 - RNA, 22 nt, Bordetella pertussis
uucggcgugacccgcccggggc

SEQ ID NO: 2103 - RNA, 22 nt, Bordetella pertussis
uucggcgugcgcgccgacaaca

SEQ ID NO: 2104 - RNA, 22 nt, Bordetella pertussis
uucgugaucaugaucaugaucg

SEQ ID NO: 2105 - RNA, 22 nt, Bordetella pertussis
uucguuguucagcgugcggcag

SEQ ID NO: 2106 - RNA, 22 nt, Bordetella pertussis
uucuacgucgacgcgcagcguc

SEQ ID NO: 2107 - RNA, 22 nt, Bordetella pertussis
uucuucagggcgaccuugaaca

SEQ ID NO: 2108 - RNA, 22 nt, Bordetella pertussis
uucuucgaguacaugaucgacg

SEQ ID NO: 2109 - RNA, 22 nt, Bordetella pertussis
uugaccggauuccugggcagcg

SEQ ID NO: 2110 - RNA, 21 nt, Bordetella pertussis
uugacgcgacgcgaggcgcug

SEQ ID NO: 2111 - RNA, 22 nt, Bordetella pertussis
uugacgcgacgcgaggcgcuga

SEQ ID NO: 2112 - RNA, 22 nt, Bordetella pertussis
uugauggcgaauuccuuggugu

SEQ ID NO: 2113 - RNA, 22 nt, Bordetella pertussis
uugcaccgcaugaacgcguuuu

SEQ ID NO: 2114 - RNA, 22 nt, Bordetella pertussis
uugcaggaugaccgugcggccg

SEQ ID NO: 2115 - RNA, 22 nt, Bordetella pertussis
uugcccaggcagaucgucagca

SEQ ID NO: 2116 - RNA, 22 nt, Bordetella pertussis
uugccgcaggcuuggcgggaug

SEQ ID NO: 2117 - RNA, 19 nt, Bordetella pertussis
uugcgcaauaugaccgccg

SEQ ID NO: 2118 - RNA, 22 nt, Bordetella pertussis
uugcggcuugcgccagccaggc

SEQ ID NO: 2119 - RNA, 22 nt, Bordetella pertussis
uugcgggcguuuuuccuggcgu

SEQ ID NO: 2120 - RNA, 22 nt, Bordetella pertussis
uugcuggcggcuuucauggccu

SEQ ID NO: 2121 - RNA, 22 nt, Bordetella pertussis
uuggccaccgccagcggcugca

SEQ ID NO: 2122 - RNA, 22 nt, Bordetella pertussis
uuggccagguucucgauggugg

SEQ ID NO: 2123 - RNA, 22 nt, Bordetella pertussis
uuggccugcccuggcugucgcg

SEQ ID NO: 2124 - RNA, 22 nt, Bordetella pertussis
uuggcgccgcugcggcccaggc

SEQ ID NO: 2125 - RNA, 22 nt, Bordetella pertussis
uuggcgcuguagcucaccagca

SEQ ID NO: 2126 - RNA, 22 nt, Bordetella pertussis
uuggcguuuuccguuucgauac

SEQ ID NO: 2127 - RNA, 22 nt, Bordetella pertussis
uugggcaguuccugcagcaggc

SEQ ID NO: 2128 - RNA, 22 nt, Bordetella pertussis
uugguguccaucauggcgcgga

SEQ ID NO: 2129 - RNA, 22 nt, Bordetella pertussis
uugucgcugaucgucggcgugg

SEQ ID NO: 2130 - RNA, 22 nt, Bordetella pertussis
uugucgcugggcuucgaugugu

SEQ ID NO: 2131 - RNA, 22 nt, Bordetella pertussis
uuugcgccaucucggcgcgcag

SEQ ID NO: 2132 - RNA, 22 nt, Bordetella pertussis
gcggcaagugcaagccggugug

SEQ ID NO: 2133 - RNA, 22 nt, Bordetella pertussis
gcggcaauccgcgccaugucgu

SEQ ID NO: 2134 - RNA, 22 nt, Bordetella pertussis
gcggccgacaggaugguggcca

SEQ ID NO: 2135 - RNA, 22 nt, Bordetella pertussis
gcggccucgauggccuaugucg

SEQ ID NO: 2136 - RNA, 22 nt, Bordetella pertussis
gcggcgauggucgacgcgucgu

SEQ ID NO: 2137 - RNA, 22 nt, Bordetella pertussis
gcggcgcgagccgagucaggau

SEQ ID NO: 2138 - RNA, 22 nt, Bordetella pertussis
gcggcgguacaggugcugugcg

SEQ ID NO: 2139 - RNA, 19 nt, Bordetella pertussis
gcgggcgcccaggguggcc

SEQ ID NO: 2140 - RNA, 22 nt, Bordetella pertussis
gcgggcggccuaucaccugggc

SEQ ID NO: 2141 - RNA, 22 nt, Bordetella pertussis
gcggucggauauucccaugauc

SEQ ID NO: 2142 - RNA, 22 nt, Bordetella pertussis
gcgguugggcacggccaggauc

SEQ ID NO: 2143 - RNA, 22 nt, Bordetella pertussis
gcgucauggccgauacgaucag

SEQ ID NO: 2144 - RNA, 22 nt, Bordetella pertussis
gcgucgauggcgccguggguga

SEQ ID NO: 2145 - RNA, 22 nt, Bordetella pertussis
gcgucggcggugaucgucgagc

SEQ ID NO: 2146 - RNA, 22 nt, Bordetella pertussis
gcgugcucaccaccgaggacgc

SEQ ID NO: 2147 - RNA, 22 nt, Bordetella pertussis
gcguggaugucaugccauaccg

SEQ ID NO: 2148 - RNA, 22 nt, Bordetella pertussis
gcgugggcauuuugcugcgccc

SEQ ID NO: 2149 - RNA, 22 nt, Bordetella pertussis
gcguuaucgaugucuguagcaa

SEQ ID NO: 2150 - RNA, 22 nt, Bordetella pertussis
gcguucaggccggugaccaccg

SEQ ID NO: 2151 - RNA, 22 nt, Bordetella pertussis
gcguugaugaccggucgccagg

SEQ ID NO: 2152 - RNA, 22 nt, Bordetella pertussis
gcguuucccggggcgcgcuggc

SEQ ID NO: 2153 - RNA, 22 nt, Bordetella pertussis
gcuccguuggagccgaugacgg

SEQ ID NO: 2154 - RNA, 19 nt, Bordetella pertussis
gcucgcguccugcgccugc

SEQ ID NO: 2155 - RNA, 22 nt, Bordetella pertussis
gcugcccuggaagcggauggcg

SEQ ID NO: 2156 - RNA, 22 nt, Bordetella pertussis
gcugccggucauguuucucgcg

SEQ ID NO: 2157 - RNA, 22 nt, Bordetella pertussis
gcugcgcaauacgcugauggug

SEQ ID NO: 2158 - RNA, 22 nt, Bordetella pertussis
gcuggacgcgggaucuaugcug

SEQ ID NO: 2159 - RNA, 22 nt, Bordetella pertussis
gcuggagcagcugaugggcaaa

SEQ ID NO: 2160 - RNA, 22 nt, Bordetella pertussis
gcuggauguugugcgccagcag

SEQ ID NO: 2161 - RNA, 22 nt, Bordetella pertussis
gcuggauucgcguuuuuucagc

SEQ ID NO: 2162 - RNA, 22 nt, Bordetella pertussis
gcuggcgcaguggcugggccag

SEQ ID NO: 2163 - RNA, 22 nt, Bordetella pertussis
gcugggcguggcccugugcguc

SEQ ID NO: 2164 - RNA, 22 nt, Bordetella pertussis
gcuggggugggcgcgucucgug

SEQ ID NO: 2165 - RNA, 23 nt, Bordetella pertussis
gcugucguaugcccuggucaauc

SEQ ID NO: 2166 - RNA, 22 nt, Bordetella pertussis
gcugucgucguucaucucgccg

SEQ ID NO: 2167 - RNA, 22 nt, Bordetella pertussis
gcugugccgcgagcugggcgug

SEQ ID NO: 2168 - RNA, 19 nt, Bordetella pertussis
gcuguuucccagcgcggug

SEQ ID NO: 2169 - RNA, 22 nt, Bordetella pertussis
gcuugggcucggccgccagcgc

SEQ ID NO: 2170 - RNA, 22 nt, Bordetella pertussis
ggaacggcaccagccgggcuuu

SEQ ID NO: 2171 - RNA, 22 nt, Bordetella pertussis
ggaaucagcaucgccagcgcca

SEQ ID NO: 2172 - RNA, 22 nt, Bordetella pertussis
ggacauguucagcggacugggc

SEQ ID NO: 2173 - RNA, 22 nt, Bordetella pertussis
ggacgcucguggcccccggcgg

SEQ ID NO: 2174 - RNA, 22 nt, Bordetella pertussis
ggacgucaagccggucaacauc

SEQ ID NO: 2175 - RNA, 19 nt, Bordetella pertussis
ggagccgggcgacgaggcc

SEQ ID NO: 2176 - RNA, 22 nt, Bordetella pertussis
ggagcgccauuacccggugcug

SEQ ID NO: 2177 - RNA, 22 nt, Bordetella pertussis
ggagugcgcggucaucggcgug

SEQ ID NO: 2178 - RNA, 22 nt, Bordetella pertussis
ggcaaggugcuguucuauggcc

SEQ ID NO: 2179 - RNA, 22 nt, Bordetella pertussis
ggcaccccgcgcgucggggcag

SEQ ID NO: 2180 - RNA, 22 nt, Bordetella pertussis
ggcaccuugcaggccaucaagg

SEQ ID NO: 2181 - RNA, 22 nt, Bordetella pertussis
ggcagcgaauccauguacgacu

SEQ ID NO: 2182 - RNA, 22 nt, Bordetella pertussis
ggcagcucggccucgggcgcca

SEQ ID NO: 2183 - RNA, 22 nt, Bordetella pertussis
ggcauuuucauuugugcgccag

SEQ ID NO: 2184 - RNA, 22 nt, Bordetella pertussis
ggccacgaccuguugucgcugc

SEQ ID NO: 2185 - RNA, 22 nt, Bordetella pertussis
ggccagcaauccagcacgauca

SEQ ID NO: 2186 - RNA, 22 nt, Bordetella pertussis
ggccaucuggagcgccugcucg

SEQ ID NO: 2187 - RNA, 18 nt, Bordetella pertussis
ggcccgcacaugaccgcg

SEQ ID NO: 2188 - RNA, 22 nt, Bordetella pertussis
ggccgaguggaucucgucgcug

SEQ ID NO: 2189 - RNA, 22 nt, Bordetella pertussis
ggccgauauuucgcgugugcag

SEQ ID NO: 2190 - RNA, 22 nt, Bordetella pertussis
ggccgcaagcgcaugaucuggg

SEQ ID NO: 2191 - RNA, 22 nt, Bordetella pertussis
ggccgcugacgccggugcuggu

SEQ ID NO: 2192 - RNA, 22 nt, Bordetella pertussis
ggccggcggcgugacccggcug

SEQ ID NO: 2193 - RNA, 22 nt, Bordetella pertussis
ggccugauguucggccaggcgu

SEQ ID NO: 2194 - RNA, 22 nt, Bordetella pertussis
ggccugcgucagcaugugcucg

SEQ ID NO: 2195 - RNA, 22 nt, Bordetella pertussis
ggccuguuccaucaucgacagc

SEQ ID NO: 2196 - RNA, 22 nt, Bordetella pertussis
ggcgagagagcaacgcuuagug

SEQ ID NO: 2197 - RNA, 22 nt, Bordetella pertussis
ggcgaucacgcugauguucgag

SEQ ID NO: 2198 - RNA, 22 nt, Bordetella pertussis
ggcgaugcucguccagcgugcg

SEQ ID NO: 2199 - RNA, 22 nt, Bordetella pertussis
ggcgauggccaugccacgucgc

SEQ ID NO: 2200 - RNA, 22 nt, Bordetella pertussis
ggcgauggcgaagucgugguac

SEQ ID NO: 2201 - RNA, 22 nt, Bordetella pertussis
ggcgcacucucccacgcccuug

SEQ ID NO: 2202 - RNA, 22 nt, Bordetella pertussis
ggcgcauuccagcgcggccggg

SEQ ID NO: 2203 - RNA, 22 nt, Bordetella pertussis
ggcgccaguuguccaugaacca

SEQ ID NO: 2204 - RNA, 22 nt, Bordetella pertussis
ggcgcgauccugguggugucgg

SEQ ID NO: 2205 - RNA, 22 nt, Bordetella pertussis
ggcgcgcagguccugauccaga

SEQ ID NO: 2206 - RNA, 22 nt, Bordetella pertussis
ggcgcgccuggugggagcgacc

SEQ ID NO: 2207 - RNA, 22 nt, Bordetella pertussis
ggcgcgcuggucagcagcgucg

SEQ ID NO: 2208 - RNA, 22 nt, Bordetella pertussis
ggcgcggcgugcgaugauuaca

SEQ ID NO: 2209 - RNA, 22 nt, Bordetella pertussis
ggcgcuaggcgccggccacggu

SEQ ID NO: 2210 - RNA, 22 nt, Bordetella pertussis
ggcgcugaacuggccgccgguc

SEQ ID NO: 2211 - RNA, 22 nt, Bordetella pertussis
ggcgcugcgcuacggcgagaac

SEQ ID NO: 2212 - RNA, 22 nt, Bordetella pertussis
ggcgcuggcccugaucgacgug

SEQ ID NO: 2213 - RNA, 22 nt, Bordetella pertussis
ggcggaugaucuugucgucgau

SEQ ID NO: 2214 - RNA, 22 nt, Bordetella pertussis
ggcggcaacaucgugcagcccu

SEQ ID NO: 2215 - RNA, 22 nt, Bordetella pertussis
ggcggcaugcacgagggcaagg

SEQ ID NO: 2216 - RNA, 22 nt, Bordetella pertussis
uaccgggcgcgcgcguugauga

SEQ ID NO: 2217 - RNA, 22 nt, Bordetella pertussis
uaccgggcuggacuggcccggc

SEQ ID NO: 2218 - RNA, 22 nt, Bordetella pertussis
uacgauccucgugcgcuccggc

SEQ ID NO: 2219 - RNA, 22 nt, Bordetella pertussis
uacgcuggguacggcgcugcgc

SEQ ID NO: 2220 - RNA, 22 nt, Bordetella pertussis
uacggcugcgacagcgcaucga

SEQ ID NO: 2221 - RNA, 22 nt, Bordetella pertussis
uacgucgacacggugcuggcgg

SEQ ID NO: 2222 - RNA, 22 nt, Bordetella pertussis
uagaccggaaacucgauggcga

SEQ ID NO: 2223 - RNA, 22 nt, Bordetella pertussis
uagccgcuuucgagcgagccgu

SEQ ID NO: 2224 - RNA, 22 nt, Bordetella pertussis
uagcuguccaccaccacgucga

SEQ ID NO: 2225 - RNA, 22 nt, Bordetella pertussis
uauccucgaugucgcucagcga

SEQ ID NO: 2226 - RNA, 22 nt, Bordetella pertussis
uaucucgucgaucgugguacgg

SEQ ID NO: 2227 - RNA, 22 nt, Bordetella pertussis
uaugccgugguggggcugacgc

SEQ ID NO: 2228 - RNA, 22 nt, Bordetella pertussis
uauggccaggcggccugcucgc

SEQ ID NO: 2229 - RNA, 22 nt, Bordetella pertussis
ucaagccgcuuuuuugcgccug

SEQ ID NO: 2230 - RNA, 22 nt, Bordetella pertussis
ucaagcuguacgaggggcugcg

SEQ ID NO: 2231 - RNA, 22 nt, Bordetella pertussis
ucacccuguggcaagccuggcg

SEQ ID NO: 2232 - RNA, 22 nt, Bordetella pertussis
ucacgccgaacacgaugguggc

SEQ ID NO: 2233 - RNA, 22 nt, Bordetella pertussis
ucacgcgcaucgacgcccaucu

SEQ ID NO: 2234 - RNA, 20 nt, Bordetella pertussis
ucacgcucucgccgaucguc

SEQ ID NO: 2235 - RNA, 20 nt, Bordetella pertussis
ucacggugcugccgcccggc

SEQ ID NO: 2236 - RNA, 19 nt, Bordetella pertussis
ucagccagacgucgcgcga

SEQ ID NO: 2237 - RNA, 22 nt, Bordetella pertussis
ucagcgcagaggaagcgaucuu

SEQ ID NO: 2238 - RNA, 22 nt, Bordetella pertussis
ucagcgcgaacuuguagcggcu

SEQ ID NO: 2239 - RNA, 20 nt, Bordetella pertussis
ucaggccgaugucgaccuug

SEQ ID NO: 2240 - RNA, 22 nt, Bordetella pertussis
ucaucgacgaucucugguugcc

SEQ ID NO: 2241 - RNA, 20 nt, Bordetella pertussis
ucaucucgagcuggccuucg

SEQ ID NO: 2242 - RNA, 23 nt, Bordetella pertussis
ucaugggcaaggccagcuucgcc

SEQ ID NO: 2243 - RNA, 22 nt, Bordetella pertussis
ucauggugcgcgucgccauggu

SEQ ID NO: 2244 - RNA, 22 nt, Bordetella pertussis
uccagcagcagaucgagaaucc

SEQ ID NO: 2245 - RNA, 22 nt, Bordetella pertussis
uccagcccaggcuggccgccgg

SEQ ID NO: 2246 - RNA, 19 nt, Bordetella pertussis
uccagcccgccauggacau

SEQ ID NO: 2247 - RNA, 22 nt, Bordetella pertussis
uccagcgugcgcgccaacgaca

SEQ ID NO: 2248 - RNA, 22 nt, Bordetella pertussis
uccagcguuucgcgcuggcgca

SEQ ID NO: 2249 - RNA, 22 nt, Bordetella pertussis
uccaggaacugcaggccacggu

SEQ ID NO: 2250 - RNA, 22 nt, Bordetella pertussis
uccaugauggguggcgacgccg

SEQ ID NO: 2251 - RNA, 22 nt, Bordetella pertussis
ucccauggcgcggggacgccgc

SEQ ID NO: 2252 - RNA, 22 nt, Bordetella pertussis
uccgccaggucgucgcgcugga

SEQ ID NO: 2253 - RNA, 22 nt, Bordetella pertussis
uccgcgccaugcgcagguugcu

SEQ ID NO: 2254 - RNA, 22 nt, Bordetella pertussis
uccggugggcuacuucaccaug

SEQ ID NO: 2255 - RNA, 22 nt, Bordetella pertussis
uccgguuccagcucggcauccg

SEQ ID NO: 2256 - RNA, 22 nt, Bordetella pertussis
uccuccacaucggccaccauga

SEQ ID NO: 2257 - RNA, 22 nt, Bordetella pertussis
ucgaacauggugggcgaguucc

SEQ ID NO: 2258 - RNA, 22 nt, Bordetella pertussis
ucgacggcuucggcgugcugcc

SEQ ID NO: 2259 - RNA, 22 nt, Bordetella pertussis
ucgacgucgggcagcagguggc

SEQ ID NO: 2260 - RNA, 22 nt, Bordetella pertussis
ucgacgugcacgagcgcgucgu

SEQ ID NO: 2261 - RNA, 22 nt, Bordetella pertussis
ucgacgugcaugggcgcgcugc

SEQ ID NO: 2262 - RNA, 20 nt, Bordetella pertussis
ucgacuucuggucgucgaua

SEQ ID NO: 2263 - RNA, 22 nt, Bordetella pertussis
ucgagccaugccccauggcggc

SEQ ID NO: 2264 - RNA, 23 nt, Bordetella pertussis
ucgagcgucgcgucggccugugc

SEQ ID NO: 2265 - RNA, 22 nt, Bordetella pertussis
ucgaggcguucgggccggugcg

SEQ ID NO: 2266 - RNA, 22 nt, Bordetella pertussis
ucgauacguucgcccgcgaaac

SEQ ID NO: 2267 - RNA, 22 nt, Bordetella pertussis
ucgauguggaucuugcgcgcau

SEQ ID NO: 2268 - RNA, 22 nt, Bordetella pertussis
ucgcccagauaggcgccccagg

SEQ ID NO: 2269 - RNA, 22 nt, Bordetella pertussis
ucgccgacgccaucaugaugcg

SEQ ID NO: 2270 - RNA, 22 nt, Bordetella pertussis
ucgccgaucuucucgagcagcc

SEQ ID NO: 2271 - RNA, 22 nt, Bordetella pertussis
ucgcgcgucauguuuuccuggu

SEQ ID NO: 2272 - RNA, 22 nt, Bordetella pertussis
ucgcggacaagagcuucaccuu

SEQ ID NO: 2273 - RNA, 22 nt, Bordetella pertussis
ucgcggccgucuugcucgccgg

SEQ ID NO: 2274 - RNA, 22 nt, Bordetella pertussis
ucgcggugcugcugaucgagca

SEQ ID NO: 2275 - RNA, 22 nt, Bordetella pertussis
ucggauuccugcccaccgcgcc

SEQ ID NO: 2276 - RNA, 22 nt, Bordetella pertussis
ucggccuggccacggcgcuggu

SEQ ID NO: 2277 - RNA, 22 nt, Bordetella pertussis
ucggcgcugauuccgcgcaccg

SEQ ID NO: 2278 - RNA, 22 nt, Bordetella pertussis
ucgggaugagucaccgucgagc

SEQ ID NO: 2279 - RNA, 22 nt, Bordetella pertussis
ucggugaugcgcggccugggcu

SEQ ID NO: 2280 - RNA, 22 nt, Bordetella pertussis
ucggugcuggugucggacaucc

SEQ ID NO: 2281 - RNA, 21 nt, Bordetella pertussis
ucguacauggauucgcugccg

SEQ ID NO: 2282 - RNA, 22 nt, Bordetella pertussis
ucguacgucacgaugggguauu

SEQ ID NO: 2283 - RNA, 22 nt, Bordetella pertussis
ucgucaacguggcguugcccag

SEQ ID NO: 2284 - RNA, 22 nt, Bordetella pertussis
ucgucacggaucauucaccaau

SEQ ID NO: 2285 - RNA, 22 nt, Bordetella pertussis
ucguccagcgcccguaccuggc

SEQ ID NO: 2286 - RNA, 22 nt, Bordetella pertussis
ucgucggcaccgacgugggcgg

SEQ ID NO: 2287 - RNA, 22 nt, Bordetella pertussis
ucgugcgccgacagcagcgcca

SEQ ID NO: 2288 - RNA, 20 nt, Bordetella pertussis
ucgugcucagcucggcggug

SEQ ID NO: 2289 - RNA, 22 nt, Bordetella pertussis
ucgugguggugacggugguuuu

SEQ ID NO: 2290 - RNA, 22 nt, Bordetella pertussis
ucguugacgcgcuugggguugu

SEQ ID NO: 2291 - RNA, 17 nt, Bordetella pertussis
ucucgcgcaauuucggc

SEQ ID NO: 2292 - RNA, 22 nt, Bordetella pertussis
ucucgcugcugccgcucgagcc

SEQ ID NO: 2293 - RNA, 20 nt, Bordetella pertussis
ucuucuccagcgucuggugg

SEQ ID NO: 2294 - RNA, 22 nt, Bordetella pertussis
ugaccugcugccagucgcugau

SEQ ID NO: 2295 - RNA, 21 nt, Bordetella pertussis
ugccaugggaaugaugauggu

SEQ ID NO: 2296 - RNA, 22 nt, Bordetella pertussis
ugcccaugacgcgccccggcau

SEQ ID NO: 2297 - RNA, 22 nt, Bordetella pertussis
ugccccgccaugucgucuccgu

SEQ ID NO: 2298 - RNA, 22 nt, Bordetella pertussis
ugcccgggcugugcgagguggc

SEQ ID NO: 2299 - RNA, 22 nt, Bordetella pertussis
ugcccggucgacugcaucgaca

SEQ ID NO: 2300 - RNA, 22 nt, Bordetella pertussis
ugcccguggugaucggcgcgcu

SEQ ID NO: 2301 - RNA, 22 nt, Bordetella pertussis
ugccgcgcaucaugaucucgug

SEQ ID NO: 2302 - RNA, 22 nt, Bordetella pertussis
ugccgcggccgacgagcuggcc

SEQ ID NO: 2303 - RNA, 23 nt, Bordetella pertussis
ugccggcaccauggugggcgcac

SEQ ID NO: 2304 - RNA, 22 nt, Bordetella pertussis
ugccggcacgucgguggugcag

SEQ ID NO: 2305 - RNA, 22 nt, Bordetella pertussis
ugccgggccggcgcauggccuu

SEQ ID NO: 2306 - RNA, 22 nt, Bordetella pertussis
ugccugcgccaccaugcgggug

SEQ ID NO: 2307 - RNA, 22 nt, Bordetella pertussis
ugccugucccagcggggacagg

SEQ ID NO: 2308 - RNA, 22 nt, Bordetella pertussis
ugccuguccccgcugggacagg

SEQ ID NO: 2309 - RNA, 22 nt, Bordetella pertussis
ugccuguccccggcggggacug

SEQ ID NO: 2310 - RNA, 22 nt, Bordetella pertussis
ugcgccuggaucugggccuggc

SEQ ID NO: 2311 - RNA, 22 nt, Bordetella pertussis
ugcgcgacgaaucggugggccg

SEQ ID NO: 2312 - RNA, 20 nt, Bordetella pertussis
ugcgcgcggccuggauggcg

SEQ ID NO: 2313 - RNA, 22 nt, Bordetella pertussis
ugcgcgcuuuugcggcaagcug

SEQ ID NO: 2314 - RNA, 22 nt, Bordetella pertussis
ugcgcuggccguacgccugccg

SEQ ID NO: 2315 - RNA, 20 nt, Bordetella pertussis
ugcggaucgccagcaccgcg

SEQ ID NO: 2316 - RNA, 22 nt, Bordetella pertussis
ugcggccguuguaggucuugcg

SEQ ID NO: 2317 - RNA, 22 nt, Bordetella pertussis
ugcggcgcauuggauguaucug

SEQ ID NO: 2318 - RNA, 22 nt, Bordetella pertussis
ugcggcguuggcgucgagcaug

SEQ ID NO: 2319 - RNA, 22 nt, Bordetella pertussis
ugcggcugcuccuuguccacca

SEQ ID NO: 2320 - RNA, 22 nt, Bordetella pertussis
ugcuccaugugcgacagcagcc

SEQ ID NO: 2321 - RNA, 22 nt, Bordetella pertussis
ugcucgacaucccgauggccga

SEQ ID NO: 2322 - RNA, 18 nt, Bordetella pertussis
ugcucgaccgacggacug

SEQ ID NO: 2323 - RNA, 22 nt, Bordetella pertussis
ugcucgagccccugucgccgug

SEQ ID NO: 2324 - RNA, 22 nt, Bordetella pertussis
ugcucgagcgugugguggcggc

SEQ ID NO: 2325 - RNA, 22 nt, Bordetella pertussis
ugcugcaggcgguucggguuuu

SEQ ID NO: 2326 - RNA, 20 nt, Bordetella pertussis
ugcugcgcggccuggacauc

SEQ ID NO: 2327 - RNA, 22 nt, Bordetella pertussis
ugcuggacuucgcccgcacgcu

SEQ ID NO: 2328 - RNA, 22 nt, Bordetella pertussis
ugcuggccaucgugcugaccuc

SEQ ID NO: 2329 - RNA, 22 nt, Bordetella pertussis
ugcuggccgccaccggcggcca

SEQ ID NO: 2330 - RNA, 22 nt, Bordetella pertussis
ugcuggccgcgcagggcaagcg

SEQ ID NO: 2331 - RNA, 22 nt, Bordetella pertussis
ugcuggugcgcagcgucgagga

SEQ ID NO: 2332 - RNA, 22 nt, Bordetella pertussis
uggaaaaugcgcucgcggaugu

SEQ ID NO: 2333 - RNA, 18 nt, Bordetella pertussis
uggaccuggucgucgguc

SEQ ID NO: 2334 - RNA, 22 nt, Bordetella pertussis
uggaugccgcgcaucauggacg

SEQ ID NO: 2335 - RNA, 22 nt, Bordetella pertussis
uggcagcgcaucuucuggucca

SEQ ID NO: 2336 - RNA, 22 nt, Bordetella pertussis
uggccaagcaccuggagauggg

SEQ ID NO: 2337 - RNA, 22 nt, Bordetella pertussis
uggccaggcggccgcgcaacgg

SEQ ID NO: 2338 - RNA, 20 nt, Bordetella pertussis
uggccgaccugcccgucgug

SEQ ID NO: 2339 - RNA, 22 nt, Bordetella pertussis
uggccgacggcggcgaaggcac

SEQ ID NO: 2340 - RNA, 22 nt, Bordetella pertussis
uggccgucaccgaggcguugua

SEQ ID NO: 2341 - RNA, 22 nt, Bordetella pertussis
uggcgaugaucgugaugauggu

SEQ ID NO: 2342 - RNA, 22 nt, Bordetella pertussis
uggcgaugcugcgcggcagcac

SEQ ID NO: 2343 - RNA, 22 nt, Bordetella pertussis
uggcgccagcagaucggcgaac

SEQ ID NO: 2344 - RNA, 22 nt, Bordetella pertussis
uggcgcccaagguggcgcugcu

SEQ ID NO: 2345 - RNA, 22 nt, Bordetella pertussis
uggcgccgauggccugcagcuc

SEQ ID NO: 2346 - RNA, 22 nt, Bordetella pertussis
uggcgcugagcagcggcacgcu

SEQ ID NO: 2347 - RNA, 22 nt, Bordetella pertussis
uggcggccagggccaggccgau

SEQ ID NO: 2348 - RNA, 22 nt, Bordetella pertussis
uggcgucgaagaugggcaugcc

SEQ ID NO: 2349 - RNA, 22 nt, Bordetella pertussis
uggcguguuccuugcccgggau

SEQ ID NO: 2350 - RNA, 22 nt, Bordetella pertussis
uggcuggcgcgccgcaaggcca

SEQ ID NO: 2351 - RNA, 22 nt, Bordetella pertussis
ugggaucgguggcgcgcaaggu

SEQ ID NO: 2352 - RNA, 22 nt, Bordetella pertussis
ugggcggccgacacgaucgccu

SEQ ID NO: 2353 - RNA, 22 nt, Bordetella pertussis
ugggcuggcagcagauggauca

SEQ ID NO: 2354 - RNA, 22 nt, Bordetella pertussis
ugggugcgcagggcgccaucgg

SEQ ID NO: 2355 - RNA, 18 nt, Bordetella pertussis
uggucgcccagcugacga

SEQ ID NO: 2356 - RNA, 22 nt, Bordetella pertussis
uggucggguucgugcgcaaggu

SEQ ID NO: 2357 - RNA, 22 nt, Bordetella pertussis
uggugcuguuccuguucaaggc

SEQ ID NO: 2358 - RNA, 22 nt, Bordetella pertussis
ugguggcuccagagcgugggag

SEQ ID NO: 2359 - RNA, 22 nt, Bordetella pertussis
uguaccaguugcccgaccagca

SEQ ID NO: 2360 - RNA, 22 nt, Bordetella pertussis
uguacucggugaugccgacggu

SEQ ID NO: 2361 - RNA, 22 nt, Bordetella pertussis
uguccggcggcgcaucgacgcc

SEQ ID NO: 2362 - RNA, 21 nt, Bordetella pertussis
ugucgcgguacgcgugcugga

SEQ ID NO: 2363 - RNA, 22 nt, Bordetella pertussis
ugucggccucgggcaagccggg

SEQ ID NO: 2364 - RNA, 22 nt, Bordetella pertussis
ugucgugcuggccgggcgcgcc

SEQ ID NO: 2365 - RNA, 22 nt, Bordetella pertussis
ugugaagucgaugugguacucg

SEQ ID NO: 2366 - RNA, 22 nt, Bordetella pertussis
ugugcgcccugaucgacgcugu

SEQ ID NO: 2367 - RNA, 22 nt, Bordetella pertussis
ugugcgccgaauagcggcggug

SEQ ID NO: 2368 - RNA, 22 nt, Bordetella pertussis
uguggauguucucccugguggu

SEQ ID NO: 2369 - RNA, 21 nt, Bordetella pertussis
uguucgccgguucgggcggcg

SEQ ID NO: 2370 - RNA, 21 nt, Bordetella pertussis
uguucggcacgauuucgaucu

SEQ ID NO: 2371 - RNA, 22 nt, Bordetella pertussis
uguucggcgaccaccaugccua

SEQ ID NO: 2372 - RNA, 20 nt, Bordetella pertussis
guucgccaagaccgauccgg

SEQ ID NO: 2373 - RNA, 22 nt, Bordetella pertussis
guucuucuugacgaugccgauc

SEQ ID NO: 2374 - RNA, 22 nt, Bordetella pertussis
guugcgcacguagucgaccgcc

SEQ ID NO: 2375 - RNA, 22 nt, Bordetella pertussis
guugcuggcaaagcgcgcgucc

SEQ ID NO: 2376 - RNA, 22 nt, Bordetella pertussis
guugcuggguucgucgagcagc

SEQ ID NO: 2377 - RNA, 22 nt, Bordetella pertussis
guuggcgcauccggcguggcaa

SEQ ID NO: 2378 - RNA, 22 nt, Bordetella pertussis
guugggcacgacgacgacggcg

SEQ ID NO: 2379 - RNA, 22 nt, Bordetella pertussis
guuggucgaggugucgccgucg

SEQ ID NO: 2380 - RNA, 22 nt, Bordetella pertussis
guuugcccggacggccaucgcg

SEQ ID NO: 2381 - RNA, 22 nt, Bordetella pertussis
uaccgcaggguuucgccggucu

SEQ ID NO: 2382 - RNA, 21 nt, Brucella suis 1330
cgauugagugagauggucgcu

SEQ ID NO: 2383 - RNA, 22 nt, Brucella suis 1330
cgcacgauuccggcucgagccu

SEQ ID NO: 2384 - RNA, 21 nt, Brucella suis 1330
cgcagcuauuuccgcgacauc

SEQ ID NO: 2385 - RNA, 20 nt, Brucella suis 1330
cgccauccacacucgccagc

SEQ ID NO: 2386 - RNA, 22 nt, Brucella suis 1330
cgcccggcacuucugguuuuug

SEQ ID NO: 2387 - RNA, 22 nt, Brucella suis 1330
cgccgauagaggaugagacgcc

SEQ ID NO: 2388 - RNA, 22 nt, Brucella suis 1330
cgccggacaaucucuaccgcga

SEQ ID NO: 2389 - RNA, 22 nt, Brucella suis 1330
cgccggcaagacugucgggcag

SEQ ID NO: 2390 - RNA, 22 nt, Brucella suis 1330
cgccgggcuucuugauccaucc

SEQ ID NO: 2391 - RNA, 22 nt, Brucella suis 1330
cgccguugcgaucaugaugccu

SEQ ID NO: 2392 - RNA, 22 nt, Brucella suis 1330
cgcgaaggccgcaacaagucgc

SEQ ID NO: 2393 - RNA, 22 nt, Brucella suis 1330
cgcgauccuuguauucgucaua

SEQ ID NO: 2394 - RNA, 22 nt, Brucella suis 1330
cgcggcgcgaccugcucgaucu

SEQ ID NO: 2395 - RNA, 22 nt, Brucella suis 1330
cgcgucuucguucacaagaaua

SEQ ID NO: 2396 - RNA, 21 nt, Brucella suis 1330
cgcgugugcuugcggggcggg

SEQ ID NO: 2397 - RNA, 21 nt, Brucella suis 1330
cggaucggcucguugauccau

SEQ ID NO: 2398 - RNA, 22 nt, Brucella suis 1330
cggcagcucaagcgggccuuug

SEQ ID NO: 2399 - RNA, 22 nt, Brucella suis 1330
aggugaaggucauuuccacgcc

SEQ ID NO: 2400 - RNA, 22 nt, Brucella suis 1330
aguggcggguuacggugccgug

SEQ ID NO: 2401 - RNA, 22 nt, Brucella suis 1330
aguggggcguuucggcugcugc

SEQ ID NO: 2402 - RNA, 22 nt, Brucella suis 1330
aguuuuccaggauugcuccgaa

SEQ ID NO: 2403 - RNA, 22 nt, Brucella suis 1330
auaccggggacaauucauucga

SEQ ID NO: 2404 - RNA, 22 nt, Brucella suis 1330
auauccuucacugcccuacugc

SEQ ID NO: 2405 - RNA, 22 nt, Brucella suis 1330
auaucgccgccuuccaugggag

SEQ ID NO: 2406 - RNA, 22 nt, Brucella suis 1330
aucagcacgauagccagaauaa

SEQ ID NO: 2407 - RNA, 22 nt, Brucella suis 1330
aucaucgccacgcacgaucuuu

SEQ ID NO: 2408 - RNA, 23 nt, Brucella suis 1330
auccggccaucaugcugaugccg

SEQ ID NO: 2409 - RNA, 22 nt, Brucella suis 1330
auccgguuccgucaacuuuaug

SEQ ID NO: 2410 - RNA, 21 nt, Brucella suis 1330
auccgucuugcaguuauagga

SEQ ID NO: 2411 - RNA, 22 nt, Brucella suis 1330
aucgcucgugauagggcauggc

SEQ ID NO: 2412 - RNA, 22 nt, Brucella suis 1330
aucggccucuccuucaugucgu

SEQ ID NO: 2413 - RNA, 22 nt, Brucella suis 1330
aucgugcuggaagaugccgauc

SEQ ID NO: 2414 - RNA, 22 nt, Brucella suis 1330
ugccucuuuccgggcgcuguug

SEQ ID NO: 2415 - RNA, 22 nt, Brucella suis 1330
ugcgaacguugaagucguuaau

SEQ ID NO: 2416 - RNA, 21 nt, Brucella suis 1330
ugcgaccgccguugucgaggu

SEQ ID NO: 2417 - RNA, 22 nt, Brucella suis 1330
ugcgauccgcauucgugaggga

SEQ ID NO: 2418 - RNA, 22 nt, Brucella suis 1330
ugcgcaaauggugauuuucgag

SEQ ID NO: 2419 - RNA, 22 nt, Brucella suis 1330
ugcgcgaaauucccgacaugua

SEQ ID NO: 2420 - RNA, 22 nt, Brucella suis 1330
ugcgcgccguugaaaccgugcg

SEQ ID NO: 2421 - RNA, 22 nt, Brucella suis 1330
ugcuugccggauggcgcacaca

SEQ ID NO: 2422 - RNA, 22 nt, Brucella suis 1330
uggaaaagauuuccguuuccau

SEQ ID NO: 2423 - RNA, 22 nt, Brucella suis 1330
uggaaagcugaugagucgcccg

SEQ ID NO: 2424 - RNA, 22 nt, Brucella suis 1330
uggaacgaguggucguacaugg

SEQ ID NO: 2425 - RNA, 22 nt, Brucella suis 1330
uggauugcaaggcauucacgca

SEQ ID NO: 2426 - RNA, 22 nt, Brucella suis 1330
uggcaaugauaauacucuggag

SEQ ID NO: 2427 - RNA, 22 nt, Brucella suis 1330
uggccgaugaaaaccaugcugg

SEQ ID NO: 2428 - RNA, 19 nt, Brucella suis 1330
uggccgucaaaaacacuga

SEQ ID NO: 2429 - RNA, 22 nt, Brucella suis 1330
uggcgagcuaaggucgccgguu

SEQ ID NO: 2430 - RNA, 20 nt, Brucella suis 1330
uggcggcgauagccgccaaa

SEQ ID NO: 2431 - RNA, 22 nt, Brucella suis 1330
uggcggcgcgcgcuuccaccca

SEQ ID NO: 2432 - RNA, 22 nt, Brucella suis 1330
uggcggcucaggcauuggcacg

SEQ ID NO: 2433 - RNA, 22 nt, Brucella suis 1330
uggcgugcgauaccgucgucaa

SEQ ID NO: 2434 - RNA, 22 nt, Brucella suis 1330
uggcugcgggccugccgcuuga

SEQ ID NO: 2435 - RNA, 22 nt, Brucella suis 1330
ugggccguccugaacagcgcaa

SEQ ID NO: 2436 - RNA, 22 nt, Brucella suis 1330
ugggcgcugccuucggcggucc

SEQ ID NO: 2437 - RNA, 22 nt, Brucella suis 1330
ugggcggucugguuggcgaaau

SEQ ID NO: 2438 - RNA, 22 nt, Brucella suis 1330
uggugcaguucuggcccgacug

SEQ ID NO: 2439 - RNA, 22 nt, Brucella suis 1330
ugguucggucggcgauugccug

SEQ ID NO: 2440 - RNA, 22 nt, Brucella suis 1330
ugugcggcugcaaauggaaauu

SEQ ID NO: 2441 - RNA, 23 nt, Brucella suis 1330
uguucgugacggugccggugauc

SEQ ID NO: 2442 - RNA, 22 nt, Brucella suis 1330
uuaucggcuaugcgagcgugga

SEQ ID NO: 2443 - RNA, 22 nt, Brucella suis 1330
uucaauaugggcaagugcaugc

SEQ ID NO: 2444 - RNA, 22 nt, Brucella suis 1330
uucaaucccuaucgcguuucga

SEQ ID NO: 2445 - RNA, 22 nt, Brucella suis 1330
uucaauuccgugcgcaucuccg

SEQ ID NO: 2446 - RNA, 22 nt, Brucella suis 1330
uucagagcauuuucccgcgcag

SEQ ID NO: 2447 - RNA, 20 nt, Brucella suis 1330
uucaggcggcgauacggcgg

SEQ ID NO: 2448 - RNA, 22 nt, Brucella suis 1330
uuccauauccaucccgaagggg

SEQ ID NO: 2449 - RNA, 22 nt, Brucella suis 1330
uucgcgaaaacaucaagaggcu

SEQ ID NO: 2450 - RNA, 22 nt, Brucella suis 1330
uucgcgcgagaacgucucggug

SEQ ID NO: 2451 - RNA, 22 nt, Brucella suis 1330
uucggaaagcgccagaacaucg

SEQ ID NO: 2452 - RNA, 22 nt, Brucella suis 1330
uucggcagcgguugccgcaugu

SEQ ID NO: 2453 - RNA, 22 nt, Brucella suis 1330
uucggcauugaacgggaagggg

SEQ ID NO: 2454 - RNA, 22 nt, Brucella suis 1330
uugaagcggcagcuugcgcauu

SEQ ID NO: 2455 - RNA, 22 nt, Brucella suis 1330
uugcccggaucguguuugccgu

SEQ ID NO: 2456 - RNA, 22 nt, Brucella suis 1330
uugccgauuucgcuugcauaug

SEQ ID NO: 2457 - RNA, 21 nt, Brucella suis 1330
uugccgcggccuugaucgaga

SEQ ID NO: 2458 - RNA, 22 nt, Brucella suis 1330
uugcggccaucgagaaccgccu

SEQ ID NO: 2459 - RNA, 18 nt, Brucella suis 1330
uugcgucgccgugucggg

SEQ ID NO: 2460 - RNA, 22 nt, Brucella suis 1330
uuggaugauggcacuuaugguu

SEQ ID NO: 2461 - RNA, 22 nt, Brucella suis 1330
uuggccuguuguucgcuucgau

SEQ ID NO: 2462 - RNA, 22 nt, Brucella suis 1330
uugggcgcaaccaccagcaaua

SEQ ID NO: 2463 - RNA, 22 nt, Brucella suis 1330
uuguuuugacgaaugcaucgca

SEQ ID NO: 2464 - RNA, 22 nt, Brucella suis 1330
uuuaugguggggcaaauggcga

SEQ ID NO: 2465 - RNA, 22 nt, Brucella suis 1330
uuuccauuggauugcugcggca

SEQ ID NO: 2466 - RNA, 22 nt, Brucella suis 1330
uuucuggauuccaaaauuugcu

SEQ ID NO: 2467 - RNA, 22 nt, Brucella suis 1330
uuugaugugccgccgcaggcuu

SEQ ID NO: 2468 - RNA, 22 nt, Brucella suis 1330
uuugcggucgaucucaucgagc

SEQ ID NO: 2469 - RNA, 22 nt, Brucella suis 1330
uuugcggucgggucggcaaggg

SEQ ID NO: 2470 - RNA, 22 nt, Brucella suis 1330
uuugcugaugauagucgcguuc

SEQ ID NO: 2471 - RNA, 20 nt, Brucella suis 1330
uuugcuggaaaugcucuaaa

SEQ ID NO: 2472 - RNA, 22 nt, Brucella suis 1330
uuuggcggcaauugccgccaug

SEQ ID NO: 2473 - RNA, 22 nt, Brucella suis 1330
uuuuaggcauugaucgcaguca

SEQ ID NO: 2474 - RNA, 22 nt, Brucella suis 1330
uuuuggaagacaugcucuggca

SEQ ID NO: 2475 - RNA, 22 nt, Brucella suis 1330
uuuugggagacaugcauuagau

SEQ ID NO: 2476 - RNA, 22 nt, Brucella suis 1330
gcaggcggccugggaugcuugc

SEQ ID NO: 2477 - RNA, 18 nt, Brucella suis 1330
gcaggcggccuugccaug

SEQ ID NO: 2478 - RNA, 22 nt, Brucella suis 1330
gcaggcuuuguugcaucggcag

SEQ ID NO: 2479 - RNA, 18 nt, Brucella suis 1330
gcaugcucguauguccau

SEQ ID NO: 2480 - RNA, 22 nt, Brucella suis 1330
gcauggcgaaggcgaggauggc

SEQ ID NO: 2481 - RNA, 22 nt, Brucella suis 1330
gcaugguggcucucgguuucgu

SEQ ID NO: 2482 - RNA, 22 nt, Brucella suis 1330
gcauuuuaagagcauaauccag

SEQ ID NO: 2483 - RNA, 22 nt, Brucella suis 1330
gcauuuuucgcccaugugcagg

SEQ ID NO: 2484 - RNA, 22 nt, Brucella suis 1330
gccagcuucugauuuucgauau

SEQ ID NO: 2485 - RNA, 22 nt, Brucella suis 1330
gcccgccaucgggaucaccgcu

SEQ ID NO: 2486 - RNA, 20 nt, Brucella suis 1330
gcccggcgggugguuucggc

SEQ ID NO: 2487 - RNA, 22 nt, Brucella suis 1330
gccgaaaucucugccgaagccg

SEQ ID NO: 2488 - RNA, 22 nt, Brucella suis 1330
gccgaugggcagaaggccauag

SEQ ID NO: 2489 - RNA, 22 nt, Brucella suis 1330
gccggggcugaucgcauuggcg

SEQ ID NO: 2490 - RNA, 22 nt, Brucella suis 1330
gccgggugucgaacugcaugau

SEQ ID NO: 2491 - RNA, 22 nt, Brucella suis 1330
gccgugacgguuuccgugcgga

SEQ ID NO: 2492 - RNA, 22 nt, Brucella suis 1330
gccguugcaauguuucacguga

SEQ ID NO: 2493 - RNA, 22 nt, Brucella suis 1330
gccguuuccauuccggugauug

SEQ ID NO: 2494 - RNA, 22 nt, Brucella suis 1330
gucgggccgacgagcagaaugu

SEQ ID NO: 2495 - RNA, 22 nt, Brucella suis 1330
gugaaauggaucgugcgggaau

SEQ ID NO: 2496 - RNA, 22 nt, Brucella suis 1330
gugcgcaggccaugcucggcaa

SEQ ID NO: 2497 - RNA, 22 nt, Brucella suis 1330
gugcgcgauuucugcggucaug

SEQ ID NO: 2498 - RNA, 22 nt, Brucella suis 1330
gugcggugacacugcuuucacc

SEQ ID NO: 2499 - RNA, 22 nt, Brucella suis 1330
gugcuggauagagaaacgcacc

SEQ ID NO: 2500 - RNA, 22 nt, Brucella suis 1330
gugggccuugaaauucugccag

SEQ ID NO: 2501 - RNA, 22 nt, Brucella suis 1330
gugggcgucgagcgugucgaga

SEQ ID NO: 2502 - RNA, 22 nt, Brucella suis 1330
guuaagcuuuaaagcgaaaggg

SEQ ID NO: 2503 - RNA, 22 nt, Brucella suis 1330
guucacgcuucccugaaauaau

SEQ ID NO: 2504 - RNA, 22 nt, Brucella suis 1330
guucugguugauuauaucgugg

SEQ ID NO: 2505 - RNA, 22 nt, Brucella suis 1330
guugaagcggcgaaacgccaaa

SEQ ID NO: 2506 - RNA, 22 nt, Brucella suis 1330
guugaucaaauguuggaaucac

SEQ ID NO: 2507 - RNA, 22 nt, Brucella suis 1330
guuucgauauuuccgaccgcgc

SEQ ID NO: 2508 - RNA, 23 nt, Brucella suis 1330
guuuggccccuaaagccgcucca

SEQ ID NO: 2509 - RNA, 22 nt, Brucella suis 1330
uaagagcaggcaguuccagcgg

SEQ ID NO: 2510 - RNA, 22 nt, Brucella suis 1330
uaccggucuucagggcuaugau

SEQ ID NO: 2511 - RNA, 22 nt, Brucella suis 1330
uacgccgauagcgggcaauugc

SEQ ID NO: 2512 - RNA, 22 nt, Brucella suis 1330
uacugccugcgcgcuggcuuua

SEQ ID NO: 2513 - RNA, 22 nt, Brucella suis 1330
ugcgcaggccugccgggacgcu

SEQ ID NO: 2514 - RNA, 22 nt, Brucella suis 1330
ugcgcaugaucaagaucaugug

SEQ ID NO: 2515 - RNA, 17 nt, Brucella suis 1330
ugcgcgcgccaagcuuc

SEQ ID NO: 2516 - RNA, 22 nt, Brucella suis 1330
ugcgcggcaucgugccggaugg

SEQ ID NO: 2517 - RNA, 22 nt, Brucella suis 1330
ugcgcuugaccuguucaucgac

SEQ ID NO: 2518 - RNA, 22 nt, Brucella suis 1330
ugcggcacgcccggcccguuau

SEQ ID NO: 2519 - RNA, 22 nt, Brucella suis 1330
ugcguggacuuucgauauggug

SEQ ID NO: 2520 - RNA, 22 nt, Brucella suis 1330
ugcguuugcccuugaugucgcu

SEQ ID NO: 2521 - RNA, 22 nt, Brucella suis 1330
ugcguuuuauuucugauggccg

SEQ ID NO: 2522 - RNA, 22 nt, Brucella suis 1330
ugcuaucuggugcucgauaaug

SEQ ID NO: 2523 - RNA, 22 nt, Brucella suis 1330
ugcugauugagauuggcuaucu

SEQ ID NO: 2524 - RNA, 22 nt, Brucella suis 1330
ugcuuccaccgccgcaucgagc

SEQ ID NO: 2525 - RNA, 21 nt, Brucella suis 1330
uggaaaugcucuaaaaagaua

SEQ ID NO: 2526 - RNA, 22 nt, Brucella suis 1330
uggaaggcuucuaugccaucca

SEQ ID NO: 2527 - RNA, 22 nt, Brucella suis 1330
uggauggcauguuugccacccg

SEQ ID NO: 2528 - RNA, 18 nt, Brucella suis 1330
uggcacugaucucaucgc

SEQ ID NO: 2529 - RNA, 20 nt, Brucella suis 1330
uggcaucgagguucgagagc

SEQ ID NO: 2530 - RNA, 22 nt, Brucella suis 1330
uggccgauggagcaggcgcuuc

SEQ ID NO: 2531 - RNA, 22 nt, Brucella suis 1330
uggccuguguuuccuugccacc

SEQ ID NO: 2532 - RNA, 22 nt, Brucella suis 1330
uggcgauugccccggcugggau

SEQ ID NO: 2533 - RNA, 22 nt, Brucella suis 1330
aacaggccggugcugugcgagg

SEQ ID NO: 2534 - RNA, 22 nt, Brucella suis 1330
aaccugcauccaaccggccgca

SEQ ID NO: 2535 - RNA, 22 nt, Brucella suis 1330
aacgccaucaugcuugucaucg

SEQ ID NO: 2536 - RNA, 22 nt, Brucella suis 1330
aagaccgacgaucuugccguca

SEQ ID NO: 2537 - RNA, 22 nt, Brucella suis 1330
aagacgauuuuugugcgcgccg

SEQ ID NO: 2538 - RNA, 22 nt, Brucella suis 1330
aagaucgucaucgacgcuggcc

SEQ ID NO: 2539 - RNA, 22 nt, Brucella suis 1330
aagcagcuugcuuuugugcaug

SEQ ID NO: 2540 - RNA, 22 nt, Brucella suis 1330
aagccagaaugacaucggugau

SEQ ID NO: 2541 - RNA, 22 nt, Brucella suis 1330
aagccauggugccgcaggcccu

SEQ ID NO: 2542 - RNA, 22 nt, Brucella suis 1330
aagcccuuugucuugccgaugg

SEQ ID NO: 2543 - RNA, 21 nt, Brucella suis 1330
aagcgcaucauagucauacgg

SEQ ID NO: 2544 - RNA, 22 nt, Brucella suis 1330
aagcggucugcuggaaggcgau

SEQ ID NO: 2545 - RNA, 22 nt, Brucella suis 1330
aagcgucgccgcacagucacgg

SEQ ID NO: 2546 - RNA, 22 nt, Brucella suis 1330
aagcucgauggcgucaaugccg

SEQ ID NO: 2547 - RNA, 22 nt, Brucella suis 1330
aaggaaucgauuucggccgcgg

SEQ ID NO: 2548 - RNA, 22 nt, Brucella suis 1330
cagugacgaugcgaacuucauc

SEQ ID NO: 2549 - RNA, 22 nt, Brucella suis 1330
cauccgugcugcggguguuccc

SEQ ID NO: 2550 - RNA, 22 nt, Brucella suis 1330
caucgauguucgggauauucga

SEQ ID NO: 2551 - RNA, 22 nt, Brucella suis 1330
caugaugcgccgaauauccugc

SEQ ID NO: 2552 - RNA, 22 nt, Brucella suis 1330
caugccgguuucgcgccgcaau

SEQ ID NO: 2553 - RNA, 22 nt, Brucella suis 1330
caugggcgagccgaaaucggcg

SEQ ID NO: 2554 - RNA, 22 nt, Brucella suis 1330
caugguccugaucgccgauggg

SEQ ID NO: 2555 - RNA, 22 nt, Brucella suis 1330
cauuugccgauaaucgcaucgg

SEQ ID NO: 2556 - RNA, 20 nt, Brucella suis 1330
cauuuuucgacgcaauauca

SEQ ID NO: 2557 - RNA, 22 nt, Brucella suis 1330
ccagaagcagacgacgcagacg

SEQ ID NO: 2558 - RNA, 22 nt, Brucella suis 1330
ccagccgaggccggaaagcucg

SEQ ID NO: 2559 - RNA, 22 nt, Brucella suis 1330
ccagcuucaggaaauggccgau

SEQ ID NO: 2560 - RNA, 22 nt, Brucella suis 1330
ccagugauuggccggaccagaa

SEQ ID NO: 2561 - RNA, 22 nt, Brucella suis 1330
ccaguucgucggcaugugccag

SEQ ID NO: 2562 - RNA, 19 nt, Brucella suis 1330
ccauuucacucgccuucgc

SEQ ID NO: 2563 - RNA, 23 nt, Brucella suis 1330
ccgaaaucagccagcgcaucggc

SEQ ID NO: 2564 - RNA, 22 nt, Brucella suis 1330
ccgacgagucgacugguaucac

SEQ ID NO: 2565 - RNA, 22 nt, Brucella suis 1330
ccgcagaucagccuugaggcug

SEQ ID NO: 2566 - RNA, 22 nt, Brucella suis 1330
ccgccuauggcuuuacccugaa

SEQ ID NO: 2567 - RNA, 22 nt, Brucella suis 1330
ccgcgcaggccggcauugauca

SEQ ID NO: 2568 - RNA, 22 nt, Brucella suis 1330
ccggccauucacuucaaaaugu

SEQ ID NO: 2569 - RNA, 22 nt, Brucella suis 1330
ccggccuuauuuccgaccuuuc

SEQ ID NO: 2570 - RNA, 22 nt, Brucella suis 1330
ccgggcuuuuccuguucuuccg

SEQ ID NO: 2571 - RNA, 22 nt, Brucella suis 1330
ccgguucgacugacgauuccgc

SEQ ID NO: 2572 - RNA, 22 nt, Brucella suis 1330
ccgucuucacagcuuuggcguc

SEQ ID NO: 2573 - RNA, 19 nt, Brucella suis 1330
ccgugcguggccuugccau

SEQ ID NO: 2574 - RNA, 22 nt, Brucella suis 1330
ccgugcugaaaggcugccgauc

SEQ ID NO: 2575 - RNA, 22 nt, Brucella suis 1330
ccguuaucggcacggccgguuu

SEQ ID NO: 2576 - RNA, 22 nt, Brucella suis 1330
ccucuggccccaugcugcgcgg

SEQ ID NO: 2577 - RNA, 22 nt, Brucella suis 1330
ccugccggucguggcugucgau

SEQ ID NO: 2578 - RNA, 22 nt, Brucella suis 1330
ccugcgcuggauggaagcgcgc

SEQ ID NO: 2579 - RNA, 22 nt, Brucella suis 1330
ccugggcaagaacguugauugc

SEQ ID NO: 2580 - RNA, 22 nt, Brucella suis 1330
ccugucgcuggaacaggugcgg

SEQ ID NO: 2581 - RNA, 22 nt, Brucella suis 1330
ccuucggcucggcugcaagcag

SEQ ID NO: 2582 - RNA, 20 nt, Brucella suis 1330
ccuugcugucccauggcgcc

SEQ ID NO: 2583 - RNA, 22 nt, Brucella suis 1330
ccuuucuguuucgugggguuca

SEQ ID NO: 2584 - RNA, 22 nt, Brucella suis 1330
ccuuuugcuauguucgguccgc

SEQ ID NO: 2585 - RNA, 22 nt, Brucella suis 1330
cgaccccgcccgaucugcuucg

SEQ ID NO: 2586 - RNA, 22 nt, Brucella suis 1330
cgacgagcaggcuuugcgcggc

SEQ ID NO: 2587 - RNA, 18 nt, Brucella suis 1330
cgacuaucguccagcaga

SEQ ID NO: 2588 - RNA, 23 nt, Brucella suis 1330
cgagccgcuuuucaaccucgcgc

SEQ ID NO: 2589 - RNA, 22 nt, Brucella suis 1330
cgagggugaggcugagcgcggc

SEQ ID NO: 2590 - RNA, 22 nt, Brucella suis 1330
cgauuuguuuaccuugucggcu

SEQ ID NO: 2591 - RNA, 22 nt, Brucella suis 1330
cgcaauauugcgcauuuccgcc

SEQ ID NO: 2592 - RNA, 22 nt, Brucella suis 1330
cgccagcaaacacuuagagcgg

SEQ ID NO: 2593 - RNA, 22 nt, Brucella suis 1330
cgccauucugguggccaucaau

SEQ ID NO: 2594 - RNA, 22 nt, Brucella suis 1330
cgcccgucaccgugcggucgau

SEQ ID NO: 2595 - RNA, 22 nt, Brucella suis 1330
cgccgacagaauggcaagcaag

SEQ ID NO: 2596 - RNA, 22 nt, Brucella suis 1330
cgccggugugaacgcccaucgg

SEQ ID NO: 2597 - RNA, 22 nt, Brucella suis 1330
cgccuaucauaugcgccaggau

SEQ ID NO: 2598 - RNA, 22 nt, Brucella suis 1330
cgcgaugaaaaugugaagcucg

SEQ ID NO: 2599 - RNA, 22 nt, Brucella suis 1330
cgcgauuaccugauggggcgua

SEQ ID NO: 2600 - RNA, 22 nt, Brucella suis 1330
cgcgcccagaccaucgccuaug

SEQ ID NO: 2601 - RNA, 22 nt, Brucella suis 1330
cgcgccgaggugaucgauguuu

SEQ ID NO: 2602 - RNA, 22 nt, Brucella suis 1330
cgcgccugaaaucuuucucgga

SEQ ID NO: 2603 - RNA, 22 nt, Brucella suis 1330
cgcgccuugaucugccacagaa

SEQ ID NO: 2604 - RNA, 22 nt, Brucella suis 1330
cgcggcggccagaaugggacag

SEQ ID NO: 2605 - RNA, 22 nt, Brucella suis 1330
cgcguuucggcaucgaugcgga

SEQ ID NO: 2606 - RNA, 22 nt, Brucella suis 1330
cgcguuuucggaucgaagccug

SEQ ID NO: 2607 - RNA, 22 nt, Brucella suis 1330
cgcucgaucuuauccgcgcguu

SEQ ID NO: 2608 - RNA, 22 nt, Brucella suis 1330
cgcuggaggcaucgaagguugc

SEQ ID NO: 2609 - RNA, 22 nt, Brucella suis 1330
cgcuggaggucuuccggcucga

SEQ ID NO: 2610 - RNA, 22 nt, Brucella suis 1330
cgcuuccaccgucuugccaucc

SEQ ID NO: 2611 - RNA, 22 nt, Brucella suis 1330
cggaacuguggcuuggcgauuu

SEQ ID NO: 2612 - RNA, 22 nt, Brucella suis 1330
cggacgaaaacucggccauugg

SEQ ID NO: 2613 - RNA, 22 nt, Brucella suis 1330
cggcaaugucaccuauggccac

SEQ ID NO: 2614 - RNA, 22 nt, Brucella suis 1330
cggcccgacaucauagaggcga

SEQ ID NO: 2615 - RNA, 22 nt, Brucella suis 1330
cggcgcaagccugccaauggug

SEQ ID NO: 2616 - RNA, 22 nt, Brucella suis 1330
cggcggcguucccauugagcca

SEQ ID NO: 2617 - RNA, 22 nt, Brucella suis 1330
cggcuuggcauugcugaguaua

SEQ ID NO: 2618 - RNA, 20 nt, Brucella suis 1330
cgggaaggucgcauugucau

SEQ ID NO: 2619 - RNA, 22 nt, Brucella suis 1330
cgggccaugggcuggagauugc

SEQ ID NO: 2620 - RNA, 22 nt, Brucella suis 1330
cgggccgcucaguuuugcagga

SEQ ID NO: 2621 - RNA, 22 nt, Brucella suis 1330
cggggcagaugucgucgugcuu

SEQ ID NO: 2622 - RNA, 20 nt, Brucella suis 1330
cgguggugacgcccaucugc

SEQ ID NO: 2623 - RNA, 22 nt, Brucella suis 1330
cgguuggcgcaaacgcaggucu

SEQ ID NO: 2624 - RNA, 22 nt, Brucella suis 1330
cguaacauugcgugagaucggg

SEQ ID NO: 2625 - RNA, 22 nt, Brucella suis 1330
cguaggcaguuuuggaagagcc

SEQ ID NO: 2626 - RNA, 22 nt, Brucella suis 1330
cgucauccaugugcuggguguc

SEQ ID NO: 2627 - RNA, 22 nt, Brucella suis 1330
cgucgauguggcuccgcugauc

SEQ ID NO: 2628 - RNA, 22 nt, Brucella suis 1330
cgucggcgggcaucauuuuuuc

SEQ ID NO: 2629 - RNA, 22 nt, Brucella suis 1330
cgugaccuucuauuaucucgug

SEQ ID NO: 2630 - RNA, 22 nt, Brucella suis 1330
cucggcauggccccugccgucc

SEQ ID NO: 2631 - RNA, 22 nt, Brucella suis 1330
cucggcguuggagacgcgccag

SEQ ID NO: 2632 - RNA, 22 nt, Brucella suis 1330
cucuucugaaaaccggaaagcg

SEQ ID NO: 2633 - RNA, 22 nt, Brucella suis 1330
cugaucgucggagagcggcacu

SEQ ID NO: 2634 - RNA, 22 nt, Brucella suis 1330
cugccugcggaaugcgggcaag

SEQ ID NO: 2635 - RNA, 22 nt, Brucella suis 1330
cugccuuugcacaagguaugga

SEQ ID NO: 2636 - RNA, 22 nt, Brucella suis 1330
cugccuuuugagcagacagcuu

SEQ ID NO: 2637 - RNA, 22 nt, Brucella suis 1330
cugcgagaugccgguugaggau

SEQ ID NO: 2638 - RNA, 22 nt, Brucella suis 1330
cuggccggucagguucgcgcag

SEQ ID NO: 2639 - RNA, 22 nt, Brucella suis 1330
cuggccguggccuggaugcaag

SEQ ID NO: 2640 - RNA, 22 nt, Brucella suis 1330
ggcgaugaacgcuugcaagcug

SEQ ID NO: 2641 - RNA, 22 nt, Brucella suis 1330
ggcgccacuuucguuucaacag

SEQ ID NO: 2642 - RNA, 18 nt, Brucella suis 1330
ggcgccuugucgaguuuc

SEQ ID NO: 2643 - RNA, 22 nt, Brucella suis 1330
ggcggcaugcguuuuggcgcgu

SEQ ID NO: 2644 - RNA, 22 nt, Brucella suis 1330
ggcgucgagcgggugaugggcu

SEQ ID NO: 2645 - RNA, 22 nt, Brucella suis 1330
ggcguucagccaguugccgcgc

SEQ ID NO: 2646 - RNA, 22 nt, Brucella suis 1330
aaaagcgcagcagaucguccuu

SEQ ID NO: 2647 - RNA, 22 nt, Brucella suis 1330
aaaaguugaguaucggcgcgcg

SEQ ID NO: 2648 - RNA, 22 nt, Brucella suis 1330
aaaccgauaaaggugggcguug

SEQ ID NO: 2649 - RNA, 22 nt, Brucella suis 1330
aaaccggaauucguucaugucu

SEQ ID NO: 2650 - RNA, 22 nt, Brucella suis 1330
aaccggcgaccccaucagccug

SEQ ID NO: 2651 - RNA, 22 nt, Brucella suis 1330
aacgcguuuuaaucgucuuagu

SEQ ID NO: 2652 - RNA, 22 nt, Brucella suis 1330
aacgcucgaccugcuuggccuu

SEQ ID NO: 2653 - RNA, 22 nt, Brucella suis 1330
aacgucaaauucaauccacuag

SEQ ID NO: 2654 - RNA, 22 nt, Brucella suis 1330
aacugauugacgucagguggaa

SEQ ID NO: 2655 - RNA, 22 nt, Brucella suis 1330
aacuggcagaacgagaccgagg

SEQ ID NO: 2656 - RNA, 22 nt, Brucella suis 1330
aagacgaucuucuaaagacgcu

SEQ ID NO: 2657 - RNA, 23 nt, Brucella suis 1330
aagacgggcaaccggaacaggcc

SEQ ID NO: 2658 - RNA, 22 nt, Brucella suis 1330
aagcaggaacaggaaaauccac

SEQ ID NO: 2659 - RNA, 22 nt, Brucella suis 1330
aagccgcugagcuguccaagcu

SEQ ID NO: 2660 - RNA, 22 nt, Brucella suis 1330
aagccguuuuugugcugcucgg

SEQ ID NO: 2661 - RNA, 22 nt, Brucella suis 1330
aagcgccuucagcgugcgcucg

SEQ ID NO: 2662 - RNA, 22 nt, Brucella suis 1330
aagcgugacggaaucaccguca

SEQ ID NO: 2663 - RNA, 22 nt, Brucella suis 1330
aagcugcgcuuuucuccccaga

SEQ ID NO: 2664 - RNA, 22 nt, Brucella suis 1330
aaggaugucguaaacauugaug

SEQ ID NO: 2665 - RNA, 22 nt, Brucella suis 1330
aaggcgcacaaugccggaacgg

SEQ ID NO: 2666 - RNA, 22 nt, Brucella suis 1330
aaggcggucgccgaauauaccg

SEQ ID NO: 2667 - RNA, 22 nt, Brucella suis 1330
aaggcguuccgauccaccggug

SEQ ID NO: 2668 - RNA, 22 nt, Brucella suis 1330
aaggcuggagcuuccagaagca

SEQ ID NO: 2669 - RNA, 22 nt, Brucella suis 1330
aaggucaucgauuucgaugucg

SEQ ID NO: 2670 - RNA, 22 nt, Brucella suis 1330
aauagcugucgaacugguugga

SEQ ID NO: 2671 - RNA, 22 nt, Brucella suis 1330
aauaucggccuugaugucgaua

SEQ ID NO: 2672 - RNA, 20 nt, Brucella suis 1330
aauccagcacgaaaccggug

SEQ ID NO: 2673 - RNA, 22 nt, Brucella suis 1330
aaugccgcgauaggcagccgaa

SEQ ID NO: 2674 - RNA, 22 nt, Brucella suis 1330
aaugcuggagcuuuugaccggg

SEQ ID NO: 2675 - RNA, 23 nt, Brucella suis 1330
aauggccgccggugucaucgauc

SEQ ID NO: 2676 - RNA, 22 nt, Brucella suis 1330
aauguuggaaucagaccacuag

SEQ ID NO: 2677 - RNA, 22 nt, Brucella suis 1330
acaaugauauagcccuuuucgg

SEQ ID NO: 2678 - RNA, 22 nt, Brucella suis 1330
acccgcaucuuccugcgugccg

SEQ ID NO: 2679 - RNA, 22 nt, Brucella suis 1330
accgcugauaaggaggcgcuug

SEQ ID NO: 2680 - RNA, 22 nt, Brucella suis 1330
accuggaagggugagccgguua

SEQ ID NO: 2681 - RNA, 22 nt, Brucella suis 1330
acgaagccggcgaaaaucggua

SEQ ID NO: 2682 - RNA, 22 nt, Brucella suis 1330
acgcauugcaucaggccgauaa

SEQ ID NO: 2683 - RNA, 22 nt, Brucella suis 1330
acgccggauuuugaacggauga

SEQ ID NO: 2684 - RNA, 22 nt, Brucella suis 1330
acgccggucgaaccgucugcgg

SEQ ID NO: 2685 - RNA, 22 nt, Brucella suis 1330
acgcgaauaucgagaucaaugc

SEQ ID NO: 2686 - RNA, 22 nt, Brucella suis 1330
acgcuucauucccugauuuauc

SEQ ID NO: 2687 - RNA, 22 nt, Brucella suis 1330
acggccaaccggcggguaguuu

SEQ ID NO: 2688 - RNA, 22 nt, Brucella suis 1330
acggcugcuucuacagccggac

SEQ ID NO: 2689 - RNA, 22 nt, Brucella suis 1330
acugguucuggaagcgcagcgg

SEQ ID NO: 2690 - RNA, 22 nt, Brucella suis 1330
agagcauuuucgagccaaaacu

SEQ ID NO: 2691 - RNA, 22 nt, Brucella suis 1330
agcaaaucauugaugauacggu

SEQ ID NO: 2692 - RNA, 22 nt, Brucella suis 1330
agcagguucgguuagagcauuu

SEQ ID NO: 2693 - RNA, 22 nt, Brucella suis 1330
agccgaaaugcccgccgggcca

SEQ ID NO: 2694 - RNA, 22 nt, Brucella suis 1330
agccggaucaaacgcuggcgac

SEQ ID NO: 2695 - RNA, 22 nt, Brucella suis 1330
agcgaagaagacaauucgggca

SEQ ID NO: 2696 - RNA, 22 nt, Brucella suis 1330
agcgccauuaaugcggucacgc

SEQ ID NO: 2697 - RNA, 22 nt, Brucella suis 1330
agcggcgauggugucaacaagc

SEQ ID NO: 2698 - RNA, 22 nt, Brucella suis 1330
agcgggaucagccaugccaccg

SEQ ID NO: 2699 - RNA, 22 nt, Brucella suis 1330
agcgguuuugcguuggauaaug

SEQ ID NO: 2700 - RNA, 22 nt, Brucella suis 1330
agcugcauguuucacgugaauc

SEQ ID NO: 2701 - RNA, 21 nt, Brucella suis 1330
agcuugcaagcguucaucgcc

SEQ ID NO: 2702 - RNA, 22 nt, Brucella suis 1330
aggccgaucuuaccgccgggcu

SEQ ID NO: 2703 - RNA, 22 nt, Brucella suis 1330
aggccggugauaucgaugccca

SEQ ID NO: 2704 - RNA, 22 nt, Brucella suis 1330
aggcgcugaucugggcgcauca

SEQ ID NO: 2705 - RNA, 22 nt, Brucella suis 1330
aggcggcaucuucgaucacugg

SEQ ID NO: 2706 - RNA, 22 nt, Brucella suis 1330
aggcggcguucaguaucugcuc

SEQ ID NO: 2707 - RNA, 22 nt, Brucella suis 1330
aggcuugucgcuuuguuauucg

SEQ ID NO: 2708 - RNA, 22 nt, Brucella suis 1330
agggcucgauugccgucguugc

SEQ ID NO: 2709 - RNA, 22 nt, Brucella suis 1330
agggcuuuacagguuucuugug

SEQ ID NO: 2710 - RNA, 22 nt, Brucella suis 1330
aggucaaugcgcggcgcaugau

SEQ ID NO: 2711 - RNA, 22 nt, Brucella suis 1330
aggucggcggcgaucugccgga

SEQ ID NO: 2712 - RNA, 22 nt, Brucella suis 1330
ggcugaugacgccugaagguga

SEQ ID NO: 2713 - RNA, 23 nt, Brucella suis 1330
ggcugcaaccagcgaagagugcu

SEQ ID NO: 2714 - RNA, 22 nt, Brucella suis 1330
ggcugcacgaagcgcgggucuu

SEQ ID NO: 2715 - RNA, 22 nt, Brucella suis 1330
ggcugucgcgccuuuucuaugg

SEQ ID NO: 2716 - RNA, 22 nt, Brucella suis 1330
ggcuucuggcagagcuugccau

SEQ ID NO: 2717 - RNA, 22 nt, Brucella suis 1330
gggaucaacugggauucgacgc

SEQ ID NO: 2718 - RNA, 22 nt, Brucella suis 1330
gggccguuuuuggcuuggugau

SEQ ID NO: 2719 - RNA, 22 nt, Brucella suis 1330
gggcgcuuguuccggcuuccgg

SEQ ID NO: 2720 - RNA, 22 nt, Brucella suis 1330
ggggcgcaacacuccauauugc

SEQ ID NO: 2721 - RNA, 22 nt, Brucella suis 1330
ggguggagcgaucucacgcuaa

SEQ ID NO: 2722 - RNA, 22 nt, Brucella suis 1330
ggguggcaaacaugccauccau

SEQ ID NO: 2723 - RNA, 22 nt, Brucella suis 1330
ggucaacgcugcucaccucacc

SEQ ID NO: 2724 - RNA, 22 nt, Brucella suis 1330
ggucaaugucgaauauguaucg

SEQ ID NO: 2725 - RNA, 22 nt, Brucella suis 1330
ggucaggccgcccgaagccuga

SEQ ID NO: 2726 - RNA, 22 nt, Brucella suis 1330
ggucgagcgcaucgccgcccug

SEQ ID NO: 2727 - RNA, 22 nt, Brucella suis 1330
ggugaucgauacgggugcggca

SEQ ID NO: 2728 - RNA, 22 nt, Brucella suis 1330
gguggagcauaucaagcucauc

SEQ ID NO: 2729 - RNA, 22 nt, Brucella suis 1330
gguucaggaagugcgccuggcc

SEQ ID NO: 2730 - RNA, 22 nt, Brucella suis 1330
guccgcucaggagcagcccguu

SEQ ID NO: 2731 - RNA, 22 nt, Brucella suis 1330
gucgacgacuucacgggucacg

SEQ ID NO: 2732 - RNA, 22 nt, Brucella suis 1330
gucgagcaaauguuggaaucac

SEQ ID NO: 2733 - RNA, 22 nt, Brucella suis 1330
gucgagcacaagcaggcuuuug

SEQ ID NO: 2734 - RNA, 22 nt, Brucella suis 1330
gucgauccagcgcuccggcuga

SEQ ID NO: 2735 - RNA, 22 nt, Brucella suis 1330
gucgcagagcauuuccggcaaa

SEQ ID NO: 2736 - RNA, 22 nt, Brucella suis 1330
gucgccgggcugcuucucccaa

SEQ ID NO: 2737 - RNA, 22 nt, Brucella suis 1330
gucggcaaggauaucgagcuca

SEQ ID NO: 2738 - RNA, 22 nt, Brucella suis 1330
gucggcgcguaucaugcgccag

SEQ ID NO: 2739 - RNA, 22 nt, Brucella suis 1330
gucgggcuggcgcucgccaucg

SEQ ID NO: 2740 - RNA, 22 nt, Brucella suis 1330
gucgucaucaguggcgaaugac

SEQ ID NO: 2741 - RNA, 23 nt, Brucella suis 1330
gucguucucgcugacggcggcgc

SEQ ID NO: 2742 - RNA, 22 nt, Brucella suis 1330
gucucgaucaaggccgcggcaa

SEQ ID NO: 2743 - RNA, 22 nt, Brucella suis 1330
gugacgacgauaguuugcggcc

SEQ ID NO: 2744 - RNA, 22 nt, Brucella suis 1330
gugcuugcaaguggagauccga

SEQ ID NO: 2745 - RNA, 22 nt, Brucella suis 1330
guggccgaggugaugaagggcg

SEQ ID NO: 2746 - RNA, 22 nt, Brucella suis 1330
guggcuuuccucagcaauuggc

SEQ ID NO: 2747 - RNA, 22 nt, Brucella suis 1330
guucugguucgugcaaagcuua

SEQ ID NO: 2748 - RNA, 22 nt, Brucella suis 1330
guugagcaaauguuggaaucac

SEQ ID NO: 2749 - RNA, 20 nt, Brucella suis 1330
guuucuggcccagcgcccag

SEQ ID NO: 2750 - RNA, 22 nt, Brucella suis 1330
guuugcaaucucgacggaagaa

SEQ ID NO: 2751 - RNA, 22 nt, Brucella suis 1330
guuuuucggugguaacaggaua

SEQ ID NO: 2752 - RNA, 22 nt, Brucella suis 1330
uaccguucauggacggaaggaa

SEQ ID NO: 2753 - RNA, 22 nt, Brucella suis 1330
uacgaucugcacggcgaaugcg

SEQ ID NO: 2754 - RNA, 19 nt, Brucella suis 1330
uacggugcuggacagcgcg

SEQ ID NO: 2755 - RNA, 22 nt, Brucella suis 1330
uauuuucgcuuaucaagaauac

SEQ ID NO: 2756 - RNA, 22 nt, Brucella suis 1330
ucagcucgcuugauauuucacc

SEQ ID NO: 2757 - RNA, 22 nt, Brucella suis 1330
ucauccagauugagauaggcga

SEQ ID NO: 2758 - RNA, 22 nt, Brucella suis 1330
ucaucgagaagcaggagcuucg

SEQ ID NO: 2759 - RNA, 18 nt, Brucella suis 1330
uccaaggaugccgucuuc

SEQ ID NO: 2760 - RNA, 22 nt, Brucella suis 1330
uccauggugaagucgcgugagg

SEQ ID NO: 2761 - RNA, 22 nt, Brucella suis 1330
ucccgcaagcgaggugauggcc

SEQ ID NO: 2762 - RNA, 22 nt, Brucella suis 1330
uccgcuuucgcccccuuggcga

SEQ ID NO: 2763 - RNA, 22 nt, Brucella suis 1330
uccggcaucgggaucguaacac

SEQ ID NO: 2764 - RNA, 22 nt, Brucella suis 1330
uccucaagaacuucgcugccuu

SEQ ID NO: 2765 - RNA, 22 nt, Brucella suis 1330
ucgaaccgguccgaaccuucga

SEQ ID NO: 2766 - RNA, 22 nt, Brucella suis 1330
ucgagcguugccaugccguuca

SEQ ID NO: 2767 - RNA, 22 nt, Brucella suis 1330
ucgauaugggcuugccgguuga

SEQ ID NO: 2768 - RNA, 22 nt, Brucella suis 1330
ucgauauguauuacucgguaua

SEQ ID NO: 2769 - RNA, 22 nt, Brucella suis 1330
ucgauggaugcggagcugaugc

SEQ ID NO: 2770 - RNA, 19 nt, Brucella suis 1330
ucgcagggagcccgcuauc

SEQ ID NO: 2771 - RNA, 22 nt, Brucella suis 1330
ucgccgauacgucaccaucgau

SEQ ID NO: 2772 - RNA, 22 nt, Brucella suis 1330
ucgccgcagacgcugguggccu

SEQ ID NO: 2773 - RNA, 22 nt, Brucella suis 1330
ucgccgccgagcgucagcagaa

SEQ ID NO: 2774 - RNA, 22 nt, Brucella suis 1330
ucgccgugccggaagugcgcgg

SEQ ID NO: 2775 - RNA, 17 nt, Brucella suis 1330
ucgcggcgccggacgac

SEQ ID NO: 2776 - RNA, 22 nt, Brucella suis 1330
ucgcugaugggcauucgcgucg

SEQ ID NO: 2777 - RNA, 22 nt, Brucella suis 1330
ucgcuguuuuucuucggcugug

SEQ ID NO: 2778 - RNA, 19 nt, Brucella suis 1330
ucgcuuuaaccggcguauu

SEQ ID NO: 2779 - RNA, 22 nt, Brucella suis 1330
ucggagauuucgagcugguuua

SEQ ID NO: 2780 - RNA, 22 nt, Brucella suis 1330
ucggcgaugaucggcggcgcaa

SEQ ID NO: 2781 - RNA, 22 nt, Brucella suis 1330
ucguaauucucauauucggcuu

SEQ ID NO: 2782 - RNA, 22 nt, Brucella suis 1330
ucguggucugcggcgcguugaa

SEQ ID NO: 2783 - RNA, 19 nt, Brucella suis 1330
ucugcggaaaaacuugcaa

SEQ ID NO: 2784 - RNA, 22 nt, Brucella suis 1330
ucuggaagacgaugaaggucgc

SEQ ID NO: 2785 - RNA, 22 nt, Brucella suis 1330
ucuuccugcaugagguggcaaa

SEQ ID NO: 2786 - RNA, 22 nt, Brucella suis 1330
ugaaacgcaggaggcguugaaa

SEQ ID NO: 2787 - RNA, 20 nt, Brucella suis 1330
ugaaaggaucaugcaguuuu

SEQ ID NO: 2788 - RNA, 22 nt, Brucella suis 1330
ugaagccgcccuucgacggaga

SEQ ID NO: 2789 - RNA, 20 nt, Brucella suis 1330
ugaaggaccgucuucacgau

SEQ ID NO: 2790 - RNA, 22 nt, Brucella suis 1330
ugaucgggcuuggcuuccguuc

SEQ ID NO: 2791 - RNA, 21 nt, Brucella suis 1330
ugcaacagggucagauggcgg

SEQ ID NO: 2792 - RNA, 21 nt, Brucella suis 1330
ugcauggacagaaaaugucgc

SEQ ID NO: 2793 - RNA, 22 nt, Brucella suis 1330
ugcaugggauaaugccaagaaa

SEQ ID NO: 2794 - RNA, 22 nt, Brucella suis 1330
ugccgcauugauugcggguuuc

SEQ ID NO: 2795 - RNA, 22 nt, Brucella suis 1330
ugccgcugaucuggccggagcc

SEQ ID NO: 2796 - RNA, 22 nt, Brucella suis 1330
ugccgguuuuuccagccugaug

SEQ ID NO: 2797 - RNA, 22 nt, Brucella suis 1330
aucgugggcgugguucuggccu

SEQ ID NO: 2798 - RNA, 22 nt, Brucella suis 1330
aucguggugacgagccuucaga

SEQ ID NO: 2799 - RNA, 22 nt, Brucella suis 1330
aucuggcuuucgggcugggcuc

SEQ ID NO: 2800 - RNA, 22 nt, Brucella suis 1330
aucuggucgcuuucgaugguga

SEQ ID NO: 2801 - RNA, 22 nt, Brucella suis 1330
augaaaccgaaacccguaugcc

SEQ ID NO: 2802 - RNA, 22 nt, Brucella suis 1330
augaagcgauugcccggcuuug

SEQ ID NO: 2803 - RNA, 22 nt, Brucella suis 1330
augagcugauguaggaagauuu

SEQ ID NO: 2804 - RNA, 22 nt, Brucella suis 1330
augagguggaucccgaacuucu

SEQ ID NO: 2805 - RNA, 22 nt, Brucella suis 1330
augcgacuuuaucgcaaugcag

SEQ ID NO: 2806 - RNA, 22 nt, Brucella suis 1330
augcgcucugcaagcguuaugg

SEQ ID NO: 2807 - RNA, 22 nt, Brucella suis 1330
augcgucgcauuggcgcggcca

SEQ ID NO: 2808 - RNA, 22 nt, Brucella suis 1330
augggcaaugauuucauguucg

SEQ ID NO: 2809 - RNA, 22 nt, Brucella suis 1330
auggggaagccgucguccucga

SEQ ID NO: 2810 - RNA, 22 nt, Brucella suis 1330
augucaccaugcgggugaagga

SEQ ID NO: 2811 - RNA, 22 nt, Brucella suis 1330
augucauguucucgcagcgcgg

SEQ ID NO: 2812 - RNA, 22 nt, Brucella suis 1330
augucggucauuucgggcaagu

SEQ ID NO: 2813 - RNA, 23 nt, Brucella suis 1330
augucguuauccggcugcuguuc

SEQ ID NO: 2814 - RNA, 22 nt, Brucella suis 1330
auguggugggcuuucaucuggu

SEQ ID NO: 2815 - RNA, 22 nt, Brucella suis 1330
auucggcguuaugagcugcauc

SEQ ID NO: 2816 - RNA, 22 nt, Brucella suis 1330
auugcccgacauggugcgggcc

SEQ ID NO: 2817 - RNA, 22 nt, Brucella suis 1330
auuggcaagaucaaggcgauau

SEQ ID NO: 2818 - RNA, 19 nt, Brucella suis 1330
auuucaaggaagaugcgau

SEQ ID NO: 2819 - RNA, 22 nt, Brucella suis 1330
auuucggagcaucaucacgcag

SEQ ID NO: 2820 - RNA, 22 nt, Brucella suis 1330
caacaugccgcuucugaacggc

SEQ ID NO: 2821 - RNA, 22 nt, Brucella suis 1330
caagauggacaagcgccgcggc

SEQ ID NO: 2822 - RNA, 22 nt, Brucella suis 1330
caccauggcaauucgcgcgccg

SEQ ID NO: 2823 - RNA, 22 nt, Brucella suis 1330
caccggaacgaagguuuuugaa

SEQ ID NO: 2824 - RNA, 22 nt, Brucella suis 1330
cacuugugcgggaaucgcaugg

SEQ ID NO: 2825 - RNA, 18 nt, Brucella suis 1330
cagaaaagaaccgcuuga

SEQ ID NO: 2826 - RNA, 22 nt, Brucella suis 1330
cagcaauagaggaaaccaaggc

SEQ ID NO: 2827 - RNA, 21 nt, Brucella suis 1330
cagcacuugauggcgggccgg

SEQ ID NO: 2828 - RNA, 21 nt, Brucella suis 1330
cagcaugugcgcaucgcggcc

SEQ ID NO: 2829 - RNA, 22 nt, Brucella suis 1330
cagccggaaugaaaccagcguu

SEQ ID NO: 2830 - RNA, 22 nt, Brucella suis 1330
cagccguuuccggcgugauggc

SEQ ID NO: 2831 - RNA, 22 nt, Brucella suis 1330
cagcgcgugguuuugcgcuggc

SEQ ID NO: 2832 - RNA, 22 nt, Brucella suis 1330
cagcgggcuguuucucgaccau

SEQ ID NO: 2833 - RNA, 22 nt, Brucella suis 1330
cagcuucgugacgcacuuuuug

SEQ ID NO: 2834 - RNA, 22 nt, Brucella suis 1330
caggcgcugaucgacgagaaug

SEQ ID NO: 2835 - RNA, 22 nt, Brucella suis 1330
caucauggaacgagaacgcccc

SEQ ID NO: 2836 - RNA, 22 nt, Brucella suis 1330
caugcucgccuauauccucugg

SEQ ID NO: 2837 - RNA, 22 nt, Brucella suis 1330
cauguguccgcagucgccaaag

SEQ ID NO: 2838 - RNA, 22 nt, Brucella suis 1330
cauugcggcggcauuggccgaa

SEQ ID NO: 2839 - RNA, 22 nt, Brucella suis 1330
cauuuccagccaaaagugcaaa

SEQ ID NO: 2840 - RNA, 22 nt, Brucella suis 1330
ccagaugccggucaacgaauau

SEQ ID NO: 2841 - RNA, 22 nt, Brucella suis 1330
ccagcgcagcgaugaaggcggu

SEQ ID NO: 2842 - RNA, 22 nt, Brucella suis 1330
ccauggccuugucugcgcaagu

SEQ ID NO: 2843 - RNA, 22 nt, Brucella suis 1330
cccagugcgaaagccgugucuu

SEQ ID NO: 2844 - RNA, 22 nt, Brucella suis 1330
ccccucgcucugaucggggcgc

SEQ ID NO: 2845 - RNA, 22 nt, Brucella suis 1330
cccgcagcgacgaucaucucac

SEQ ID NO: 2846 - RNA, 22 nt, Brucella suis 1330
cccgccagauagagcgauccgc

SEQ ID NO: 2847 - RNA, 22 nt, Brucella suis 1330
cccgcgcccggugcagccgggu

SEQ ID NO: 2848 - RNA, 22 nt, Brucella suis 1330
cccggaucuucuggguggauca

SEQ ID NO: 2849 - RNA, 22 nt, Brucella suis 1330
cccggcucgauuucgacgaacg

SEQ ID NO: 2850 - RNA, 22 nt, Brucella suis 1330
ccgcacccugcacggcgcauug

SEQ ID NO: 2851 - RNA, 22 nt, Brucella suis 1330
ccgcgaucuggccgugaucgaa

SEQ ID NO: 2852 - RNA, 22 nt, Brucella suis 1330
ccgcucuaggauuuuugcuguu

SEQ ID NO: 2853 - RNA, 22 nt, Brucella suis 1330
ccggcgcgggcaagacgacgcu

SEQ ID NO: 2854 - RNA, 22 nt, Brucella suis 1330
ccggcggaugggcaggccgcuu

SEQ ID NO: 2855 - RNA, 22 nt, Brucella suis 1330
ccggcuagaaaggagcacgaga

SEQ ID NO: 2856 - RNA, 22 nt, Brucella suis 1330
ccgggcgcgguuucucgucgga

SEQ ID NO: 2857 - RNA, 22 nt, Brucella suis 1330
ccggugcgugucuucauugaug

SEQ ID NO: 2858 - RNA, 22 nt, Brucella suis 1330
ccgguuugucgcgcgaagugcg

SEQ ID NO: 2859 - RNA, 22 nt, Brucella suis 1330
ccguaaggugugaugucauauu

SEQ ID NO: 2860 - RNA, 19 nt, Brucella suis 1330
ccuccgauccgaaauggua

SEQ ID NO: 2861 - RNA, 22 nt, Brucella suis 1330
ccuccgccaaugucgccuucaa

SEQ ID NO: 2862 - RNA, 21 nt, Brucella suis 1330
ccugcuccagagcgacaucga

SEQ ID NO: 2863 - RNA, 23 nt, Brucella suis 1330
ccuggagcagaaauucuacaccg

SEQ ID NO: 2864 - RNA, 22 nt, Brucella suis 1330
ccuguuccagcgcacugaccug

SEQ ID NO: 2865 - RNA, 18 nt, Brucella suis 1330
ccuguuccggcgaaagau

SEQ ID NO: 2866 - RNA, 22 nt, Brucella suis 1330
ccuugcggcgauccucgcguac

SEQ ID NO: 2867 - RNA, 22 nt, Brucella suis 1330
cgacaagcugcgguucgucuuc

SEQ ID NO: 2868 - RNA, 22 nt, Brucella suis 1330
cgacauggaaucggccacgauu

SEQ ID NO: 2869 - RNA, 20 nt, Brucella suis 1330
cgagcgcgcgcacuguggaa

SEQ ID NO: 2870 - RNA, 20 nt, Brucella suis 1330
cgauauuccccgcccgccuu

SEQ ID NO: 2871 - RNA, 22 nt, Brucella suis 1330
cgaucaucaugacaguacugcu

SEQ ID NO: 2872 - RNA, 22 nt, Brucella suis 1330
cgaugcgcuuuggcuggcggcg

SEQ ID NO: 2873 - RNA, 21 nt, Brucella suis 1330
cggcagcuuuccugccgggcg

SEQ ID NO: 2874 - RNA, 22 nt, Brucella suis 1330
cggcaucgucauccauggccgc

SEQ ID NO: 2875 - RNA, 22 nt, Brucella suis 1330
cggcccuucccaugcugcucgu

SEQ ID NO: 2876 - RNA, 22 nt, Brucella suis 1330
cggcggaauucggcccgacuac

SEQ ID NO: 2877 - RNA, 22 nt, Brucella suis 1330
cggcggccagcaggcacagcgu

SEQ ID NO: 2878 - RNA, 22 nt, Brucella suis 1330
cggcucugauccacauaggaaa

SEQ ID NO: 2879 - RNA, 20 nt, Brucella suis 1330
cggcugcaagcaaggcuguc

SEQ ID NO: 2880 - RNA, 22 nt, Brucella suis 1330
cggcuucaauccgaaaucaaga

SEQ ID NO: 2881 - RNA, 23 nt, Brucella suis 1330
cgggccgauccguuauggcguca

SEQ ID NO: 2882 - RNA, 22 nt, Brucella suis 1330
cgggccuuaucugaauuugcua

SEQ ID NO: 2883 - RNA, 22 nt, Brucella suis 1330
cggugcgucguccgauagcguc

SEQ ID NO: 2884 - RNA, 22 nt, Brucella suis 1330
cgguuucggcaggcucuuuccg

SEQ ID NO: 2885 - RNA, 22 nt, Brucella suis 1330
cgucaagggcgaugugcacgau

SEQ ID NO: 2886 - RNA, 22 nt, Brucella suis 1330
cgucuuuagaagaucgucuucc

SEQ ID NO: 2887 - RNA, 22 nt, Brucella suis 1330
cgugaaaucgauccgugccguc

SEQ ID NO: 2888 - RNA, 22 nt, Brucella suis 1330
cgugaccacgacauuuucgcuu

SEQ ID NO: 2889 - RNA, 22 nt, Brucella suis 1330
cguguucgccgguucacuucau

SEQ ID NO: 2890 - RNA, 20 nt, Brucella suis 1330
cguucauccgccugucgggc

SEQ ID NO: 2891 - RNA, 22 nt, Brucella suis 1330
cuaaagcauuuccagcaaaagu

SEQ ID NO: 2892 - RNA, 22 nt, Brucella suis 1330
cuccagaaucuucuuguugcca

SEQ ID NO: 2893 - RNA, 22 nt, Brucella suis 1330
cucggccauaucgaggaacugg

SEQ ID NO: 2894 - RNA, 22 nt, Brucella suis 1330
cugaccgacuaccgcaauauca

SEQ ID NO: 2895 - RNA, 22 nt, Brucella suis 1330
cugcacauuccaaauugacaag

SEQ ID NO: 2896 - RNA, 22 nt, Brucella suis 1330
cugcgcugcacgauacggacgg

SEQ ID NO: 2897 - RNA, 22 nt, Brucella suis 1330
cugcgggcgcgguggaaaagua

SEQ ID NO: 2898 - RNA, 22 nt, Brucella suis 1330
cugcugccgcagaagaaaagac

SEQ ID NO: 2899 - RNA, 22 nt, Brucella suis 1330
cugggaaaacuacgagccggug

SEQ ID NO: 2900 - RNA, 22 nt, Brucella suis 1330
cugggcaaggagcgugucggcc

SEQ ID NO: 2901 - RNA, 22 nt, Brucella suis 1330
cugguaaagcuugaauucuuca

SEQ ID NO: 2902 - RNA, 22 nt, Brucella suis 1330
cugucaucgggguaauucguca

SEQ ID NO: 2903 - RNA, 22 nt, Brucella suis 1330
cuguggaagucaucaaggccgg

SEQ ID NO: 2904 - RNA, 22 nt, Brucella suis 1330
cuguggcucccgccaugucggc

SEQ ID NO: 2905 - RNA, 22 nt, Brucella suis 1330
cuguuuccggcaaaagcggcaa

SEQ ID NO: 2906 - RNA, 18 nt, Brucella suis 1330
cuucaggcgucaucagcc

SEQ ID NO: 2907 - RNA, 22 nt, Brucella suis 1330
cuucggcacgauggggccggau

SEQ ID NO: 2908 - RNA, 22 nt, Brucella suis 1330
cuugcgcuuuaucugccgcgaa

SEQ ID NO: 2909 - RNA, 17 nt, Brucella suis 1330
cuugucgagcgcacgcg

SEQ ID NO: 2910 - RNA, 22 nt, Brucella suis 1330
cuuuggcuggaaugucucgccc

SEQ ID NO: 2911 - RNA, 22 nt, Brucella suis 1330
cuuuucguggcgauuuccauga

SEQ ID NO: 2912 - RNA, 22 nt, Brucella suis 1330
gaaaaccgguugaaauccccga

SEQ ID NO: 2913 - RNA, 22 nt, Brucella suis 1330
gaacaugacguucgauagauca

SEQ ID NO: 2914 - RNA, 22 nt, Brucella suis 1330
gaaccgcucugauuauuuguuu

SEQ ID NO: 2915 - RNA, 18 nt, Brucella suis 1330
gaacuggcgcauggaaag

SEQ ID NO: 2916 - RNA, 22 nt, Brucella suis 1330
gaagcgacgccaggccugauag

SEQ ID NO: 2917 - RNA, 22 nt, Brucella suis 1330
gaagcucggcuaucucuacaau

SEQ ID NO: 2918 - RNA, 22 nt, Brucella suis 1330
gaaggcaaccuucuuguccggg

SEQ ID NO: 2919 - RNA, 22 nt, Brucella suis 1330
gaauaugccgaacccgaauggu

SEQ ID NO: 2920 - RNA, 22 nt, Brucella suis 1330
gaccgccauugccgcgcugcug

SEQ ID NO: 2921 - RNA, 22 nt, Brucella suis 1330
gaccuguagccugaaccaccug

SEQ ID NO: 2922 - RNA, 22 nt, Brucella suis 1330
gacgaggccgaguuucgcaauu

SEQ ID NO: 2923 - RNA, 19 nt, Brucella suis 1330
gacgaguugaacaugcguu

SEQ ID NO: 2924 - RNA, 22 nt, Brucella suis 1330
gacgccgaaaaagguugaccag

SEQ ID NO: 2925 - RNA, 22 nt, Brucella suis 1330
gacgcugacgaccgcagggcga

SEQ ID NO: 2926 - RNA, 22 nt, Brucella suis 1330
gacggcacacugaucgacuucg

SEQ ID NO: 2927 - RNA, 22 nt, Brucella suis 1330
gacggcaugggacaggugagcg

SEQ ID NO: 2928 - RNA, 22 nt, Brucella suis 1330
gacggcgaucuuggcgcgggaa

SEQ ID NO: 2929 - RNA, 22 nt, Brucella suis 1330
gagauauaggugaagucgucga

SEQ ID NO: 2930 - RNA, 22 nt, Brucella suis 1330
gagcggcggucgucacgaucau

SEQ ID NO: 2931 - RNA, 22 nt, Brucella suis 1330
gagcgucgucuugcccgcgccg

SEQ ID NO: 2932 - RNA, 22 nt, Brucella suis 1330
gaggacgaugauuucuugucgg

SEQ ID NO: 2933 - RNA, 20 nt, Brucella suis 1330
gagucgcagaucagcgccag

SEQ ID NO: 2934 - RNA, 22 nt, Brucella suis 1330
gauccgauggucaccaaggaca

SEQ ID NO: 2935 - RNA, 22 nt, Brucella suis 1330
gaucggcauugguuuugcuauu

SEQ ID NO: 2936 - RNA, 22 nt, Brucella suis 1330
gaucgggcgaaauuucgcugaa

SEQ ID NO: 2937 - RNA, 22 nt, Brucella suis 1330
gaucucgaaaauuccgggugcu

SEQ ID NO: 2938 - RNA, 22 nt, Brucella suis 1330
gaugaaaauauggaggaguugg

SEQ ID NO: 2939 - RNA, 22 nt, Brucella suis 1330
gaugccgauuuugccgguuugg

SEQ ID NO: 2940 - RNA, 22 nt, Brucella suis 1330
gaugcgccccugccgggaaaca

SEQ ID NO: 2941 - RNA, 22 nt, Brucella suis 1330
gaugcgucggauaaugcgacaa

SEQ ID NO: 2942 - RNA, 22 nt, Brucella suis 1330
gauggccagcguggagacggcu

SEQ ID NO: 2943 - RNA, 22 nt, Brucella suis 1330
gauguggcugucgauggugcga

SEQ ID NO: 2944 - RNA, 22 nt, Brucella suis 1330
gauuauccgaacagaaagaaga

SEQ ID NO: 2945 - RNA, 22 nt, Brucella suis 1330
gauuccaacauuugccucccuc

SEQ ID NO: 2946 - RNA, 20 nt, Brucella suis 1330
gcaaaacgaggagacuuguc

SEQ ID NO: 2947 - RNA, 17 nt, Brucella suis 1330
gcaaaugucggaaucaa

SEQ ID NO: 2948 - RNA, 22 nt, Brucella suis 1330
gccucgucgccgaacggcaccu

SEQ ID NO: 2949 - RNA, 18 nt, Brucella suis 1330
gccugcggcggcggcguc

SEQ ID NO: 2950 - RNA, 22 nt, Brucella suis 1330
gcgaaacaguuucaauuuccgu

SEQ ID NO: 2951 - RNA, 22 nt, Brucella suis 1330
gcgauggaucaucgccgcgcgg

SEQ ID NO: 2952 - RNA, 22 nt, Brucella suis 1330
gcgcaagugcugaacgaucugg

SEQ ID NO: 2953 - RNA, 22 nt, Brucella suis 1330
gcgcaugguaaucaucgugccu

SEQ ID NO: 2954 - RNA, 22 nt, Brucella suis 1330
gcgcauucgccgugcagaucgu

SEQ ID NO: 2955 - RNA, 22 nt, Brucella suis 1330
gcgcauugucaucugcaagguc

SEQ ID NO: 2956 - RNA, 20 nt, Brucella suis 1330
gcgcccuguuuggcaccggc

SEQ ID NO: 2957 - RNA, 22 nt, Brucella suis 1330
gcgccggcguuguacggaggaa

SEQ ID NO: 2958 - RNA, 22 nt, Brucella suis 1330
gcgccggggucaacaugcccga

SEQ ID NO: 2959 - RNA, 22 nt, Brucella suis 1330
gcgcgcgggaugaucgaucugc

SEQ ID NO: 2960 - RNA, 22 nt, Brucella suis 1330
gcgcgcuuuccgguuuucagaa

SEQ ID NO: 2961 - RNA, 22 nt, Brucella suis 1330
gcgcggggaaucaucacguccu

SEQ ID NO: 2962 - RNA, 19 nt, Brucella suis 1330
gcgcuuccgauuucgucga

SEQ ID NO: 2963 - RNA, 22 nt, Brucella suis 1330
gcggcgaugguucauugugcgg

SEQ ID NO: 2964 - RNA, 22 nt, Brucella suis 1330
gcggcgguaucgaucuugucuu

SEQ ID NO: 2965 - RNA, 22 nt, Brucella suis 1330
gcggcguuuaucaucgcggcau

SEQ ID NO: 2966 - RNA, 22 nt, Brucella suis 1330
gcggcuuugcgggcuguuugca

SEQ ID NO: 2967 - RNA, 22 nt, Brucella suis 1330
gcggggcgcgugaacauggaug

SEQ ID NO: 2968 - RNA, 22 nt, Brucella suis 1330
gcggggcuugccucggcccuga

SEQ ID NO: 2969 - RNA, 22 nt, Brucella suis 1330
gcgggucagcggcggcgucagg

SEQ ID NO: 2970 - RNA, 22 nt, Brucella suis 1330
gcgguaaauguaaaagugagug

SEQ ID NO: 2971 - RNA, 21 nt, Brucella suis 1330
gcguaucggccuugcgcauga

SEQ ID NO: 2972 - RNA, 22 nt, Brucella suis 1330
gcguggcccgguugauaucuuc

SEQ ID NO: 2973 - RNA, 22 nt, Brucella suis 1330
gcguucaaccgugauagcguuc

SEQ ID NO: 2974 - RNA, 22 nt, Brucella suis 1330
gcucaaagugcaggccacuucg

SEQ ID NO: 2975 - RNA, 22 nt, Brucella suis 1330
gcuccgaagucuuguguucggu

SEQ ID NO: 2976 - RNA, 22 nt, Brucella suis 1330
gcucgaaaaggcucuaaggaaa

SEQ ID NO: 2977 - RNA, 22 nt, Brucella suis 1330
gcugaucgaauauugccuugcc

SEQ ID NO: 2978 - RNA, 22 nt, Brucella suis 1330
gcugcucgacugggaccgcaug

SEQ ID NO: 2979 - RNA, 22 nt, Brucella suis 1330
gcuggugcugccggggcgcgau

SEQ ID NO: 2980 - RNA, 22 nt, Brucella suis 1330
gcuguuccgccuugcgcgcauu

SEQ ID NO: 2981 - RNA, 22 nt, Brucella suis 1330
gcuucccguugucuugcccgug

SEQ ID NO: 2982 - RNA, 22 nt, Brucella suis 1330
gcuugccgcgcuuuccugcgac

SEQ ID NO: 2983 - RNA, 22 nt, Brucella suis 1330
gcuugcuugccauucugucggc

SEQ ID NO: 2984 - RNA, 21 nt, Brucella suis 1330
gcuuucuuguacauucacaau

SEQ ID NO: 2985 - RNA, 22 nt, Brucella suis 1330
ggaaaaugucgcgggcgagaug

SEQ ID NO: 2986 - RNA, 22 nt, Brucella suis 1330
ggaaaugcagauuggccgcuau

SEQ ID NO: 2987 - RNA, 22 nt, Brucella suis 1330
ggagccugccagaaaagguagg

SEQ ID NO: 2988 - RNA, 22 nt, Brucella suis 1330
ggaugaaaaacucaucagcaac

SEQ ID NO: 2989 - RNA, 22 nt, Brucella suis 1330
ggauggauggcgaggccgauau

SEQ ID NO: 2990 - RNA, 22 nt, Brucella suis 1330
ggauugaauuugacguuugaau

SEQ ID NO: 2991 - RNA, 22 nt, Brucella suis 1330
ggcaauauggaguguugcgccc

SEQ ID NO: 2992 - RNA, 20 nt, Brucella suis 1330
ggcauuccaccuuguccagc

SEQ ID NO: 2993 - RNA, 22 nt, Brucella suis 1330
ggccgugugcgugccgcgcagg

SEQ ID NO: 2994 - RNA, 22 nt, Brucella suis 1330
ggccuuaccuuugaucuuugug

SEQ ID NO: 2995 - RNA, 22 nt, Brucella suis 1330
ggcgaaagcgcuggaauauugc

SEQ ID NO: 2996 - RNA, 22 nt, Brucella suis 1330
ggcgacaggccgucaaucuggu

SEQ ID NO: 2997 - RNA, 21 nt, Brucella suis 1330
ggcgcgguaauggccgugcgc

SEQ ID NO: 2998 - RNA, 22 nt, Brucella suis 1330
ggcggcacggcuucugggucuu

SEQ ID NO: 2999 - RNA, 22 nt, Brucella suis 1330
ggcguggugaucucgaccgcuu

SEQ ID NO: 3000 - RNA, 22 nt, Brucella suis 1330
ggcucgucuuccucacggauga

SEQ ID NO: 3001 - RNA, 22 nt, Brucella suis 1330
ggcuuaucccaauauuuagcgu

SEQ ID NO: 3002 - RNA, 22 nt, Brucella suis 1330
ggcuugccaucgggccgcagga

SEQ ID NO: 3003 - RNA, 22 nt, Brucella suis 1330
ggcuuuucugcugccugugcag

SEQ ID NO: 3004 - RNA, 22 nt, Brucella suis 1330
gggaauaugucagugaaggcga

SEQ ID NO: 3005 - RNA, 22 nt, Brucella suis 1330
gggacggugaauucuuccgccg

SEQ ID NO: 3006 - RNA, 22 nt, Brucella suis 1330
gggaugcaaauguuggaaucag

SEQ ID NO: 3007 - RNA, 22 nt, Brucella suis 1330
gggcuugcaggguucgggcaag

SEQ ID NO: 3008 - RNA, 22 nt, Brucella suis 1330
ggucaaggacgccgaagccaau

SEQ ID NO: 3009 - RNA, 22 nt, Brucella suis 1330
ggugaucgcuggauggucugcc

SEQ ID NO: 3010 - RNA, 22 nt, Brucella suis 1330
ggugccgauaacaaaggaggga

SEQ ID NO: 3011 - RNA, 22 nt, Brucella suis 1330
ggugccgcacgaaacucaucgu

SEQ ID NO: 3012 - RNA, 22 nt, Brucella suis 1330
ggugccguuuugcagcgacugg

SEQ ID NO: 3013 - RNA, 21 nt, Brucella suis 1330
ggugcgcuggucuaugccccg

SEQ ID NO: 3014 - RNA, 22 nt, Brucella suis 1330
ggugcgggagccuuugcugccc

SEQ ID NO: 3015 - RNA, 20 nt, Brucella suis 1330
ggugggauuuccuauuaccu

SEQ ID NO: 3016 - RNA, 22 nt, Brucella suis 1330
gguguugacgguuuccagauuc

SEQ ID NO: 3017 - RNA, 22 nt, Brucella suis 1330
guaguuuucggggucgcugcuu

SEQ ID NO: 3018 - RNA, 22 nt, Brucella suis 1330
gucacggaucgccaucuggcgc

SEQ ID NO: 3019 - RNA, 21 nt, Brucella suis 1330
gucaggggugcgaugggcgga

SEQ ID NO: 3020 - RNA, 22 nt, Brucella suis 1330
gucgaaaguuuuggcaugaugu

SEQ ID NO: 3021 - RNA, 22 nt, Brucella suis 1330
gucgaugucagcguggccgauc

SEQ ID NO: 3022 - RNA, 22 nt, Brucella suis 1330
uaucagaugacaccuuuauggu

SEQ ID NO: 3023 - RNA, 22 nt, Brucella suis 1330
uaucgaagcuuuuuucggucga

SEQ ID NO: 3024 - RNA, 20 nt, Brucella suis 1330
uauggcgaacugaugcgggu

SEQ ID NO: 3025 - RNA, 22 nt, Brucella suis 1330
uauggcggauagcgauaugauc

SEQ ID NO: 3026 - RNA, 22 nt, Brucella suis 1330
uaugucauggucaaccagccug

SEQ ID NO: 3027 - RNA, 22 nt, Brucella suis 1330
uauuccauauagagcauaaucu

SEQ ID NO: 3028 - RNA, 22 nt, Brucella suis 1330
ucaagcggaaucacauuuugca

SEQ ID NO: 3029 - RNA, 22 nt, Brucella suis 1330
ucaaguauuuccugaugcaaaa

SEQ ID NO: 3030 - RNA, 22 nt, Brucella suis 1330
ucaauauugcggccuguucgcu

SEQ ID NO: 3031 - RNA, 22 nt, Brucella suis 1330
ucacuuccucgaucauuucgcc

SEQ ID NO: 3032 - RNA, 22 nt, Brucella suis 1330
ucagccuggugcagauucaccu

SEQ ID NO: 3033 - RNA, 22 nt, Brucella suis 1330
ucagcgaugugaagccggguga

SEQ ID NO: 3034 - RNA, 22 nt, Brucella suis 1330
ucaggcuucgggcggccugacc

SEQ ID NO: 3035 - RNA, 22 nt, Brucella suis 1330
ucagugccguugaaggccagcu

SEQ ID NO: 3036 - RNA, 22 nt, Brucella suis 1330
ucagugcgggcgacuggauggg

SEQ ID NO: 3037 - RNA, 22 nt, Brucella suis 1330
ucauccggccccaucgugccga

SEQ ID NO: 3038 - RNA, 22 nt, Brucella suis 1330
ucaucgggcuugacgaagcgga

SEQ ID NO: 3039 - RNA, 22 nt, Brucella suis 1330
ucaucuggaacgugaaggugag

SEQ ID NO: 3040 - RNA, 22 nt, Brucella suis 1330
ucauggaaaucgccacgaaaag

SEQ ID NO: 3041 - RNA, 22 nt, Brucella suis 1330
ucaugguaggcugcaugguggg

SEQ ID NO: 3042 - RNA, 20 nt, Brucella suis 1330
uccaugccguucggaggcag

SEQ ID NO: 3043 - RNA, 22 nt, Brucella suis 1330
uccauugccgcaauuccgauac

SEQ ID NO: 3044 - RNA, 22 nt, Brucella suis 1330
uccgaaacgcugaauuccagca

SEQ ID NO: 3045 - RNA, 19 nt, Brucella suis 1330
uccguuuucgaugcgccag

SEQ ID NO: 3046 - RNA, 21 nt, Brucella suis 1330
uccuuccgccgccgcacaggc

SEQ ID NO: 3047 - RNA, 23 nt, Brucella suis 1330
ucgaaggguucaagcgcggcgug

SEQ ID NO: 3048 - RNA, 22 nt, Brucella suis 1330
ucgacaagggccgcauugugga

SEQ ID NO: 3049 - RNA, 22 nt, Brucella suis 1330
ucgacuguuuucggcgacaagc

SEQ ID NO: 3050 - RNA, 20 nt, Brucella suis 1330
ucgagcgcaucggcaagugc

SEQ ID NO: 3051 - RNA, 22 nt, Brucella suis 1330
ucgagcguauagggcgcgaugg

SEQ ID NO: 3052 - RNA, 22 nt, Brucella suis 1330
ucgaggaugcgggaaaggccga

SEQ ID NO: 3053 - RNA, 20 nt, Brucella suis 1330
ucgauaugcgcauggggguu

SEQ ID NO: 3054 - RNA, 22 nt, Brucella suis 1330
ucgaucuuuaccggaacaccgg

SEQ ID NO: 3055 - RNA, 22 nt, Brucella suis 1330
ucgccgacaacgaugcggccac

SEQ ID NO: 3056 - RNA, 22 nt, Brucella suis 1330
ucgccgaucggccauuugcagg

SEQ ID NO: 3057 - RNA, 22 nt, Brucella suis 1330
ucgccuucgagccugcguuucg

SEQ ID NO: 3058 - RNA, 22 nt, Brucella suis 1330
ucgcgcgguguggugcuggucg

SEQ ID NO: 3059 - RNA, 22 nt, Brucella suis 1330
ucgcggcagauaaagcgcaagc

SEQ ID NO: 3060 - RNA, 22 nt, Brucella suis 1330
ucgcugcuucugcucuucgugg

SEQ ID NO: 3061 - RNA, 22 nt, Brucella suis 1330
ucggaagucggugccggccugc

SEQ ID NO: 3062 - RNA, 22 nt, Brucella suis 1330
ucggccauggcugccuguuuga

SEQ ID NO: 3063 - RNA, 22 nt, Brucella suis 1330
ucggcggguggcaagcgcauug

SEQ ID NO: 3064 - RNA, 22 nt, Brucella suis 1330
ucgggcguaugcugauggaugg

SEQ ID NO: 3065 - RNA, 22 nt, Brucella suis 1330
ucgucaaccagcuuaccggcga

SEQ ID NO: 3066 - RNA, 22 nt, Brucella suis 1330
ucgucgcguucaauggcgucga

SEQ ID NO: 3067 - RNA, 22 nt, Brucella suis 1330
ucgucgguggugcugucgggau

SEQ ID NO: 3068 - RNA, 21 nt, Brucella suis 1330
ucgucgguuugcgcccagcca

SEQ ID NO: 3069 - RNA, 22 nt, Brucella suis 1330
ucgugaugauauucaagcguuu

SEQ ID NO: 3070 - RNA, 22 nt, Brucella suis 1330
ucgugcggucagaagccuugcg

SEQ ID NO: 3071 - RNA, 22 nt, Brucella suis 1330
ucguggaagcguaauccugguc

SEQ ID NO: 3072 - RNA, 22 nt, Brucella suis 1330
ucguggucgcccagcuauugcg

SEQ ID NO: 3073 - RNA, 22 nt, Brucella suis 1330
ucguucgcaaguucgauuaugc

SEQ ID NO: 3074 - RNA, 18 nt, Brucella suis 1330
ucucaagacggucgcuug

SEQ ID NO: 3075 - RNA, 22 nt, Brucella suis 1330
ucugacggaguugaacgcuguu

SEQ ID NO: 3076 - RNA, 22 nt, Brucella suis 1330
ucugcauggacaucauccguga

SEQ ID NO: 3077 - RNA, 22 nt, Brucella suis 1330
ucugcccggugaugagaaagca

SEQ ID NO: 3078 - RNA, 22 nt, Brucella suis 1330
ucugcgcgauguggaaacggcc

SEQ ID NO: 3079 - RNA, 22 nt, Brucella suis 1330
ucuggcguucgaugaucgugcc

SEQ ID NO: 3080 - RNA, 22 nt, Brucella suis 1330
ugaaaauuucuuaaucgcguga

SEQ ID NO: 3081 - RNA, 22 nt, Brucella suis 1330
ugaaggaucguaucgggcuugc

SEQ ID NO: 3082 - RNA, 22 nt, Brucella suis 1330
ugaaggguguggggcaugucau

SEQ ID NO: 3083 - RNA, 22 nt, Brucella suis 1330
ugacgcaugauuccaucggucu

SEQ ID NO: 3084 - RNA, 22 nt, Brucella suis 1330
ugauauugcggcgcggaauggc

SEQ ID NO: 3085 - RNA, 22 nt, Brucella suis 1330
ugaucggcaagacgaucuggag

SEQ ID NO: 3086 - RNA, 22 nt, Brucella suis 1330
ugaucugaacgcgccugcgccc

SEQ ID NO: 3087 - RNA, 22 nt, Brucella suis 1330
ugcaagccgcaagcccggcagc

SEQ ID NO: 3088 - RNA, 21 nt, Brucella suis 1330
ugcagacauggacauauuccc

SEQ ID NO: 3089 - RNA, 22 nt, Brucella suis 1330
ugcagccuugagacgugaugcg

SEQ ID NO: 3090 - RNA, 22 nt, Brucella suis 1330
ugcaggccggcggcaaucagac

SEQ ID NO: 3091 - RNA, 22 nt, Brucella suis 1330
ugcaggcgaacuggguggucaa

SEQ ID NO: 3092 - RNA, 23 nt, Brucella suis 1330
ugccaaugccacggccauggcgc

SEQ ID NO: 3093 - RNA, 22 nt, Brucella suis 1330
ugcccgaauugucuucuucgcu

SEQ ID NO: 3094 - RNA, 22 nt, Brucella suis 1330
ugccgcucuccgacgaucaggc

SEQ ID NO: 3095 - RNA, 22 nt, Brucella suis 1330
uggcgcauacggugcaugacgu

SEQ ID NO: 3096 - RNA, 22 nt, Brucella suis 1330
uggcggagcgguggaguucggu

SEQ ID NO: 3097 - RNA, 22 nt, Brucella suis 1330
uggcggauaaugccgauaucau

SEQ ID NO: 3098 - RNA, 22 nt, Brucella suis 1330
uggcggauauuuucggcuauga

SEQ ID NO: 3099 - RNA, 21 nt, Brucella suis 1330
uggcggcgaucaagcguuucc

SEQ ID NO: 3100 - RNA, 22 nt, Brucella suis 1330
uggcgggcggcuaucgcaucag

SEQ ID NO: 3101 - RNA, 22 nt, Brucella suis 1330
uggcugaagugaugcguuuuga

SEQ ID NO: 3102 - RNA, 22 nt, Brucella suis 1330
ugggcgcgaucuuuggccggug

SEQ ID NO: 3103 - RNA, 22 nt, Brucella suis 1330
uggggcgguacugcaugagggc

SEQ ID NO: 3104 - RNA, 22 nt, Brucella suis 1330
uggggcgguuucgguuaaaccc

SEQ ID NO: 3105 - RNA, 22 nt, Brucella suis 1330
uggucgcaaucaggcagcgcca

SEQ ID NO: 3106 - RNA, 22 nt, Brucella suis 1330
ugguucaucacggaauauuaau

SEQ ID NO: 3107 - RNA, 23 nt, Brucella suis 1330
ugugaagcugcaccgcaagcggc

SEQ ID NO: 3108 - RNA, 22 nt, Brucella suis 1330
ugugccugcccguuucggcugc

SEQ ID NO: 3109 - RNA, 22 nt, Brucella suis 1330
ugugcgggccaaauucuggcga

SEQ ID NO: 3110 - RNA, 22 nt, Brucella suis 1330
uguggacguguucaaggccgau

SEQ ID NO: 3111 - RNA, 22 nt, Brucella suis 1330
uguggcggaugauuguagguga

SEQ ID NO: 3112 - RNA, 22 nt, Brucella suis 1330
uguuucaaacgucaaauucuaa

SEQ ID NO: 3113 - RNA, 22 nt, Brucella suis 1330
uguuuccagagcgcgaugcgug

SEQ ID NO: 3114 - RNA, 22 nt, Brucella suis 1330
uucaaacgucaaauucaaucca

SEQ ID NO: 3115 - RNA, 22 nt, Brucella suis 1330
uuccagaccgucgagccgcuca

SEQ ID NO: 3116 - RNA, 22 nt, Brucella suis 1330
uucgccggucgccuggaaggaa

SEQ ID NO: 3117 - RNA, 22 nt, Brucella suis 1330
uucggcccgcaucgcguugcug

SEQ ID NO: 3118 - RNA, 22 nt, Brucella suis 1330
uucguugaaauguucgucggug

SEQ ID NO: 3119 - RNA, 22 nt, Brucella suis 1330
uucucggacuuuucgacacauc

SEQ ID NO: 3120 - RNA, 20 nt, Brucella suis 1330
uucucugccgccggaugcuc

SEQ ID NO: 3121 - RNA, 22 nt, Brucella suis 1330
uucuucccugcgugccagaugc

SEQ ID NO: 3122 - RNA, 22 nt, Brucella suis 1330
uucuuggcgcaggguucgcagg

SEQ ID NO: 3123 - RNA, 22 nt, Brucella suis 1330
uugacgauggugaugacgcuca

SEQ ID NO: 3124 - RNA, 22 nt, Brucella suis 1330
uugagggcugccaccguaucgc

SEQ ID NO: 3125 - RNA, 22 nt, Brucella suis 1330
uugccauugcacagcaucaugg

SEQ ID NO: 3126 - RNA, 22 nt, Brucella suis 1330
uugcccucaugucucgcgcuac

SEQ ID NO: 3127 - RNA, 21 nt, Brucella suis 1330
uugccucgccauugaugagau

SEQ ID NO: 3128 - RNA, 22 nt, Brucella suis 1330
uugcugauugcccuugccguua

SEQ ID NO: 3129 - RNA, 22 nt, Brucella suis 1330
uuggauggcauagaagccuucc

SEQ ID NO: 3130 - RNA, 22 nt, Brucella suis 1330
uuggccaaaagcaguggaagcc

SEQ ID NO: 3131 - RNA, 22 nt, Brucella suis 1330
uugggcgaaagugccgcaguuu

SEQ ID NO: 3132 - RNA, 22 nt, Brucella suis 1330
uuguuucggauggcggacagcu

SEQ ID NO: 3133 - RNA, 22 nt, Brucella suis 1330
uuuagagcauuuccggcaaauc

SEQ ID NO: 3134 - RNA, 22 nt, Brucella suis 1330
uuucaucggaaaugcggucgca

SEQ ID NO: 3135 - RNA, 22 nt, Brucella suis 1330
uuuccacagugcgcgcgcucga

SEQ ID NO: 3136 - RNA, 22 nt, Brucella suis 1330
uuucgggaugcgcucuaaaauc

SEQ ID NO: 3137 - RNA, 22 nt, Brucella suis 1330
uuugacgcgcaucuuuuccgaa

SEQ ID NO: 3138 - RNA, 22 nt, Brucella suis 1330
uuugcuggaaaugcucuagauu

SEQ ID NO: 3139 - RNA, 22 nt, Brucella suis 1330
uuuuccgcgauaugcuuaaguu

SEQ ID NO: 3140 - RNA, 22 nt, Brucella suis 1330
uuuucgcucggacggccuucac

SEQ ID NO: 3141 - RNA, 22 nt, Brucella suis 1330
uuuucggaaaagaugcgcguca

SEQ ID NO: 3142 - RNA, 22 nt, Brucella suis 1330
uuuugcugcuucacgcucgaug

SEQ ID NO: 3143 - RNA, 22 nt, Brucella suis 1330
uuuugcuggaaaugcucuaaau

SEQ ID NO: 3144 - RNA, 22 nt, Brucella suis 1330
aaggaccggucuaugugaacau

SEQ ID NO: 3145 - RNA, 22 nt, Brucella suis 1330
aaggcgcaguucugcaagcagu

SEQ ID NO: 3146 - RNA, 22 nt, Brucella suis 1330
aaggcugcggaugcgcguaucg

SEQ ID NO: 3147 - RNA, 22 nt, Brucella suis 1330
aagggcgaguuuggcgucuauc

SEQ ID NO: 3148 - RNA, 22 nt, Brucella suis 1330
aagggcguggaccaugcgcguu

SEQ ID NO: 3149 - RNA, 21 nt, Brucella suis 1330
aaguuucuugucgugaaucgc

SEQ ID NO: 3150 - RNA, 21 nt, Brucella suis 1330
aaucuggauaccguugccgcc

SEQ ID NO: 3151 - RNA, 22 nt, Brucella suis 1330
aaugccguuggugccuucauag

SEQ ID NO: 3152 - RNA, 22 nt, Brucella suis 1330
aauucucgggcgcaauaucgac

SEQ ID NO: 3153 - RNA, 22 nt, Brucella suis 1330
acaaagaguuagggcuguuccg

SEQ ID NO: 3154 - RNA, 22 nt, Brucella suis 1330
acaggcguagcuggaucgggcu

SEQ ID NO: 3155 - RNA, 21 nt, Brucella suis 1330
acauauucaaaguccggcgua

SEQ ID NO: 3156 - RNA, 22 nt, Brucella suis 1330
acaugaaaccugugugaaaauu

SEQ ID NO: 3157 - RNA, 22 nt, Brucella suis 1330
acaugcugucgcaccugucgau

SEQ ID NO: 3158 - RNA, 22 nt, Brucella suis 1330
accgaacacaagacuucggagc

SEQ ID NO: 3159 - RNA, 22 nt, Brucella suis 1330
accugcugcuccaagcgucgcg

SEQ ID NO: 3160 - RNA, 22 nt, Brucella suis 1330
accuugauaucggucguguagc

SEQ ID NO: 3161 - RNA, 22 nt, Brucella suis 1330
acgaccgugacuuucaucguuu

SEQ ID NO: 3162 - RNA, 22 nt, Brucella suis 1330
acgaucucacacgcgaugccuu

SEQ ID NO: 3163 - RNA, 22 nt, Brucella suis 1330
acgcaaauguuggaaucagaca

SEQ ID NO: 3164 - RNA, 22 nt, Brucella suis 1330
acgcgcucaauacggugauugg

SEQ ID NO: 3165 - RNA, 22 nt, Brucella suis 1330
acggugacgguggcgccauguu

SEQ ID NO: 3166 - RNA, 18 nt, Brucella suis 1330
acgucggcagugaaacgg

SEQ ID NO: 3167 - RNA, 22 nt, Brucella suis 1330
acuugucguaaacgccgcgcug

SEQ ID NO: 3168 - RNA, 23 nt, Brucella suis 1330
acuuuugcuggaaaugcuuuagg

SEQ ID NO: 3169 - RNA, 22 nt, Brucella suis 1330
agaaaaccuugcaagcugcugu

SEQ ID NO: 3170 - RNA, 22 nt, Brucella suis 1330
agaagcugggcauuccgcuucg

SEQ ID NO: 3171 - RNA, 22 nt, Brucella suis 1330
agacgcuugccgaucuuguugu

SEQ ID NO: 3172 - RNA, 22 nt, Brucella suis 1330
agaugccggauuuggcuucgcg

SEQ ID NO: 3173 - RNA, 22 nt, Brucella suis 1330
agcagcucguccgcgucugaau

SEQ ID NO: 3174 - RNA, 22 nt, Brucella suis 1330
agcagguucagggagugcuugc

SEQ ID NO: 3175 - RNA, 22 nt, Brucella suis 1330
agcgggcgcaucgccgaugcau

SEQ ID NO: 3176 - RNA, 22 nt, Brucella suis 1330
agcggggucaaaaacgcgcugc

SEQ ID NO: 3177 - RNA, 22 nt, Brucella suis 1330
aggcagcgaaguucuugaggau

SEQ ID NO: 3178 - RNA, 22 nt, Brucella suis 1330
aggcaucaagcacggcgauggc

SEQ ID NO: 3179 - RNA, 22 nt, Brucella suis 1330
aggcaucgcgugugagaucgua

SEQ ID NO: 3180 - RNA, 22 nt, Brucella suis 1330
aggcgcaugacugcgccgcguc

SEQ ID NO: 3181 - RNA, 22 nt, Brucella suis 1330
aggcgcgcgaaguugaaugcgg

SEQ ID NO: 3182 - RNA, 22 nt, Brucella suis 1330
aggcggaagaacgucugaccac

SEQ ID NO: 3183 - RNA, 22 nt, Brucella suis 1330
aggcugccauggccgcaacggc

SEQ ID NO: 3184 - RNA, 22 nt, Brucella suis 1330
agggcagugaagaauauggucg

SEQ ID NO: 3185 - RNA, 22 nt, Brucella suis 1330
agggccuuguacaaugaaucga

SEQ ID NO: 3186 - RNA, 22 nt, Brucella suis 1330
agggcggcaucuaugcccgccu

SEQ ID NO: 3187 - RNA, 22 nt, Brucella suis 1330
aggugguucucuuugcggugcc

SEQ ID NO: 3188 - RNA, 22 nt, Brucella suis 1330
agugccgcacccguaucgauca

SEQ ID NO: 3189 - RNA, 22 nt, Brucella suis 1330
aguucaggucgauuuggggagc

SEQ ID NO: 3190 - RNA, 22 nt, Brucella suis 1330
aguuuuggcucgaaaaugcucu

SEQ ID NO: 3191 - RNA, 22 nt, Brucella suis 1330
auauuucuucuccgcgucuggg

SEQ ID NO: 3192 - RNA, 22 nt, Brucella suis 1330
aucaaaggauuucugucugaua

SEQ ID NO: 3193 - RNA, 22 nt, Brucella suis 1330
aucacggaaggccagagcgaag

SEQ ID NO: 3194 - RNA, 22 nt, Brucella suis 1330
aucagcaugauggccggaucga

SEQ ID NO: 3195 - RNA, 22 nt, Brucella suis 1330
aucaugcgcaccggaacgguug

SEQ ID NO: 3196 - RNA, 22 nt, Brucella suis 1330
aucgaccgugucaucauguugc

SEQ ID NO: 3197 - RNA, 22 nt, Brucella suis 1330
aucgcacgcguuuccuggcgau

SEQ ID NO: 3198 - RNA, 22 nt, Brucella suis 1330
aucgccaacgcgguugacaacg

SEQ ID NO: 3199 - RNA, 22 nt, Brucella suis 1330
aucggaaugcgaggcaagugaa

SEQ ID NO: 3200 - RNA, 22 nt, Brucella suis 1330
aucgggagcaaccggcauggcg

SEQ ID NO: 3201 - RNA, 22 nt, Brucella suis 1330
aucgguacggucgccaucacgg

SEQ ID NO: 3202 - RNA, 22 nt, Brucella suis 1330
aucguggcuucggucgugggcg

SEQ ID NO: 3203 - RNA, 22 nt, Brucella suis 1330
aucguuccggcauggugcugaa

SEQ ID NO: 3204 - RNA, 22 nt, Brucella suis 1330
aucguuucaaauccgucuccgc

SEQ ID NO: 3205 - RNA, 22 nt, Brucella suis 1330
aucuagagcauuuccagcaaaa

SEQ ID NO: 3206 - RNA, 20 nt, Brucella suis 1330
augaagucgaaaucgcgcug

SEQ ID NO: 3207 - RNA, 22 nt, Brucella suis 1330
augacgugaauuguugcuggug

SEQ ID NO: 3208 - RNA, 22 nt, Brucella suis 1330
augaugcaucguugaucaagau

SEQ ID NO: 3209 - RNA, 22 nt, Brucella suis 1330
augcagcgcgucuuccggugug

SEQ ID NO: 3210 - RNA, 19 nt, Brucella suis 1330
augcaugucggccauugcc

SEQ ID NO: 3211 - RNA, 21 nt, Brucella suis 1330
augccggcaauauucgccaga

SEQ ID NO: 3212 - RNA, 22 nt, Brucella suis 1330
augcgaucgaguucgccgagcg

SEQ ID NO: 3213 - RNA, 22 nt, Brucella suis 1330
augcgcgauuugccgcaagcca

SEQ ID NO: 3214 - RNA, 20 nt, Brucella suis 1330
augcggcgcaucggcugucg

SEQ ID NO: 3215 - RNA, 22 nt, Brucella suis 1330
auggccuuggccugcgugucgg

SEQ ID NO: 3216 - RNA, 22 nt, Brucella suis 1330
auggcgggccauuccuucucga

SEQ ID NO: 3217 - RNA, 22 nt, Brucella suis 1330
auggucaaagccugcgcgucgg

SEQ ID NO: 3218 - RNA, 22 nt, Brucella suis 1330
auguucacauuuuaagaccgug

SEQ ID NO: 3219 - RNA, 21 nt, Brucella suis 1330
auucaagcggcuugauccggc

SEQ ID NO: 3220 - RNA, 22 nt, Brucella suis 1330
auucgcuuuuccaugccgcgca

SEQ ID NO: 3221 - RNA, 22 nt, Brucella suis 1330
auugccagcaccgugcggccgu

SEQ ID NO: 3222 - RNA, 22 nt, Brucella suis 1330
auugcccuaucgaugacggcug

SEQ ID NO: 3223 - RNA, 22 nt, Brucella suis 1330
auugcgguguccgcuucggcca

SEQ ID NO: 3224 - RNA, 22 nt, Brucella suis 1330
auugucgagggucugcuugagg

SEQ ID NO: 3225 - RNA, 22 nt, Brucella suis 1330
auuucccggaacugaccgcugg

SEQ ID NO: 3226 - RNA, 22 nt, Brucella suis 1330
auuuugcaaguguaacggucag

SEQ ID NO: 3227 - RNA, 22 nt, Brucella suis 1330
caaauaugccuucagcuuuuuc

SEQ ID NO: 3228 - RNA, 22 nt, Brucella suis 1330
caagaccugaucgcagaaccuu

SEQ ID NO: 3229 - RNA, 22 nt, Brucella suis 1330
caccaaugcugcacgucacccu

SEQ ID NO: 3230 - RNA, 22 nt, Brucella suis 1330
cacgaaaaagacaaaugccuga

SEQ ID NO: 3231 - RNA, 22 nt, Brucella suis 1330
cacggauacgguucuugcgcau

SEQ ID NO: 3232 - RNA, 22 nt, Brucella suis 1330
cacugguccgccguucgcugag

SEQ ID NO: 3233 - RNA, 22 nt, Brucella suis 1330
cagaucaauuuccauuugcagc

SEQ ID NO: 3234 - RNA, 22 nt, Brucella suis 1330
cagccuuugucgaguucggcgc

SEQ ID NO: 3235 - RNA, 22 nt, Brucella suis 1330
cagggcgaauucauugucggcg

SEQ ID NO: 3236 - RNA, 22 nt, Brucella suis 1330
cuggcgcuccgauggggacuca

SEQ ID NO: 3237 - RNA, 22 nt, Brucella suis 1330
cuuccagcuugauccaguucgu

SEQ ID NO: 3238 - RNA, 22 nt, Brucella suis 1330
cuucgagcacaacgacuucgac

SEQ ID NO: 3239 - RNA, 21 nt, Brucella suis 1330
cuugaucucgaugaugccguc

SEQ ID NO: 3240 - RNA, 22 nt, Brucella suis 1330
cuugccgucggcuauggccuuu

SEQ ID NO: 3241 - RNA, 22 nt, Brucella suis 1330
cuugcgcagccccgacgggcgc

SEQ ID NO: 3242 - RNA, 22 nt, Brucella suis 1330
cuuggcaucgggauagaaggag

SEQ ID NO: 3243 - RNA, 22 nt, Brucella suis 1330
cuuuggcgcggaaggauaccug

SEQ ID NO: 3244 - RNA, 22 nt, Brucella suis 1330
cuuuucaugcggauaguucagc

SEQ ID NO: 3245 - RNA, 22 nt, Brucella suis 1330
gaaaucugcgccugugucggcu

SEQ ID NO: 3246 - RNA, 22 nt, Brucella suis 1330
gaacccggcggaugucgaugcc

SEQ ID NO: 3247 - RNA, 22 nt, Brucella suis 1330
gaagaccgcuaucgcaagaugu

SEQ ID NO: 3248 - RNA, 23 nt, Brucella suis 1330
gaagagccaugcuuuucgggcag

SEQ ID NO: 3249 - RNA, 22 nt, Brucella suis 1330
gaagcccaguuccgcauauucu

SEQ ID NO: 3250 - RNA, 22 nt, Brucella suis 1330
gaagcggcuuugcuuuggauaa

SEQ ID NO: 3251 - RNA, 22 nt, Brucella suis 1330
gaagcgguucaaaguucaucgc

SEQ ID NO: 3252 - RNA, 22 nt, Brucella suis 1330
gaagcuuggaaugucgcgcgga

SEQ ID NO: 3253 - RNA, 22 nt, Brucella suis 1330
gaaggacaagcucggcaucgca

SEQ ID NO: 3254 - RNA, 22 nt, Brucella suis 1330
gaaggcgaggugcugcggguug

SEQ ID NO: 3255 - RNA, 22 nt, Brucella suis 1330
gaauaucauugacgauggugag

SEQ ID NO: 3256 - RNA, 22 nt, Brucella suis 1330
gaauuugccgggcgcgaauggg

SEQ ID NO: 3257 - RNA, 22 nt, Brucella suis 1330
gacaagguggaaugccccacga

SEQ ID NO: 3258 - RNA, 22 nt, Brucella suis 1330
gacacgcuugacggugccguug

SEQ ID NO: 3259 - RNA, 22 nt, Brucella suis 1330
gacaugaacgaauuccgguuuc

SEQ ID NO: 3260 - RNA, 22 nt, Brucella suis 1330
gacauguggccaugcgugcguu

SEQ ID NO: 3261 - RNA, 22 nt, Brucella suis 1330
gacgauuuugaugucagccgcc

SEQ ID NO: 3262 - RNA, 22 nt, Brucella suis 1330
gacggcucgacggugcuguuuu

SEQ ID NO: 3263 - RNA, 22 nt, Brucella suis 1330
gacuggcagcuucugccguggc

SEQ ID NO: 3264 - RNA, 22 nt, Brucella suis 1330
gagcaggaacuggcgcgcaauc

SEQ ID NO: 3265 - RNA, 22 nt, Brucella suis 1330
gaggcuggucuccgccaugcgc

SEQ ID NO: 3266 - RNA, 22 nt, Brucella suis 1330
gauccgcgccauacguugaacg

SEQ ID NO: 3267 - RNA, 22 nt, Brucella suis 1330
gaucgcgcgcagccaugcaagu

SEQ ID NO: 3268 - RNA, 22 nt, Brucella suis 1330
gaugaaaagccauuuccagucg

SEQ ID NO: 3269 - RNA, 20 nt, Brucella suis 1330
gaugacuucaugauggcauc

SEQ ID NO: 3270 - RNA, 18 nt, Brucella suis 1330
gaugcgccauugaccguc

SEQ ID NO: 3271 - RNA, 22 nt, Brucella suis 1330
gaugcggcagcuuucggcgccu

SEQ ID NO: 3272 - RNA, 22 nt, Brucella suis 1330
gauuccaacauuugcaucccuc

SEQ ID NO: 3273 - RNA, 22 nt, Brucella suis 1330
gauuccaacauuugcucgacgc

SEQ ID NO: 3274 - RNA, 22 nt, Brucella suis 1330
gauuugauuguagcggcaucuu

SEQ ID NO: 3275 - RNA, 22 nt, Brucella suis 1330
gauuuuuuguaucuugaggaau

SEQ ID NO: 3276 - RNA, 22 nt, Brucella suis 1330
gcaauaacuucggcugcuaugc

SEQ ID NO: 3277 - RNA, 22 nt, Brucella suis 1330
gcagcaggaugcgcgggugaag

SEQ ID NO: 3278 - RNA, 22 nt, Brucella suis 1330
gcaggccauugaagauuucgcc

SEQ ID NO: 3279 - RNA, 22 nt, Brucella suis 1330
gcaggggcauaccgucaucguc

SEQ ID NO: 3280 - RNA, 22 nt, Brucella suis 1330
gcaucgaaaucucccgccgcau

SEQ ID NO: 3281 - RNA, 22 nt, Brucella suis 1330
gcccgcaucuuccgcuguuugu

SEQ ID NO: 3282 - RNA, 22 nt, Brucella suis 1330
gcccgguuggcgaugcccauga

SEQ ID NO: 3283 - RNA, 22 nt, Brucella suis 1330
gccgcauuggaagcugccggug

SEQ ID NO: 3284 - RNA, 22 nt, Brucella suis 1330
gccgcggcgucagcgccaucac

SEQ ID NO: 3285 - RNA, 22 nt, Brucella suis 1330
gccggguucccggacggauuga

SEQ ID NO: 3286 - RNA, 22 nt, Brucella suis 1330
gccgguauauuccuugucgaga

SEQ ID NO: 3287 - RNA, 22 nt, Brucella suis 1330
gccgguuuccacguugauggug

SEQ ID NO: 3288 - RNA, 18 nt, Brucella suis 1330
gccgugcuuccuuccgag

SEQ ID NO: 3289 - RNA, 22 nt, Brucella suis 1330
gccguucccgucugugcuguuu

SEQ ID NO: 3290 - RNA, 22 nt, Brucella suis 1330
gccguuccggccgugugcuggc

SEQ ID NO: 3291 - RNA, 22 nt, Brucella suis 1330
gccguucgugaagcuugccgau

SEQ ID NO: 3292 - RNA, 18 nt, Brucella suis 1330
gccugcuuucgcggcgau

SEQ ID NO: 3293 - RNA, 23 nt, Brucella suis 1330
gccuuugguccacuggcccuggc

SEQ ID NO: 3294 - RNA, 22 nt, Brucella suis 1330
gccuuuuuauugcucuauugga

SEQ ID NO: 3295 - RNA, 22 nt, Brucella suis 1330
gcgagcugccuuccgguuucga

SEQ ID NO: 3296 - RNA, 22 nt, Brucella suis 1330
gcgaugacaagcaugauggcgu

SEQ ID NO: 3297 - RNA, 20 nt, Brucella suis 1330
gcgcaucgaugccgagcgca

SEQ ID NO: 3298 - RNA, 22 nt, Brucella suis 1330
gcgccguguucauuuaguuucg

SEQ ID NO: 3299 - RNA, 22 nt, Brucella suis 1330
gcgcggcauuggugaagagcug

SEQ ID NO: 3300 - RNA, 22 nt, Brucella suis 1330
gcgcguggaacaaagcgcugcu

SEQ ID NO: 3301 - RNA, 22 nt, Brucella suis 1330
gcgcuguucccuguugagggaa

SEQ ID NO: 3302 - RNA, 22 nt, Brucella suis 1330
gcggagaugcgcacggaauuga

SEQ ID NO: 3303 - RNA, 22 nt, Brucella suis 1330
gcggcaauggcggcaauggccg

SEQ ID NO: 3304 - RNA, 22 nt, Brucella suis 1330
gcggcaucagacgccuucugca

SEQ ID NO: 3305 - RNA, 22 nt, Brucella suis 1330
gcggccauguucuguguugagc

SEQ ID NO: 3306 - RNA, 22 nt, Brucella suis 1330
gcggcgaaaaucgugcaggcug

SEQ ID NO: 3307 - RNA, 19 nt, Brucella suis 1330
gcggcggcugcgcgauaua

SEQ ID NO: 3308 - RNA, 22 nt, Brucella suis 1330
gcggcuaucaccggcggcuggg

SEQ ID NO: 3309 - RNA, 22 nt, Brucella suis 1330
gcgggcauggcgcacugacgau

SEQ ID NO: 3310 - RNA, 22 nt, Brucella suis 1330
gcggucgagaugcuuggcgauc

SEQ ID NO: 3311 - RNA, 22 nt, Brucella suis 1330
gcgugcgcaauauagacggcuu

SEQ ID NO: 3312 - RNA, 22 nt, Brucella suis 1330
gcgugcguccuuucaucgguca

SEQ ID NO: 3313 - RNA, 22 nt, Brucella suis 1330
gcugaaaauccgguccaugaug

SEQ ID NO: 3314 - RNA, 22 nt, Brucella suis 1330
gcugccgacgguccgcuucucg

SEQ ID NO: 3315 - RNA, 22 nt, Brucella suis 1330
gcuggaacugcauggccccgga

SEQ ID NO: 3316 - RNA, 22 nt, Brucella suis 1330
gcuggcgcguucagauuuucga

SEQ ID NO: 3317 - RNA, 22 nt, Brucella suis 1330
gcuguuccguccggcgcaucga

SEQ ID NO: 3318 - RNA, 22 nt, Brucella suis 1330
gcuucuugauuucggugcgcau

SEQ ID NO: 3319 - RNA, 22 nt, Brucella suis 1330
gcuuggcggaauguucgcgcug

SEQ ID NO: 3320 - RNA, 22 nt, Brucella suis 1330
gcuuuucaagcggcaguugccc

SEQ ID NO: 3321 - RNA, 22 nt, Brucella suis 1330
ggaaugcugaucaaauuguugc

SEQ ID NO: 3322 - RNA, 22 nt, Brucella suis 1330
ggacggucgaucaggcgcgaaa

SEQ ID NO: 3323 - RNA, 22 nt, Brucella suis 1330
ggcaaggcaaugcgcgagcguu

SEQ ID NO: 3324 - RNA, 21 nt, Brucella suis 1330
ggccacacugcgcguccuuga

SEQ ID NO: 3325 - RNA, 22 nt, Brucella suis 1330
ggccaucaggucuauucggcag

SEQ ID NO: 3326 - RNA, 22 nt, Brucella suis 1330
ggcgaagacguaauggaacugc

SEQ ID NO: 3327 - RNA, 22 nt, Brucella suis 1330
ggcgaagauuauccggucgaug

SEQ ID NO: 3328 - RNA, 22 nt, Chlamydia trachomatis
aaaaauauagcgaguagagccg

SEQ ID NO: 3329 - RNA, 22 nt, Chlamydia trachomatis
aaaagaccugagaacgcucuuu

SEQ ID NO: 3330 - RNA, 22 nt, Chlamydia trachomatis
aaaaucaacguagaucgucgga

SEQ ID NO: 3331 - RNA, 22 nt, Chlamydia trachomatis
aaaauccuuuuaugaugugagu

SEQ ID NO: 3332 - RNA, 22 nt, Chlamydia trachomatis
aaacgggagcccaauuaaaaca

SEQ ID NO: 3333 - RNA, 22 nt, Chlamydia trachomatis
aaagcaagcccuuucucuacag

SEQ ID NO: 3334 - RNA, 22 nt, Chlamydia trachomatis
aaagguuuuuaagguauuagau

SEQ ID NO: 3335 - RNA, 22 nt, Chlamydia trachomatis
aaauaguuaacucuguagcgua

SEQ ID NO: 3336 - RNA, 22 nt, Chlamydia trachomatis
aacucuuuauucauaacaaaac

SEQ ID NO: 3337 - RNA, 22 nt, Chlamydia trachomatis
aacuuuuaauagcagauagucg

SEQ ID NO: 3338 - RNA, 22 nt, Chlamydia trachomatis
aagacuucgagacuucccagaa

SEQ ID NO: 3339 - RNA, 22 nt, Chlamydia trachomatis
aagauucuguauccaagaguga

SEQ ID NO: 3340 - RNA, 22 nt, Chlamydia trachomatis
aagcagcaucauuuugucgagg

SEQ ID NO: 3341 - RNA, 23 nt, Chlamydia trachomatis
aagccuuuauuaaagacccugaa

SEQ ID NO: 3342 - RNA, 22 nt, Chlamydia trachomatis
aagcuauagauucagcgcaguu

SEQ ID NO: 3343 - RNA, 22 nt, Chlamydia trachomatis
aagcuauugaugacgcugguau

SEQ ID NO: 3344 - RNA, 22 nt, Chlamydia trachomatis
aagcuuaaagcugaagaaguau

SEQ ID NO: 3345 - RNA, 22 nt, Chlamydia trachomatis
aagcuucguacacaagaaaauc

SEQ ID NO: 3346 - RNA, 22 nt, Chlamydia trachomatis
aagggaaacucaccuuaguagu

SEQ ID NO: 3347 - RNA, 22 nt, Chlamydia trachomatis
aaguagaggcuaccuauggaga

SEQ ID NO: 3348 - RNA, 22 nt, Chlamydia trachomatis
aaguauuagugacuaccauuac

SEQ ID NO: 3349 - RNA, 22 nt, Chlamydia trachomatis
aagucuaguuuauauguauggg

SEQ ID NO: 3350 - RNA, 22 nt, Chlamydia trachomatis
agauucguggagaaguagacuu

SEQ ID NO: 3351 - RNA, 22 nt, Chlamydia trachomatis
agccaagcgaaugaguucgaca

SEQ ID NO: 3352 - RNA, 22 nt, Chlamydia trachomatis
agccccaacugauccagagccu

SEQ ID NO: 3353 - RNA, 22 nt, Chlamydia trachomatis
agcuacaggaaccgggauugcu

SEQ ID NO: 3354 - RNA, 22 nt, Chlamydia trachomatis
agcucgucugcuaggccuaaag

SEQ ID NO: 3355 - RNA, 22 nt, Chlamydia trachomatis
aggaaacaguuucauuuuggga

SEQ ID NO: 3356 - RNA, 22 nt, Chlamydia trachomatis
aggaacgaggaauaagcgcucu

SEQ ID NO: 3357 - RNA, 22 nt, Chlamydia trachomatis
aggauagcaagaauucuuuggu

SEQ ID NO: 3358 - RNA, 22 nt, Chlamydia trachomatis
aggcucuucggaugggaaaacu

SEQ ID NO: 3359 - RNA, 22 nt, Chlamydia trachomatis
agggauagugauuucugcauaa

SEQ ID NO: 3360 - RNA, 22 nt, Chlamydia trachomatis
agggcuuucuguuuguuuagcu

SEQ ID NO: 3361 - RNA, 22 nt, Chlamydia trachomatis
agggcuuugugagaguuugcuu

SEQ ID NO: 3362 - RNA, 22 nt, Chlamydia trachomatis
aggggcuuugucaugacucgga

SEQ ID NO: 3363 - RNA, 22 nt, Chlamydia trachomatis
aguccaagguacuagguccuca

SEQ ID NO: 3364 - RNA, 22 nt, Chlamydia trachomatis
agucgggaggauugaaaagaga

SEQ ID NO: 3365 - RNA, 22 nt, Chlamydia trachomatis
agucuuguaucauagaggauag

SEQ ID NO: 3366 - RNA, 22 nt, Chlamydia trachomatis
agugcuuucuacuauugcuuua

SEQ ID NO: 3367 - RNA, 22 nt, Chlamydia trachomatis
aguguauuggggaugacauugc

SEQ ID NO: 3368 - RNA, 22 nt, Chlamydia trachomatis
auacauuuuaugcuagccuggc

SEQ ID NO: 3369 - RNA, 22 nt, Chlamydia trachomatis
auacucuuauagcuuaucgauu

SEQ ID NO: 3370 - RNA, 15 nt, Chlamydia trachomatis
auagcaacucguugg

SEQ ID NO: 3371 - RNA, 22 nt, Chlamydia trachomatis
auagggaaucauaagaauuucc

SEQ ID NO: 3372 - RNA, 22 nt, Chlamydia trachomatis
auagucuuagcguuuauauccu

SEQ ID NO: 3373 - RNA, 22 nt, Chlamydia trachomatis
aucaagaaggcugguuccuuuc

SEQ ID NO: 3374 - RNA, 22 nt, Chlamydia trachomatis
aucaauugcaugaagaauuugc

SEQ ID NO: 3375 - RNA, 22 nt, Chlamydia trachomatis
aucguaaagaugguucuacacu

SEQ ID NO: 3376 - RNA, 22 nt, Chlamydia trachomatis
augcgcuacuucaaaucgauug

SEQ ID NO: 3377 - RNA, 22 nt, Chlamydia trachomatis
auggaaauguguucuggaguuu

SEQ ID NO: 3378 - RNA, 22 nt, Chlamydia trachomatis
auggaaguauugcguuuaucug

SEQ ID NO: 3379 - RNA, 22 nt, Chlamydia trachomatis
auggcgaguuuucuuccguagc

SEQ ID NO: 3380 - RNA, 22 nt, Chlamydia trachomatis
auggggguccacgcucuuauca

SEQ ID NO: 3381 - RNA, 22 nt, Chlamydia trachomatis
auguuucuuauuugcccaguca

SEQ ID NO: 3382 - RNA, 22 nt, Chlamydia trachomatis
auucaccauucucuucauugug

SEQ ID NO: 3383 - RNA, 22 nt, Chlamydia trachomatis
auucgagagggaauuuuaaaug

SEQ ID NO: 3384 - RNA, 22 nt, Chlamydia trachomatis
auugugauuacuccaucuaagc

SEQ ID NO: 3385 - RNA, 22 nt, Chlamydia trachomatis
auuugcagcauggauuuaaggc

SEQ ID NO: 3386 - RNA, 22 nt, Chlamydia trachomatis
auuuucuauuggcguuugaggu

SEQ ID NO: 3387 - RNA, 22 nt, Chlamydia trachomatis
auuuugcggcuaaaaacuccag

SEQ ID NO: 3388 - RNA, 22 nt, Chlamydia trachomatis
caaagcaguuauuaugauaacg

SEQ ID NO: 3389 - RNA, 20 nt, Chlamydia trachomatis
caaagcugcagauguuuuug

SEQ ID NO: 3390 - RNA, 22 nt, Chlamydia trachomatis
caacuccuuugaguuugucugc

SEQ ID NO: 3391 - RNA, 22 nt, Chlamydia trachomatis
cagaaauauaagguagcuuggc

SEQ ID NO: 3392 - RNA, 22 nt, Chlamydia trachomatis
cagcaucuguagcucuuugucc

SEQ ID NO: 3393 - RNA, 22 nt, Chlamydia trachomatis
cagccucagccuauucuguuuc

SEQ ID NO: 3394 - RNA, 21 nt, Chlamydia trachomatis
ccagaacaaugugaaagcuuu

SEQ ID NO: 3395 - RNA, 17 nt, Chlamydia trachomatis
ccgacgagacucccuuc

SEQ ID NO: 3396 - RNA, 22 nt, Chlamydia trachomatis
ccgcaaucuccugaagagauug

SEQ ID NO: 3397 - RNA, 22 nt, Chlamydia trachomatis
cgaguuucugcaaaagacugug

SEQ ID NO: 3398 - RNA, 22 nt, Chlamydia trachomatis
cgauuaugagauucuuuuugug

SEQ ID NO: 3399 - RNA, 22 nt, Chlamydia trachomatis
cgauuucuucugaagauuaugg

SEQ ID NO: 3400 - RNA, 22 nt, Chlamydia trachomatis
cguggucucugugguaagagag

SEQ ID NO: 3401 - RNA, 22 nt, Chlamydia trachomatis
cuacaauacgacagaagaauuu

SEQ ID NO: 3402 - RNA, 22 nt, Chlamydia trachomatis
cuagaggcuguuuuagauaucu

SEQ ID NO: 3403 - RNA, 22 nt, Chlamydia trachomatis
cuauuuuccauuuugcagaucu

SEQ ID NO: 3404 - RNA, 22 nt, Chlamydia trachomatis
cucauugcaaaugaaucuauag

SEQ ID NO: 3405 - RNA, 22 nt, Chlamydia trachomatis
cucuguguaguaucaguauucc

SEQ ID NO: 3406 - RNA, 22 nt, Chlamydia trachomatis
cucuuuuuguucuuaaggacca

SEQ ID NO: 3407 - RNA, 22 nt, Chlamydia trachomatis
cugucuguaggagaauuaucac

SEQ ID NO: 3408 - RNA, 22 nt, Chlamydia trachomatis
cuguguauguuuaagggaagac

SEQ ID NO: 3409 - RNA, 22 nt, Chlamydia trachomatis
cuuccugugacuugguaaagua

SEQ ID NO: 3410 - RNA, 22 nt, Chlamydia trachomatis
cuuguuccuccacauuuuguau

SEQ ID NO: 3411 - RNA, 22 nt, Chlamydia trachomatis
gaagagagaaucacaaaucgau

SEQ ID NO: 3412 - RNA, 22 nt, Chlamydia trachomatis
gaagagauuguccuauuuccau

SEQ ID NO: 3413 - RNA, 21 nt, Chlamydia trachomatis
gaagagccuaaaauagcgcgc

SEQ ID NO: 3414 - RNA, 22 nt, Chlamydia trachomatis
gaaguuucugugaucgaagcaa

SEQ ID NO: 3415 - RNA, 22 nt, Chlamydia trachomatis
gaauguuagacucucuuccugu

SEQ ID NO: 3416 - RNA, 22 nt, Chlamydia trachomatis
gacuagaggagagacuucaaua

SEQ ID NO: 3417 - RNA, 22 nt, Chlamydia trachomatis
gacugcuauagacaucuugcca

SEQ ID NO: 3418 - RNA, 22 nt, Chlamydia trachomatis
ggguggcaauucucagguauuu

SEQ ID NO: 3419 - RNA, 22 nt, Chlamydia trachomatis
gguauugacuauauuuguaccg

SEQ ID NO: 3420 - RNA, 22 nt, Chlamydia trachomatis
gguugucuuccuuugcuuauac

SEQ ID NO: 3421 - RNA, 22 nt, Chlamydia trachomatis
gguuuuuagccucuggagagcu

SEQ ID NO: 3422 - RNA, 22 nt, Chlamydia trachomatis
guagggaauucuggaaguggcu

SEQ ID NO: 3423 - RNA, 22 nt, Chlamydia trachomatis
guaguuguaugaaaauccguga

SEQ ID NO: 3424 - RNA, 22 nt, Chlamydia trachomatis
gucaggcuguguuaucuacaac

SEQ ID NO: 3425 - RNA, 22 nt, Chlamydia trachomatis
gugauuguguuuucuuaugcau

SEQ ID NO: 3426 - RNA, 22 nt, Chlamydia trachomatis
gugcuaaaugcuucaaaagaac

SEQ ID NO: 3427 - RNA, 22 nt, Chlamydia trachomatis
gugggauuggaaagaguaaucc

SEQ ID NO: 3428 - RNA, 22 nt, Chlamydia trachomatis
guucuuuucuaugaaucgggua

SEQ ID NO: 3429 - RNA, 22 nt, Chlamydia trachomatis
uaaagcgaguaagaaggauuug

SEQ ID NO: 3430 - RNA, 22 nt, Chlamydia trachomatis
uaacaagaggcuuuuugggagu

SEQ ID NO: 3431 - RNA, 22 nt, Chlamydia trachomatis
uaagggaagcgacuccguccaa

SEQ ID NO: 3432 - RNA, 22 nt, Chlamydia trachomatis
uaaucaagagaggaagagguuu

SEQ ID NO: 3433 - RNA, 22 nt, Chlamydia trachomatis
uacauaaguuaggauuagaggu

SEQ ID NO: 3434 - RNA, 22 nt, Chlamydia trachomatis
uacuucuauggggauagaaacc

SEQ ID NO: 3435 - RNA, 22 nt, Chlamydia trachomatis
uagaagaagcuggaggccucgu

SEQ ID NO: 3436 - RNA, 22 nt, Chlamydia trachomatis
uagaagccacuguacgcuuccu

SEQ ID NO: 3437 - RNA, 22 nt, Chlamydia trachomatis
uagagaucugaaagagccucgu

SEQ ID NO: 3438 - RNA, 18 nt, Chlamydia trachomatis
uauaagagggcauaucau

SEQ ID NO: 3439 - RNA, 22 nt, Chlamydia trachomatis
uauacuuucucuauacagcauu

SEQ ID NO: 3440 - RNA, 19 nt, Chlamydia trachomatis
uaucccuaccccaggagug

SEQ ID NO: 3441 - RNA, 22 nt, Chlamydia trachomatis
uauggggaugguuucuuagaaa

SEQ ID NO: 3442 - RNA, 22 nt, Chlamydia trachomatis
uauguuugcagucgcucugccu

SEQ ID NO: 3443 - RNA, 22 nt, Chlamydia trachomatis
uauuucguuggugggagcguuc

SEQ ID NO: 3444 - RNA, 22 nt, Chlamydia trachomatis
ucaggaauauuuggcauaggua

SEQ ID NO: 3445 - RNA, 22 nt, Chlamydia trachomatis
ucaggaggccaaauucaacgug

SEQ ID NO: 3446 - RNA, 22 nt, Chlamydia trachomatis
ucauuaucaauagcuuuggccg

SEQ ID NO: 3447 - RNA, 22 nt, Chlamydia trachomatis
uccugaagguagagaacugcaa

SEQ ID NO: 3448 - RNA, 18 nt, Chlamydia trachomatis
uccuuucuuucugcaagu

SEQ ID NO: 3449 - RNA, 22 nt, Chlamydia trachomatis
ucgagacucaaaugacaauucc

SEQ ID NO: 3450 - RNA, 22 nt, Chlamydia trachomatis
ucguaugccucccuuuguuuuu

SEQ ID NO: 3451 - RNA, 22 nt, Chlamydia trachomatis
ucguuguucgcauauuggaaga

SEQ ID NO: 3452 - RNA, 22 nt, Chlamydia trachomatis
ucuaaugagcugaccaaguuuc

SEQ ID NO: 3453 - RNA, 22 nt, Chlamydia trachomatis
ucuaugcagguguagaaaaagg

SEQ ID NO: 3454 - RNA, 22 nt, Chlamydia trachomatis
ucuauuucuuggaauagagcaa

SEQ ID NO: 3455 - RNA, 22 nt, Chlamydia trachomatis
ucuucuguuagcuacgcucugu

SEQ ID NO: 3456 - RNA, 22 nt, Chlamydia trachomatis
ucuugugggacagggauguugg

SEQ ID NO: 3457 - RNA, 22 nt, Chlamydia trachomatis
ucuuuagauacacaguauucaa

SEQ ID NO: 3458 - RNA, 22 nt, Chlamydia trachomatis
ucuuuugaagcagaggaaucuu

SEQ ID NO: 3459 - RNA, 22 nt, Chlamydia trachomatis
ugaaacuuuugguacaaaggcu

SEQ ID NO: 3460 - RNA, 22 nt, Chlamydia trachomatis
ugaaagaaaugggaaccguucc

SEQ ID NO: 3461 - RNA, 22 nt, Chlamydia trachomatis
ugagaggaaaaguggugcauuc

SEQ ID NO: 3462 - RNA, 22 nt, Chlamydia trachomatis
ugagcuuucugaaguaucugga

SEQ ID NO: 3463 - RNA, 22 nt, Chlamydia trachomatis
ugauuugguaaacaagugugcu

SEQ ID NO: 3464 - RNA, 22 nt, Chlamydia trachomatis
ugcagaucaacucguugcauuu

SEQ ID NO: 3465 - RNA, 19 nt, Chlamydia trachomatis
ugcagggauagcaacucuu

SEQ ID NO: 3466 - RNA, 21 nt, Chlamydia trachomatis
uggaagaaauagauagcuucu

SEQ ID NO: 3467 - RNA, 23 nt, Chlamydia trachomatis
uggaaggucaugagauccguauu

SEQ ID NO: 3468 - RNA, 22 nt, Chlamydia trachomatis
ugguaguacuauugcagauauu

SEQ ID NO: 3469 - RNA, 22 nt, Chlamydia trachomatis
ugugucuaaagaucggcuuaca

SEQ ID NO: 3470 - RNA, 22 nt, Chlamydia trachomatis
uguucaguaccccagcaguaga

SEQ ID NO: 3471 - RNA, 22 nt, Chlamydia trachomatis
uguuccuuagagaagagcuugg

SEQ ID NO: 3472 - RNA, 22 nt, Chlamydia trachomatis
uguuguaagguucgcguuuccg

SEQ ID NO: 3473 - RNA, 22 nt, Chlamydia trachomatis
uguuuauaguucccguucaaaa

SEQ ID NO: 3474 - RNA, 22 nt, Chlamydia trachomatis
uguuuuucuagacaagcuuuau

SEQ ID NO: 3475 - RNA, 22 nt, Chlamydia trachomatis
uuaaagcuuuuuuccauagaac

SEQ ID NO: 3476 - RNA, 23 nt, Chlamydia trachomatis
uuacuucuuugauaagcucuuca

SEQ ID NO: 3477 - RNA, 22 nt, Chlamydia trachomatis
uuauccauagagagacuucucg

SEQ ID NO: 3478 - RNA, 22 nt, Chlamydia trachomatis
uucagaagggaccagcccuugu

SEQ ID NO: 3479 - RNA, 22 nt, Chlamydia trachomatis
uucagcgacuugaucggcagga

SEQ ID NO: 3480 - RNA, 22 nt, Chlamydia trachomatis
uuccuaaagcguaugacccuaa

SEQ ID NO: 3481 - RNA, 22 nt, Chlamydia trachomatis
uucgaauauagucaaagauacu

SEQ ID NO: 3482 - RNA, 22 nt, Chlamydia trachomatis
uucguugcuuaaaaaguauccu

SEQ ID NO: 3483 - RNA, 22 nt, Chlamydia trachomatis
uucuaagaacccucuaccagag

SEQ ID NO: 3484 - RNA, 22 nt, Chlamydia trachomatis
uucugcgccuuuuacagggugu

SEQ ID NO: 3485 - RNA, 22 nt, Chlamydia trachomatis
acuguucaagaaaucauugccg

SEQ ID NO: 3486 - RNA, 22 nt, Chlamydia trachomatis
acuuuucuaugacagaagaucu

SEQ ID NO: 3487 - RNA, 22 nt, Chlamydia trachomatis
agaaagucgauuccguaaauuu

SEQ ID NO: 3488 - RNA, 21 nt, Chlamydia trachomatis
agaaaguugggaagcuaauuc

SEQ ID NO: 3489 - RNA, 23 nt, Chlamydia trachomatis
agaaauacaacaaagcacgauuc

SEQ ID NO: 3490 - RNA, 22 nt, Chlamydia trachomatis
agaagauaaugauuagggggac

SEQ ID NO: 3491 - RNA, 22 nt, Chlamydia trachomatis
agagaagcauauucauaagcuc

SEQ ID NO: 3492 - RNA, 22 nt, Chlamydia trachomatis
agagugcauccgguugcauggu

SEQ ID NO: 3493 - RNA, 22 nt, Chlamydia trachomatis
agaguuugcgucaagauuucuu

SEQ ID NO: 3494 - RNA, 22 nt, Chlamydia trachomatis
ggaagagguggaaauuucuaag

SEQ ID NO: 3495 - RNA, 22 nt, Chlamydia trachomatis
ggaaucuuggagaugacguugu

SEQ ID NO: 3496 - RNA, 22 nt, Chlamydia trachomatis
ggacaaagagcuacagaugcug

SEQ ID NO: 3497 - RNA, 22 nt, Chlamydia trachomatis
ggauauugauaccgcuauacau

SEQ ID NO: 3498 - RNA, 22 nt, Chlamydia trachomatis
ggcaaugauuucuugaacaguc

SEQ ID NO: 3499 - RNA, 22 nt, Chlamydia trachomatis
ggcacccuguguacaguuagga

SEQ ID NO: 3500 - RNA, 22 nt, Chlamydia trachomatis
ggcuucuugagaucggaugggc

SEQ ID NO: 3501 - RNA, 22 nt, Chlamydia trachomatis
gggaauccucucccuuuuucua

SEQ ID NO: 3502 - RNA, 20 nt, Chlamydia trachomatis
gguaguugaaggucuagaau

SEQ ID NO: 3503 - RNA, 22 nt, Chlamydia trachomatis
gguuugggcguguuugaaaaga

SEQ ID NO: 3504 - RNA, 22 nt, Chlamydia trachomatis
guauauuuauauugcccuucuu

SEQ ID NO: 3505 - RNA, 22 nt, Chlamydia trachomatis
guauuuuucaaucgcuuguucu

SEQ ID NO: 3506 - RNA, 22 nt, Chlamydia trachomatis
gucgaggauuaggcggaggauc

SEQ ID NO: 3507 - RNA, 22 nt, Chlamydia trachomatis
gucuuuggaaucaaagcuuuag

SEQ ID NO: 3508 - RNA, 22 nt, Chlamydia trachomatis
gugaauuguauccgcaguccga

SEQ ID NO: 3509 - RNA, 22 nt, Chlamydia trachomatis
gugauuucuccuugcauauuuu

SEQ ID NO: 3510 - RNA, 22 nt, Chlamydia trachomatis
guuccuugugauuuugcuacug

SEQ ID NO: 3511 - RNA, 22 nt, Chlamydia trachomatis
guuuucauugugaugugauuau

SEQ ID NO: 3512 - RNA, 22 nt, Chlamydia trachomatis
guuuuugacggagcauaauagc

SEQ ID NO: 3513 - RNA, 22 nt, Chlamydia trachomatis
uaacucuuuuuuauaagaaggg

SEQ ID NO: 3514 - RNA, 22 nt, Chlamydia trachomatis
uaaugacuauacagcugcagcu

SEQ ID NO: 3515 - RNA, 22 nt, Chlamydia trachomatis
uaaugcagauuuuucagaagaa

SEQ ID NO: 3516 - RNA, 22 nt, Chlamydia trachomatis
uacaccauuacgaggaagcugu

SEQ ID NO: 3517 - RNA, 22 nt, Chlamydia trachomatis
uacagcuuuuugagucauuguu

SEQ ID NO: 3518 - RNA, 22 nt, Chlamydia trachomatis
uaccgccuaccucaacuuauag

SEQ ID NO: 3519 - RNA, 22 nt, Chlamydia trachomatis
uacuuacuuuaguauugaccuu

SEQ ID NO: 3520 - RNA, 22 nt, Chlamydia trachomatis
uagaaauuauggaagagcggua

SEQ ID NO: 3521 - RNA, 22 nt, Chlamydia trachomatis
uagcggaucgugauugguuaga

SEQ ID NO: 3522 - RNA, 22 nt, Chlamydia trachomatis
uagcuaugucaaauucuuuugg

SEQ ID NO: 3523 - RNA, 23 nt, Chlamydia trachomatis
uaucaauagggagcaaaccucua

SEQ ID NO: 3524 - RNA, 20 nt, Chlamydia trachomatis
uaucgcuauuaguaucagaa

SEQ ID NO: 3525 - RNA, 22 nt, Chlamydia trachomatis
uaucugcaaaagugaagguaga

SEQ ID NO: 3526 - RNA, 23 nt, Chlamydia trachomatis
uaugcggucuuucaguagccgag

SEQ ID NO: 3527 - RNA, 22 nt, Chlamydia trachomatis
uauucccaaaaauugacagcca

SEQ ID NO: 3528 - RNA, 22 nt, Chlamydia trachomatis
uauuucuauuucggauaacggu

SEQ ID NO: 3529 - RNA, 22 nt, Chlamydia trachomatis
ucacuggacuuguuuaucauau

SEQ ID NO: 3530 - RNA, 22 nt, Chlamydia trachomatis
uccaaucuuggaaaaaaggauc

SEQ ID NO: 3531 - RNA, 22 nt, Chlamydia trachomatis
uccagcaacggcuugggaaguu

SEQ ID NO: 3532 - RNA, 22 nt, Chlamydia trachomatis
uccauuccagauggagguaugu

SEQ ID NO: 3533 - RNA, 22 nt, Chlamydia trachomatis
ucgaaugauaugauagcgagaa

SEQ ID NO: 3534 - RNA, 22 nt, Chlamydia trachomatis
ucgauagaacgcauaauccaga

SEQ ID NO: 3535 - RNA, 22 nt, Chlamydia trachomatis
ucgauuacaacuagcuccccau

SEQ ID NO: 3536 - RNA, 22 nt, Chlamydia trachomatis
ucggcuucuauucuuucgagau

SEQ ID NO: 3537 - RNA, 22 nt, Chlamydia trachomatis
ucucccaauagauugauauuau

SEQ ID NO: 3538 - RNA, 23 nt, Chlamydia trachomatis
ucucuucaguugaugccgcuuuc

SEQ ID NO: 3539 - RNA, 22 nt, Chlamydia trachomatis
ucugcauacugugugaugucuc

SEQ ID NO: 3540 - RNA, 22 nt, Chlamydia trachomatis
ucugcuaucucucuuugaguga

SEQ ID NO: 3541 - RNA, 22 nt, Chlamydia trachomatis
ucuguucuacuuguucagccuu

SEQ ID NO: 3542 - RNA, 22 nt, Chlamydia trachomatis
ucuuagguuuagauuucuuagc

SEQ ID NO: 3543 - RNA, 22 nt, Chlamydia trachomatis
ucuugaggauguucuguuuuua

SEQ ID NO: 3544 - RNA, 22 nt, Chlamydia trachomatis
ucuugggaggcggagcggcucu

SEQ ID NO: 3545 - RNA, 22 nt, Chlamydia trachomatis
ugagucacuaaugcagaccuua

SEQ ID NO: 3546 - RNA, 22 nt, Chlamydia trachomatis
ugcugccauaaagauuucuuau

SEQ ID NO: 3547 - RNA, 22 nt, Chlamydia trachomatis
ugcuuugaauaauccagauauu

SEQ ID NO: 3548 - RNA, 22 nt, Chlamydia trachomatis
uggaaguaucgaggaucucugg

SEQ ID NO: 3549 - RNA, 22 nt, Chlamydia trachomatis
uggaugugcguggauaguuucg

SEQ ID NO: 3550 - RNA, 22 nt, Chlamydia trachomatis
uggcugauuaugagaaguauua

SEQ ID NO: 3551 - RNA, 22 nt, Chlamydia trachomatis
uguaucuucgguugucaaugaa

SEQ ID NO: 3552 - RNA, 22 nt, Chlamydia trachomatis
ugucugucaccauggugaugag

SEQ ID NO: 3553 - RNA, 22 nt, Chlamydia trachomatis
uguuaucauaggugccagagca

SEQ ID NO: 3554 - RNA, 22 nt, Chlamydia trachomatis
uguugcuaagauuagguggauu

SEQ ID NO: 3555 - RNA, 22 nt, Chlamydia trachomatis
uuacuaccuaugugaaugacua

SEQ ID NO: 3556 - RNA, 22 nt, Chlamydia trachomatis
uuaucgguaguaacguugucuu

SEQ ID NO: 3557 - RNA, 22 nt, Chlamydia trachomatis
uucagaaacauaaggcgcuuca

SEQ ID NO: 3558 - RNA, 22 nt, Chlamydia trachomatis
uucaugcuuugacggaguuuuu

SEQ ID NO: 3559 - RNA, 19 nt, Chlamydia trachomatis
uuccaauaaggguuucuca

SEQ ID NO: 3560 - RNA, 22 nt, Chlamydia trachomatis
uucugcauuuacuagagcugcu

SEQ ID NO: 3561 - RNA, 22 nt, Chlamydia trachomatis
uucuuagauaaggcauuugugu

SEQ ID NO: 3562 - RNA, 22 nt, Chlamydia trachomatis
uucuucauuaggagguucaugu

SEQ ID NO: 3563 - RNA, 22 nt, Chlamydia trachomatis
uucuuugaucacugcguccaca

SEQ ID NO: 3564 - RNA, 22 nt, Chlamydia trachomatis
uugaaaaagagucuagagagca

SEQ ID NO: 3565 - RNA, 22 nt, Chlamydia trachomatis
uugagauucucagagcggaaga

SEQ ID NO: 3566 - RNA, 22 nt, Chlamydia trachomatis
uugauuaucccgaagauauaac

SEQ ID NO: 3567 - RNA, 22 nt, Chlamydia trachomatis
uugcuauguugaugccuaagcu

SEQ ID NO: 3568 - RNA, 22 nt, Chlamydia trachomatis
uugcuccuuuguuacaaaaaac

SEQ ID NO: 3569 - RNA, 22 nt, Chlamydia trachomatis
uugcuugauuuuguaagagcuc

SEQ ID NO: 3570 - RNA, 22 nt, Chlamydia trachomatis
uuggauaugauccuuuguuugu

SEQ ID NO: 3571 - RNA, 22 nt, Chlamydia trachomatis
uuggauguagacuuugaaaagc

SEQ ID NO: 3572 - RNA, 22 nt, Chlamydia trachomatis
uuggguuaguagaaaugacucg

SEQ ID NO: 3573 - RNA, 22 nt, Chlamydia trachomatis
uugguuccuucuuuaggggagc

SEQ ID NO: 3574 - RNA, 22 nt, Chlamydia trachomatis
uuguaagguuugcauguaggcu

SEQ ID NO: 3575 - RNA, 22 nt, Chlamydia trachomatis
uuguagagaaagggauuuguag

SEQ ID NO: 3576 - RNA, 22 nt, Chlamydia trachomatis
uuguuguguuccuaggcaaaga

SEQ ID NO: 3577 - RNA, 22 nt, Chlamydia trachomatis
uuuaaagacagaucuaauccgc

SEQ ID NO: 3578 - RNA, 22 nt, Chlamydia trachomatis
uuuaguugaaggucaggcagau

SEQ ID NO: 3579 - RNA, 22 nt, Chlamydia trachomatis
uuuauaacaaaggaacuuauga

SEQ ID NO: 3580 - RNA, 22 nt, Chlamydia trachomatis
uuuauugagagaaugguggauu

SEQ ID NO: 3581 - RNA, 22 nt, Chlamydia trachomatis
uuucaugguaacuucuucucua

SEQ ID NO: 3582 - RNA, 22 nt, Chlamydia trachomatis
uuucggaucucuugcacagcug

SEQ ID NO: 3583 - RNA, 18 nt, Chlamydia trachomatis
aaguuuugggaagaagcu

SEQ ID NO: 3584 - RNA, 22 nt, Chlamydia trachomatis
aauaaacucgccacacuaguca

SEQ ID NO: 3585 - RNA, 22 nt, Chlamydia trachomatis
aauauaucuauuugcccucuau

SEQ ID NO: 3586 - RNA, 21 nt, Chlamydia trachomatis
aaugauuucccaguauuuggg

SEQ ID NO: 3587 - RNA, 22 nt, Chlamydia trachomatis
aauugcuuuuucuuagaaguga

SEQ ID NO: 3588 - RNA, 22 nt, Chlamydia trachomatis
acaagcuuagcucacuggaaau

SEQ ID NO: 3589 - RNA, 23 nt, Chlamydia trachomatis
accuucguuugcuagagagccuc

SEQ ID NO: 3590 - RNA, 22 nt, Chlamydia trachomatis
acuucuggguauuccuucgaga

SEQ ID NO: 3591 - RNA, 22 nt, Chlamydia trachomatis
agaaagagaaacauuagccgau

SEQ ID NO: 3592 - RNA, 21 nt, Chlamydia trachomatis
agaagcuuuaggagcuagcau

SEQ ID NO: 3593 - RNA, 22 nt, Chlamydia trachomatis
agaauuccuuaaagauggugua

SEQ ID NO: 3594 - RNA, 22 nt, Chlamydia trachomatis
agacucugauauuguggaaugg

SEQ ID NO: 3595 - RNA, 22 nt, Chlamydia trachomatis
agagaaugucaaaagauacuuu

SEQ ID NO: 3596 - RNA, 22 nt, Chlamydia trachomatis
agagagcggucucuauugguaa

SEQ ID NO: 3597 - RNA, 22 nt, Chlamydia trachomatis
agagcuuuuggauccuguuuau

SEQ ID NO: 3598 - RNA, 22 nt, Chlamydia trachomatis
agagguuuuucacacucuuucu

SEQ ID NO: 3599 - RNA, 22 nt, Chlamydia trachomatis
agaguuucugcauuacucgaga

SEQ ID NO: 3600 - RNA, 22 nt, Chlamydia trachomatis
agaucauuggcccuaaacaggg

SEQ ID NO: 3601 - RNA, 22 nt, Chlamydia trachomatis
agauccuaaaaaagucccuaug

SEQ ID NO: 3602 - RNA, 23 nt, Chlamydia trachomatis
agauccuaaacaauuucuuccua

SEQ ID NO: 3603 - RNA, 22 nt, Chlamydia trachomatis
gagaucuccuagcgaagcauaa

SEQ ID NO: 3604 - RNA, 22 nt, Chlamydia trachomatis
gagauguugugcaaaaaugugu

SEQ ID NO: 3605 - RNA, 22 nt, Chlamydia trachomatis
gagcuaucauuuccaaaaucuu

SEQ ID NO: 3606 - RNA, 22 nt, Chlamydia trachomatis
gagugguugaaaggaguuccuu

SEQ ID NO: 3607 - RNA, 22 nt, Chlamydia trachomatis
gaucucucuugaaaugaaggug

SEQ ID NO: 3608 - RNA, 22 nt, Chlamydia trachomatis
gauguggugcuuguuucuuauu

SEQ ID NO: 3609 - RNA, 23 nt, Chlamydia trachomatis
gaugugugugcagcagcuacugc

SEQ ID NO: 3610 - RNA, 21 nt, Chlamydia trachomatis
gcagcgaucacauugcuuucc

SEQ ID NO: 3611 - RNA, 22 nt, Chlamydia trachomatis
gcagcgauuguagcauguugag

SEQ ID NO: 3612 - RNA, 22 nt, Chlamydia trachomatis
gcaucuguagcauauccagucc

SEQ ID NO: 3613 - RNA, 22 nt, Chlamydia trachomatis
gccaauggucccuauguugaua

SEQ ID NO: 3614 - RNA, 22 nt, Chlamydia trachomatis
gccaugccugagguauucaugg

SEQ ID NO: 3615 - RNA, 19 nt, Chlamydia trachomatis
gccuuuucgugcaaucucu

SEQ ID NO: 3616 - RNA, 22 nt, Chlamydia trachomatis
gcucucucuacaaauggauuuu

SEQ ID NO: 3617 - RNA, 22 nt, Chlamydia trachomatis
gcuuuagagggucuuauucacg

SEQ ID NO: 3618 - RNA, 20 nt, Chlamydia trachomatis
ggagaguuuugaagcuuugc

SEQ ID NO: 3619 - RNA, 22 nt, Chlamydia trachomatis
ggagauuacgaaaaggugcuuu

SEQ ID NO: 3620 - RNA, 22 nt, Chlamydia trachomatis
ggcuucucguuaaggcuuuacg

SEQ ID NO: 3621 - RNA, 21 nt, Chlamydia trachomatis
gggaaaggugggcugagcuga

SEQ ID NO: 3622 - RNA, 22 nt, Chlamydia trachomatis
gggaaaguauuucgagcgaaag

SEQ ID NO: 3623 - RNA, 22 nt, Chlamydia trachomatis
gggacguuacacuaugacccca

SEQ ID NO: 3624 - RNA, 22 nt, Chlamydia trachomatis
gggauuauagaaguuuuuauaa

SEQ ID NO: 3625 - RNA, 22 nt, Chlamydia trachomatis
uugaucaauaagguagcuaaaa

SEQ ID NO: 3626 - RNA, 22 nt, Chlamydia trachomatis
uuggcaagaugucuauagcagu

SEQ ID NO: 3627 - RNA, 22 nt, Chlamydia trachomatis
uugggaggagacgacuucgaug

SEQ ID NO: 3628 - RNA, 22 nt, Chlamydia trachomatis
uuggggaaagguuaucuugaaa

SEQ ID NO: 3629 - RNA, 22 nt, Chlamydia trachomatis
uuggggaacucgguggacucgu

SEQ ID NO: 3630 - RNA, 22 nt, Chlamydia trachomatis
uuguccaaugucgaggcuuuaa

SEQ ID NO: 3631 - RNA, 22 nt, Chlamydia trachomatis
uugugguuuuuauauuaugcca

SEQ ID NO: 3632 - RNA, 22 nt, Chlamydia trachomatis
uuguuugcuugugaauaagaaa

SEQ ID NO: 3633 - RNA, 22 nt, Chlamydia trachomatis
uuguuugucuuuaucaugauac

SEQ ID NO: 3634 - RNA, 22 nt, Chlamydia trachomatis
uuucuauccauuaaugcaggag

SEQ ID NO: 3635 - RNA, 22 nt, Chlamydia trachomatis
uuucuauucucaacagacgaua

SEQ ID NO: 3636 - RNA, 22 nt, Chlamydia trachomatis
uuugcuagcuaaacgaguuacu

SEQ ID NO: 3637 - RNA, 22 nt, Chlamydia trachomatis
uuugcuaguugauacugaaaua

SEQ ID NO: 3638 - RNA, 22 nt, Chlamydia trachomatis
uuuggggauauauacuguaacu

SEQ ID NO: 3639 - RNA, 22 nt, Chlamydia trachomatis
uuuggucuuggagucuucacag

SEQ ID NO: 3640 - RNA, 22 nt, Chlamydia trachomatis
uuuuaccuuaagucguugacuc

SEQ ID NO: 3641 - RNA, 22 nt, Chlamydia trachomatis
uuuugauugauagcgacauuca

SEQ ID NO: 3642 - RNA, 22 nt, Chlamydia trachomatis
uuuugauuuccuucaaauggga

SEQ ID NO: 3643 - RNA, 20 nt, Chlamydia trachomatis
uuuuuuguaacaaaggagca

SEQ ID NO: 3644 - RNA, 22 nt, Chlamydia trachomatis
aaaacgcagagucggcaucgga

SEQ ID NO: 3645 - RNA, 23 nt, Chlamydia trachomatis
aaaauacggucacaaugaaagug

SEQ ID NO: 3646 - RNA, 22 nt, Chlamydia trachomatis
aaaaugcugacgccuugauuca

SEQ ID NO: 3647 - RNA, 21 nt, Chlamydia trachomatis
aaacucuuuaucgaccucuac

SEQ ID NO: 3648 - RNA, 22 nt, Chlamydia trachomatis
aaacuuuucggaauucuuuggu

SEQ ID NO: 3649 - RNA, 22 nt, Chlamydia trachomatis
aaaguuuuguguuuccaaagcu

SEQ ID NO: 3650 - RNA, 22 nt, Chlamydia trachomatis
aaaucguuucuucgaaaacugu

SEQ ID NO: 3651 - RNA, 20 nt, Chlamydia trachomatis
aaaugguuuagcugaagcug

SEQ ID NO: 3652 - RNA, 22 nt, Chlamydia trachomatis
aacaaaguuuucugggaagaga

SEQ ID NO: 3653 - RNA, 22 nt, Chlamydia trachomatis
aacaacaagauguuagcauaga

SEQ ID NO: 3654 - RNA, 17 nt, Chlamydia trachomatis
aacauuugcucaauagg

SEQ ID NO: 3655 - RNA, 20 nt, Chlamydia trachomatis
aaccucuguuuucuuuagcu

SEQ ID NO: 3656 - RNA, 22 nt, Chlamydia trachomatis
aacgguuuuaugaaguauugga

SEQ ID NO: 3657 - RNA, 22 nt, Chlamydia trachomatis
aagagaaagcucuucuuuuagu

SEQ ID NO: 3658 - RNA, 22 nt, Chlamydia trachomatis
aagaugcucucaaaaguuacga

SEQ ID NO: 3659 - RNA, 22 nt, Chlamydia trachomatis
aaggagaucuuaacagauaaga

SEQ ID NO: 3660 - RNA, 22 nt, Chlamydia trachomatis
aaggauuucugaaggacagagg

SEQ ID NO: 3661 - RNA, 19 nt, Chlamydia trachomatis
aaguuguuugacauuuucu

SEQ ID NO: 3662 - RNA, 22 nt, Chlamydia trachomatis
aauagcggcuuauuauggcugu

SEQ ID NO: 3663 - RNA, 22 nt, Chlamydia trachomatis
aaucccuugggauagucugcga

SEQ ID NO: 3664 - RNA, 22 nt, Chlamydia trachomatis
aaucuuaucuaugaauggcgag

SEQ ID NO: 3665 - RNA, 22 nt, Chlamydia trachomatis
acaaaagggguguuugacaauc

SEQ ID NO: 3666 - RNA, 22 nt, Chlamydia trachomatis
acaaacuggucauucuuuuggg

SEQ ID NO: 3667 - RNA, 22 nt, Chlamydia trachomatis
acaacgaauaaucuugcaaucc

SEQ ID NO: 3668 - RNA, 22 nt, Chlamydia trachomatis
accaugcccuaaauugaaaaua

SEQ ID NO: 3669 - RNA, 22 nt, Chlamydia trachomatis
acgaaaagcaaguaucugcuua

SEQ ID NO: 3670 - RNA, 22 nt, Chlamydia trachomatis
acgcuagacguaaggcuuuaga

SEQ ID NO: 3671 - RNA, 22 nt, Chlamydia trachomatis
acgguaucguaaagcuuauguu

SEQ ID NO: 3672 - RNA, 22 nt, Chlamydia trachomatis
acuacggaguuucuaucccuga

SEQ ID NO: 3673 - RNA, 19 nt, Chlamydia trachomatis
agauguuuuugugccagca

SEQ ID NO: 3674 - RNA, 22 nt, Chlamydia trachomatis
agccguugcuaaaacuguuuug

SEQ ID NO: 3675 - RNA, 22 nt, Chlamydia trachomatis
agcucuuuaaugucuuugauuu

SEQ ID NO: 3676 - RNA, 17 nt, Chlamydia trachomatis
agcugggcgaucugaag

SEQ ID NO: 3677 - RNA, 22 nt, Chlamydia trachomatis
agcuuuucagagcuuuguaaau

SEQ ID NO: 3678 - RNA, 22 nt, Chlamydia trachomatis
aggaguuauuuagcucucucaa

SEQ ID NO: 3679 - RNA, 21 nt, Chlamydia trachomatis
aggaguugucauggcucaaag

SEQ ID NO: 3680 - RNA, 23 nt, Chlamydia trachomatis
aggauaggaaaugagagcuagca

SEQ ID NO: 3681 - RNA, 22 nt, Chlamydia trachomatis
aggauauucagacguaccuaug

SEQ ID NO: 3682 - RNA, 22 nt, Chlamydia trachomatis
aggaugcucgcagccugcauua

SEQ ID NO: 3683 - RNA, 22 nt, Chlamydia trachomatis
aggauuuuguauuggaacaaua

SEQ ID NO: 3684 - RNA, 22 nt, Chlamydia trachomatis
aggcuugguaugcgauuguucu

SEQ ID NO: 3685 - RNA, 22 nt, Chlamydia trachomatis
agggagccuauguuuuuagcgu

SEQ ID NO: 3686 - RNA, 19 nt, Chlamydia trachomatis
aggggaagagaguuagcug

SEQ ID NO: 3687 - RNA, 22 nt, Chlamydia trachomatis
aguuuguucguauaggcucuua

SEQ ID NO: 3688 - RNA, 22 nt, Chlamydia trachomatis
auaauuguagacauuucgagcu

SEQ ID NO: 3689 - RNA, 22 nt, Chlamydia trachomatis
auacggauaucuugcuggcugg

SEQ ID NO: 3690 - RNA, 22 nt, Chlamydia trachomatis
auagaagaauucgaugugguug

SEQ ID NO: 3691 - RNA, 22 nt, Chlamydia trachomatis
auccacaacccagagaauuccu

SEQ ID NO: 3692 - RNA, 22 nt, Chlamydia trachomatis
auccacaggaugcaacuccuca

SEQ ID NO: 3693 - RNA, 22 nt, Chlamydia trachomatis
auccggauauuguuguuguugu

SEQ ID NO: 3694 - RNA, 22 nt, Chlamydia trachomatis
auccuuuuugaacuuucggagc

SEQ ID NO: 3695 - RNA, 22 nt, Chlamydia trachomatis
aucggcuaauguuucucuuucu

SEQ ID NO: 3696 - RNA, 22 nt, Chlamydia trachomatis
aucgggcuaguaaagugugugu

SEQ ID NO: 3697 - RNA, 22 nt, Chlamydia trachomatis
aucgguuaucuggacugcugug

SEQ ID NO: 3698 - RNA, 22 nt, Chlamydia trachomatis
aucuucauacuuucaucgaaaa

SEQ ID NO: 3699 - RNA, 22 nt, Chlamydia trachomatis
augauucucguaauccuugugg

SEQ ID NO: 3700 - RNA, 22 nt, Chlamydia trachomatis
auggaaagaaguauuaucuuua

SEQ ID NO: 3701 - RNA, 22 nt, Chlamydia trachomatis
auggagguguuagccuaucauu

SEQ ID NO: 3702 - RNA, 22 nt, Chlamydia trachomatis
auguagagguaugggcugaagu

SEQ ID NO: 3703 - RNA, 20 nt, Chlamydia trachomatis
augucuuugaugcaagcucu

SEQ ID NO: 3704 - RNA, 22 nt, Chlamydia trachomatis
auuaggagaagcuguugguauu

SEQ ID NO: 3705 - RNA, 22 nt, Chlamydia trachomatis
auucgacagagcugucaagagu

SEQ ID NO: 3706 - RNA, 23 nt, Chlamydia trachomatis
auucugaauuggcuacuuguuac

SEQ ID NO: 3707 - RNA, 22 nt, Chlamydia trachomatis
auugauuuuggcuucaacugua

SEQ ID NO: 3708 - RNA, 22 nt, Chlamydia trachomatis
auuuccacaauucuucuacaaa

SEQ ID NO: 3709 - RNA, 22 nt, Chlamydia trachomatis
auuugggagcuuuggagagcau

SEQ ID NO: 3710 - RNA, 23 nt, Chlamydia trachomatis
auuuuucauccagugguucuauc

SEQ ID NO: 3711 - RNA, 22 nt, Chlamydia trachomatis
caccaugcgaucaucuuuugaa

SEQ ID NO: 3712 - RNA, 22 nt, Chlamydia trachomatis
cagcuaaaucaucagcuccuug

SEQ ID NO: 3713 - RNA, 22 nt, Chlamydia trachomatis
caggagaauuaacgguucucgu

SEQ ID NO: 3714 - RNA, 22 nt, Chlamydia trachomatis
cauagaaugauuucugcuugga

SEQ ID NO: 3715 - RNA, 22 nt, Chlamydia trachomatis
cauauuugaaacaagaguccaa

SEQ ID NO: 3716 - RNA, 22 nt, Chlamydia trachomatis
cauggaaaggaauucguuucac

SEQ ID NO: 3717 - RNA, 22 nt, Chlamydia trachomatis
cccaagcaacuuggaauucauu

SEQ ID NO: 3718 - RNA, 22 nt, Chlamydia trachomatis
ccgaguuccccaagaggcauac

SEQ ID NO: 3719 - RNA, 22 nt, Chlamydia trachomatis
ccuaagaacgggggaccucgua

SEQ ID NO: 3720 - RNA, 22 nt, Chlamydia trachomatis
cgcguccugaauuccuuuuguu

SEQ ID NO: 3721 - RNA, 22 nt, Chlamydia trachomatis
cgucuuuugaaugaucugcuua

SEQ ID NO: 3722 - RNA, 22 nt, Chlamydia trachomatis
cuacuuugugcgauaaagucuu

SEQ ID NO: 3723 - RNA, 22 nt, Chlamydia trachomatis
cuauccuuguaguuggcggugu

SEQ ID NO: 3724 - RNA, 22 nt, Chlamydia trachomatis
cuaugccuuacggaacucguua

SEQ ID NO: 3725 - RNA, 22 nt, Chlamydia trachomatis
cucaacaugcuacaaucgcugc

SEQ ID NO: 3726 - RNA, 21 nt, Chlamydia trachomatis
cucguugcguucaagaucaag

SEQ ID NO: 3727 - RNA, 22 nt, Chlamydia trachomatis
cugaucggacaaggugauaugu

SEQ ID NO: 3728 - RNA, 22 nt, Chlamydia trachomatis
cugauucuuugucuuuaauacg

SEQ ID NO: 3729 - RNA, 22 nt, Chlamydia trachomatis
cugcaguuuuauccagaauuug

SEQ ID NO: 3730 - RNA, 22 nt, Chlamydia trachomatis
cugcuauugagguaagcuauuu

SEQ ID NO: 3731 - RNA, 22 nt, Chlamydia trachomatis
cugcuguugagaauguauucag

SEQ ID NO: 3732 - RNA, 22 nt, Chlamydia trachomatis
cuguagcugcagcggcaaaguu

SEQ ID NO: 3733 - RNA, 21 nt, Chlamydia trachomatis
cuucugaaaagguucugccac

SEQ ID NO: 3734 - RNA, 22 nt, Chlamydia trachomatis
gaaacguugaauauaggggaga

SEQ ID NO: 3735 - RNA, 22 nt, Chlamydia trachomatis
gaacuguauagcuuuuccuguc

SEQ ID NO: 3736 - RNA, 22 nt, Chlamydia trachomatis
gauauucuaaaguuuuguggua

SEQ ID NO: 3737 - RNA, 22 nt, Chlamydia trachomatis
gaucuguauauuggaggugcag

SEQ ID NO: 3738 - RNA, 22 nt, Chlamydia trachomatis
gaucuuguucaaagcuccguuu

SEQ ID NO: 3739 - RNA, 22 nt, Chlamydia trachomatis
gaugauuacguaggcaagguuu

SEQ ID NO: 3740 - RNA, 22 nt, Chlamydia trachomatis
gauucucugguauuaacugguu

SEQ ID NO: 3741 - RNA, 22 nt, Chlamydia trachomatis
gauucuuuugcaaugaggaaga

SEQ ID NO: 3742 - RNA, 22 nt, Chlamydia trachomatis
gcacagaccguaauggccuuug

SEQ ID NO: 3743 - RNA, 23 nt, Chlamydia trachomatis
gcagcauuuccauugaaagauuu

SEQ ID NO: 3744 - RNA, 22 nt, Chlamydia trachomatis
gcgaauuccccugauguaagga

SEQ ID NO: 3745 - RNA, 22 nt, Chlamydia trachomatis
gcguaucagugaauugauucug

SEQ ID NO: 3746 - RNA, 22 nt, Chlamydia trachomatis
gcuaaaaaccagcagguagacu

SEQ ID NO: 3747 - RNA, 18 nt, Chlamydia trachomatis
gcuuaugcggcuuauugg

SEQ ID NO: 3748 - RNA, 22 nt, Chlamydia trachomatis
gcuucccuuaaauauucauaug

SEQ ID NO: 3749 - RNA, 22 nt, Chlamydia trachomatis
ggaaagcgagaaaguugcuagc

SEQ ID NO: 3750 - RNA, 22 nt, Chlamydia trachomatis
ggaaaugaauucuuauucggua

SEQ ID NO: 3751 - RNA, 22 nt, Chlamydia trachomatis
ggaacuggugaaggacuguuug

SEQ ID NO: 3752 - RNA, 22 nt, Chlamydia trachomatis
uuucguucaagacaugaugcgu

SEQ ID NO: 3753 - RNA, 22 nt, Chlamydia trachomatis
uuucuagagauauuggcgcacc

SEQ ID NO: 3754 - RNA, 22 nt, Chlamydia trachomatis
uuugccuaguggggaaucuugg

SEQ ID NO: 3755 - RNA, 22 nt, Chlamydia trachomatis
uuuguuugaaggacguacgcuu

SEQ ID NO: 3756 - RNA, 22 nt, Chlamydia trachomatis
uuuuaucgauaaaagaaacuuc

SEQ ID NO: 3757 - RNA, 22 nt, Chlamydia trachomatis
uuuuggguuguguacgaagcuu

SEQ ID NO: 3758 - RNA, 22 nt, Chlamydia trachomatis
uuuuuauguaagaugaaccuug

SEQ ID NO: 3759 - RNA, 22 nt, Chlamydia trachomatis
uuuuugaaguucucucaaccaa

SEQ ID NO: 3760 - RNA, 22 nt, Chlamydia trachomatis
uuuuuuacucaugguuuagucc

SEQ ID NO: 3761 - RNA, 22 nt, Chlamydophila pneumoniae AR39
aagaagaagaauccguggauga

SEQ ID NO: 3762 - RNA, 22 nt, Chlamydophila pneumoniae AR39
aaggauggccaggauuuucagg

SEQ ID NO: 3763 - RNA, 22 nt, Chlamydophila pneumoniae AR39
aaucucugaacuuuugcuguug

SEQ ID NO: 3764 - RNA, 22 nt, Chlamydophila pneumoniae AR39
acgauaaaguguguguaggauu

SEQ ID NO: 3765 - RNA, 22 nt, Chlamydophila pneumoniae AR39
agaguucugcugcugcuagacc

SEQ ID NO: 3766 - RNA, 22 nt, Chlamydophila pneumoniae AR39
agcaaaggaacuuauauucgca

SEQ ID NO: 3767 - RNA, 22 nt, Chlamydophila pneumoniae AR39
accagcuguagagggauugggg

SEQ ID NO: 3768 - RNA, 22 nt, Chlamydophila pneumoniae AR39
acuccucuaucguauuggggau

SEQ ID NO: 3769 - RNA, 22 nt, Chlamydophila pneumoniae AR39
agagaaggugaaaaucggggaa

SEQ ID NO: 3770 - RNA, 22 nt, Chlamydophila pneumoniae AR39
agcaggauuuuacuguauuucu

SEQ ID NO: 3771 - RNA, 22 nt, Chlamydophila pneumoniae AR39
agcccgagguacuacaaggcga

SEQ ID NO: 3772 - RNA, 21 nt, Chlamydophila pneumoniae AR39
auaguaaguucaugcuuguua

SEQ ID NO: 3773 - RNA, 22 nt, Chlamydophila pneumoniae AR39
aucugccuuguaaauaaguaug

SEQ ID NO: 3774 - RNA, 22 nt, Chlamydophila pneumoniae AR39
auuggggauuguuacgauagac

SEQ ID NO: 3775 - RNA, 22 nt, Chlamydophila pneumoniae AR39
cacaaccaaaacgugcgcaggg

SEQ ID NO: 3776 - RNA, 22 nt, Chlamydophila pneumoniae AR39
cauuuuuaaauacgauggucgu

SEQ ID NO: 3777 - RNA, 20 nt, Chlamydophila pneumoniae AR39
ccuuaucuaggaagagcuug

SEQ ID NO: 3778 - RNA, 22 nt, Chlamydophila pneumoniae AR39
cugugcucuugaagauuguguc

SEQ ID NO: 3779 - RNA, 22 nt, Chlamydophila pneumoniae AR39
gagaggggaagaaaaauagcca

SEQ ID NO: 3780 - RNA, 22 nt, Chlamydophila pneumoniae AR39
gcagguggugcauggacuccuc

SEQ ID NO: 3781 - RNA, 22 nt, Chlamydophila pneumoniae AR39
uaggauaguauagugaggagau

SEQ ID NO: 3782 - RNA, 22 nt, Chlamydophila pneumoniae AR39
ucccuuuggauccagaagcuaa

SEQ ID NO: 3783 - RNA, 22 nt, Chlamydophila pneumoniae AR39
ucugaaguccuagcauugaaag

SEQ ID NO: 3784 - RNA, 22 nt, Chlamydophila pneumoniae AR39
ucuggagacaucuuuugaagcu

SEQ ID NO: 3785 - RNA, 22 nt, Chlamydophila pneumoniae AR39
uggaggagcagguucaucuuuu

SEQ ID NO: 3786 - RNA, 22 nt, Chlamydophila pneumoniae AR39
uucuacaauuccuauagcucaa

SEQ ID NO: 3787 - RNA, 22 nt, Chlamydophila pneumoniae AR39
uugaccagaugcaugagaauag

SEQ ID NO: 3788 - RNA, 22 nt, Chlamydophila pneumoniae AR39
uuggagaguuuuuuaccaucug

SEQ ID NO: 3789 - RNA, 22 nt, Chlamydophila pneumoniae AR39
agcuuuuggauauccuuccuua

SEQ ID NO: 3790 - RNA, 22 nt, Chlamydophila pneumoniae AR39
aggcaaggcgcaugccaguaaa

SEQ ID NO: 3791 - RNA, 22 nt, Chlamydophila pneumoniae AR39
aggguucaauacuauggauuua

SEQ ID NO: 3792 - RNA, 21 nt, Chlamydophila pneumoniae AR39
caaaggcaaaggaaucucuau

SEQ ID NO: 3793 - RNA, 22 nt, Chlamydophila pneumoniae AR39
gaagcucaggaucugucaguuc

SEQ ID NO: 3794 - RNA, 19 nt, Chlamydophila pneumoniae AR39
guucuaguaggacucgaga

SEQ ID NO: 3795 - RNA, 22 nt, Chlamydophila pneumoniae AR39
uagaaguauuaagccaagauuu

SEQ ID NO: 3796 - RNA, 19 nt, Chlamydophila pneumoniae AR39
uagagccuucuggacguuc

SEQ ID NO: 3797 - RNA, 23 nt, Chlamydophila pneumoniae AR39
ucagucucuagaggagcucuuug

SEQ ID NO: 3798 - RNA, 22 nt, Chlamydophila pneumoniae AR39
ugaagcauuugcucuuugggaa

SEQ ID NO: 3799 - RNA, 22 nt, Chlamydophila pneumoniae AR39
uguagagauaugaauguuuccc

SEQ ID NO: 3800 - RNA, 19 nt, Chlamydophila pneumoniae AR39
uucuuucaggagcuccuca

SEQ ID NO: 3801 - RNA, 22 nt, Chlamydophila pneumoniae AR39
uugagacaaagaauccccccuu

SEQ ID NO: 3802 - RNA, 22 nt, Chlamydophila pneumoniae CWL029
aaaauauaugcagaguuauggu

SEQ ID NO: 3803 - RNA, 22 nt, Chlamydophila pneumoniae CWL029
aaacuaaggagugucaaugaag

SEQ ID NO: 3804 - RNA, 22 nt, Chlamydophila pneumoniae CWL029
aaauagucucuagguucuauag

SEQ ID NO: 3805 - RNA, 22 nt, Chlamydophila pneumoniae CWL029
aaaucaagaauacaucgcagau

SEQ ID NO: 3806 - RNA, 22 nt, Chlamydophila pneumoniae CWL029
aaaucgaacuccaagcaucguu

SEQ ID NO: 3807 - RNA, 22 nt, Chlamydophila pneumoniae CWL029
aacauacaguucugcaauggcu

SEQ ID NO: 3808 - RNA, 22 nt, Chlamydophila pneumoniae CWL029
aaccaggaugcgucucugucca

SEQ ID NO: 3809 - RNA, 22 nt, Chlamydophila pneumoniae CWL029
aacucgggcagacguacugcau

SEQ ID NO: 3810 - RNA, 22 nt, Chlamydophila pneumoniae CWL029
aagaguuuuuuaugacucaugc

SEQ ID NO: 3811 - RNA, 22 nt, Chlamydophila pneumoniae CWL029
aagaucaugucuccucugugcg

SEQ ID NO: 3812 - RNA, 22 nt, Chlamydophila pneumoniae CWL029
aagcucuuccagaaacaagauc

SEQ ID NO: 3813 - RNA, 22 nt, Chlamydophila pneumoniae CWL029
aagcuuuucgcagauacuucuu

SEQ ID NO: 3814 - RNA, 22 nt, Chlamydophila pneumoniae CWL029
aaggaguuaugacaauuagagu

SEQ ID NO: 3815 - RNA, 22 nt, Chlamydophila pneumoniae CWL029
aaggauggccaggauuuucagg

SEQ ID NO: 3816 - RNA, 22 nt, Chlamydophila pneumoniae CWL029
aaggcuaucgauuugauagaug

SEQ ID NO: 3817 - RNA, 22 nt, Chlamydophila pneumoniae CWL029
aaggugaacaagaucuucuggu

SEQ ID NO: 3818 - RNA, 22 nt, Chlamydophila pneumoniae CWL029
aagguguuucuuuaggaaaaau

SEQ ID NO: 3819 - RNA, 22 nt, Chlamydophila pneumoniae CWL029
aaguuguauauaugcgcuaauu

SEQ ID NO: 3820 - RNA, 22 nt, Chlamydophila pneumoniae CWL029
aaucucugaacuuuugcuguug

SEQ ID NO: 3821 - RNA, 22 nt, Chlamydophila pneumoniae CWL029
aaucugugauugaugaguuuuu

SEQ ID NO: 3822 - RNA, 22 nt, Chlamydophila pneumoniae CWL029
aaugguuucuagaaccacggag

SEQ ID NO: 3823 - RNA, 22 nt, Chlamydophila pneumoniae CWL029
aauguguauggaauugugaggu

SEQ ID NO: 3824 - RNA, 22 nt, Chlamydophila pneumoniae CWL029
aauuuucuguucuuuaccgcug

SEQ ID NO: 3825 - RNA, 18 nt, Chlamydophila pneumoniae CWL029
acaggaaucggaaugggc

SEQ ID NO: 3826 - RNA, 22 nt, Chlamydophila pneumoniae CWL029
accagcuucccaagcugaaaga

SEQ ID NO: 3827 - RNA, 22 nt, Chlamydophila pneumoniae CWL029
acgauaaaguguguguaggauu

SEQ ID NO: 3828 - RNA, 22 nt, Chlamydophila pneumoniae CWL029
acuauacaccaagaacaauaag

SEQ ID NO: 3829 - RNA, 22 nt, Chlamydophila pneumoniae CWL029
acucauuguucuauuggcugcg

SEQ ID NO: 3830 - RNA, 22 nt, Chlamydophila pneumoniae CWL029
acuuuauugcugaaggguugga

SEQ ID NO: 3831 - RNA, 22 nt, Chlamydophila pneumoniae CWL029
acuuucuuuuaaagaacaucac

SEQ ID NO: 3832 - RNA, 22 nt, Chlamydophila pneumoniae CWL029
acuuugcucuucuuguuggaag

SEQ ID NO: 3833 - RNA, 21 nt, Chlamydophila pneumoniae CWL029
agaacgcacguucuauacaag

SEQ ID NO: 3834 - RNA, 22 nt, Chlamydophila pneumoniae CWL029
agaagguuugaugacaacaguu

SEQ ID NO: 3835 - RNA, 22 nt, Chlamydophila pneumoniae CWL029
agaaucuugauggguagcggca

SEQ ID NO: 3836 - RNA, 22 nt, Chlamydophila pneumoniae CWL029
agagaaaugagggagucuucug

SEQ ID NO: 3837 - RNA, 22 nt, Chlamydophila pneumoniae CWL029
agagaguuuuaccgggugaggg

SEQ ID NO: 3838 - RNA, 22 nt, Chlamydophila pneumoniae CWL029
agagcgcacgccuauugguuau

SEQ ID NO: 3839 - RNA, 22 nt, Chlamydophila pneumoniae CWL029
agcaaaggaacuuauauucgca

SEQ ID NO: 3840 - RNA, 22 nt, Chlamydophila pneumoniae CWL029
agcacuauuggagaaucuggag

SEQ ID NO: 3841 - RNA, 22 nt, Chlamydophila pneumoniae CWL029
agcagcuucgggaccaagcagu

SEQ ID NO: 3842 - RNA, 22 nt, Chlamydophila pneumoniae CWL029
agcaggauuuuacuguauuucu

SEQ ID NO: 3843 - RNA, 22 nt, Chlamydophila pneumoniae CWL029
agccauuccaagcuauaguaug

SEQ ID NO: 3844 - RNA, 22 nt, Chlamydophila pneumoniae CWL029
agcccgagguacuacaaggcga

SEQ ID NO: 3845 - RNA, 22 nt, Chlamydophila pneumoniae CWL029
agcuaucaauaaagcuaaagaa

SEQ ID NO: 3846 - RNA, 22 nt, Chlamydophila pneumoniae CWL029
agcucaauuggauagaguaccu

SEQ ID NO: 3847 - RNA, 22 nt, Chlamydophila pneumoniae CWL029
auccugaagauauucaggcaau

SEQ ID NO: 3848 - RNA, 18 nt, Chlamydophila pneumoniae CWL029
aucuaagugacucacaga

SEQ ID NO: 3849 - RNA, 22 nt, Chlamydophila pneumoniae CWL029
aucuaugcagcagauuucuuca

SEQ ID NO: 3850 - RNA, 23 nt, Chlamydophila pneumoniae CWL029
aucugccuuguaaauaaguaugg

SEQ ID NO: 3851 - RNA, 22 nt, Chlamydophila pneumoniae CWL029
aucuuuucuuaggcgggaauag

SEQ ID NO: 3852 - RNA, 22 nt, Chlamydophila pneumoniae CWL029
augccuauguguaacucuauag

SEQ ID NO: 3853 - RNA, 22 nt, Chlamydophila pneumoniae CWL029
augcuugcuuaggaucguuguu

SEQ ID NO: 3854 - RNA, 22 nt, Chlamydophila pneumoniae CWL029
augggaaucuugaagaguuguu

SEQ ID NO: 3855 - RNA, 20 nt, Chlamydophila pneumoniae CWL029
auguaauacagaagaacauu

SEQ ID NO: 3856 - RNA, 22 nt, Chlamydophila pneumoniae CWL029
auguuccaagagaagaaagagu

SEQ ID NO: 3857 - RNA, 22 nt, Chlamydophila pneumoniae CWL029
auuaaaagaacgcucguaucca

SEQ ID NO: 3858 - RNA, 22 nt, Chlamydophila pneumoniae CWL029
auuaaauaaacuuggaguaucu

SEQ ID NO: 3859 - RNA, 21 nt, Chlamydophila pneumoniae CWL029
auugaucucaucacuaguuuc

SEQ ID NO: 3860 - RNA, 22 nt, Chlamydophila pneumoniae CWL029
auuuggaucagcuguuguaugg

SEQ ID NO: 3861 - RNA, 22 nt, Chlamydophila pneumoniae CWL029
caaacuaaagagcuugaguuug

SEQ ID NO: 3862 - RNA, 22 nt, Chlamydophila pneumoniae CWL029
cacaaccaaaacgugcgcaggg

SEQ ID NO: 3863 - RNA, 22 nt, Chlamydophila pneumoniae CWL029
cacauuaucuaggucguugugu

SEQ ID NO: 3864 - RNA, 22 nt, Chlamydophila pneumoniae CWL029
cagcuuugggauguagauuucu

SEQ ID NO: 3865 - RNA, 22 nt, Chlamydophila pneumoniae CWL029
caugucuuuuuuacagaaagau

SEQ ID NO: 3866 - RNA, 22 nt, Chlamydophila pneumoniae CWL029
cauuuaucucggaguucuugcg

SEQ ID NO: 3867 - RNA, 22 nt, Chlamydophila pneumoniae CWL029
cauuuuuaaauacgauggucgu

SEQ ID NO: 3868 - RNA, 22 nt, Chlamydophila pneumoniae CWL029
ccauaccaaagaagugguuccu

SEQ ID NO: 3869 - RNA, 22 nt, Chlamydophila pneumoniae CWL029
cccugcauuguuaaacucaauu

SEQ ID NO: 3870 - RNA, 22 nt, Chlamydophila pneumoniae CWL029
ccuagaauuuaauccuaaugau

SEQ ID NO: 3871 - RNA, 22 nt, Chlamydophila pneumoniae CWL029
ccuagcauuuauuauuacuuca

SEQ ID NO: 3872 - RNA, 22 nt, Chlamydophila pneumoniae CWL029
ccuggauuuucaagucuuuuga

SEQ ID NO: 3873 - RNA, 22 nt, Chlamydophila pneumoniae CWL029
cgcugcucaugcuuuuccaaua

SEQ ID NO: 3874 - RNA, 22 nt, Chlamydophila pneumoniae CWL029
cggagagauauucugaucuaca

SEQ ID NO: 3875 - RNA, 18 nt, Chlamydophila pneumoniae CWL029
cguugucuuaaugaucau

SEQ ID NO: 3876 - RNA, 23 nt, Chlamydophila pneumoniae CWL029
cuaaagacuccacaaugauuaca

SEQ ID NO: 3877 - RNA, 23 nt, Chlamydophila pneumoniae CWL029
cuacauagauuuagauaaagacc

SEQ ID NO: 3878 - RNA, 22 nt, Chlamydophila pneumoniae CWL029
cuaguuuugacguaggaagagg

SEQ ID NO: 3879 - RNA, 22 nt, Chlamydophila pneumoniae CWL029
cuauguaguugccuggauugau

SEQ ID NO: 3880 - RNA, 22 nt, Chlamydophila pneumoniae CWL029
cucagcuuguugcaguagcaac

SEQ ID NO: 3881 - RNA, 22 nt, Chlamydophila pneumoniae CWL029
cucuauaauagggugcguauag

SEQ ID NO: 3882 - RNA, 22 nt, Chlamydophila pneumoniae CWL029
cucuauacaaauccaacagugc

SEQ ID NO: 3883 - RNA, 22 nt, Chlamydophila pneumoniae CWL029
cucuggguucugcuggggauug

SEQ ID NO: 3884 - RNA, 22 nt, Chlamydophila pneumoniae CWL029
cugcaagagucuaagcaagguu

SEQ ID NO: 3885 - RNA, 22 nt, Chlamydophila pneumoniae CWL029
cugcucuaucucagaaaucaau

SEQ ID NO: 3886 - RNA, 22 nt, Chlamydophila pneumoniae CWL029
cuggagacgcuuggaaagaagc

SEQ ID NO: 3887 - RNA, 22 nt, Chlamydophila pneumoniae CWL029
cuggaggugcugcuaaagcaau

SEQ ID NO: 3888 - RNA, 22 nt, Chlamydophila pneumoniae CWL029
cuguaucuucgacaacaugguu

SEQ ID NO: 3889 - RNA, 22 nt, Chlamydophila pneumoniae CWL029
cugugcucuugaagauuguguc

SEQ ID NO: 3890 - RNA, 22 nt, Chlamydophila pneumoniae CWL029
cuguuuuuucauaguauccuua

SEQ ID NO: 3891 - RNA, 22 nt, Chlamydophila pneumoniae CWL029
cuucacaaggucuaugaguauc

SEQ ID NO: 3892 - RNA, 22 nt, Chlamydophila pneumoniae CWL029
cuugauagaacugugauucuug

SEQ ID NO: 3893 - RNA, 22 nt, Chlamydophila pneumoniae CWL029
cuuuuugcuauuaaggaguauu

SEQ ID NO: 3894 - RNA, 22 nt, Chlamydophila pneumoniae CWL029
gaaacgacgagcagccugaggg

SEQ ID NO: 3895 - RNA, 22 nt, Chlamydophila pneumoniae CWL029
gaaauauuguugggacuuuggu

SEQ ID NO: 3896 - RNA, 22 nt, Chlamydophila pneumoniae CWL029
gaacaauagcuuugacaacagg

SEQ ID NO: 3897 - RNA, 22 nt, Chlamydophila pneumoniae CWL029
gaagauucuuuuaguggauugg

SEQ ID NO: 3898 - RNA, 22 nt, Chlamydophila pneumoniae CWL029
gaagcucaggaucugucaguuc

SEQ ID NO: 3899 - RNA, 22 nt, Chlamydophila pneumoniae CWL029
gacuuuuauuuagaucguguug

SEQ ID NO: 3900 - RNA, 22 nt, Chlamydophila pneumoniae CWL029
gagaagaguuaaaauaaugacg

SEQ ID NO: 3901 - RNA, 22 nt, Chlamydophila pneumoniae CWL029
gagaggggaagaaaaauagcca

SEQ ID NO: 3902 - RNA, 22 nt, Chlamydophila pneumoniae CWL029
gagaguauagggguguuucgga

SEQ ID NO: 3903 - RNA, 22 nt, Chlamydophila pneumoniae CWL029
gagcaauugcugauuccgggac

SEQ ID NO: 3904 - RNA, 22 nt, Chlamydophila pneumoniae CWL029
ugcaugcuaaccuuccagagga

SEQ ID NO: 3905 - RNA, 22 nt, Chlamydophila pneumoniae CWL029
ugccugcuucucaagauacucg

SEQ ID NO: 3906 - RNA, 22 nt, Chlamydophila pneumoniae CWL029
ugccuuuaagagaggaacauga

SEQ ID NO: 3907 - RNA, 22 nt, Chlamydophila pneumoniae CWL029
ugcuuacaguaugacgaggucu

SEQ ID NO: 3908 - RNA, 22 nt, Chlamydophila pneumoniae CWL029
ugcuuuuagguaggacgucacu

SEQ ID NO: 3909 - RNA, 22 nt, Chlamydophila pneumoniae CWL029
uggacgauacguuuuuaaugua

SEQ ID NO: 3910 - RNA, 22 nt, Chlamydophila pneumoniae CWL029
uggaggagcagguucaucuuuu

SEQ ID NO: 3911 - RNA, 22 nt, Chlamydophila pneumoniae CWL029
uggaugaagaagcuggaaaucc

SEQ ID NO: 3912 - RNA, 22 nt, Chlamydophila pneumoniae CWL029
uggaugaugauaucauuucuca

SEQ ID NO: 3913 - RNA, 20 nt, Chlamydophila pneumoniae CWL029
uggcgugcuuccuaugagua

SEQ ID NO: 3914 - RNA, 22 nt, Chlamydophila pneumoniae CWL029
uggcuauucucuuugguauagg

SEQ ID NO: 3915 - RNA, 22 nt, Chlamydophila pneumoniae CWL029
ugggauuucagauccguauaaa

SEQ ID NO: 3916 - RNA, 22 nt, Chlamydophila pneumoniae CWL029
uggguuauuaucuuaugaagaa

SEQ ID NO: 3917 - RNA, 22 nt, Chlamydophila pneumoniae CWL029
ugguuagaccuauuucuuguuu

SEQ ID NO: 3918 - RNA, 22 nt, Chlamydophila pneumoniae CWL029
uguagauguuuuaucgcuaucu

SEQ ID NO: 3919 - RNA, 20 nt, Chlamydophila pneumoniae CWL029
ugucucugaaaaagagagcc

SEQ ID NO: 3920 - RNA, 22 nt, Chlamydophila pneumoniae CWL029
ugugauuaucuguggagaccag

SEQ ID NO: 3921 - RNA, 21 nt, Chlamydophila pneumoniae CWL029
ugugggugcguugcuaaaguu

SEQ ID NO: 3922 - RNA, 22 nt, Chlamydophila pneumoniae CWL029
uguguagcaaaggcgugucgua

SEQ ID NO: 3923 - RNA, 22 nt, Chlamydophila pneumoniae CWL029
uguuucuggaagagcuucuuau

SEQ ID NO: 3924 - RNA, 22 nt, Chlamydophila pneumoniae CWL029
uuaaaaaugcucaagauuugcg

SEQ ID NO: 3925 - RNA, 22 nt, Chlamydophila pneumoniae CWL029
uuacgagaaaaguuagaauuua

SEQ ID NO: 3926 - RNA, 22 nt, Chlamydophila pneumoniae CWL029
uuagaguugacuguaguuacag

SEQ ID NO: 3927 - RNA, 22 nt, Chlamydophila pneumoniae CWL029
aaaaucagcaacuaacauagcu

SEQ ID NO: 3928 - RNA, 22 nt, Chlamydophila pneumoniae CWL029
aaacuucaggaacuuucugagu

SEQ ID NO: 3929 - RNA, 22 nt, Chlamydophila pneumoniae CWL029
aaagagaaucgcuacagauccc

SEQ ID NO: 3930 - RNA, 22 nt, Chlamydophila pneumoniae CWL029
aaagucuucaauuucugcgaua

SEQ ID NO: 3931 - RNA, 22 nt, Chlamydophila pneumoniae CWL029
aaauuaucggucaaaagcuaag

SEQ ID NO: 3932 - RNA, 22 nt, Chlamydophila pneumoniae CWL029
aaauuuggaggagaaucuauag

SEQ ID NO: 3933 - RNA, 22 nt, Chlamydophila pneumoniae CWL029
aacaauaccuugaguuacaaac

SEQ ID NO: 3934 - RNA, 22 nt, Chlamydophila pneumoniae CWL029
aacaauacuuggaguucgauga

SEQ ID NO: 3935 - RNA, 22 nt, Chlamydophila pneumoniae CWL029
aacaggaaggaaaaaaucuaca

SEQ ID NO: 3936 - RNA, 22 nt, Chlamydophila pneumoniae CWL029
aacauuuuccacugagaaguug

SEQ ID NO: 3937 - RNA, 22 nt, Chlamydophila pneumoniae CWL029
aacgucacgucucuccagaaca

SEQ ID NO: 3938 - RNA, 22 nt, Chlamydophila pneumoniae CWL029
aagaagaagaauccguggauga

SEQ ID NO: 3939 - RNA, 22 nt, Chlamydophila pneumoniae CWL029
aagauuugccgaugaaccagua

SEQ ID NO: 3940 - RNA, 22 nt, Chlamydophila pneumoniae CWL029
aagcuguuuucuaugaaaguaa

SEQ ID NO: 3941 - RNA, 22 nt, Chlamydophila pneumoniae CWL029
aagcuucgugaucagaaaauga

SEQ ID NO: 3942 - RNA, 22 nt, Chlamydophila pneumoniae CWL029
aaggaggcgaagucaaaaguga

SEQ ID NO: 3943 - RNA, 19 nt, Chlamydophila pneumoniae CWL029
aaggagguccuugccaauu

SEQ ID NO: 3944 - RNA, 22 nt, Chlamydophila pneumoniae CWL029
aaggcagguaucuccuugauaa

SEQ ID NO: 3945 - RNA, 22 nt, Chlamydophila pneumoniae CWL029
aagucucuggauaguaauaccc

SEQ ID NO: 3946 - RNA, 22 nt, Chlamydophila pneumoniae CWL029
aauaaugugagagcauaguucu

SEQ ID NO: 3947 - RNA, 22 nt, Chlamydophila pneumoniae CWL029
aaugacgcguaggucugccuua

SEQ ID NO: 3948 - RNA, 22 nt, Chlamydophila pneumoniae CWL029
aaugucucucagguuuauuccu

SEQ ID NO: 3949 - RNA, 21 nt, Chlamydophila pneumoniae CWL029
aauuccucacuuccuuuaccu

SEQ ID NO: 3950 - RNA, 22 nt, Chlamydophila pneumoniae CWL029
aauucguggagccguuuuuuua

SEQ ID NO: 3951 - RNA, 22 nt, Chlamydophila pneumoniae CWL029
aauuggauaggguuucuugagg

SEQ ID NO: 3952 - RNA, 20 nt, Chlamydophila pneumoniae CWL029
aauuucugaucacgaaguuu

SEQ ID NO: 3953 - RNA, 23 nt, Chlamydophila pneumoniae CWL029
acaagaaucacaguucuaucaag

SEQ ID NO: 3954 - RNA, 21 nt, Chlamydophila pneumoniae CWL029
acaguucauucgauuucucuc

SEQ ID NO: 3955 - RNA, 22 nt, Chlamydophila pneumoniae CWL029
acauggaugccgaacugcuccg

SEQ ID NO: 3956 - RNA, 22 nt, Chlamydophila pneumoniae CWL029
accagcuguagagggauugggg

SEQ ID NO: 3957 - RNA, 22 nt, Chlamydophila pneumoniae CWL029
acuccucuaucguauuggggau

SEQ ID NO: 3958 - RNA, 22 nt, Chlamydophila pneumoniae CWL029
agaaaauuguaugacagcuugu

SEQ ID NO: 3959 - RNA, 22 nt, Chlamydophila pneumoniae CWL029
agaaaucugcugcauagauauc

SEQ ID NO: 3960 - RNA, 22 nt, Chlamydophila pneumoniae CWL029
agagaaggugaaaaucggggaa

SEQ ID NO: 3961 - RNA, 22 nt, Chlamydophila pneumoniae CWL029
agagggcgaagaauuccuuccu

SEQ ID NO: 3962 - RNA, 22 nt, Chlamydophila pneumoniae CWL029
agaguuacaggcuguaguagcu

SEQ ID NO: 3963 - RNA, 22 nt, Chlamydophila pneumoniae CWL029
agauauucuuaaaguuucggau

SEQ ID NO: 3964 - RNA, 22 nt, Chlamydophila pneumoniae CWL029
agauucucuaugauauacuaug

SEQ ID NO: 3965 - RNA, 22 nt, Chlamydophila pneumoniae CWL029
agauuuuuagggacuauaauuu

SEQ ID NO: 3966 - RNA, 22 nt, Chlamydophila pneumoniae CWL029
agcaaggcuuuguaaaacguuc

SEQ ID NO: 3967 - RNA, 22 nt, Chlamydophila pneumoniae CWL029
agcaugauuucuauuucuucga

SEQ ID NO: 3968 - RNA, 20 nt, Chlamydophila pneumoniae CWL029
agccaucuggagauacuagg

SEQ ID NO: 3969 - RNA, 22 nt, Chlamydophila pneumoniae CWL029
agcuggaaguuagauucccugu

SEQ ID NO: 3970 - RNA, 22 nt, Chlamydophila pneumoniae CWL029
agcuucucgaauuucuaauguu

SEQ ID NO: 3971 - RNA, 22 nt, Chlamydophila pneumoniae CWL029
aggaaaagucgcgaagcguuau

SEQ ID NO: 3972 - RNA, 22 nt, Chlamydophila pneumoniae CWL029
aggacggaucuuuuuacuuagc

SEQ ID NO: 3973 - RNA, 19 nt, Chlamydophila pneumoniae CWL029
aggagaaccaagaacauuu

SEQ ID NO: 3974 - RNA, 22 nt, Chlamydophila pneumoniae CWL029
aggagauccuacaauugccauu

SEQ ID NO: 3975 - RNA, 22 nt, Chlamydophila pneumoniae CWL029
guuaaagucuacguugccucua

SEQ ID NO: 3976 - RNA, 22 nt, Chlamydophila pneumoniae CWL029
guucuuuauuauacuccugaca

SEQ ID NO: 3977 - RNA, 22 nt, Chlamydophila pneumoniae CWL029
guuguaaaauuauucaguaggg

SEQ ID NO: 3978 - RNA, 22 nt, Chlamydophila pneumoniae CWL029
guuugcucuuaagauguauugc

SEQ ID NO: 3979 - RNA, 22 nt, Chlamydophila pneumoniae CWL029
uaaacuuagagcaaguagcaua

SEQ ID NO: 3980 - RNA, 21 nt, Chlamydophila pneumoniae CWL029
uaacucucgucgacuuuuccu

SEQ ID NO: 3981 - RNA, 22 nt, Chlamydophila pneumoniae CWL029
uaacugcacugagcgugcagau

SEQ ID NO: 3982 - RNA, 22 nt, Chlamydophila pneumoniae CWL029
uaaugacaacuuaguuucuuuu

SEQ ID NO: 3983 - RNA, 22 nt, Chlamydophila pneumoniae CWL029
uaaugagggggaguguuuugga

SEQ ID NO: 3984 - RNA, 19 nt, Chlamydophila pneumoniae CWL029
uaauuuagacgacguagau

SEQ ID NO: 3985 - RNA, 22 nt, Chlamydophila pneumoniae CWL029
uaauuugugggaaugagggaag

SEQ ID NO: 3986 - RNA, 22 nt, Chlamydophila pneumoniae CWL029
uacauuuuggacauauugcagg

SEQ ID NO: 3987 - RNA, 21 nt, Chlamydophila pneumoniae CWL029
uacuacagguucuuguagaag

SEQ ID NO: 3988 - RNA, 19 nt, Chlamydophila pneumoniae CWL029
uagaaaaagaucuaagucg

SEQ ID NO: 3989 - RNA, 22 nt, Chlamydophila pneumoniae CWL029
uagaauccucucgaaguauguc

SEQ ID NO: 3990 - RNA, 22 nt, Chlamydophila pneumoniae CWL029
uagagcucuuaagcaggagauc

SEQ ID NO: 3991 - RNA, 22 nt, Chlamydophila pneumoniae CWL029
uagaggcucuuccagcaaaaca

SEQ ID NO: 3992 - RNA, 22 nt, Chlamydophila pneumoniae CWL029
uagcucuacccaaaaucuuaga

SEQ ID NO: 3993 - RNA, 22 nt, Chlamydophila pneumoniae CWL029
uaggagcuauuugugucauugc

SEQ ID NO: 3994 - RNA, 22 nt, Chlamydophila pneumoniae CWL029
uaggauaguauagugaggagau

SEQ ID NO: 3995 - RNA, 22 nt, Chlamydophila pneumoniae CWL029
uaggaucuuagaauguuguagg

SEQ ID NO: 3996 - RNA, 22 nt, Chlamydophila pneumoniae CWL029
uagggaaaucgcugcaaaggcu

SEQ ID NO: 3997 - RNA, 22 nt, Chlamydophila pneumoniae CWL029
uaggguagaugucaaaagacaa

SEQ ID NO: 3998 - RNA, 22 nt, Chlamydophila pneumoniae CWL029
uaguugaaacagauggaagagu

SEQ ID NO: 3999 - RNA, 22 nt, Chlamydophila pneumoniae CWL029
uaucgguguggauaaguuucuc

SEQ ID NO: 4000 - RNA, 22 nt, Chlamydophila pneumoniae CWL029
uauggaagugauucaagaugaa

SEQ ID NO: 4001 - RNA, 22 nt, Chlamydophila pneumoniae CWL029
uauuccaaaggacugauggucu

SEQ ID NO: 4002 - RNA, 22 nt, Chlamydophila pneumoniae CWL029
uauucgacuguugcugcucuaa

SEQ ID NO: 4003 - RNA, 22 nt, Chlamydophila pneumoniae CWL029
uauuucagcuuaugucaaaggu

SEQ ID NO: 4004 - RNA, 22 nt, Chlamydophila pneumoniae CWL029
uauuugugcugaaggucacggu

SEQ ID NO: 4005 - RNA, 22 nt, Chlamydophila pneumoniae CWL029
uauuuucuuuguagcuaccaau

SEQ ID NO: 4006 - RNA, 22 nt, Chlamydophila pneumoniae CWL029
uauuuuuuauugaagugguagc

SEQ ID NO: 4007 - RNA, 22 nt, Chlamydophila pneumoniae CWL029
ucagcuuuuaaagcaucugcua

SEQ ID NO: 4008 - RNA, 22 nt, Chlamydophila pneumoniae CWL029
ucaggagaacaucaaagcgaau

SEQ ID NO: 4009 - RNA, 22 nt, Chlamydophila pneumoniae CWL029
ucccuuuggauccagaagcuaa

SEQ ID NO: 4010 - RNA, 19 nt, Chlamydophila pneumoniae CWL029
uccuauuaccaaagcggcu

SEQ ID NO: 4011 - RNA, 22 nt, Chlamydophila pneumoniae CWL029
uccuauuuucaugagaaagggg

SEQ ID NO: 4012 - RNA, 23 nt, Chlamydophila pneumoniae CWL029
uccucagucuucccuagggaacu

SEQ ID NO: 4013 - RNA, 22 nt, Chlamydophila pneumoniae CWL029
uccugaugaaaacggaggaguu

SEQ ID NO: 4014 - RNA, 19 nt, Chlamydophila pneumoniae CWL029
uccuuauuuguucuuucug

SEQ ID NO: 4015 - RNA, 22 nt, Chlamydophila pneumoniae CWL029
ucgucuacaggguucuucgcuu

SEQ ID NO: 4016 - RNA, 22 nt, Chlamydophila pneumoniae CWL029
ucuaaagauucccugugucuuu

SEQ ID NO: 4017 - RNA, 22 nt, Chlamydophila pneumoniae CWL029
ucuaaagcugcauagcuuuccu

SEQ ID NO: 4018 - RNA, 22 nt, Chlamydophila pneumoniae CWL029
ucuagauguaaaaaaagaucgu

SEQ ID NO: 4019 - RNA, 22 nt, Chlamydophila pneumoniae CWL029
ucuaugauuuuaguggguagag

SEQ ID NO: 4020 - RNA, 22 nt, Chlamydophila pneumoniae CWL029
ucuauuccucaugaaguucuug

SEQ ID NO: 4021 - RNA, 22 nt, Chlamydophila pneumoniae CWL029
ucuccucccagcaauuucucgu

SEQ ID NO: 4022 - RNA, 22 nt, Chlamydophila pneumoniae CWL029
ucucugaugguugauguacaga

SEQ ID NO: 4023 - RNA, 22 nt, Chlamydophila pneumoniae CWL029
ucuggaauucuuuaugcuguaa

SEQ ID NO: 4024 - RNA, 22 nt, Chlamydophila pneumoniae CWL029
ucuguauugucccagacaacca

SEQ ID NO: 4025 - RNA, 22 nt, Chlamydophila pneumoniae CWL029
ucuguugcagaaauuauaggau

SEQ ID NO: 4026 - RNA, 22 nt, Chlamydophila pneumoniae CWL029
ucuuaggaaguuuacucuugau

SEQ ID NO: 4027 - RNA, 17 nt, Chlamydophila pneumoniae CWL029
ucuugagcaucuuuuaa

SEQ ID NO: 4028 - RNA, 22 nt, Chlamydophila pneumoniae CWL029
ucuugagcauuuuuaaaaguca

SEQ ID NO: 4029 - RNA, 18 nt, Chlamydophila pneumoniae CWL029
ucuuggucugugaccauu

SEQ ID NO: 4030 - RNA, 22 nt, Chlamydophila pneumoniae CWL029
ucuuuaauuuucugaaagauua

SEQ ID NO: 4031 - RNA, 22 nt, Chlamydophila pneumoniae CWL029
ugaagcauuugcucuuugggaa

SEQ ID NO: 4032 - RNA, 22 nt, Chlamydophila pneumoniae CWL029
ugagaaaagaggucuuuacaga

SEQ ID NO: 4033 - RNA, 22 nt, Chlamydophila pneumoniae CWL029
ugagugagguucugauugaauc

SEQ ID NO: 4034 - RNA, 22 nt, Chlamydophila pneumoniae CWL029
ugagugucaggagcuuuugaaa

SEQ ID NO: 4035 - RNA, 22 nt, Chlamydophila pneumoniae CWL029
ugagugucgacagacaauagca

SEQ ID NO: 4036 - RNA, 22 nt, Chlamydophila pneumoniae CWL029
ugauuuugcuucgcagcuugaa

SEQ ID NO: 4037 - RNA, 22 nt, Chlamydophila pneumoniae CWL029
ugcaugauucucccuacguggc

SEQ ID NO: 4038 - RNA, 22 nt, Chlamydophila pneumoniae CWL029
ugccgcuacccaucaagauucu

SEQ ID NO: 4039 - RNA, 20 nt, Chlamydophila pneumoniae CWL029
ugcuaugcaaaauaagcgag

SEQ ID NO: 4040 - RNA, 22 nt, Chlamydophila pneumoniae CWL029
ugcucaguuugauucucuuucu

SEQ ID NO: 4041 - RNA, 22 nt, Chlamydophila pneumoniae CWL029
uggcauuacgaaaugcaggacg

SEQ ID NO: 4042 - RNA, 16 nt, Chlamydophila pneumoniae CWL029
ugggauugaaguuagg

SEQ ID NO: 4043 - RNA, 22 nt, Chlamydophila pneumoniae CWL029
uggucuugauuuuuauagaaaa

SEQ ID NO: 4044 - RNA, 22 nt, Chlamydophila pneumoniae CWL029
uguagagauaugaauguuuccc

SEQ ID NO: 4045 - RNA, 22 nt, Chlamydophila pneumoniae CWL029
ugucccauguggucuaguauag

SEQ ID NO: 4046 - RNA, 22 nt, Chlamydophila pneumoniae CWL029
uuagcgaaguuauucagaauug

SEQ ID NO: 4047 - RNA, 23 nt, Chlamydophila pneumoniae CWL029
uuaguuggagaaguugaaguugg

SEQ ID NO: 4048 - RNA, 22 nt, Chlamydophila pneumoniae CWL029
uuauuguucuuggugaaucugu

SEQ ID NO: 4049 - RNA, 22 nt, Chlamydophila pneumoniae CWL029
uuauuguucuugguguauagua

SEQ ID NO: 4050 - RNA, 22 nt, Chlamydophila pneumoniae CWL029
uucauuuaaagaguccgaagcc

SEQ ID NO: 4051 - RNA, 22 nt, Chlamydophila pneumoniae CWL029
uuccauucagaacggaagccua

SEQ ID NO: 4052 - RNA, 22 nt, Chlamydophila pneumoniae CWL029
uuccuacagaucguauuuuccg

SEQ ID NO: 4053 - RNA, 22 nt, Chlamydophila pneumoniae CWL029
uuccuucaguauaacagacucu

SEQ ID NO: 4054 - RNA, 22 nt, Chlamydophila pneumoniae CWL029
uuccuuuucguguuuuacagga

SEQ ID NO: 4055 - RNA, 22 nt, Chlamydophila pneumoniae CWL029
agcugcucccguaauuacugcg

SEQ ID NO: 4056 - RNA, 22 nt, Chlamydophila pneumoniae CWL029
agcuuuuggauauccuuccuua

SEQ ID NO: 4057 - RNA, 22 nt, Chlamydophila pneumoniae CWL029
aggaaggaauggaagcucugcu

SEQ ID NO: 4058 - RNA, 22 nt, Chlamydophila pneumoniae CWL029
aggagauuuucucacuuacagc

SEQ ID NO: 4059 - RNA, 22 nt, Chlamydophila pneumoniae CWL029
aggaguguagccuaaagaguau

SEQ ID NO: 4060 - RNA, 22 nt, Chlamydophila pneumoniae CWL029
aggguuugaaucuuuagaagau

SEQ ID NO: 4061 - RNA, 22 nt, Chlamydophila pneumoniae CWL029
agguaagggauaugugacuucu

SEQ ID NO: 4062 - RNA, 22 nt, Chlamydophila pneumoniae CWL029
aggugguuggagguucgagccc

SEQ ID NO: 4063 - RNA, 22 nt, Chlamydophila pneumoniae CWL029
agguguagagggaugacauuca

SEQ ID NO: 4064 - RNA, 22 nt, Chlamydophila pneumoniae CWL029
agugaugccuuugauuacgaaa

SEQ ID NO: 4065 - RNA, 22 nt, Chlamydophila pneumoniae CWL029
agugcuucgauguagcgagaaa

SEQ ID NO: 4066 - RNA, 21 nt, Chlamydophila pneumoniae CWL029
aguuguauguguuuugggaaa

SEQ ID NO: 4067 - RNA, 22 nt, Chlamydophila pneumoniae CWL029
aguuuuaccuuuaagugugauu

SEQ ID NO: 4068 - RNA, 22 nt, Chlamydophila pneumoniae CWL029
aguuuuuagaugcucgugcuca

SEQ ID NO: 4069 - RNA, 22 nt, Chlamydophila pneumoniae CWL029
auaacgcaaaugaggucgacuu

SEQ ID NO: 4070 - RNA, 22 nt, Chlamydophila pneumoniae CWL029
auacgauaucagauccuuuaga

SEQ ID NO: 4071 - RNA, 22 nt, Chlamydophila pneumoniae CWL029
auagccaauaaggagaucguca

SEQ ID NO: 4072 - RNA, 22 nt, Chlamydophila pneumoniae CWL029
auaguccaagaugaaaucauug

SEQ ID NO: 4073 - RNA, 22 nt, Chlamydophila pneumoniae CWL029
auauaguucuucagcaaagaua

SEQ ID NO: 4074 - RNA, 22 nt, Chlamydophila pneumoniae CWL029
aucaaacuauagaggaugcugc

SEQ ID NO: 4075 - RNA, 22 nt, Chlamydophila pneumoniae CWL029
aucaucuuauauaauggagugg

SEQ ID NO: 4076 - RNA, 22 nt, Chlamydophila pneumoniae CWL029
aucccacucauaggaauucccu

SEQ ID NO: 4077 - RNA, 22 nt, Chlamydophila pneumoniae CWL029
gaggaauuuuugcguaauguuc

SEQ ID NO: 4078 - RNA, 22 nt, Chlamydophila pneumoniae CWL029
gaggaugucguccugucggucu

SEQ ID NO: 4079 - RNA, 22 nt, Chlamydophila pneumoniae CWL029
gagucuucacuucccgcaguuu

SEQ ID NO: 4080 - RNA, 22 nt, Chlamydophila pneumoniae CWL029
gagugcccuuaagaagcuuucu

SEQ ID NO: 4081 - RNA, 22 nt, Chlamydophila pneumoniae CWL029
gaucgcucgaaucaugaaagcc

SEQ ID NO: 4082 - RNA, 22 nt, Chlamydophila pneumoniae CWL029
gauguaugcgagcaaugaccuc

SEQ ID NO: 4083 - RNA, 22 nt, Chlamydophila pneumoniae CWL029
gauucuguggaguaugcaucca

SEQ ID NO: 4084 - RNA, 22 nt, Chlamydophila pneumoniae CWL029
gauuuggaucaccaaagaaaau

SEQ ID NO: 4085 - RNA, 22 nt, Chlamydophila pneumoniae CWL029
gcagggcuugauagagcgucuc

SEQ ID NO: 4086 - RNA, 22 nt, Chlamydophila pneumoniae CWL029
gcauuccauuuccaagcuuaua

SEQ ID NO: 4087 - RNA, 22 nt, Chlamydophila pneumoniae CWL029
gccaaggcucuugcggauguua

SEQ ID NO: 4088 - RNA, 22 nt, Chlamydophila pneumoniae CWL029
gccuuucucaacuagauuacga

SEQ ID NO: 4089 - RNA, 22 nt, Chlamydophila pneumoniae CWL029
gccuuuuuugaugcucuugucc

SEQ ID NO: 4090 - RNA, 22 nt, Chlamydophila pneumoniae CWL029
gcgauucuaagauuccuacgau

SEQ ID NO: 4091 - RNA, 22 nt, Chlamydophila pneumoniae CWL029
gcucuggcuuuuucaacucaaa

SEQ ID NO: 4092 - RNA, 23 nt, Chlamydophila pneumoniae CWL029
gcuuaugcauuaggaaggagagc

SEQ ID NO: 4093 - RNA, 22 nt, Chlamydophila pneumoniae CWL029
gcuuuuggcucaccuauuccaa

SEQ ID NO: 4094 - RNA, 22 nt, Chlamydophila pneumoniae CWL029
ggaaggaucuuuaucggaauau

SEQ ID NO: 4095 - RNA, 22 nt, Chlamydophila pneumoniae CWL029
ggacuucuugaaagaauacccu

SEQ ID NO: 4096 - RNA, 22 nt, Chlamydophila pneumoniae CWL029
ggcaaaucuuugacucuaccgc

SEQ ID NO: 4097 - RNA, 22 nt, Chlamydophila pneumoniae CWL029
ggcauuuuggaaagaguuuacc

SEQ ID NO: 4098 - RNA, 22 nt, Chlamydophila pneumoniae CWL029
ggcuguggaaacuguugagcug

SEQ ID NO: 4099 - RNA, 22 nt, Chlamydophila pneumoniae CWL029
gggggaaagccaagaagaugua

SEQ ID NO: 4100 - RNA, 22 nt, Chlamydophila pneumoniae CWL029
gggguuuugcugguaacaagac

SEQ ID NO: 4101 - RNA, 22 nt, Chlamydophila pneumoniae CWL029
ggucggauuuagauuaaagaga

SEQ ID NO: 4102 - RNA, 22 nt, Chlamydophila pneumoniae CWL029
ggucucaugucuccuaaguuaa

SEQ ID NO: 4103 - RNA, 22 nt, Chlamydophila pneumoniae CWL029
ggucuucaagccaaaugaucag

SEQ ID NO: 4104 - RNA, 22 nt, Chlamydophila pneumoniae CWL029
ggugagauacccuucaaaauag

SEQ ID NO: 4105 - RNA, 17 nt, Chlamydophila pneumoniae CWL029
gucuccucuuggaagga

SEQ ID NO: 4106 - RNA, 22 nt, Chlamydophila pneumoniae CWL029
gugaaucauucgaugaaggaag

SEQ ID NO: 4107 - RNA, 22 nt, Chlamydophila pneumoniae CWL029
gugcaggucaugagcuugccgg

SEQ ID NO: 4108 - RNA, 22 nt, Chlamydophila pneumoniae CWL029
guuaggauauuucggagauuca

SEQ ID NO: 4109 - RNA, 22 nt, Chlamydophila pneumoniae CWL029
guucccuagggaagacugagga

SEQ ID NO: 4110 - RNA, 22 nt, Chlamydophila pneumoniae CWL029
guugccuuuagaauauaaggcg

SEQ ID NO: 4111 - RNA, 22 nt, Chlamydophila pneumoniae CWL029
guugucuuuccaacuccagaac

SEQ ID NO: 4112 - RNA, 20 nt, Chlamydophila pneumoniae CWL029
guuuugcuggaagagccucu

SEQ ID NO: 4113 - RNA, 22 nt, Chlamydophila pneumoniae CWL029
uaagacuucaccuguugcaguc

SEQ ID NO: 4114 - RNA, 22 nt, Chlamydophila pneumoniae CWL029
uacagauucaccaagaacaaua

SEQ ID NO: 4115 - RNA, 22 nt, Chlamydophila pneumoniae CWL029
uacaggaaaaacuuuaagaauu

SEQ ID NO: 4116 - RNA, 22 nt, Chlamydophila pneumoniae CWL029
uacgguauccguauaauuugau

SEQ ID NO: 4117 - RNA, 22 nt, Chlamydophila pneumoniae CWL029
uacuucaacucguugauuguga

SEQ ID NO: 4118 - RNA, 22 nt, Chlamydophila pneumoniae CWL029
uagaacgugcguucucuuaugu

SEQ ID NO: 4119 - RNA, 22 nt, Chlamydophila pneumoniae CWL029
uagaaguauuaagccaagauuu

SEQ ID NO: 4120 - RNA, 22 nt, Chlamydophila pneumoniae CWL029
uagagcuuccguaguucccgau

SEQ ID NO: 4121 - RNA, 22 nt, Chlamydophila pneumoniae CWL029
uagaggaagagguugaccugca

SEQ ID NO: 4122 - RNA, 22 nt, Chlamydophila pneumoniae CWL029
uagguucuucucugauccuuug

SEQ ID NO: 4123 - RNA, 22 nt, Chlamydophila pneumoniae CWL029
uaguuucugcagggcacucuca

SEQ ID NO: 4124 - RNA, 22 nt, Chlamydophila pneumoniae CWL029
uaucuuagagcgaugcugaccg

SEQ ID NO: 4125 - RNA, 22 nt, Chlamydophila pneumoniae CWL029
uaucuuggacuaucuuauugua

SEQ ID NO: 4126 - RNA, 22 nt, Chlamydophila pneumoniae CWL029
uauguuaggaaauaguguugga

SEQ ID NO: 4127 - RNA, 22 nt, Chlamydophila pneumoniae CWL029
uauugauuuaagaguuucaggg

SEQ ID NO: 4128 - RNA, 22 nt, Chlamydophila pneumoniae CWL029
ucaccuccagggaugauucgua

SEQ ID NO: 4129 - RNA, 21 nt, Chlamydophila pneumoniae CWL029
ucacugcugggggcaaaguua

SEQ ID NO: 4130 - RNA, 23 nt, Chlamydophila pneumoniae CWL029
ucagucucuagaggagcucuuug

SEQ ID NO: 4131 - RNA, 22 nt, Chlamydophila pneumoniae CWL029
ucauucacuacagacaugaaag

SEQ ID NO: 4132 - RNA, 22 nt, Chlamydophila pneumoniae CWL029
uccaagagauacguaggaagag

SEQ ID NO: 4133 - RNA, 22 nt, Chlamydophila pneumoniae CWL029
uccaggauuuuucguccuuaca

SEQ ID NO: 4134 - RNA, 21 nt, Chlamydophila pneumoniae CWL029
uccugaguuuccuaaggaacu

SEQ ID NO: 4135 - RNA, 22 nt, Chlamydophila pneumoniae CWL029
uccuguagagccuauuuaugau

SEQ ID NO: 4136 - RNA, 22 nt, Chlamydophila pneumoniae CWL029
uccuugauuugugaagaaauug

SEQ ID NO: 4137 - RNA, 22 nt, Chlamydophila pneumoniae CWL029
uccuuucucuuauugaaagauu

SEQ ID NO: 4138 - RNA, 22 nt, Chlamydophila pneumoniae CWL029
ucgaaagaccgugucuuuugcc

SEQ ID NO: 4139 - RNA, 22 nt, Chlamydophila pneumoniae CWL029
ucguggacuuguuggggaagau

SEQ ID NO: 4140 - RNA, 21 nt, Chlamydophila pneumoniae CWL029
ucuaagauuuuggguagagcu

SEQ ID NO: 4141 - RNA, 22 nt, Chlamydophila pneumoniae CWL029
ucucuuguaggaauugacgggc

SEQ ID NO: 4142 - RNA, 22 nt, Chlamydophila pneumoniae CWL029
ucugaaacgacuuguuuccaug

SEQ ID NO: 4143 - RNA, 23 nt, Chlamydophila pneumoniae CWL029
ucugcuauccguucaggagaaau

SEQ ID NO: 4144 - RNA, 22 nt, Chlamydophila pneumoniae CWL029
ucuggagacaucuuuugaagcu

SEQ ID NO: 4145 - RNA, 22 nt, Chlamydophila pneumoniae CWL029
ucugguggucccuuauguuggg

SEQ ID NO: 4146 - RNA, 22 nt, Chlamydophila pneumoniae CWL029
ucuuaucugcugggggagcuag

SEQ ID NO: 4147 - RNA, 23 nt, Chlamydophila pneumoniae CWL029
ucuugaguaucuucguaguuuca

SEQ ID NO: 4148 - RNA, 22 nt, Chlamydophila pneumoniae CWL029
ucuugcagucauuuagguaggu

SEQ ID NO: 4149 - RNA, 22 nt, Chlamydophila pneumoniae CWL029
ucuugggcaaugauggagaggu

SEQ ID NO: 4150 - RNA, 22 nt, Chlamydophila pneumoniae CWL029
ugaaaauaugagcaacuucuau

SEQ ID NO: 4151 - RNA, 22 nt, Chlamydophila pneumoniae CWL029
ugaagagaucgaagcgauacuu

SEQ ID NO: 4152 - RNA, 22 nt, Chlamydophila pneumoniae CWL029
ugaggaggaagaaucggaaugc

SEQ ID NO: 4153 - RNA, 22 nt, Chlamydophila pneumoniae CWL029
ugagggagaugcagauuuagau

SEQ ID NO: 4154 - RNA, 22 nt, Chlamydophila pneumoniae CWL029
ugauaggaauuuuucaaucuga

SEQ ID NO: 4155 - RNA, 22 nt, Chlamydophila pneumoniae CWL029
ugaugcuacgaucacuuaagaa

SEQ ID NO: 4156 - RNA, 22 nt, Chlamydophila pneumoniae CWL029
ugcaggaagaaagauuucuucu

SEQ ID NO: 4157 - RNA, 22 nt, Chlamydophila pneumoniae CWL029
aggcaaugagcuugugugugga

SEQ ID NO: 4158 - RNA, 22 nt, Chlamydophila pneumoniae CWL029
aggcuucuugguuauuuaggua

SEQ ID NO: 4159 - RNA, 22 nt, Chlamydophila pneumoniae CWL029
aggguucaauacuauggauuua

SEQ ID NO: 4160 - RNA, 22 nt, Chlamydophila pneumoniae CWL029
aguaagaacuucguuucagcac

SEQ ID NO: 4161 - RNA, 22 nt, Chlamydophila pneumoniae CWL029
aguauagcgaaauaugcaaucu

SEQ ID NO: 4162 - RNA, 22 nt, Chlamydophila pneumoniae CWL029
agucgagacuaugaccuuguca

SEQ ID NO: 4163 - RNA, 22 nt, Chlamydophila pneumoniae CWL029
agucuguuauuaucacgauauc

SEQ ID NO: 4164 - RNA, 22 nt, Chlamydophila pneumoniae CWL029
agugucuuuuguaucgcguaac

SEQ ID NO: 4165 - RNA, 22 nt, Chlamydophila pneumoniae CWL029
auaaaguuuugcugcgggcucc

SEQ ID NO: 4166 - RNA, 22 nt, Chlamydophila pneumoniae CWL029
auaaaucuguacaagauccucu

SEQ ID NO: 4167 - RNA, 22 nt, Chlamydophila pneumoniae CWL029
auaauucaaugauuugauugug

SEQ ID NO: 4168 - RNA, 22 nt, Chlamydophila pneumoniae CWL029
auacauuucugcgauguugugg

SEQ ID NO: 4169 - RNA, 22 nt, Chlamydophila pneumoniae CWL029
auaccaaaaugugauuuugagg

SEQ ID NO: 4170 - RNA, 22 nt, Chlamydophila pneumoniae CWL029
auagcagcuacuaagagaagug

SEQ ID NO: 4171 - RNA, 22 nt, Chlamydophila pneumoniae CWL029
auaggaauccuuagcuucuuga

SEQ ID NO: 4172 - RNA, 22 nt, Chlamydophila pneumoniae CWL029
auauagauagaauuuuacagga

SEQ ID NO: 4173 - RNA, 22 nt, Chlamydophila pneumoniae CWL029
auauucgugauauugaagacau

SEQ ID NO: 4174 - RNA, 22 nt, Chlamydophila pneumoniae CWL029
aucacgguuccuggaguaugga

SEQ ID NO: 4175 - RNA, 22 nt, Chlamydophila pneumoniae CWL029
auccugauggaacuuuuguuuc

SEQ ID NO: 4176 - RNA, 22 nt, Chlamydophila pneumoniae CWL029
aucugcaauguguucuuuauuu

SEQ ID NO: 4177 - RNA, 22 nt, Chlamydophila pneumoniae CWL029
aucugucuguuucuugcaggac

SEQ ID NO: 4178 - RNA, 22 nt, Chlamydophila pneumoniae CWL029
aucuugccuacgauccuguaug

SEQ ID NO: 4179 - RNA, 22 nt, Chlamydophila pneumoniae CWL029
augaaguuugaugcgacagaaa

SEQ ID NO: 4180 - RNA, 19 nt, Chlamydophila pneumoniae CWL029
augauuguagaaggaguga

SEQ ID NO: 4181 - RNA, 22 nt, Chlamydophila pneumoniae CWL029
augcaaggugcuaaucuccaca

SEQ ID NO: 4182 - RNA, 22 nt, Chlamydophila pneumoniae CWL029
auucuagaugguguaacuuuuu

SEQ ID NO: 4183 - RNA, 22 nt, Chlamydophila pneumoniae CWL029
auucugaucauaucuccgggau

SEQ ID NO: 4184 - RNA, 22 nt, Chlamydophila pneumoniae CWL029
auucuucacaauaggagaaagu

SEQ ID NO: 4185 - RNA, 22 nt, Chlamydophila pneumoniae CWL029
auugagauuuuccccauaucca

SEQ ID NO: 4186 - RNA, 22 nt, Chlamydophila pneumoniae CWL029
auuggcaugggugaagcuguug

SEQ ID NO: 4187 - RNA, 22 nt, Chlamydophila pneumoniae CWL029
auugugaaugcuauuuuguaaa

SEQ ID NO: 4188 - RNA, 22 nt, Chlamydophila pneumoniae CWL029
auuucugaaaagcuugcgauga

SEQ ID NO: 4189 - RNA, 22 nt, Chlamydophila pneumoniae CWL029
auuuuaucuauagcacuuugcu

SEQ ID NO: 4190 - RNA, 21 nt, Chlamydophila pneumoniae CWL029
caaaggcaaaggaaucucuau

SEQ ID NO: 4191 - RNA, 22 nt, Chlamydophila pneumoniae CWL029
caauauuugcuuuagaacaugc

SEQ ID NO: 4192 - RNA, 22 nt, Chlamydophila pneumoniae CWL029
cauucuuuaaccaagggaaucu

SEQ ID NO: 4193 - RNA, 22 nt, Chlamydophila pneumoniae CWL029
cauuuaaaccaaucggaagaga

SEQ ID NO: 4194 - RNA, 22 nt, Chlamydophila pneumoniae CWL029
ccauucaguauaagauugagca

SEQ ID NO: 4195 - RNA, 16 nt, Chlamydophila pneumoniae CWL029
ccucuauuguuccucc

SEQ ID NO: 4196 - RNA, 22 nt, Chlamydophila pneumoniae CWL029
ccugcagauguguaugcaagau

SEQ ID NO: 4197 - RNA, 22 nt, Chlamydophila pneumoniae CWL029
cgacuuagaucuuuucuacuuc

SEQ ID NO: 4198 - RNA, 22 nt, Chlamydophila pneumoniae CWL029
cgagaucuugauuuugguuaug

SEQ ID NO: 4199 - RNA, 22 nt, Chlamydophila pneumoniae CWL029
cgaguauuuuuucauguccgca

SEQ ID NO: 4200 - RNA, 22 nt, Chlamydophila pneumoniae CWL029
cgcaugaggaauaagauaguaa

SEQ ID NO: 4201 - RNA, 22 nt, Chlamydophila pneumoniae CWL029
cgcuuucuucagacaguucaag

SEQ ID NO: 4202 - RNA, 22 nt, Chlamydophila pneumoniae CWL029
cuaagauuccucuauuuccugc

SEQ ID NO: 4203 - RNA, 22 nt, Chlamydophila pneumoniae CWL029
cuccauauagccgcauuggaau

SEQ ID NO: 4204 - RNA, 22 nt, Chlamydophila pneumoniae CWL029
cucuauuaaaagaugcucaaga

SEQ ID NO: 4205 - RNA, 22 nt, Chlamydophila pneumoniae CWL029
cucuucaggaucggcauuauuu

SEQ ID NO: 4206 - RNA, 22 nt, Chlamydophila pneumoniae CWL029
cugguaaaagucucauuccugg

SEQ ID NO: 4207 - RNA, 22 nt, Chlamydophila pneumoniae CWL029
cuguuacuucacgcaggaucac

SEQ ID NO: 4208 - RNA, 21 nt, Chlamydophila pneumoniae CWL029
cuuacgaguuuccuggaguuu

SEQ ID NO: 4209 - RNA, 22 nt, Chlamydophila pneumoniae CWL029
cuuauggaauuacucaugucgu

SEQ ID NO: 4210 - RNA, 22 nt, Chlamydophila pneumoniae CWL029
cuuuaugaauuaggccuugugu

SEQ ID NO: 4211 - RNA, 22 nt, Chlamydophila pneumoniae CWL029
cuuuuagaugguggauuuucaa

SEQ ID NO: 4212 - RNA, 22 nt, Chlamydophila pneumoniae CWL029
gaaagaugacgaccgcccuuua

SEQ ID NO: 4213 - RNA, 22 nt, Chlamydophila pneumoniae CWL029
gaaccauauacugagcuuccuc

SEQ ID NO: 4214 - RNA, 22 nt, Chlamydophila pneumoniae CWL029
gaaggacaacuacguuaucauu

SEQ ID NO: 4215 - RNA, 22 nt, Chlamydophila pneumoniae CWL029
gaaggauaguuucucuaugaua

SEQ ID NO: 4216 - RNA, 22 nt, Chlamydophila pneumoniae CWL029
gaauuauuggaaagggaggcau

SEQ ID NO: 4217 - RNA, 19 nt, Chlamydophila pneumoniae CWL029
gaggaaaaggguccugaau

SEQ ID NO: 4218 - RNA, 22 nt, Chlamydophila pneumoniae CWL029
gauauguauguaaaggcucuuc

SEQ ID NO: 4219 - RNA, 22 nt, Chlamydophila pneumoniae CWL029
gaugguaaaauuguuauaggaa

SEQ ID NO: 4220 - RNA, 22 nt, Chlamydophila pneumoniae CWL029
gauggucaguuuucugaagaaa

SEQ ID NO: 4221 - RNA, 22 nt, Chlamydophila pneumoniae CWL029
gauuaaagaauaguucugaauu

SEQ ID NO: 4222 - RNA, 22 nt, Chlamydophila pneumoniae CWL029
gcaaucuuaaugacgaucuccu

SEQ ID NO: 4223 - RNA, 22 nt, Chlamydophila pneumoniae CWL029
gcagguggugcauggacuccuc

SEQ ID NO: 4224 - RNA, 22 nt, Chlamydophila pneumoniae CWL029
gcauguucuagagcauaugguc

SEQ ID NO: 4225 - RNA, 22 nt, Chlamydophila pneumoniae CWL029
gcccaagucggagaaagcuuau

SEQ ID NO: 4226 - RNA, 22 nt, Chlamydophila pneumoniae CWL029
gccuaggagauaagcaauguuu

SEQ ID NO: 4227 - RNA, 22 nt, Chlamydophila pneumoniae CWL029
gcggugauacaaaagagagugu

SEQ ID NO: 4228 - RNA, 22 nt, Chlamydophila pneumoniae CWL029
gcuagcaauuucaaugagaagu

SEQ ID NO: 4229 - RNA, 22 nt, Chlamydophila pneumoniae CWL029
ggagacaguuugcuuuaucucu

SEQ ID NO: 4230 - RNA, 22 nt, Chlamydophila pneumoniae CWL029
ggauuauucgugcauuuggugg

SEQ ID NO: 4231 - RNA, 22 nt, Chlamydophila pneumoniae CWL029
ggcauuaaagauuuggcugaag

SEQ ID NO: 4232 - RNA, 22 nt, Chlamydophila pneumoniae CWL029
ggcuguuuuuguaaguagauug

SEQ ID NO: 4233 - RNA, 22 nt, Chlamydophila pneumoniae CWL029
ggcuuuguuuuucagaaauaga

SEQ ID NO: 4234 - RNA, 22 nt, Chlamydophila pneumoniae CWL029
ggucgcaccccggaaggguaga

SEQ ID NO: 4235 - RNA, 22 nt, Chlamydophila pneumoniae CWL029
guccccuuucucaugaaaauag

SEQ ID NO: 4236 - RNA, 22 nt, Chlamydophila pneumoniae CWL029
gugagagcgaucucuggaacaa

SEQ ID NO: 4237 - RNA, 22 nt, Chlamydophila pneumoniae CWL029
uucgugaucaagggaaaacugu

SEQ ID NO: 4238 - RNA, 22 nt, Chlamydophila pneumoniae CWL029
uucuacaauuccuauagcucaa

SEQ ID NO: 4239 - RNA, 22 nt, Chlamydophila pneumoniae CWL029
uucuauggcugcucagaauauc

SEQ ID NO: 4240 - RNA, 23 nt, Chlamydophila pneumoniae CWL029
uucucaaagcaacgcgacucccu

SEQ ID NO: 4241 - RNA, 22 nt, Chlamydophila pneumoniae CWL029
uucuccagcaggagcccagaaa

SEQ ID NO: 4242 - RNA, 23 nt, Chlamydophila pneumoniae CWL029
uucuccuguauuuauaaagaaug

SEQ ID NO: 4243 - RNA, 22 nt, Chlamydophila pneumoniae CWL029
uucuggaguggcuuuaacgaua

SEQ ID NO: 4244 - RNA, 22 nt, Chlamydophila pneumoniae CWL029
uucuucaugcaucaaucuagag

SEQ ID NO: 4245 - RNA, 22 nt, Chlamydophila pneumoniae CWL029
uucuuuagagcacucggggaga

SEQ ID NO: 4246 - RNA, 22 nt, Chlamydophila pneumoniae CWL029
uucuuuuucuaugaugaugagu

SEQ ID NO: 4247 - RNA, 22 nt, Chlamydophila pneumoniae CWL029
uugcugagacuauaucgguaac

SEQ ID NO: 4248 - RNA, 22 nt, Chlamydophila pneumoniae CWL029
uuggagaguuuuuuaccaucug

SEQ ID NO: 4249 - RNA, 22 nt, Chlamydophila pneumoniae CWL029
uugguuuugagacucuccuaca

SEQ ID NO: 4250 - RNA, 22 nt, Chlamydophila pneumoniae CWL029
uuguccguauguuagagcaaga

SEQ ID NO: 4251 - RNA, 22 nt, Chlamydophila pneumoniae CWL029
uuguuauugaaucagaacugca

SEQ ID NO: 4252 - RNA, 22 nt, Chlamydophila pneumoniae CWL029
uuguuuaagagccucgcuuguu

SEQ ID NO: 4253 - RNA, 22 nt, Chlamydophila pneumoniae CWL029
uuuaggauggggaugaaaauug

SEQ ID NO: 4254 - RNA, 22 nt, Chlamydophila pneumoniae CWL029
uuucccuauguauggauucuca

SEQ ID NO: 4255 - RNA, 22 nt, Chlamydophila pneumoniae CWL029
uuucuaauuauuguuuuggaag

SEQ ID NO: 4256 - RNA, 22 nt, Chlamydophila pneumoniae CWL029
uuucucuuaagaugcgugguau

SEQ ID NO: 4257 - RNA, 22 nt, Chlamydophila pneumoniae CWL029
uuucugauguaacgaaccgucu

SEQ ID NO: 4258 - RNA, 22 nt, Chlamydophila pneumoniae CWL029
uuugucguagcguuccauaaga

SEQ ID NO: 4259 - RNA, 20 nt, Chlamydophila pneumoniae CWL029
uuugugcgauuuucuugaac

SEQ ID NO: 4260 - RNA, 22 nt, Chlamydophila pneumoniae CWL029
uuuuaaugucggaagguacguu

SEQ ID NO: 4261 - RNA, 18 nt, Chlamydophila pneumoniae CWL029
uuuuccaugguguaaaug

SEQ ID NO: 4262 - RNA, 22 nt, Chlamydophila pneumoniae CWL029
uuuucgcuucucuugaagaaau

SEQ ID NO: 4263 - RNA, 22 nt, Chlamydophila pneumoniae CWL029
uuaggaucggcagaauuaccaa

SEQ ID NO: 4264 - RNA, 22 nt, Chlamydophila pneumoniae CWL029
uucagacuuuagaaacuucuuc

SEQ ID NO: 4265 - RNA, 22 nt, Chlamydophila pneumoniae CWL029
uuccggaugauccuuuugcuau

SEQ ID NO: 4266 - RNA, 22 nt, Chlamydophila pneumoniae CWL029
uucgaguaguuauaggagagca

SEQ ID NO: 4267 - RNA, 22 nt, Chlamydophila pneumoniae CWL029
uucuuuagucguauauucacga

SEQ ID NO: 4268 - RNA, 19 nt, Chlamydophila pneumoniae CWL029
uucuuucaggagcuccuca

SEQ ID NO: 4269 - RNA, 22 nt, Chlamydophila pneumoniae CWL029
uugaagauguuuccucaguuga

SEQ ID NO: 4270 - RNA, 22 nt, Chlamydophila pneumoniae CWL029
uugaccagaugcaugagaauag

SEQ ID NO: 4271 - RNA, 22 nt, Chlamydophila pneumoniae CWL029
uugagcaaucaacuagggguaa

SEQ ID NO: 4272 - RNA, 23 nt, Chlamydophila pneumoniae CWL029
uugauuacacucaaggaugcugc

SEQ ID NO: 4273 - RNA, 22 nt, Chlamydophila pneumoniae CWL029
uuggcguugagauuauuccuga

SEQ ID NO: 4274 - RNA, 22 nt, Chlamydophila pneumoniae CWL029
uuguaggggcuuguaucggauu

SEQ ID NO: 4275 - RNA, 22 nt, Chlamydophila pneumoniae CWL029
uuguaggguuauuguccucugu

SEQ ID NO: 4276 - RNA, 22 nt, Chlamydophila pneumoniae CWL029
uugugauuccucgagcgagacg

SEQ ID NO: 4277 - RNA, 20 nt, Chlamydophila pneumoniae CWL029
uuguggacuccuaaauaucu

SEQ ID NO: 4278 - RNA, 22 nt, Chlamydophila pneumoniae CWL029
uuuagaggaucggguaucggaa

SEQ ID NO: 4279 - RNA, 22 nt, Chlamydophila pneumoniae CWL029
uuucccuguuguaggaacggua

SEQ ID NO: 4280 - RNA, 22 nt, Chlamydophila pneumoniae CWL029
uuucucuguagucacuggggug

SEQ ID NO: 4281 - RNA, 22 nt, Chlamydophila pneumoniae CWL029
uuucuucggauuuguuuacaga

SEQ ID NO: 4282 - RNA, 22 nt, Chlamydophila pneumoniae CWL029
uuugauuauugaugggaagauc

SEQ ID NO: 4283 - RNA, 22 nt, Chlamydophila pneumoniae CWL029
uuugugaucggaaguuauaauu

SEQ ID NO: 4284 - RNA, 22 nt, Chlamydophila pneumoniae CWL029
uuuuauacucucacagugauuu

SEQ ID NO: 4285 - RNA, 22 nt, Chlamydophila pneumoniae CWL029
uuuuccaaaagcauauaacuuu

SEQ ID NO: 4286 - RNA, 22 nt, Chlamydophila pneumoniae J138
aaaaauuguggguucuugagca

SEQ ID NO: 4287 - RNA, 22 nt, Chlamydophila pneumoniae J138
aaaaucagcaacuaacauagcu

SEQ ID NO: 4288 - RNA, 22 nt, Chlamydophila pneumoniae J138
aaagaacucuccuauaauggca

SEQ ID NO: 4289 - RNA, 22 nt, Chlamydophila pneumoniae J138
aaagggaaguucuaaaucaaau

SEQ ID NO: 4290 - RNA, 22 nt, Chlamydophila pneumoniae J138
aaaucaagaauacaucgcagau

SEQ ID NO: 4291 - RNA, 22 nt, Chlamydophila pneumoniae J138
aaaucgaacuccaagcaucguu

SEQ ID NO: 4292 - RNA, 22 nt, Chlamydophila pneumoniae J138
aaauuaucggucaaaagcuaag

SEQ ID NO: 4293 - RNA, 22 nt, Chlamydophila pneumoniae J138
aacaauaccuugaguuacaaac

SEQ ID NO: 4294 - RNA, 22 nt, Chlamydophila pneumoniae J138
aacucgggcagacguacugcau

SEQ ID NO: 4295 - RNA, 22 nt, Chlamydophila pneumoniae J138
aagaagaagaauccguggauga

SEQ ID NO: 4296 - RNA, 22 nt, Chlamydophila pneumoniae J138
aagaguuuuuuaugacucaugc

SEQ ID NO: 4297 - RNA, 22 nt, Chlamydophila pneumoniae J138
aagcucuacccacuaaaaucau

SEQ ID NO: 4298 - RNA, 22 nt, Chlamydophila pneumoniae J138
aagcucuuccagaaacaagauc

SEQ ID NO: 4299 - RNA, 22 nt, Chlamydophila pneumoniae J138
aagcuucgugaucagaaauuga

SEQ ID NO: 4300 - RNA, 22 nt, Chlamydophila pneumoniae J138
aagcuuuucgcagauacuucuu

SEQ ID NO: 4301 - RNA, 22 nt, Chlamydophila pneumoniae J138
aaggauggccaggauuuucagg

SEQ ID NO: 4302 - RNA, 22 nt, Chlamydophila pneumoniae J138
aagguguuucuuuaggaaaaau

SEQ ID NO: 4303 - RNA, 22 nt, Chlamydophila pneumoniae J138
aagucucuggauaguaauaccc

SEQ ID NO: 4304 - RNA, 22 nt, Chlamydophila pneumoniae J138
aaguuguauauaugcgcuaauu

SEQ ID NO: 4305 - RNA, 22 nt, Chlamydophila pneumoniae J138
aaucuuaucuugauccaagaag

SEQ ID NO: 4306 - RNA, 22 nt, Chlamydophila pneumoniae J138
aauguguauggaauugugaggu

SEQ ID NO: 4307 - RNA, 21 nt, Chlamydophila pneumoniae J138
aauuccucacuuccuuuaccu

SEQ ID NO: 4308 - RNA, 22 nt, Chlamydophila pneumoniae J138
aauucguggagccguuuuuuua

SEQ ID NO: 4309 - RNA, 22 nt, Chlamydophila pneumoniae J138
aauuuucuguucuuuaccgcug

SEQ ID NO: 4310 - RNA, 22 nt, Chlamydophila pneumoniae J138
acaagaaaguagcucacgcaau

SEQ ID NO: 4311 - RNA, 22 nt, Chlamydophila pneumoniae J138
accagcuguagagggauugggg

SEQ ID NO: 4312 - RNA, 22 nt, Chlamydophila pneumoniae J138
accagcuucccaagcugaaaga

SEQ ID NO: 4313 - RNA, 22 nt, Chlamydophila pneumoniae J138
acgacaaacuucaagcaaucug

SEQ ID NO: 4314 - RNA, 21 nt, Chlamydophila pneumoniae J138
acguaaguaaaaucuuuagga

SEQ ID NO: 4315 - RNA, 22 nt, Chlamydophila pneumoniae J138
acuauacaccaagaacaauaag

SEQ ID NO: 4316 - RNA, 22 nt, Chlamydophila pneumoniae J138
agaaaucugcugcauagauauc

SEQ ID NO: 4317 - RNA, 21 nt, Chlamydophila pneumoniae J138
agaagcugcugaugccuaugc

SEQ ID NO: 4318 - RNA, 22 nt, Chlamydophila pneumoniae J138
agagauccccgguucuaagaaa

SEQ ID NO: 4319 - RNA, 22 nt, Chlamydophila pneumoniae J138
agaggaacgcccuguuuucuuc

SEQ ID NO: 4320 - RNA, 22 nt, Chlamydophila pneumoniae J138
auccugaagauauucaggcaau

SEQ ID NO: 4321 - RNA, 22 nt, Chlamydophila pneumoniae J138
aucugcgaaggagauagucgcu

SEQ ID NO: 4322 - RNA, 22 nt, Chlamydophila pneumoniae J138
aucugucuguuucuugcaggac

SEQ ID NO: 4323 - RNA, 22 nt, Chlamydophila pneumoniae J138
aucuugccuacgauccuguaug

SEQ ID NO: 4324 - RNA, 22 nt, Chlamydophila pneumoniae J138
aucuuucaagcucagauggaac

SEQ ID NO: 4325 - RNA, 22 nt, Chlamydophila pneumoniae J138
augggaaucuugaagaguuguu

SEQ ID NO: 4326 - RNA, 20 nt, Chlamydophila pneumoniae J138
auguaauacagaagaacauu

SEQ ID NO: 4327 - RNA, 22 nt, Chlamydophila pneumoniae J138
auuaaauaaacuuggaguaucu

SEQ ID NO: 4328 - RNA, 22 nt, Chlamydophila pneumoniae J138
auucaucauuugacuauugaua

SEQ ID NO: 4329 - RNA, 22 nt, Chlamydophila pneumoniae J138
auuccuuauuugauuggagggu

SEQ ID NO: 4330 - RNA, 22 nt, Chlamydophila pneumoniae J138
auucgacuuagaucuuuuucua

SEQ ID NO: 4331 - RNA, 22 nt, Chlamydophila pneumoniae J138
auucugaaggagaauaaaauau

SEQ ID NO: 4332 - RNA, 22 nt, Chlamydophila pneumoniae J138
auucuucacaauaggagaaagu

SEQ ID NO: 4333 - RNA, 22 nt, Chlamydophila pneumoniae J138
auugaguuuaacaaugcaggga

SEQ ID NO: 4334 - RNA, 22 nt, Chlamydophila pneumoniae J138
auuucgggacuacuauguuuuu

SEQ ID NO: 4335 - RNA, 22 nt, Chlamydophila pneumoniae J138
auuuggaucagcuguuguaugg

SEQ ID NO: 4336 - RNA, 22 nt, Chlamydophila pneumoniae J138
auuuuauuuuguggccaccagg

SEQ ID NO: 4337 - RNA, 22 nt, Chlamydophila pneumoniae J138
auuuuccucacaguaaucuugu

SEQ ID NO: 4338 - RNA, 20 nt, Chlamydophila pneumoniae J138
auuuucugaucacgaaguuu

SEQ ID NO: 4339 - RNA, 23 nt, Chlamydophila pneumoniae J138
caaagcuggggauuucuuucuag

SEQ ID NO: 4340 - RNA, 21 nt, Chlamydophila pneumoniae J138
caaaggcaaaggaaucucuau

SEQ ID NO: 4341 - RNA, 22 nt, Chlamydophila pneumoniae J138
cagcuuugggauguagauuucu

SEQ ID NO: 4342 - RNA, 22 nt, Chlamydophila pneumoniae J138
caugcaagcaaggcagauucaa

SEQ ID NO: 4343 - RNA, 22 nt, Chlamydophila pneumoniae J138
caugucuuuuuuacagaaagau

SEQ ID NO: 4344 - RNA, 22 nt, Chlamydophila pneumoniae J138
cauuguuccuuuaagauuucug

SEQ ID NO: 4345 - RNA, 22 nt, Chlamydophila pneumoniae J138
cauuuaucucggaguucuugcg

SEQ ID NO: 4346 - RNA, 22 nt, Chlamydophila pneumoniae J138
cauuuuagaugggucuauuucu

SEQ ID NO: 4347 - RNA, 22 nt, Chlamydophila pneumoniae J138
cauuuuuaaauacgauggucgu

SEQ ID NO: 4348 - RNA, 21 nt, Chlamydophila pneumoniae J138
cccuauggauaugauuccuuc

SEQ ID NO: 4349 - RNA, 22 nt, Chlamydophila pneumoniae J138
cccugcauuguuaaacucaauu

SEQ ID NO: 4350 - RNA, 22 nt, Chlamydophila pneumoniae J138
ccucuugguaacgaucgcaacg

SEQ ID NO: 4351 - RNA, 20 nt, Chlamydophila pneumoniae J138
ccuuaucuaggaagagcuug

SEQ ID NO: 4352 - RNA, 22 nt, Chlamydophila pneumoniae J138
cgagaucuugauuuugguuaug

SEQ ID NO: 4353 - RNA, 22 nt, Chlamydophila pneumoniae J138
cuccauauagccgcauuggaau

SEQ ID NO: 4354 - RNA, 22 nt, Chlamydophila pneumoniae J138
cucuauacaaauccaacagugc

SEQ ID NO: 4355 - RNA, 23 nt, Chlamydophila pneumoniae J138
cugaagcagagacgaucuuuuuu

SEQ ID NO: 4356 - RNA, 22 nt, Chlamydophila pneumoniae J138
cugguaaaagucucauuccugg

SEQ ID NO: 4357 - RNA, 22 nt, Chlamydophila pneumoniae J138
cuucuagagacucgcgaaguaa

SEQ ID NO: 4358 - RNA, 22 nt, Chlamydophila pneumoniae J138
gaaacgacgagcagccugaggg

SEQ ID NO: 4359 - RNA, 22 nt, Chlamydophila pneumoniae J138
gaaauauuguugggacuuuggu

SEQ ID NO: 4360 - RNA, 22 nt, Chlamydophila pneumoniae J138
gaacuuugugaagcuugagaag

SEQ ID NO: 4361 - RNA, 22 nt, Chlamydophila pneumoniae J138
gaagauucuuuuaguggauugg

SEQ ID NO: 4362 - RNA, 22 nt, Chlamydophila pneumoniae J138
gaaggcaaacuccccgcuuuug

SEQ ID NO: 4363 - RNA, 22 nt, Chlamydophila pneumoniae J138
gaauuguaggagcuucgggagc

SEQ ID NO: 4364 - RNA, 22 nt, Chlamydophila pneumoniae J138
gaggaauuuuugcguaauguuc

SEQ ID NO: 4365 - RNA, 22 nt, Chlamydophila pneumoniae J138
gaguauaggugccuguguuagu

SEQ ID NO: 4366 - RNA, 22 nt, Chlamydophila pneumoniae J138
gagugcccuuaagaagcuuucu

SEQ ID NO: 4367 - RNA, 22 nt, Chlamydophila pneumoniae J138
gagugugcauaacgagccuuug

SEQ ID NO: 4368 - RNA, 17 nt, Chlamydophila pneumoniae J138
gaucuccaaagaguaga

SEQ ID NO: 4369 - RNA, 22 nt, Chlamydophila pneumoniae J138
gaugguaaaauuguuauaggaa

SEQ ID NO: 4370 - RNA, 22 nt, Chlamydophila pneumoniae J138
gcacuauuggagaaucuggagg

SEQ ID NO: 4371 - RNA, 22 nt, Chlamydophila pneumoniae J138
gcagaacuuagagcuucaauau

SEQ ID NO: 4372 - RNA, 22 nt, Chlamydophila pneumoniae J138
gcccaagucggagaaagcuuau

SEQ ID NO: 4373 - RNA, 22 nt, Chlamydophila pneumoniae J138
gccuuuuuugaugcucuugucc

SEQ ID NO: 4374 - RNA, 22 nt, Chlamydophila pneumoniae J138
gcgauucuaagauuccuacgau

SEQ ID NO: 4375 - RNA, 22 nt, Chlamydophila pneumoniae J138
gcguucuugauauuuuguuaau

SEQ ID NO: 4376 - RNA, 22 nt, Chlamydophila pneumoniae J138
gcucuaaacgcgagaacgaugc

SEQ ID NO: 4377 - RNA, 22 nt, Chlamydophila pneumoniae J138
gcugccgauagaacuugauuug

SEQ ID NO: 4378 - RNA, 23 nt, Chlamydophila pneumoniae J138
gcuuaugcauuaggaaggagagc

SEQ ID NO: 4379 - RNA, 22 nt, Chlamydophila pneumoniae J138
ggaaaccaucuucucucuuuga

SEQ ID NO: 4380 - RNA, 22 nt, Chlamydophila pneumoniae J138
ggauuauucgugcauuuggugg

SEQ ID NO: 4381 - RNA, 22 nt, Chlamydophila pneumoniae J138
ggcaaaucuuugacucuaccgc

SEQ ID NO: 4382 - RNA, 22 nt, Chlamydophila pneumoniae J138
guaaauaccgauuuuaauaggg

SEQ ID NO: 4383 - RNA, 17 nt, Chlamydophila pneumoniae J138
gucuccucuuggaagga

SEQ ID NO: 4384 - RNA, 22 nt, Chlamydophila pneumoniae J138
gugaaguuugagagauuuucag

SEQ ID NO: 4385 - RNA, 22 nt, Chlamydophila pneumoniae J138
gugcaggucaugagcuugccgg

SEQ ID NO: 4386 - RNA, 22 nt, Chlamydophila pneumoniae J138
guuaaagucuacguugccucua

SEQ ID NO: 4387 - RNA, 22 nt, Chlamydophila pneumoniae J138
guuagaggaagaaggauuugcu

SEQ ID NO: 4388 - RNA, 22 nt, Chlamydophila pneumoniae J138
guuaggauauuucggagauuca

SEQ ID NO: 4389 - RNA, 22 nt, Chlamydophila pneumoniae J138
guuugcucuuaagauguauugc

SEQ ID NO: 4390 - RNA, 22 nt, Chlamydophila pneumoniae J138
uaaacuuagagcaaguagcaua

SEQ ID NO: 4391 - RNA, 21 nt, Chlamydophila pneumoniae J138
uaacucucgucgacuuuuccu

SEQ ID NO: 4392 - RNA, 19 nt, Chlamydophila pneumoniae J138
uaauuuagacgacguagau

SEQ ID NO: 4393 - RNA, 22 nt, Chlamydophila pneumoniae J138
uacaggaaaaacuuuaagaauu

SEQ ID NO: 4394 - RNA, 22 nt, Chlamydophila pneumoniae J138
uacccugaaacucuuaaaucaa

SEQ ID NO: 4395 - RNA, 22 nt, Chlamydophila pneumoniae J138
uacuucaacucguugauuguga

SEQ ID NO: 4396 - RNA, 22 nt, Chlamydophila pneumoniae J138
uacuugauagaacugugauucu

SEQ ID NO: 4397 - RNA, 19 nt, Chlamydophila pneumoniae J138
uagaaaaagaucuaagucg

SEQ ID NO: 4398 - RNA, 22 nt, Chlamydophila pneumoniae J138
uagaaaagaucuaagucguugu

SEQ ID NO: 4399 - RNA, 22 nt, Chlamydophila pneumoniae J138
uagaaguauuaagccaagauuu

SEQ ID NO: 4400 - RNA, 22 nt, Chlamydophila pneumoniae J138
uagaggcucuuccagcaaaaca

SEQ ID NO: 4401 - RNA, 22 nt, Chlamydophila pneumoniae J138
uagcaaguaugcgauacgcaau

SEQ ID NO: 4402 - RNA, 22 nt, Chlamydophila pneumoniae J138
uagcucuacccaaaaucuuaga

SEQ ID NO: 4403 - RNA, 22 nt, Chlamydophila pneumoniae J138
uagguucuucucugauccuuug

SEQ ID NO: 4404 - RNA, 22 nt, Chlamydophila pneumoniae J138
uaguugaaacagauggaagagu

SEQ ID NO: 4405 - RNA, 22 nt, Chlamydophila pneumoniae J138
uauacgauacgaucgaaacucu

SEQ ID NO: 4406 - RNA, 22 nt, Chlamydophila pneumoniae J138
uaucgguguggauaaguuucuc

SEQ ID NO: 4407 - RNA, 22 nt, Chlamydophila pneumoniae J138
uaucguuaaaagaucgcaacca

SEQ ID NO: 4408 - RNA, 23 nt, Chlamydophila pneumoniae J138
uaugucugggcuggagagcuggg

SEQ ID NO: 4409 - RNA, 22 nt, Chlamydophila pneumoniae J138
uauugauuuaagaguuucaggg

SEQ ID NO: 4410 - RNA, 22 nt, Chlamydophila pneumoniae J138
uauuuuuuauugaagugguagc

SEQ ID NO: 4411 - RNA, 22 nt, Chlamydophila pneumoniae J138
ucaaaugcacaggucuuugaga

SEQ ID NO: 4412 - RNA, 22 nt, Chlamydophila pneumoniae J138
ucaccuccagggaugauucgua

SEQ ID NO: 4413 - RNA, 21 nt, Chlamydophila pneumoniae J138
ucacugcugggggcaaaguua

SEQ ID NO: 4414 - RNA, 22 nt, Chlamydophila pneumoniae J138
ucccuauacaaugagagaugug

SEQ ID NO: 4415 - RNA, 22 nt, Chlamydophila pneumoniae J138
uccgagggaacuaaaggagcga

SEQ ID NO: 4416 - RNA, 19 nt, Chlamydophila pneumoniae J138
uccuauuaccaaagcggcu

SEQ ID NO: 4417 - RNA, 23 nt, Chlamydophila pneumoniae J138
uccucagucuucccuagggaacu

SEQ ID NO: 4418 - RNA, 22 nt, Chlamydophila pneumoniae J138
uccugagcauugacuugggauu

SEQ ID NO: 4419 - RNA, 21 nt, Chlamydophila pneumoniae J138
uccugaguuuccuaaggaacu

SEQ ID NO: 4420 - RNA, 22 nt, Chlamydophila pneumoniae J138
uccuuauuuguucuuucugugu

SEQ ID NO: 4421 - RNA, 22 nt, Chlamydophila pneumoniae J138
uccuugauuugugaagaaauug

SEQ ID NO: 4422 - RNA, 22 nt, Chlamydophila pneumoniae J138
uccuuucucuuauugaaagauu

SEQ ID NO: 4423 - RNA, 22 nt, Chlamydophila pneumoniae J138
ucgucuacaggguucuucgcuu

SEQ ID NO: 4424 - RNA, 22 nt, Chlamydophila pneumoniae J138
ucuaaagauucccugugucuuu

SEQ ID NO: 4425 - RNA, 22 nt, Chlamydophila pneumoniae J138
ucuaaaggugaugguaagcacg

SEQ ID NO: 4426 - RNA, 22 nt, Chlamydophila pneumoniae J138
ucuaugauuuuaguggguagag

SEQ ID NO: 4427 - RNA, 22 nt, Chlamydophila pneumoniae J138
ucucagcauuauggaggcuccu

SEQ ID NO: 4428 - RNA, 22 nt, Chlamydophila pneumoniae J138
ucucuuguaggaauugacgggc

SEQ ID NO: 4429 - RNA, 22 nt, Chlamydophila pneumoniae J138
ucuggagacaucuuuugaagcu

SEQ ID NO: 4430 - RNA, 22 nt, Chlamydophila pneumoniae J138
ucuguaguugcuaugcgcggug

SEQ ID NO: 4431 - RNA, 22 nt, Chlamydophila pneumoniae J138
ucuuaucugcugggggagcuag

SEQ ID NO: 4432 - RNA, 22 nt, Chlamydophila pneumoniae J138
ugaaaauaugagcaacuucuau

SEQ ID NO: 4433 - RNA, 22 nt, Chlamydophila pneumoniae J138
ugagaaaagaggucuuuacaga

SEQ ID NO: 4434 - RNA, 22 nt, Chlamydophila pneumoniae J138
ugagacccgcgaguaaagauuc

SEQ ID NO: 4435 - RNA, 22 nt, Chlamydophila pneumoniae J138
ugaggauaacgauacgcaaugu

SEQ ID NO: 4436 - RNA, 22 nt, Chlamydophila pneumoniae J138
ugagggagaugcagauuuagau

SEQ ID NO: 4437 - RNA, 22 nt, Chlamydophila pneumoniae J138
ugaguuuaggaauuaagagcac

SEQ ID NO: 4438 - RNA, 22 nt, Chlamydophila pneumoniae J138
uggaugaagaagcuggaaaucc

SEQ ID NO: 4439 - RNA, 20 nt, Chlamydophila pneumoniae J138
uggcgugcuuccuaugagua

SEQ ID NO: 4440 - RNA, 23 nt, Chlamydophila pneumoniae J138
uggcuuugguuauuguuaaagag

SEQ ID NO: 4441 - RNA, 16 nt, Chlamydophila pneumoniae J138
ugggauugaaguuagg

SEQ ID NO: 4442 - RNA, 22 nt, Chlamydophila pneumoniae J138
uggguuauuaucuuaugaagaa

SEQ ID NO: 4443 - RNA, 22 nt, Chlamydophila pneumoniae J138
uggucuugauuuuuauagaaaa

SEQ ID NO: 4444 - RNA, 22 nt, Chlamydophila pneumoniae J138
uguaggaaagccuuauuuacau

SEQ ID NO: 4445 - RNA, 21 nt, Chlamydophila pneumoniae J138
ugugggugcguugcuaaaguu

SEQ ID NO: 4446 - RNA, 22 nt, Chlamydophila pneumoniae J138
uguuucuggaagagcuucuuau

SEQ ID NO: 4447 - RNA, 22 nt, Chlamydophila pneumoniae J138
uguuuggagaauguucagaagg

SEQ ID NO: 4448 - RNA, 22 nt, Chlamydophila pneumoniae J138
uuagaguugacuguaguuacag

SEQ ID NO: 4449 - RNA, 19 nt, Chlamydophila pneumoniae J138
uuauugauacgauuuuaga

SEQ ID NO: 4450 - RNA, 22 nt, Chlamydophila pneumoniae J138
uuauuguucuugguguauagua

SEQ ID NO: 4451 - RNA, 22 nt, Chlamydophila pneumoniae J138
uuccauuaaccaaacauuugau

SEQ ID NO: 4452 - RNA, 22 nt, Chlamydophila pneumoniae J138
uuccuacagaucguauuuuccg

SEQ ID NO: 4453 - RNA, 22 nt, Chlamydophila pneumoniae J138
uucggaagaucuugagauagcu

SEQ ID NO: 4454 - RNA, 22 nt, Chlamydophila pneumoniae J138
uucgugaucaagggaaaacugu

SEQ ID NO: 4455 - RNA, 22 nt, Chlamydophila pneumoniae J138
uucuccagcaggagcccagaaa

SEQ ID NO: 4456 - RNA, 22 nt, Chlamydophila pneumoniae J138
uucuucaugcaucaaucuagag

SEQ ID NO: 4457 - RNA, 23 nt, Chlamydophila pneumoniae J138
uugauuacacucaaggaugcugc

SEQ ID NO: 4458 - RNA, 22 nt, Chlamydophila pneumoniae J138
uugcggauagcuauguagagug

SEQ ID NO: 4459 - RNA, 22 nt, Chlamydophila pneumoniae J138
uugcugagacuauaucgguaac

SEQ ID NO: 4460 - RNA, 22 nt, Chlamydophila pneumoniae J138
uugcuugaaggagauguuuuua

SEQ ID NO: 4461 - RNA, 22 nt, Chlamydophila pneumoniae J138
uuggaauuaggcaugggccuuu

SEQ ID NO: 4462 - RNA, 22 nt, Chlamydophila pneumoniae J138
uuguaggggcuuguaucggauu

SEQ ID NO: 4463 - RNA, 22 nt, Chlamydophila pneumoniae J138
uuguauuuuuugcauccuagaa

SEQ ID NO: 4464 - RNA, 22 nt, Chlamydophila pneumoniae J138
uuguccguauguuagagcaaga

SEQ ID NO: 4465 - RNA, 22 nt, Chlamydophila pneumoniae J138
uuguuuaagagccucgcuuguu

SEQ ID NO: 4466 - RNA, 22 nt, Chlamydophila pneumoniae J138
uuuagaaaacgcgaacaccuuu

SEQ ID NO: 4467 - RNA, 22 nt, Chlamydophila pneumoniae J138
uuucaaagauaagccugugagu

SEQ ID NO: 4468 - RNA, 22 nt, Chlamydophila pneumoniae J138
uuugcgagauguuguugaucag

SEQ ID NO: 4469 - RNA, 22 nt, Chlamydophila pneumoniae J138
uuugugaucggaaguuauaauu

SEQ ID NO: 4470 - RNA, 22 nt, Chlamydophila pneumoniae J138
uuuguuauuacuaguugucuga

SEQ ID NO: 4471 - RNA, 22 nt, Chlamydophila pneumoniae J138
uuuuaaugucggaagguacguu

SEQ ID NO: 4472 - RNA, 18 nt, Chlamydophila pneumoniae J138
uuuuccaugguguaaaug

SEQ ID NO: 4473 - RNA, 22 nt, Chlamydophila pneumoniae J138
uuuucgcuucucuugaagaaau

SEQ ID NO: 4474 - RNA, 22 nt, Chlamydophila pneumoniae J138
uuuugaagaaggcugcuugcua

SEQ ID NO: 4475 - RNA, 22 nt, Chlamydophila pneumoniae J138
aaacuaaggagugucaaugaag

SEQ ID NO: 4476 - RNA, 22 nt, Chlamydophila pneumoniae J138
aaacuucaggaacuuucugagu

SEQ ID NO: 4477 - RNA, 22 nt, Chlamydophila pneumoniae J138
aaagagaaucgcuacagauccc

SEQ ID NO: 4478 - RNA, 22 nt, Chlamydophila pneumoniae J138
aaagaggagaaagccgccuaug

SEQ ID NO: 4479 - RNA, 22 nt, Chlamydophila pneumoniae J138
aaauagucucuagguucuauag

SEQ ID NO: 4480 - RNA, 22 nt, Chlamydophila pneumoniae J138
aaauucgugcguuuaaaagagg

SEQ ID NO: 4481 - RNA, 22 nt, Chlamydophila pneumoniae J138
aaauuuggaggagaaucuauag

SEQ ID NO: 4482 - RNA, 22 nt, Chlamydophila pneumoniae J138
aacauuuuccacugagaaguug

SEQ ID NO: 4483 - RNA, 22 nt, Chlamydophila pneumoniae J138
aaccaggaugcgucucugucca

SEQ ID NO: 4484 - RNA, 22 nt, Chlamydophila pneumoniae J138
aacgaugcuuggaguucgauuu

SEQ ID NO: 4485 - RNA, 22 nt, Chlamydophila pneumoniae J138
aacgucuaggacauuauuguua

SEQ ID NO: 4486 - RNA, 22 nt, Chlamydophila pneumoniae J138
aagaaagauucuugguagaaau

SEQ ID NO: 4487 - RNA, 22 nt, Chlamydophila pneumoniae J138
aagagucgugucuucucuuuag

SEQ ID NO: 4488 - RNA, 22 nt, Chlamydophila pneumoniae J138
aagaucaugucuccucugugcg

SEQ ID NO: 4489 - RNA, 22 nt, Chlamydophila pneumoniae J138
aagauuuuggguagagcuacac

SEQ ID NO: 4490 - RNA, 22 nt, Chlamydophila pneumoniae J138
aaggaggagcuccugguggagg

SEQ ID NO: 4491 - RNA, 22 nt, Chlamydophila pneumoniae J138
aaggcaaaaccauauucugguu

SEQ ID NO: 4492 - RNA, 22 nt, Chlamydophila pneumoniae J138
aaggcuaucgauuugauagaug

SEQ ID NO: 4493 - RNA, 22 nt, Chlamydophila pneumoniae J138
aaggugaacaagaucuucuggu

SEQ ID NO: 4494 - RNA, 22 nt, Chlamydophila pneumoniae J138
aaguucuagaauuacgggaaga

SEQ ID NO: 4495 - RNA, 22 nt, Chlamydophila pneumoniae J138
aaucucugaacuuuugcuguug

SEQ ID NO: 4496 - RNA, 22 nt, Chlamydophila pneumoniae J138
aaucugugauugaugaguuuuu

SEQ ID NO: 4497 - RNA, 22 nt, Chlamydophila pneumoniae J138
aaucuucugaagagacggcaaa

SEQ ID NO: 4498 - RNA, 22 nt, Chlamydophila pneumoniae J138
aaugacgcguaggucugccuua

SEQ ID NO: 4499 - RNA, 22 nt, Chlamydophila pneumoniae J138
aaugucucucagguuuauuccu

SEQ ID NO: 4500 - RNA, 22 nt, Chlamydophila pneumoniae J138
acaagaaaaguuuaaggcucag

SEQ ID NO: 4501 - RNA, 18 nt, Chlamydophila pneumoniae J138
acaggaaucggaaugggc

SEQ ID NO: 4502 - RNA, 22 nt, Chlamydophila pneumoniae J138
acaggcgugucuuugugccuau

SEQ ID NO: 4503 - RNA, 22 nt, Chlamydophila pneumoniae J138
acgauaaaguguguguaggauu

SEQ ID NO: 4504 - RNA, 21 nt, Chlamydophila pneumoniae J138
acucauuguucuauuggcugc

SEQ ID NO: 4505 - RNA, 22 nt, Chlamydophila pneumoniae J138
acuccucuaucguauuggggau

SEQ ID NO: 4506 - RNA, 22 nt, Chlamydophila pneumoniae J138
acuuaauaaucucuuagauagu

SEQ ID NO: 4507 - RNA, 22 nt, Chlamydophila pneumoniae J138
acuucuugcuugggcccacgcu

SEQ ID NO: 4508 - RNA, 22 nt, Chlamydophila pneumoniae J138
acuuugcucuucuuguuggaag

SEQ ID NO: 4509 - RNA, 22 nt, Chlamydophila pneumoniae J138
agaacgcacguucuauacaaga

SEQ ID NO: 4510 - RNA, 22 nt, Chlamydophila pneumoniae J138
agaagguuugaugacaacaguu

SEQ ID NO: 4511 - RNA, 22 nt, Chlamydophila pneumoniae J138
agaaucuugauggguagcggca

SEQ ID NO: 4512 - RNA, 22 nt, Chlamydophila pneumoniae J138
agagaagaugccuauaccucua

SEQ ID NO: 4513 - RNA, 22 nt, Chlamydophila pneumoniae J138
agaguagcacaaaaugccuagu

SEQ ID NO: 4514 - RNA, 22 nt, Chlamydophila pneumoniae J138
agauauucuuaaaguuucggau

SEQ ID NO: 4515 - RNA, 22 nt, Chlamydophila pneumoniae J138
agauucucuaugauauacuaug

SEQ ID NO: 4516 - RNA, 22 nt, Chlamydophila pneumoniae J138
agauuuuuagggacuauaauuu

SEQ ID NO: 4517 - RNA, 22 nt, Chlamydophila pneumoniae J138
agcaaaggaacuuauauucgca

SEQ ID NO: 4518 - RNA, 22 nt, Chlamydophila pneumoniae J138
agcaaggcuuuguaaaacguuc

SEQ ID NO: 4519 - RNA, 22 nt, Chlamydophila pneumoniae J138
agcacccaaaccugcaggagau

SEQ ID NO: 4520 - RNA, 20 nt, Chlamydophila pneumoniae J138
agccaucuggagauacuagg

SEQ ID NO: 4521 - RNA, 22 nt, Chlamydophila pneumoniae J138
agcccgagguacuacaaggcga

SEQ ID NO: 4522 - RNA, 22 nt, Chlamydophila pneumoniae J138
agcgaagaucuucagccuuuac

SEQ ID NO: 4523 - RNA, 22 nt, Chlamydophila pneumoniae J138
aggaaaagucgcgaagcguuau

SEQ ID NO: 4524 - RNA, 22 nt, Chlamydophila pneumoniae J138
aggaguguagccuaaagaguau

SEQ ID NO: 4525 - RNA, 21 nt, Chlamydophila pneumoniae J138
aggcuccuacuugccauucau

SEQ ID NO: 4526 - RNA, 22 nt, Chlamydophila pneumoniae J138
aggcucuucuaaaagacauagu

SEQ ID NO: 4527 - RNA, 22 nt, Chlamydophila pneumoniae J138
aggguuugaaucuuuagaagau

SEQ ID NO: 4528 - RNA, 22 nt, Chlamydophila pneumoniae J138
agguaagggauaugugacuucu

SEQ ID NO: 4529 - RNA, 22 nt, Chlamydophila pneumoniae J138
aguaagaacuucguuucagcac

SEQ ID NO: 4530 - RNA, 22 nt, Chlamydophila pneumoniae J138
gauucuguggaguaugcaucca

SEQ ID NO: 4531 - RNA, 22 nt, Chlamydophila pneumoniae J138
gauuuggaucaccaaagaaaau

SEQ ID NO: 4532 - RNA, 22 nt, Chlamydophila pneumoniae J138
gauuuuccaaaagcauauaacu

SEQ ID NO: 4533 - RNA, 22 nt, Chlamydophila pneumoniae J138
gcaaguagugaaaucuacugcg

SEQ ID NO: 4534 - RNA, 23 nt, Chlamydophila pneumoniae J138
gcaaucuuaaugacgaucuccuu

SEQ ID NO: 4535 - RNA, 22 nt, Chlamydophila pneumoniae J138
gcagggcuugauagagcgucuc

SEQ ID NO: 4536 - RNA, 22 nt, Chlamydophila pneumoniae J138
gcauuccauuuccaagcuuaua

SEQ ID NO: 4537 - RNA, 23 nt, Chlamydophila pneumoniae J138
gcuagcaauuucaaugagaagua

SEQ ID NO: 4538 - RNA, 22 nt, Chlamydophila pneumoniae J138
gcucuauaauagggugcguaua

SEQ ID NO: 4539 - RNA, 22 nt, Chlamydophila pneumoniae J138
gcucuggcuuuuucaacucaaa

SEQ ID NO: 4540 - RNA, 22 nt, Chlamydophila pneumoniae J138
ggacuucuugaaagaauacccu

SEQ ID NO: 4541 - RNA, 22 nt, Chlamydophila pneumoniae J138
ggagacaguuugcuuuaucucu

SEQ ID NO: 4542 - RNA, 22 nt, Chlamydophila pneumoniae J138
uuauauugcucguauccgucaa

SEQ ID NO: 4543 - RNA, 22 nt, Chlamydophila pneumoniae J138
uuauuguucuuggugaaucugu

SEQ ID NO: 4544 - RNA, 22 nt, Chlamydophila pneumoniae J138
uuccauucagaacggaagccua

SEQ ID NO: 4545 - RNA, 22 nt, Chlamydophila pneumoniae J138
uucccagaaguacguggagcua

SEQ ID NO: 4546 - RNA, 22 nt, Chlamydophila pneumoniae J138
uuccggaugauccuuuugcuau

SEQ ID NO: 4547 - RNA, 22 nt, Chlamydophila pneumoniae J138
uucuacaauuccuauagcucaa

SEQ ID NO: 4548 - RNA, 23 nt, Chlamydophila pneumoniae J138
uucucaaagcaacgcgacucccu

SEQ ID NO: 4549 - RNA, 22 nt, Chlamydophila pneumoniae J138
uucuggaguggcuuuaacgaua

SEQ ID NO: 4550 - RNA, 22 nt, Chlamydophila pneumoniae J138
uucugguuuuucgauuuggaag

SEQ ID NO: 4551 - RNA, 22 nt, Chlamydophila pneumoniae J138
uucuuuagagcacucggggaga

SEQ ID NO: 4552 - RNA, 22 nt, Chlamydophila pneumoniae J138
uucuuuuucuaugaugaugagu

SEQ ID NO: 4553 - RNA, 22 nt, Chlamydophila pneumoniae J138
uugaaagauacccggaugauuc

SEQ ID NO: 4554 - RNA, 22 nt, Chlamydophila pneumoniae J138
uugaccagaugcaugagaauag

SEQ ID NO: 4555 - RNA, 22 nt, Chlamydophila pneumoniae J138
uugagcaaucaacuagggguaa

SEQ ID NO: 4556 - RNA, 22 nt, Chlamydophila pneumoniae J138
uugcauuuaaacuaagaauacc

SEQ ID NO: 4557 - RNA, 22 nt, Chlamydophila pneumoniae J138
uugcuuccaaucgaaguuuggu

SEQ ID NO: 4558 - RNA, 22 nt, Chlamydophila pneumoniae J138
uuggagaguuuuuuaccaucug

SEQ ID NO: 4559 - RNA, 17 nt, Chlamydophila pneumoniae J138
uuggaguuccguguauc

SEQ ID NO: 4560 - RNA, 22 nt, Chlamydophila pneumoniae J138
uugguuuugagacucuccuaca

SEQ ID NO: 4561 - RNA, 22 nt, Chlamydophila pneumoniae J138
uuguaggguuauuguccucugu

SEQ ID NO: 4562 - RNA, 22 nt, Chlamydophila pneumoniae J138
uuguccaugccgacucugggaa

SEQ ID NO: 4563 - RNA, 22 nt, Chlamydophila pneumoniae J138
uugucuuguguuggauaagcuu

SEQ ID NO: 4564 - RNA, 20 nt, Chlamydophila pneumoniae J138
uuguggacuccuaaauaucu

SEQ ID NO: 4565 - RNA, 23 nt, Chlamydophila pneumoniae J138
uuucaucaacugcguaguucaug

SEQ ID NO: 4566 - RNA, 22 nt, Chlamydophila pneumoniae J138
uuucccuauguauggauucuca

SEQ ID NO: 4567 - RNA, 22 nt, Chlamydophila pneumoniae J138
uuucuaauuauuguuuuggaag

SEQ ID NO: 4568 - RNA, 20 nt, Chlamydophila pneumoniae J138
uuucucuacaaacaggaauu

SEQ ID NO: 4569 - RNA, 22 nt, Chlamydophila pneumoniae J138
uuucucuuaagaugcgugguau

SEQ ID NO: 4570 - RNA, 22 nt, Chlamydophila pneumoniae J138
uuucuggagaaucccgugaucu

SEQ ID NO: 4571 - RNA, 22 nt, Chlamydophila pneumoniae J138
uuuuguggccaccaggcaaacu

SEQ ID NO: 4572 - RNA, 23 nt, Chlamydophila pneumoniae J138
uuuuuaaaccuauaggagacauc

SEQ ID NO: 4573 - RNA, 22 nt, Chlamydophila pneumoniae J138
uuuuuaaaucaucuucagcaag

SEQ ID NO: 4574 - RNA, 19 nt, Chlamydophila pneumoniae J138
ggaguuucgggaucaggaa

SEQ ID NO: 4575 - RNA, 22 nt, Chlamydophila pneumoniae J138
ggauuuaaauugggauucccag

SEQ ID NO: 4576 - RNA, 22 nt, Chlamydophila pneumoniae J138
ggcauuuuggaaagaguuuacc

SEQ ID NO: 4577 - RNA, 22 nt, Chlamydophila pneumoniae J138
ggcuuuguuuuucagaaauaga

SEQ ID NO: 4578 - RNA, 22 nt, Chlamydophila pneumoniae J138
gggggaaagccaagaagaugua

SEQ ID NO: 4579 - RNA, 22 nt, Chlamydophila pneumoniae J138
ggucgcaccccggaaggguaga

SEQ ID NO: 4580 - RNA, 22 nt, Chlamydophila pneumoniae J138
ggucucaugucuccuaaguuaa

SEQ ID NO: 4581 - RNA, 22 nt, Chlamydophila pneumoniae J138
ggucuucaagccaaaugaucag

SEQ ID NO: 4582 - RNA, 22 nt, Chlamydophila pneumoniae J138
gguguucaucagagaugugagg

SEQ ID NO: 4583 - RNA, 22 nt, Chlamydophila pneumoniae J138
guagguuugaggaucggauuag

SEQ ID NO: 4584 - RNA, 22 nt, Chlamydophila pneumoniae J138
gugaaucauucgaugaaggaag

SEQ ID NO: 4585 - RNA, 22 nt, Chlamydophila pneumoniae J138
gugagagcgaucucuggaacaa

SEQ ID NO: 4586 - RNA, 22 nt, Chlamydophila pneumoniae J138
gugcuaugagaucuuuugggcu

SEQ ID NO: 4587 - RNA, 22 nt, Chlamydophila pneumoniae J138
guucccuagggaagacugagga

SEQ ID NO: 4588 - RNA, 19 nt, Chlamydophila pneumoniae J138
guucuaguaggacucgaga

SEQ ID NO: 4589 - RNA, 22 nt, Chlamydophila pneumoniae J138
guucuagugaucuaaguacgaa

SEQ ID NO: 4590 - RNA, 22 nt, Chlamydophila pneumoniae J138
guucuuuauuauacuccugaca

SEQ ID NO: 4591 - RNA, 22 nt, Chlamydophila pneumoniae J138
guuuugcuggaagagccucuaa

SEQ ID NO: 4592 - RNA, 22 nt, Chlamydophila pneumoniae J138
guuuugugaucaggagaguauu

SEQ ID NO: 4593 - RNA, 22 nt, Chlamydophila pneumoniae J138
uaaaguuuugcugcgggcuccc

SEQ ID NO: 4594 - RNA, 22 nt, Chlamydophila pneumoniae J138
uaaugacaacuuaguuucuuuu

SEQ ID NO: 4595 - RNA, 22 nt, Chlamydophila pneumoniae J138
uaaugagggggaguguuuugga

SEQ ID NO: 4596 - RNA, 22 nt, Chlamydophila pneumoniae J138
uacaagauucaagcaagaucca

SEQ ID NO: 4597 - RNA, 22 nt, Chlamydophila pneumoniae J138
uacagauucaccaagaacaaua

SEQ ID NO: 4598 - RNA, 22 nt, Chlamydophila pneumoniae J138
uagaaaauuuuaguggucagcu

SEQ ID NO: 4599 - RNA, 22 nt, Chlamydophila pneumoniae J138
uagaauaucugagggauaggua

SEQ ID NO: 4600 - RNA, 22 nt, Chlamydophila pneumoniae J138
uagagcucuuaagcaggagauc

SEQ ID NO: 4601 - RNA, 22 nt, Chlamydophila pneumoniae J138
uagagcuuaaauuuacgaaaug

SEQ ID NO: 4602 - RNA, 22 nt, Chlamydophila pneumoniae J138
uagagcuuccguaguucccgau

SEQ ID NO: 4603 - RNA, 22 nt, Chlamydophila pneumoniae J138
uagauauucaugguauuuuagc

SEQ ID NO: 4604 - RNA, 22 nt, Chlamydophila pneumoniae J138
uagcaagcuuccgcagcuuuuu

SEQ ID NO: 4605 - RNA, 22 nt, Chlamydophila pneumoniae J138
uaggauaguauagugaggagau

SEQ ID NO: 4606 - RNA, 22 nt, Chlamydophila pneumoniae J138
uaguaccugcucuuuuguacga

SEQ ID NO: 4607 - RNA, 22 nt, Chlamydophila pneumoniae J138
uaucuuggacuaucuuauugua

SEQ ID NO: 4608 - RNA, 22 nt, Chlamydophila pneumoniae J138
uauguuuagagaagacgauagg

SEQ ID NO: 4609 - RNA, 22 nt, Chlamydophila pneumoniae J138
uauucgacuguugcugcucuaa

SEQ ID NO: 4610 - RNA, 22 nt, Chlamydophila pneumoniae J138
uauuucagcuuaugucaaaggu

SEQ ID NO: 4611 - RNA, 22 nt, Chlamydophila pneumoniae J138
uauuuucuuuguagcuaccaau

SEQ ID NO: 4612 - RNA, 23 nt, Chlamydophila pneumoniae J138
ucagucucuagaggagcucuuug

SEQ ID NO: 4613 - RNA, 22 nt, Chlamydophila pneumoniae J138
ucaucgaacuccaaguauuguu

SEQ ID NO: 4614 - RNA, 22 nt, Chlamydophila pneumoniae J138
uccaggauuuuucguccuuaca

SEQ ID NO: 4615 - RNA, 22 nt, Chlamydophila pneumoniae J138
ucccuuuggauccagaagcuaa

SEQ ID NO: 4616 - RNA, 22 nt, Chlamydophila pneumoniae J138
uccuauuuucaugagaaagggg

SEQ ID NO: 4617 - RNA, 22 nt, Chlamydophila pneumoniae J138
uccuguagagccuauuuaugau

SEQ ID NO: 4618 - RNA, 22 nt, Chlamydophila pneumoniae J138
ucuagauguaaaaaaagaucgu

SEQ ID NO: 4619 - RNA, 22 nt, Chlamydophila pneumoniae J138
ucuccucccagcaauuucucgu

SEQ ID NO: 4620 - RNA, 22 nt, Chlamydophila pneumoniae J138
ucugaaacgacuuguuuccaug

SEQ ID NO: 4621 - RNA, 22 nt, Chlamydophila pneumoniae J138
ucugaaguccuagcauugaaag

SEQ ID NO: 4622 - RNA, 22 nt, Chlamydophila pneumoniae J138
ucugcuguuuauaggggucuag

SEQ ID NO: 4623 - RNA, 22 nt, Chlamydophila pneumoniae J138
ucuggaauucuuuaugcuguaa

SEQ ID NO: 4624 - RNA, 22 nt, Chlamydophila pneumoniae J138
ucuguauugucccagacaacca

SEQ ID NO: 4625 - RNA, 17 nt, Chlamydophila pneumoniae J138
ucuugagcaucuuuuaa

SEQ ID NO: 4626 - RNA, 22 nt, Chlamydophila pneumoniae J138
ucuugggcaaugauggagaggu

SEQ ID NO: 4627 - RNA, 22 nt, Chlamydophila pneumoniae J138
ucuuugauaaugauagauuucg

SEQ ID NO: 4628 - RNA, 22 nt, Chlamydophila pneumoniae J138
ugaagcauuugcucuuugggaa

SEQ ID NO: 4629 - RNA, 22 nt, Chlamydophila pneumoniae J138
ugagacuguuaaagauuuuauc

SEQ ID NO: 4630 - RNA, 22 nt, Chlamydophila pneumoniae J138
ugaggaugcgaucauuaucucu

SEQ ID NO: 4631 - RNA, 22 nt, Chlamydophila pneumoniae J138
ugagugucgacagacaauagca

SEQ ID NO: 4632 - RNA, 22 nt, Chlamydophila pneumoniae J138
ugauaggaauuuuucaaucuga

SEQ ID NO: 4633 - RNA, 22 nt, Chlamydophila pneumoniae J138
ugauuuugcuucgcagcuugaa

SEQ ID NO: 4634 - RNA, 22 nt, Chlamydophila pneumoniae J138
ugcaggaagaaagauuucuucu

SEQ ID NO: 4635 - RNA, 22 nt, Chlamydophila pneumoniae J138
ugcaugauucucccuacguggc

SEQ ID NO: 4636 - RNA, 22 nt, Chlamydophila pneumoniae J138
ugcaugcuaaccuuccagagga

SEQ ID NO: 4637 - RNA, 22 nt, Chlamydophila pneumoniae J138
ugccgcuacccaucaagauucu

SEQ ID NO: 4638 - RNA, 22 nt, Chlamydophila pneumoniae J138
ugccugcuucucaagauacucg

SEQ ID NO: 4639 - RNA, 22 nt, Chlamydophila pneumoniae J138
ugcuuacaguaugacgaggucu

SEQ ID NO: 4640 - RNA, 22 nt, Chlamydophila pneumoniae J138
ugcuuuuagguaggacgucacu

SEQ ID NO: 4641 - RNA, 22 nt, Chlamydophila pneumoniae J138
uggaggagcagguucaucuuuu

SEQ ID NO: 4642 - RNA, 22 nt, Chlamydophila pneumoniae J138
aguauagcgaaauaugcaaucu

SEQ ID NO: 4643 - RNA, 22 nt, Chlamydophila pneumoniae J138
agugaugccuuugauuacgaaa

SEQ ID NO: 4644 - RNA, 22 nt, Chlamydophila pneumoniae J138
agugucuuuuguaucgcguaac

SEQ ID NO: 4645 - RNA, 22 nt, Chlamydophila pneumoniae J138
aguucagacuauuuuccuuuga

SEQ ID NO: 4646 - RNA, 22 nt, Chlamydophila pneumoniae J138
aguuccuguagaugaagaagca

SEQ ID NO: 4647 - RNA, 22 nt, Chlamydophila pneumoniae J138
aguuuuaccuuuaagugugauu

SEQ ID NO: 4648 - RNA, 22 nt, Chlamydophila pneumoniae J138
auaacgcaaaugaggucgacuu

SEQ ID NO: 4649 - RNA, 21 nt, Chlamydophila pneumoniae J138
auaguaaguucaugcuuguua

SEQ ID NO: 4650 - RNA, 22 nt, Chlamydophila pneumoniae J138
auaguccaagaugaaaucauug

SEQ ID NO: 4651 - RNA, 22 nt, Chlamydophila pneumoniae J138
auauagauagaauuuuacagga

SEQ ID NO: 4652 - RNA, 22 nt, Chlamydophila pneumoniae J138
auauaguucuucagcaaagaua

SEQ ID NO: 4653 - RNA, 21 nt, Chlamydophila pneumoniae J138
aucaaacuauagaggaugcug

SEQ ID NO: 4654 - RNA, 22 nt, Chlamydophila pneumoniae J138
aucacgguuccuggaguaugga

SEQ ID NO: 4655 - RNA, 22 nt, Chlamydophila pneumoniae J138
auccaagauaucggaaugaagg

SEQ ID NO: 4656 - RNA, 22 nt, Chlamydophila pneumoniae J138
aucugcaauguguucuuuauuu

SEQ ID NO: 4657 - RNA, 22 nt, Chlamydophila pneumoniae J138
aucugccuuguaaauaaguaug

SEQ ID NO: 4658 - RNA, 22 nt, Chlamydophila pneumoniae J138
aucuuuucuuaggcgggaauag

SEQ ID NO: 4659 - RNA, 22 nt, Chlamydophila pneumoniae J138
augaugagggacccucccuagg

SEQ ID NO: 4660 - RNA, 22 nt, Chlamydophila pneumoniae J138
augcuugcuuaggaucguuguu

SEQ ID NO: 4661 - RNA, 22 nt, Chlamydophila pneumoniae J138
auguauggcacuaaagaguuua

SEQ ID NO: 4662 - RNA, 22 nt, Chlamydophila pneumoniae J138
auguuccaagagaagaaagagu

SEQ ID NO: 4663 - RNA, 22 nt, Chlamydophila pneumoniae J138
auguuuguaguguugaauaaga

SEQ ID NO: 4664 - RNA, 22 nt, Chlamydophila pneumoniae J138
auucugaucauaucuccgggau

SEQ ID NO: 4665 - RNA, 22 nt, Chlamydophila pneumoniae J138
auucuucuuuagaaggaaaaug

SEQ ID NO: 4666 - RNA, 21 nt, Chlamydophila pneumoniae J138
auugaucucaucacuaguuuc

SEQ ID NO: 4667 - RNA, 22 nt, Chlamydophila pneumoniae J138
auugugaaugcuauuuuguaaa

SEQ ID NO: 4668 - RNA, 22 nt, Chlamydophila pneumoniae J138
auuguguuuauagaaggccaga

SEQ ID NO: 4669 - RNA, 22 nt, Chlamydophila pneumoniae J138
auuuuaucuauagcacuuugcu

SEQ ID NO: 4670 - RNA, 22 nt, Chlamydophila pneumoniae J138
caaacuaaagagcuugaguuug

SEQ ID NO: 4671 - RNA, 22 nt, Chlamydophila pneumoniae J138
cacauuaucuaggucguugugu

SEQ ID NO: 4672 - RNA, 22 nt, Chlamydophila pneumoniae J138
cauuuaaaccaaucggaagaga

SEQ ID NO: 4673 - RNA, 22 nt, Chlamydophila pneumoniae J138
ccauaccaaagaagugguuccu

SEQ ID NO: 4674 - RNA, 22 nt, Chlamydophila pneumoniae J138
cccguauacgauuaaucacaga

SEQ ID NO: 4675 - RNA, 22 nt, Chlamydophila pneumoniae J138
ccgacgcucucgacggaucaua

SEQ ID NO: 4676 - RNA, 22 nt, Chlamydophila pneumoniae J138
ccuagaauuuaauccuaaugau

SEQ ID NO: 4677 - RNA, 22 nt, Chlamydophila pneumoniae J138
ccuggauuuucaagucuuuuga

SEQ ID NO: 4678 - RNA, 22 nt, Chlamydophila pneumoniae J138
ccuguaacuacauuuucuuuag

SEQ ID NO: 4679 - RNA, 22 nt, Chlamydophila pneumoniae J138
cgaaagcuuuaggagccuaugu

SEQ ID NO: 4680 - RNA, 22 nt, Chlamydophila pneumoniae J138
cgaaauaugaguacccuuuauu

SEQ ID NO: 4681 - RNA, 22 nt, Chlamydophila pneumoniae J138
cgacuuagaucuuuucuacuuc

SEQ ID NO: 4682 - RNA, 22 nt, Chlamydophila pneumoniae J138
cgcaugaggaauaagauaguaa

SEQ ID NO: 4683 - RNA, 22 nt, Chlamydophila pneumoniae J138
cgcuagcaguaccagcagcuuu

SEQ ID NO: 4684 - RNA, 22 nt, Chlamydophila pneumoniae J138
cgcuuucuucagacaguucaag

SEQ ID NO: 4685 - RNA, 22 nt, Chlamydophila pneumoniae J138
cggagagauauucugaucuaca

SEQ ID NO: 4686 - RNA, 22 nt, Chlamydophila pneumoniae J138
cuaaaagcuuuucugcauacac

SEQ ID NO: 4687 - RNA, 23 nt, Chlamydophila pneumoniae J138
cuaaagacuccacaaugauuaca

SEQ ID NO: 4688 - RNA, 22 nt, Chlamydophila pneumoniae J138
cuaaauauugaccuuuagcugc

SEQ ID NO: 4689 - RNA, 22 nt, Chlamydophila pneumoniae J138
cuaagauuccucuauuuccugc

SEQ ID NO: 4690 - RNA, 22 nt, Chlamydophila pneumoniae J138
cuacugauacagacugcgagca

SEQ ID NO: 4691 - RNA, 19 nt, Chlamydophila pneumoniae J138
cuagcguaaagcaauuuug

SEQ ID NO: 4692 - RNA, 22 nt, Chlamydophila pneumoniae J138
cuaguucuuauucaugucuuac

SEQ ID NO: 4693 - RNA, 21 nt, Chlamydophila pneumoniae J138
cuaucagaggggccuauauuu

SEQ ID NO: 4694 - RNA, 22 nt, Chlamydophila pneumoniae J138
cuauguaguugccuggauugau

SEQ ID NO: 4695 - RNA, 23 nt, Chlamydophila pneumoniae J138
cucaggaaaaacgacaacagcgg

SEQ ID NO: 4696 - RNA, 22 nt, Chlamydophila pneumoniae J138
cuccagaucaagcuucacgucc

SEQ ID NO: 4697 - RNA, 22 nt, Chlamydophila pneumoniae J138
cucuggguucugcuggggauug

SEQ ID NO: 4698 - RNA, 22 nt, Chlamydophila pneumoniae J138
cucuucaggaucggcauuauuu

SEQ ID NO: 4699 - RNA, 22 nt, Chlamydophila pneumoniae J138
cugcgagaauaaauuuugucuu

SEQ ID NO: 4700 - RNA, 22 nt, Chlamydophila pneumoniae J138
cuguaucuucgacaacaugguu

SEQ ID NO: 4701 - RNA, 22 nt, Chlamydophila pneumoniae J138
cugugcucuugaagauuguguc

SEQ ID NO: 4702 - RNA, 22 nt, Chlamydophila pneumoniae J138
cuguuuuuucauaguauccuua

SEQ ID NO: 4703 - RNA, 21 nt, Chlamydophila pneumoniae J138
cuuacgaguuuccuggaguuu

SEQ ID NO: 4704 - RNA, 22 nt, Chlamydophila pneumoniae J138
cuuguucugguuuaauuaugau

SEQ ID NO: 4705 - RNA, 22 nt, Chlamydophila pneumoniae J138
cuuuaugaauuaggccuugugu

SEQ ID NO: 4706 - RNA, 22 nt, Chlamydophila pneumoniae J138
cuuuuaaagauaaggaccaggu

SEQ ID NO: 4707 - RNA, 22 nt, Chlamydophila pneumoniae J138
gaaagaugacgaccgcccuuua

SEQ ID NO: 4708 - RNA, 22 nt, Chlamydophila pneumoniae J138
gaaccauauacugagcuuccuc

SEQ ID NO: 4709 - RNA, 22 nt, Chlamydophila pneumoniae J138
gaagcucaggaucugucaguuc

SEQ ID NO: 4710 - RNA, 22 nt, Chlamydophila pneumoniae J138
gaaggacaacuacguuaucauu

SEQ ID NO: 4711 - RNA, 22 nt, Chlamydophila pneumoniae J138
gaaggauaguuucucuaugaua

SEQ ID NO: 4712 - RNA, 22 nt, Chlamydophila pneumoniae J138
gaauuauuggaaagggaggcau

SEQ ID NO: 4713 - RNA, 22 nt, Chlamydophila pneumoniae J138
gagaagaguuaaaauaaugacg

SEQ ID NO: 4714 - RNA, 22 nt, Chlamydophila pneumoniae J138
gagaggggaagaaaaauagcca

SEQ ID NO: 4715 - RNA, 22 nt, Chlamydophila pneumoniae J138
gagaguauagggguguuucgga

SEQ ID NO: 4716 - RNA, 20 nt, Chlamydophila pneumoniae J138
gaggaaaaggguccugaauu

SEQ ID NO: 4717 - RNA, 22 nt, Chlamydophila pneumoniae J138
gaggaaaucauugcuaugggug

SEQ ID NO: 4718 - RNA, 22 nt, Chlamydophila pneumoniae J138
gaggaauuacaaauucaugaga

SEQ ID NO: 4719 - RNA, 22 nt, Chlamydophila pneumoniae J138
gaggauauuuucuugguaaguu

SEQ ID NO: 4720 - RNA, 22 nt, Chlamydophila pneumoniae J138
gaggaugucguccugucggucu

SEQ ID NO: 4721 - RNA, 22 nt, Chlamydophila pneumoniae J138
gagucuucacuucccgcaguuu

SEQ ID NO: 4722 - RNA, 22 nt, Chlamydophila pneumoniae J138
gauauguauguaaaggcucuuc

SEQ ID NO: 4723 - RNA, 22 nt, Chlamydophila pneumoniae J138
gauucaauuucagaagaacgcu

SEQ ID NO: 4724 - RNA, 22 nt, Chlamydophila pneumoniae J138
uggcuauucucuuugguauagg

SEQ ID NO: 4725 - RNA, 22 nt, Chlamydophila pneumoniae J138
uggucugaagcucaugcaauuu

SEQ ID NO: 4726 - RNA, 22 nt, Chlamydophila pneumoniae J138
uguagagauaugaauguuuccc

SEQ ID NO: 4727 - RNA, 20 nt, Chlamydophila pneumoniae J138
ugucucugaaaaagagagcc

SEQ ID NO: 4728 - RNA, 22 nt, Chlamydophila pneumoniae J138
ugugauuaucuguggagaccag

SEQ ID NO: 4729 - RNA, 22 nt, Chlamydophila pneumoniae J138
uguguagcaaaggcgugucgua

SEQ ID NO: 4730 - RNA, 22 nt, Chlamydophila pneumoniae J138
uguguucuuugcagaacucaac

SEQ ID NO: 4731 - RNA, 22 nt, Chlamydophila pneumoniae J138
uguuucaggacguuuguauuua

SEQ ID NO: 4732 - RNA, 22 nt, Chlamydophila pneumoniae J138
uuaaaaaugcucaagauuugcg

SEQ ID NO: 4733 - RNA, 22 nt, Chlamydophila pneumoniae J138
uuacaacucagggauuuguucu

SEQ ID NO: 4734 - RNA, 22 nt, Chlamydophila pneumoniae J138
uuacgagaaaaguuagaauuua

SEQ ID NO: 4735 - RNA, 22 nt, Chlamydophila pneumoniae J138
uuagaauuauacgugccuguca

SEQ ID NO: 4736 - RNA, 22 nt, Chlamydophila pneumoniae J138
uuaggaucggcagaauuaccaa

SEQ ID NO: 4737 - RNA, 22 nt, Chlamydophila pneumoniae J138
uuaggcaugggccuuuccgaau

SEQ ID NO: 4738 - RNA, 22 nt, Chlamydophila pneumoniae J138
agaguucugcugcugcuagacc

SEQ ID NO: 4739 - RNA, 22 nt, Chlamydophila pneumoniae J138
agcagcuucgggaccaagcagu

SEQ ID NO: 4740 - RNA, 22 nt, Chlamydophila pneumoniae J138
agcaggauuuuacuguauuucu

SEQ ID NO: 4741 - RNA, 22 nt, Chlamydophila pneumoniae J138
agcgaugcauugaaauuuucuu

SEQ ID NO: 4742 - RNA, 22 nt, Chlamydophila pneumoniae J138
agcucaauuggauagaguaccu

SEQ ID NO: 4743 - RNA, 22 nt, Chlamydophila pneumoniae J138
agcuucucgaauuucuaauguu

SEQ ID NO: 4744 - RNA, 22 nt, Chlamydophila pneumoniae J138
agcuuuuggauauccuuccuua

SEQ ID NO: 4745 - RNA, 22 nt, Chlamydophila pneumoniae J138
aggaaggauuaugagcuguggu

SEQ ID NO: 4746 - RNA, 22 nt, Chlamydophila pneumoniae J138
aggacggaucuuuuuacuuagc

SEQ ID NO: 4747 - RNA, 19 nt, Chlamydophila pneumoniae J138
aggagaaccaagaacauuu

SEQ ID NO: 4748 - RNA, 22 nt, Chlamydophila pneumoniae J138
aggagauccuacaauugccauu

SEQ ID NO: 4749 - RNA, 22 nt, Chlamydophila pneumoniae J138
aggagauuuucucacuuacagc

SEQ ID NO: 4750 - RNA, 22 nt, Chlamydophila pneumoniae J138
aggauguuguuauugaaccgua

SEQ ID NO: 4751 - RNA, 22 nt, Chlamydophila pneumoniae J138
aggcuucuugguuauuuaggua

SEQ ID NO: 4752 - RNA, 22 nt, Chlamydophila pneumoniae J138
aggguucaauacuauggauuua

SEQ ID NO: 4753 - RNA, 22 nt, Chlamydophila pneumoniae J138
agguguagagggaugacauuca

SEQ ID NO: 4754 - RNA, 22 nt, Chlamydophila pneumoniae J138
auaauucaaugauuugauugug

SEQ ID NO: 4755 - RNA, 22 nt, Chlamydophila pneumoniae J138
auacauuucugcgauguugugg

SEQ ID NO: 4756 - RNA, 22 nt, Chlamydophila pneumoniae J138
auaccaaaaugugauuuugagg

SEQ ID NO: 4757 - RNA, 22 nt, Chlamydophila pneumoniae J138
auagauuugcugauuuucccag

SEQ ID NO: 4758 - RNA, 22 nt, Chlamydophila pneumoniae J138
auagcagcuacuaagagaagug

SEQ ID NO: 4759 - RNA, 22 nt, Chlamydophila pneumoniae J138
auagccaauaaggagaucguca

SEQ ID NO: 4760 - RNA, 22 nt, Chlamydophila pneumoniae J138
auaggaauccuuagcuucuuga

SEQ ID NO: 4761 - RNA, 22 nt, Chlamydophila pneumoniae J138
aucaucuuauauaauggagugg

SEQ ID NO: 4762 - RNA, 22 nt, Chlamydophila pneumoniae TW-183
aaugucucucagguuuauuccu

SEQ ID NO: 4763 - RNA, 21 nt, Chlamydophila pneumoniae TW-183
aauuccucacuuccuuuaccu

SEQ ID NO: 4764 - RNA, 22 nt, Chlamydophila pneumoniae TW-183
aauuggauaggguuucuugagg

SEQ ID NO: 4765 - RNA, 21 nt, Chlamydophila pneumoniae TW-183
acaagaaucacaguucuauca

SEQ ID NO: 4766 - RNA, 22 nt, Chlamydophila pneumoniae TW-183
acuccucuaucguauuggggau

SEQ ID NO: 4767 - RNA, 22 nt, Chlamydophila pneumoniae TW-183
agaacaaaccucagagcuaguu

SEQ ID NO: 4768 - RNA, 22 nt, Chlamydophila pneumoniae TW-183
agagaaggugaaaaucggggaa

SEQ ID NO: 4769 - RNA, 22 nt, Chlamydophila pneumoniae TW-183
agcaagaguugucaaaaugaua

SEQ ID NO: 4770 - RNA, 22 nt, Chlamydophila pneumoniae TW-183
agcuucucgaauuucuaauguu

SEQ ID NO: 4771 - RNA, 22 nt, Chlamydophila pneumoniae TW-183
aggaaaagucgcgaagcguuau

SEQ ID NO: 4772 - RNA, 22 nt, Chlamydophila pneumoniae TW-183
aggaaaccaucuucucucuuug

SEQ ID NO: 4773 - RNA, 22 nt, Chlamydophila pneumoniae TW-183
agugaugccuuugauuacgaaa

SEQ ID NO: 4774 - RNA, 22 nt, Chlamydophila pneumoniae TW-183
agugcuucgauguagcgagaaa

SEQ ID NO: 4775 - RNA, 22 nt, Chlamydophila pneumoniae TW-183
aguuuuaccuuuaagugugauu

SEQ ID NO: 4776 - RNA, 22 nt, Chlamydophila pneumoniae TW-183
auaaaucuguacaagauccucu

SEQ ID NO: 4777 - RNA, 22 nt, Chlamydophila pneumoniae TW-183
auaacgcaaaugaggucgacuu

SEQ ID NO: 4778 - RNA, 22 nt, Chlamydophila pneumoniae TW-183
auccugaagauauucaggcaau

SEQ ID NO: 4779 - RNA, 22 nt, Chlamydophila pneumoniae TW-183
aucuuuaggacuugaugaaggc

SEQ ID NO: 4780 - RNA, 23 nt, Chlamydophila pneumoniae TW-183
aucuuuccagucuucugagaugc

SEQ ID NO: 4781 - RNA, 22 nt, Chlamydophila pneumoniae TW-183
auucuagaugguguaacuuuuu

SEQ ID NO: 4782 - RNA, 22 nt, Chlamydophila pneumoniae TW-183
auuggggauuguuacgauagac

SEQ ID NO: 4783 - RNA, 22 nt, Chlamydophila pneumoniae TW-183
auugugaaugcuauuuuguaaa

SEQ ID NO: 4784 - RNA, 20 nt, Chlamydophila pneumoniae TW-183
auuuucugaucacgaaguuu

SEQ ID NO: 4785 - RNA, 22 nt, Chlamydophila pneumoniae TW-183
cacaaccaaaacgugcgcaggg

SEQ ID NO: 4786 - RNA, 22 nt, Chlamydophila pneumoniae TW-183
cauucuuuaaccaagggaaucu

SEQ ID NO: 4787 - RNA, 22 nt, Chlamydophila pneumoniae TW-183
cauuguuccuuuaagauuucug

SEQ ID NO: 4788 - RNA, 22 nt, Chlamydophila pneumoniae TW-183
cccguauacgauuaaucacaga

SEQ ID NO: 4789 - RNA, 20 nt, Chlamydophila pneumoniae TW-183
ccucaauuagggcuaaagau

SEQ ID NO: 4790 - RNA, 22 nt, Chlamydophila pneumoniae TW-183
cgaguauuuuuucauguccgca

SEQ ID NO: 4791 - RNA, 22 nt, Chlamydophila pneumoniae TW-183
cuaguuuugacguaggaagagg

SEQ ID NO: 4792 - RNA, 22 nt, Chlamydophila pneumoniae TW-183
cugcucaaugguuuuaggaauc

SEQ ID NO: 4793 - RNA, 22 nt, Chlamydophila pneumoniae TW-183
cuggagacgcuuggaaagaagc

SEQ ID NO: 4794 - RNA, 22 nt, Chlamydophila pneumoniae TW-183
cugugcucuugaagauuguguc

SEQ ID NO: 4795 - RNA, 22 nt, Chlamydophila pneumoniae TW-183
cuugauagaacugugauucuug

SEQ ID NO: 4796 - RNA, 22 nt, Chlamydophila pneumoniae TW-183
gaaagaugacgaccgcccuuua

SEQ ID NO: 4797 - RNA, 22 nt, Chlamydophila pneumoniae TW-183
gaagcucaggaucugucaguuc

SEQ ID NO: 4798 - RNA, 22 nt, Chlamydophila pneumoniae TW-183
gaaggauaguuucucuaugaua

SEQ ID NO: 4799 - RNA, 22 nt, Chlamydophila pneumoniae TW-183
gaauugaacucuaaggacuacu

SEQ ID NO: 4800 - RNA, 22 nt, Chlamydophila pneumoniae TW-183
gagagauuuuuucauacuuauc

SEQ ID NO: 4801 - RNA, 19 nt, Chlamydophila pneumoniae TW-183
gaggaaaaggguccugaau

SEQ ID NO: 4802 - RNA, 22 nt, Chlamydophila pneumoniae TW-183
gaggaauuuuugcguaauguuc

SEQ ID NO: 4803 - RNA, 22 nt, Chlamydophila pneumoniae TW-183
gagugguucuuccuaaagaacu

SEQ ID NO: 4804 - RNA, 22 nt, Chlamydophila pneumoniae TW-183
gaugguaaaauuguuauaggaa

SEQ ID NO: 4805 - RNA, 22 nt, Chlamydophila pneumoniae TW-183
gauucuguggaguaugcaucca

SEQ ID NO: 4806 - RNA, 22 nt, Chlamydophila pneumoniae TW-183
gcagguggugcauggacuccuc

SEQ ID NO: 4807 - RNA, 22 nt, Chlamydophila pneumoniae TW-183
gccaaggcucuugcggauguua

SEQ ID NO: 4808 - RNA, 22 nt, Chlamydophila pneumoniae TW-183
ggaaggaucuuuaucggaauau

SEQ ID NO: 4809 - RNA, 22 nt, Chlamydophila pneumoniae TW-183
ggcaaaucuuugacucuaccgc

SEQ ID NO: 4810 - RNA, 17 nt, Chlamydophila pneumoniae TW-183
gucuccucuuggaagga

SEQ ID NO: 4811 - RNA, 22 nt, Chlamydophila pneumoniae TW-183
gugcuaugagaucuuuugggcu

SEQ ID NO: 4812 - RNA, 22 nt, Chlamydophila pneumoniae TW-183
guucuuuauuauacuccugaca

SEQ ID NO: 4813 - RNA, 21 nt, Chlamydophila pneumoniae TW-183
uaacucucgucgacuuuuccu

SEQ ID NO: 4814 - RNA, 22 nt, Chlamydophila pneumoniae TW-183
uacaggaaaaacuuuaagaauu

SEQ ID NO: 4815 - RNA, 22 nt, Chlamydophila pneumoniae TW-183
cauuuuuaaauacgauggucgu

SEQ ID NO: 4816 - RNA, 22 nt, Chlamydophila pneumoniae TW-183
ccuagcauuuauuauuacuuca

SEQ ID NO: 4817 - RNA, 22 nt, Chlamydophila pneumoniae TW-183
ccugcagauguguaugcaagau

SEQ ID NO: 4818 - RNA, 22 nt, Chlamydophila pneumoniae TW-183
cuaagauuccucuauuuccugc

SEQ ID NO: 4819 - RNA, 23 nt, Chlamydophila pneumoniae TW-183
cucaggaaaaacgacaacagcgg

SEQ ID NO: 4820 - RNA, 22 nt, Chlamydophila pneumoniae TW-183
cucuucaggaucggcauuauuu

SEQ ID NO: 4821 - RNA, 22 nt, Chlamydophila pneumoniae TW-183
cugcagaaggagugggagcacg

SEQ ID NO: 4822 - RNA, 21 nt, Chlamydophila pneumoniae TW-183
cuuacgaguuuccuggaguuu

SEQ ID NO: 4823 - RNA, 22 nt, Chlamydophila pneumoniae TW-183
cuucuagagacucgcgaaguaa

SEQ ID NO: 4824 - RNA, 22 nt, Chlamydophila pneumoniae TW-183
cuuggauuuucaagucuuuuga

SEQ ID NO: 4825 - RNA, 22 nt, Chlamydophila pneumoniae TW-183
cuuguaggaaagccuuauuuac

SEQ ID NO: 4826 - RNA, 22 nt, Chlamydophila pneumoniae TW-183
cuuuuugcuauuaaggaguauu

SEQ ID NO: 4827 - RNA, 22 nt, Chlamydophila pneumoniae TW-183
gaagauucuuuuaguggauugg

SEQ ID NO: 4828 - RNA, 22 nt, Chlamydophila pneumoniae TW-183
gagaagaguuaaaauaaugacg

SEQ ID NO: 4829 - RNA, 22 nt, Chlamydophila pneumoniae TW-183
gagaggggaagaaaaauagcca

SEQ ID NO: 4830 - RNA, 22 nt, Chlamydophila pneumoniae TW-183
aaagaggagaaagccgccuaug

SEQ ID NO: 4831 - RNA, 22 nt, Chlamydophila pneumoniae TW-183
aaauaaagaacacauugcagau

SEQ ID NO: 4832 - RNA, 22 nt, Chlamydophila pneumoniae TW-183
aaaucaagaauacaucgcagau

SEQ ID NO: 4833 - RNA, 22 nt, Chlamydophila pneumoniae TW-183
aaauuaucggucaaaagcuaag

SEQ ID NO: 4834 - RNA, 22 nt, Chlamydophila pneumoniae TW-183
aacauuuuccacugagaaguug

SEQ ID NO: 4835 - RNA, 22 nt, Chlamydophila pneumoniae TW-183
aagaucaugucuccucugugcg

SEQ ID NO: 4836 - RNA, 22 nt, Chlamydophila pneumoniae TW-183
aagcucuuccagaaacaagauc

SEQ ID NO: 4837 - RNA, 22 nt, Chlamydophila pneumoniae TW-183
aaggaauuauccuaaagcagag

SEQ ID NO: 4838 - RNA, 22 nt, Chlamydophila pneumoniae TW-183
aaggagcucguacaggaguucu

SEQ ID NO: 4839 - RNA, 22 nt, Chlamydophila pneumoniae TW-183
aaggcuaucgauuugauagaug

SEQ ID NO: 4840 - RNA, 22 nt, Chlamydophila pneumoniae TW-183
aauuuucuguucuuuaccgcug

SEQ ID NO: 4841 - RNA, 22 nt, Chlamydophila pneumoniae TW-183
acauccauuguucaggcugacu

SEQ ID NO: 4842 - RNA, 22 nt, Chlamydophila pneumoniae TW-183
accagcuguagagggauugggg

SEQ ID NO: 4843 - RNA, 22 nt, Chlamydophila pneumoniae TW-183
agaaaccagucauugcuuagga

SEQ ID NO: 4844 - RNA, 22 nt, Chlamydophila pneumoniae TW-183
agaaucuugauggguagcggca

SEQ ID NO: 4845 - RNA, 22 nt, Chlamydophila pneumoniae TW-183
agaguucugcugcugcuagacc

SEQ ID NO: 4846 - RNA, 22 nt, Chlamydophila pneumoniae TW-183
agcacuauuggagaaucuggag

SEQ ID NO: 4847 - RNA, 22 nt, Chlamydophila pneumoniae TW-183
agcagggcuugauagagcgucu

SEQ ID NO: 4848 - RNA, 22 nt, Chlamydophila pneumoniae TW-183
agcccgagguacuacaaggcga

SEQ ID NO: 4849 - RNA, 22 nt, Chlamydophila pneumoniae TW-183
agcugcucccguaauuacugcg

SEQ ID NO: 4850 - RNA, 22 nt, Chlamydophila pneumoniae TW-183
aggaaaauugaacuuagagaac

SEQ ID NO: 4851 - RNA, 22 nt, Chlamydophila pneumoniae TW-183
aggagauuuucucacuuacagc

SEQ ID NO: 4852 - RNA, 22 nt, Chlamydophila pneumoniae TW-183
agguguagagggaugacauuca

SEQ ID NO: 4853 - RNA, 22 nt, Chlamydophila pneumoniae TW-183
aguuugcuuuguuauuaugauc

SEQ ID NO: 4854 - RNA, 22 nt, Chlamydophila pneumoniae TW-183
aucaucugauccauaaggauag

SEQ ID NO: 4855 - RNA, 22 nt, Chlamydophila pneumoniae TW-183
aucugcaauguguucuuuauuu

SEQ ID NO: 4856 - RNA, 22 nt, Chlamydophila pneumoniae TW-183
augaaguuugaugcgacagaaa

SEQ ID NO: 4857 - RNA, 22 nt, Chlamydophila pneumoniae TW-183
augccuauguguaacucuauag

SEQ ID NO: 4858 - RNA, 22 nt, Chlamydophila pneumoniae TW-183
auguuccaagagaagaaagagu

SEQ ID NO: 4859 - RNA, 22 nt, Chlamydophila pneumoniae TW-183
auucuucacaauaggagaaagu

SEQ ID NO: 4860 - RNA, 22 nt, Chlamydophila pneumoniae TW-183
auuucugaaaagcuugcgauga

SEQ ID NO: 4861 - RNA, 22 nt, Chlamydophila pneumoniae TW-183
auuuuaucuauagcacuuugcu

SEQ ID NO: 4862 - RNA, 22 nt, Chlamydophila pneumoniae TW-183
caagaagauggucggcgcauua

SEQ ID NO: 4863 - RNA, 22 nt, Chlamydophila pneumoniae TW-183
cauuuaaaccaaucggaagaga

SEQ ID NO: 4864 - RNA, 22 nt, Chlamydophila pneumoniae TW-183
gagaguauagggguguuucgga

SEQ ID NO: 4865 - RNA, 22 nt, Chlamydophila pneumoniae TW-183
gauuuggaucaccaaagaaaau

SEQ ID NO: 4866 - RNA, 22 nt, Chlamydophila pneumoniae TW-183
gcauuccauuuccaagcuuaua

SEQ ID NO: 4867 - RNA, 22 nt, Chlamydophila pneumoniae TW-183
gcguuguuauaucgaguugacu

SEQ ID NO: 4868 - RNA, 22 nt, Chlamydophila pneumoniae TW-183
gcugccgauagaacuugauuug

SEQ ID NO: 4869 - RNA, 23 nt, Chlamydophila pneumoniae TW-183
gcuuaugcauuaggaaggagagc

SEQ ID NO: 4870 - RNA, 22 nt, Chlamydophila pneumoniae TW-183
ggaaguuuacucuugauuuugg

SEQ ID NO: 4871 - RNA, 22 nt, Chlamydophila pneumoniae TW-183
ggagacaguuugcuuuaucucu

SEQ ID NO: 4872 - RNA, 22 nt, Chlamydophila pneumoniae TW-183
ggauuuaaauugggauucccag

SEQ ID NO: 4873 - RNA, 22 nt, Chlamydophila pneumoniae TW-183
ggucgcaccccggaaggguaga

SEQ ID NO: 4874 - RNA, 22 nt, Chlamydophila pneumoniae TW-183
ggucuucaagccaaaugaucag

SEQ ID NO: 4875 - RNA, 22 nt, Chlamydophila pneumoniae TW-183
gugcaggucaugagcuugccgg

SEQ ID NO: 4876 - RNA, 22 nt, Chlamydophila pneumoniae TW-183
guucuaguaggacucgagaugg

SEQ ID NO: 4877 - RNA, 22 nt, Chlamydophila pneumoniae TW-183
guucuagugaucuaaguacgaa

SEQ ID NO: 4878 - RNA, 22 nt, Chlamydophila pneumoniae TW-183
uacagauucaccaagaacaaua

SEQ ID NO: 4879 - RNA, 22 nt, Chlamydophila pneumoniae TW-183
uacuucaacucguugauuguga

SEQ ID NO: 4880 - RNA, 22 nt, Chlamydophila pneumoniae TW-183
uagaaaagaucuaagucguugu

SEQ ID NO: 4881 - RNA, 22 nt, Chlamydophila pneumoniae TW-183
uagagcucuuaagcaggagauc

SEQ ID NO: 4882 - RNA, 22 nt, Chlamydophila pneumoniae TW-183
uagaggaagagguugaccugca

SEQ ID NO: 4883 - RNA, 22 nt, Chlamydophila pneumoniae TW-183
uaggaucuuagaauguuguagg

SEQ ID NO: 4884 - RNA, 22 nt, Chlamydophila pneumoniae TW-183
uaguaccugcucuuuuguacga

SEQ ID NO: 4885 - RNA, 22 nt, Chlamydophila pneumoniae TW-183
uaguuucugcagggcacucuca

SEQ ID NO: 4886 - RNA, 22 nt, Chlamydophila pneumoniae TW-183
uauugauuuaagaguuucaggg

SEQ ID NO: 4887 - RNA, 23 nt, Chlamydophila pneumoniae TW-183
ucagucucuagaggagcucuuug

SEQ ID NO: 4888 - RNA, 23 nt, Chlamydophila pneumoniae TW-183
uccucagucuucccuagggaacu

SEQ ID NO: 4889 - RNA, 21 nt, Chlamydophila pneumoniae TW-183
uccugaguuuccuaaggaacu

SEQ ID NO: 4890 - RNA, 22 nt, Chlamydophila pneumoniae TW-183
uccugcaaaaacuccuuuggaa

SEQ ID NO: 4891 - RNA, 22 nt, Chlamydophila pneumoniae TW-183
ucguaugggacuugccuaucgu

SEQ ID NO: 4892 - RNA, 22 nt, Chlamydophila pneumoniae TW-183
ucuaaagcugcauagcuuuccu

SEQ ID NO: 4893 - RNA, 22 nt, Chlamydophila pneumoniae TW-183
ucuaugauuuuaguggguagag

SEQ ID NO: 4894 - RNA, 22 nt, Chlamydophila pneumoniae TW-183
ucuggaauucuuuaugcuguaa

SEQ ID NO: 4895 - RNA, 22 nt, Chlamydophila pneumoniae TW-183
ucuggagacaucuuuugaagcu

SEQ ID NO: 4896 - RNA, 22 nt, Chlamydophila pneumoniae TW-183
ucugguggucccuuauguuggg

SEQ ID NO: 4897 - RNA, 20 nt, Chlamydophila pneumoniae TW-183
ucuuaucaccggaaacuuuc

SEQ ID NO: 4898 - RNA, 22 nt, Chlamydophila pneumoniae TW-183
ucuucacuucccgcaguuuuag

SEQ ID NO: 4899 - RNA, 18 nt, Chlamydophila pneumoniae TW-183
ucuuggucugugaccauu

SEQ ID NO: 4900 - RNA, 22 nt, Chlamydophila pneumoniae TW-183
ucuuuaauuuucugaaagauua

SEQ ID NO: 4901 - RNA, 22 nt, Chlamydophila pneumoniae TW-183
ugaagcauuugcucuuugggaa

SEQ ID NO: 4902 - RNA, 22 nt, Chlamydophila pneumoniae TW-183
ugagaaaagaggucuuuacaga

SEQ ID NO: 4903 - RNA, 22 nt, Chlamydophila pneumoniae TW-183
ugauuguaaugucuuuauuaga

SEQ ID NO: 4904 - RNA, 22 nt, Chlamydophila pneumoniae TW-183
ugcaugcuaaccuuccagagga

SEQ ID NO: 4905 - RNA, 22 nt, Chlamydophila pneumoniae TW-183
ugccugcuucucaagauacucg

SEQ ID NO: 4906 - RNA, 22 nt, Chlamydophila pneumoniae TW-183
uggacgauacguuuuuaaugua

SEQ ID NO: 4907 - RNA, 20 nt, Chlamydophila pneumoniae TW-183
uggcgugcuuccuaugagua

SEQ ID NO: 4908 - RNA, 22 nt, Chlamydophila pneumoniae TW-183
uggcuauucucuuugguauagg

SEQ ID NO: 4909 - RNA, 22 nt, Chlamydophila pneumoniae TW-183
uguaaagacuacagauccugaa

SEQ ID NO: 4910 - RNA, 22 nt, Chlamydophila pneumoniae TW-183
uuacgagaaaaguuagaauuua

SEQ ID NO: 4911 - RNA, 19 nt, Chlamydophila pneumoniae TW-183
uuauugauacgauuuuaga

SEQ ID NO: 4912 - RNA, 22 nt, Chlamydophila pneumoniae TW-183
uuauuguucuuggugaaucugu

SEQ ID NO: 4913 - RNA, 22 nt, Chlamydophila pneumoniae TW-183
uuccauuaaccaaacauuugau

SEQ ID NO: 4914 - RNA, 22 nt, Chlamydophila pneumoniae TW-183
uuccuacagaucguauuuuccg

SEQ ID NO: 4915 - RNA, 22 nt, Chlamydophila pneumoniae TW-183
uucgaguaguuauaggagagca

SEQ ID NO: 4916 - RNA, 22 nt, Chlamydophila pneumoniae TW-183
uucgugaucaagggaaaacugu

SEQ ID NO: 4917 - RNA, 21 nt, Chlamydophila pneumoniae TW-183
uucuauggcugcucagaauau

SEQ ID NO: 4918 - RNA, 19 nt, Chlamydophila pneumoniae TW-183
uucuuucaggagcuccuca

SEQ ID NO: 4919 - RNA, 22 nt, Chlamydophila pneumoniae TW-183
uucuuuuucuaugaugaugagu

SEQ ID NO: 4920 - RNA, 22 nt, Chlamydophila pneumoniae TW-183
uugaccagaugcaugagaauag

SEQ ID NO: 4921 - RNA, 22 nt, Chlamydophila pneumoniae TW-183
uuguaggguuauuguccucugu

SEQ ID NO: 4922 - RNA, 22 nt, Chlamydophila pneumoniae TW-183
uugugauuccucgagcgagacg

SEQ ID NO: 4923 - RNA, 22 nt, Chlamydophila pneumoniae TW-183
uuuagugaaagaagcguuuuuc

SEQ ID NO: 4924 - RNA, 22 nt, Chlamydophila pneumoniae TW-183
aaaaaucucagaaccaagcuuu

SEQ ID NO: 4925 - RNA, 22 nt, Chlamydophila pneumoniae TW-183
aaaauauaugcagaguuauggu

SEQ ID NO: 4926 - RNA, 22 nt, Chlamydophila pneumoniae TW-183
aaaaucagcaacuaacauagcu

SEQ ID NO: 4927 - RNA, 22 nt, Chlamydophila pneumoniae TW-183
aaacuucaggaacuuucugagu

SEQ ID NO: 4928 - RNA, 22 nt, Chlamydophila pneumoniae TW-183
aaagaacucuccuauaauggca

SEQ ID NO: 4929 - RNA, 22 nt, Chlamydophila pneumoniae TW-183
aacucgggcagacguacugcau

SEQ ID NO: 4930 - RNA, 22 nt, Chlamydophila pneumoniae TW-183
aagaagaagaauccguggauga

SEQ ID NO: 4931 - RNA, 22 nt, Chlamydophila pneumoniae TW-183
aagucucuggauaguaauaccc

SEQ ID NO: 4932 - RNA, 22 nt, Chlamydophila pneumoniae TW-183
aaucucugaacuuuugcuguug

SEQ ID NO: 4933 - RNA, 19 nt, Chlamydophila pneumoniae TW-183
uagaaaaagaucuaagucg

SEQ ID NO: 4934 - RNA, 22 nt, Chlamydophila pneumoniae TW-183
uagaacgugcguucucuuaugu

SEQ ID NO: 4935 - RNA, 22 nt, Chlamydophila pneumoniae TW-183
uagaaggaccucgaucagugcu

SEQ ID NO: 4936 - RNA, 22 nt, Chlamydophila pneumoniae TW-183
uagaauccucucgaaguauguc

SEQ ID NO: 4937 - RNA, 22 nt, Chlamydophila pneumoniae TW-183
uagcuacgucuuuucauaauaa

SEQ ID NO: 4938 - RNA, 22 nt, Chlamydophila pneumoniae TW-183
uaggagcuauuugugucauugc

SEQ ID NO: 4939 - RNA, 22 nt, Chlamydophila pneumoniae TW-183
uaggauaguauagugaggagau

SEQ ID NO: 4940 - RNA, 22 nt, Chlamydophila pneumoniae TW-183
uaguugaaacagauggaagagu

SEQ ID NO: 4941 - RNA, 22 nt, Chlamydophila pneumoniae TW-183
uauccuaauuuacaacuauccu

SEQ ID NO: 4942 - RNA, 22 nt, Chlamydophila pneumoniae TW-183
uaucuuagagcgaugcugaccg

SEQ ID NO: 4943 - RNA, 22 nt, Chlamydophila pneumoniae TW-183
uauguuaggaaauaguguugga

SEQ ID NO: 4944 - RNA, 22 nt, Chlamydophila pneumoniae TW-183
uauucgacuguugcugcucuaa

SEQ ID NO: 4945 - RNA, 22 nt, Chlamydophila pneumoniae TW-183
uauuucagcuuaugucaaaggu

SEQ ID NO: 4946 - RNA, 22 nt, Chlamydophila pneumoniae TW-183
uauuuucuuuguagcuaccaau

SEQ ID NO: 4947 - RNA, 22 nt, Chlamydophila pneumoniae TW-183
ucaccuccagggaugauucgua

SEQ ID NO: 4948 - RNA, 22 nt, Chlamydophila pneumoniae TW-183
uccaagagauacguaggaagag

SEQ ID NO: 4949 - RNA, 22 nt, Chlamydophila pneumoniae TW-183
ucccuuuggauccagaagcuaa

SEQ ID NO: 4950 - RNA, 22 nt, Chlamydophila pneumoniae TW-183
uccuauuuucaugagaaagggg

SEQ ID NO: 4951 - RNA, 22 nt, Chlamydophila pneumoniae TW-183
uccuguagagccuauuuaugau

SEQ ID NO: 4952 - RNA, 22 nt, Chlamydophila pneumoniae TW-183
ucuccucccagcaauuucucgu

SEQ ID NO: 4953 - RNA, 22 nt, Chlamydophila pneumoniae TW-183
ucugaaguccuagcauugaaag

SEQ ID NO: 4954 - RNA, 22 nt, Chlamydophila pneumoniae TW-183
ucuguauugucccagacaacca

SEQ ID NO: 4955 - RNA, 17 nt, Chlamydophila pneumoniae TW-183
ucuugagcaucuuuuaa

SEQ ID NO: 4956 - RNA, 22 nt, Chlamydophila pneumoniae TW-183
ugaguaggcucccccugcuaag

SEQ ID NO: 4957 - RNA, 22 nt, Chlamydophila pneumoniae TW-183
ugaugaaaugacagguauggaa

SEQ ID NO: 4958 - RNA, 22 nt, Chlamydophila pneumoniae TW-183
ugaugcuacgaucacuuaagaa

SEQ ID NO: 4959 - RNA, 22 nt, Chlamydophila pneumoniae TW-183
ugauuuugcuucgcagcuugaa

SEQ ID NO: 4960 - RNA, 22 nt, Chlamydophila pneumoniae TW-183
ugcaugauucucccuacguggc

SEQ ID NO: 4961 - RNA, 22 nt, Chlamydophila pneumoniae TW-183
uggaugaagaagcuggaaaucc

SEQ ID NO: 4962 - RNA, 22 nt, Chlamydophila pneumoniae TW-183
uggucuugauuuuuauagaaaa

SEQ ID NO: 4963 - RNA, 22 nt, Chlamydophila pneumoniae TW-183
uuaaacucucgagacuccguaa

SEQ ID NO: 4964 - RNA, 22 nt, Chlamydophila pneumoniae TW-183
uuacucuauagaugcagaucca

SEQ ID NO: 4965 - RNA, 22 nt, Chlamydophila pneumoniae TW-183
uuaggaucggcagaauuaccaa

SEQ ID NO: 4966 - RNA, 22 nt, Chlamydophila pneumoniae TW-183
uuauggucggcugauuuucccu

SEQ ID NO: 4967 - RNA, 22 nt, Chlamydophila pneumoniae TW-183
uucagacuuuagaaacuucuuc

SEQ ID NO: 4968 - RNA, 22 nt, Chlamydophila pneumoniae TW-183
uuccauucagaacggaagccua

SEQ ID NO: 4969 - RNA, 22 nt, Chlamydophila pneumoniae TW-183
uugaaagauacccggaugauuc

SEQ ID NO: 4970 - RNA, 22 nt, Chlamydophila pneumoniae TW-183
uugaagaauuuguaaacucgua

SEQ ID NO: 4971 - RNA, 22 nt, Chlamydophila pneumoniae TW-183
uugcucuucgcuacuuuuacag

SEQ ID NO: 4972 - RNA, 22 nt, Chlamydophila pneumoniae TW-183
uuguaggggcuuguaucggauu

SEQ ID NO: 4973 - RNA, 19 nt, Chlamydophila pneumoniae TW-183
uuuagaggaucggguaucg

SEQ ID NO: 4974 - RNA, 20 nt, Chlamydophila pneumoniae TW-183
uuugugcgauuuucuugaac

SEQ ID NO: 4975 - RNA, 22 nt, Chlamydophila pneumoniae TW-183
uuuuuagggcuaaagcgagcga

SEQ ID NO: 4976 - RNA, 22 nt, Chlamydophila pneumoniae TW-183
uuuuuguaaguugccaucuucu

SEQ ID NO: 4977 - RNA, 22 nt, Coxiella burnetii RSA 493
aaaacggagggcaauuguuggg

SEQ ID NO: 4978 - RNA, 22 nt, Coxiella burnetii RSA 493
aaaauaauuauucacgaagcua

SEQ ID NO: 4979 - RNA, 22 nt, Coxiella burnetii RSA 493
aaaccgauuuguuuuggauugg

SEQ ID NO: 4980 - RNA, 22 nt, Coxiella burnetii RSA 493
aaagcaauaggguuaguaacug

SEQ ID NO: 4981 - RNA, 22 nt, Coxiella burnetii RSA 493
aaagcgcacgagauccaaggcg

SEQ ID NO: 4982 - RNA, 22 nt, Coxiella burnetii RSA 493
aaaugaauuuaggaaagccagc

SEQ ID NO: 4983 - RNA, 22 nt, Coxiella burnetii RSA 493
aaaugcgacaaucauuuuugua

SEQ ID NO: 4984 - RNA, 20 nt, Coxiella burnetii RSA 493
aacgucguuaaaauucgucc

SEQ ID NO: 4985 - RNA, 22 nt, Coxiella burnetii RSA 493
aagaaugucaacguucguauuc

SEQ ID NO: 4986 - RNA, 22 nt, Coxiella burnetii RSA 493
aagcgaaauacgggaaaacaau

SEQ ID NO: 4987 - RNA, 22 nt, Coxiella burnetii RSA 493
aagcgaaauacggggacaauag

SEQ ID NO: 4988 - RNA, 22 nt, Coxiella burnetii RSA 493
aagcgaaauacggggacgauag

SEQ ID NO: 4989 - RNA, 22 nt, Coxiella burnetii RSA 493
aaggccgauuuuaucugcggug

SEQ ID NO: 4990 - RNA, 22 nt, Coxiella burnetii RSA 493
aaguuuuuggcgaccggcguaa

SEQ ID NO: 4991 - RNA, 22 nt, Coxiella burnetii RSA 493
aaucauuuaucguuugacaucg

SEQ ID NO: 4992 - RNA, 22 nt, Coxiella burnetii RSA 493
aaucggcuuccguuuuuggcug

SEQ ID NO: 4993 - RNA, 22 nt, Coxiella burnetii RSA 493
aaucugcuuagagccaccaaag

SEQ ID NO: 4994 - RNA, 22 nt, Coxiella burnetii RSA 493
aauggaugaucacagaauaauu

SEQ ID NO: 4995 - RNA, 22 nt, Coxiella burnetii RSA 493
aauguuaaaagggcuucgauca

SEQ ID NO: 4996 - RNA, 22 nt, Coxiella burnetii RSA 493
aauuauuaaugaaacguauuga

SEQ ID NO: 4997 - RNA, 22 nt, Coxiella burnetii RSA 493
aauucccguauuccgcugcgcu

SEQ ID NO: 4998 - RNA, 22 nt, Coxiella burnetii RSA 493
aauugccaaacgaucauccguu

SEQ ID NO: 4999 - RNA, 22 nt, Coxiella burnetii RSA 493
aauuggggguauucguuauagu

SEQ ID NO: 5000 - RNA, 22 nt, Coxiella burnetii RSA 493
aauuugaacuuuggugaaaucg

SEQ ID NO: 5001 - RNA, 22 nt, Coxiella burnetii RSA 493
acaguuuucguccuuuugacug

SEQ ID NO: 5002 - RNA, 22 nt, Coxiella burnetii RSA 493
acaugaguaagccaaagauacg

SEQ ID NO: 5003 - RNA, 23 nt, Coxiella burnetii RSA 493
accguugccgaucgagguucguc

SEQ ID NO: 5004 - RNA, 22 nt, Coxiella burnetii RSA 493
acuagcgaauuguaaacagacu

SEQ ID NO: 5005 - RNA, 22 nt, Coxiella burnetii RSA 493
acuucaaaguugacgacguauu

SEQ ID NO: 5006 - RNA, 22 nt, Coxiella burnetii RSA 493
agcacguagguugggcugagcu

SEQ ID NO: 5007 - RNA, 23 nt, Coxiella burnetii RSA 493
agcauuuuuuugacgugagguca

SEQ ID NO: 5008 - RNA, 22 nt, Coxiella burnetii RSA 493
agcgaacgaauacgggaaaaca

SEQ ID NO: 5009 - RNA, 22 nt, Coxiella burnetii RSA 493
agcgaagcggaauacggggacg

SEQ ID NO: 5010 - RNA, 22 nt, Coxiella burnetii RSA 493
agcuauuagaauauucauuuaa

SEQ ID NO: 5011 - RNA, 22 nt, Coxiella burnetii RSA 493
agcuggguuggaaauaguaccc

SEQ ID NO: 5012 - RNA, 22 nt, Coxiella burnetii RSA 493
agcuguuuucguuggaagaacc

SEQ ID NO: 5013 - RNA, 22 nt, Coxiella burnetii RSA 493
aggaucaaucgcuuuuguauuu

SEQ ID NO: 5014 - RNA, 22 nt, Coxiella burnetii RSA 493
aguaaaauucucuuuauccaug

SEQ ID NO: 5015 - RNA, 22 nt, Coxiella burnetii RSA 493
uugcggaaaucacagacaucgc

SEQ ID NO: 5016 - RNA, 22 nt, Coxiella burnetii RSA 493
uuggucggauccccuuucaugc

SEQ ID NO: 5017 - RNA, 22 nt, Coxiella burnetii RSA 493
uuguuuucccguauuccgcuuc

SEQ ID NO: 5018 - RNA, 22 nt, Coxiella burnetii RSA 493
uuuauucaaacacucggcgcga

SEQ ID NO: 5019 - RNA, 22 nt, Coxiella burnetii RSA 493
uuuccccguauuucgcuucgcu

SEQ ID NO: 5020 - RNA, 22 nt, Coxiella burnetii RSA 493
uuucccguauuucgcuucgcug

SEQ ID NO: 5021 - RNA, 22 nt, Coxiella burnetii RSA 493
uuucgcuucgcugcauacggac

SEQ ID NO: 5022 - RNA, 22 nt, Coxiella burnetii RSA 493
uuucuuaggcuuuuagccggga

SEQ ID NO: 5023 - RNA, 22 nt, Coxiella burnetii RSA 493
uuuguucccguauuucgcuuug

SEQ ID NO: 5024 - RNA, 22 nt, Coxiella burnetii RSA 493
uuuuacuuggagcaaagcggau

SEQ ID NO: 5025 - RNA, 22 nt, Coxiella burnetii RSA 493
uuuuagucguucuuauucgcca

SEQ ID NO: 5026 - RNA, 22 nt, Coxiella burnetii RSA 493
uuuuaugcgccuguuguucuuc

SEQ ID NO: 5027 - RNA, 20 nt, Coxiella burnetii RSA 493
uuuuauuugcuuuggaagca

SEQ ID NO: 5028 - RNA, 22 nt, Coxiella burnetii RSA 493
uuuugucauuuccagauugugg

SEQ ID NO: 5029 - RNA, 22 nt, Coxiella burnetii RSA 493
uuuuugaauaucgugcucgacc

SEQ ID NO: 5030 - RNA, 22 nt, Coxiella burnetii RSA 493
uuuuuuacccucuccuagccuc

SEQ ID NO: 5031 - RNA, 23 nt, Coxiella burnetii RSA 493
auuggcgauaucuugaggauuaa

SEQ ID NO: 5032 - RNA, 22 nt, Coxiella burnetii RSA 493
auugguuauuagugcuauuaau

SEQ ID NO: 5033 - RNA, 22 nt, Coxiella burnetii RSA 493
auuuauuuggucuggcggagau

SEQ ID NO: 5034 - RNA, 22 nt, Coxiella burnetii RSA 493
auuucagccguuucucguuuga

SEQ ID NO: 5035 - RNA, 22 nt, Coxiella burnetii RSA 493
auuucgcuucgcuucauacggg

SEQ ID NO: 5036 - RNA, 22 nt, Coxiella burnetii RSA 493
auuucuuagagaagcgcuugaa

SEQ ID NO: 5037 - RNA, 19 nt, Coxiella burnetii RSA 493
auuugcaaugcagauugau

SEQ ID NO: 5038 - RNA, 22 nt, Coxiella burnetii RSA 493
caaacguguauugauggacaau

SEQ ID NO: 5039 - RNA, 22 nt, Coxiella burnetii RSA 493
caaaugggaauggacguguuga

SEQ ID NO: 5040 - RNA, 22 nt, Coxiella burnetii RSA 493
caauggcucgugcgcauuuagg

SEQ ID NO: 5041 - RNA, 22 nt, Coxiella burnetii RSA 493
cagaaaaagacccuucagguaa

SEQ ID NO: 5042 - RNA, 22 nt, Coxiella burnetii RSA 493
cagaagaacgggcuaaauuaga

SEQ ID NO: 5043 - RNA, 22 nt, Coxiella burnetii RSA 493
caguaccgaagaucagcuuaaa

SEQ ID NO: 5044 - RNA, 22 nt, Coxiella burnetii RSA 493
cauaugaagcgaagcggaauac

SEQ ID NO: 5045 - RNA, 22 nt, Coxiella burnetii RSA 493
caucauccugacccuacuauuc

SEQ ID NO: 5046 - RNA, 22 nt, Coxiella burnetii RSA 493
cauuaaugaguuugccacgcga

SEQ ID NO: 5047 - RNA, 22 nt, Coxiella burnetii RSA 493
cauuacaaauggacgaugcaga

SEQ ID NO: 5048 - RNA, 22 nt, Coxiella burnetii RSA 493
cauuguuucccguauuucgcuu

SEQ ID NO: 5049 - RNA, 22 nt, Coxiella burnetii RSA 493
ccagcgauuaucaauuagcauu

SEQ ID NO: 5050 - RNA, 21 nt, Coxiella burnetii RSA 493
ccauccuucgccaagcuggcc

SEQ ID NO: 5051 - RNA, 22 nt, Coxiella burnetii RSA 493
cccagauuagggggcuaagaaa

SEQ ID NO: 5052 - RNA, 22 nt, Coxiella burnetii RSA 493
cccccguauuucgcuucgcuca

SEQ ID NO: 5053 - RNA, 22 nt, Coxiella burnetii RSA 493
cccgggaauggugaagucuaaa

SEQ ID NO: 5054 - RNA, 22 nt, Coxiella burnetii RSA 493
cccguaucucguucgcucauac

SEQ ID NO: 5055 - RNA, 22 nt, Coxiella burnetii RSA 493
cccguaugaagcgaagcgaaau

SEQ ID NO: 5056 - RNA, 22 nt, Coxiella burnetii RSA 493
cccguauuccgcuucgcucaua

SEQ ID NO: 5057 - RNA, 22 nt, Coxiella burnetii RSA 493
cccguauuccgcuucgcuccau

SEQ ID NO: 5058 - RNA, 22 nt, Coxiella burnetii RSA 493
cccguauucguucgcucauacg

SEQ ID NO: 5059 - RNA, 22 nt, Coxiella burnetii RSA 493
cccguauuucgcuccgcucaga

SEQ ID NO: 5060 - RNA, 22 nt, Coxiella burnetii RSA 493
cccguauuucgcuucgcucaga

SEQ ID NO: 5061 - RNA, 22 nt, Coxiella burnetii RSA 493
cccguauuucgcuucgcucaua

SEQ ID NO: 5062 - RNA, 22 nt, Coxiella burnetii RSA 493
ccgcaaaacccacuaauuuccc

SEQ ID NO: 5063 - RNA, 22 nt, Coxiella burnetii RSA 493
ccguaugaagcaaagcggaaua

SEQ ID NO: 5064 - RNA, 22 nt, Coxiella burnetii RSA 493
ccguaugaagcgaagcgcaaua

SEQ ID NO: 5065 - RNA, 22 nt, Coxiella burnetii RSA 493
ccguaugaagcgcagcggaaua

SEQ ID NO: 5066 - RNA, 22 nt, Coxiella burnetii RSA 493
ccguauuccacuucgcuucaua

SEQ ID NO: 5067 - RNA, 22 nt, Coxiella burnetii RSA 493
ccguauuucgcugggcugcaua

SEQ ID NO: 5068 - RNA, 22 nt, Coxiella burnetii RSA 493
ccguauuucgcuucgcugcaua

SEQ ID NO: 5069 - RNA, 22 nt, Coxiella burnetii RSA 493
ccguauuucgcuucgcuucaua

SEQ ID NO: 5070 - RNA, 22 nt, Coxiella burnetii RSA 493
ccguuauccgauagaguacgag

SEQ ID NO: 5071 - RNA, 22 nt, Coxiella burnetii RSA 493
ccuauuuucaauaaccguucca

SEQ ID NO: 5072 - RNA, 22 nt, Coxiella burnetii RSA 493
ccuuuaaaaaugcaauucguag

SEQ ID NO: 5073 - RNA, 22 nt, Coxiella burnetii RSA 493
ccuuuuuaucgcgugaguccau

SEQ ID NO: 5074 - RNA, 22 nt, Coxiella burnetii RSA 493
cgaagcgaaauacgggaaauua

SEQ ID NO: 5075 - RNA, 22 nt, Coxiella burnetii RSA 493
cgaagcgaaauacgggaacgau

SEQ ID NO: 5076 - RNA, 22 nt, Coxiella burnetii RSA 493
cgaauaaaccuuaucgaguuaa

SEQ ID NO: 5077 - RNA, 22 nt, Coxiella burnetii RSA 493
cgacgauuauugaagaugacug

SEQ ID NO: 5078 - RNA, 22 nt, Coxiella burnetii RSA 493
cgaucagccacaaugaaagccg

SEQ ID NO: 5079 - RNA, 22 nt, Coxiella burnetii RSA 493
cgauggaaaaaaugaauuacgu

SEQ ID NO: 5080 - RNA, 22 nt, Coxiella burnetii RSA 493
cgcaauuuuccacuggauguuu

SEQ ID NO: 5081 - RNA, 20 nt, Coxiella burnetii RSA 493
cgccauggcuugccucgcua

SEQ ID NO: 5082 - RNA, 22 nt, Coxiella burnetii RSA 493
cgccuuugacgaugaaguauuc

SEQ ID NO: 5083 - RNA, 22 nt, Coxiella burnetii RSA 493
cggaauaucgccuguuccgggc

SEQ ID NO: 5084 - RNA, 22 nt, Coxiella burnetii RSA 493
cgggccgaguagcuaaguagcc

SEQ ID NO: 5085 - RNA, 22 nt, Coxiella burnetii RSA 493
uagcgagaugagcuuggugauu

SEQ ID NO: 5086 - RNA, 22 nt, Coxiella burnetii RSA 493
uagcggcugauuuacaugcugu

SEQ ID NO: 5087 - RNA, 22 nt, Coxiella burnetii RSA 493
uaggugucucgcgugaugcgac

SEQ ID NO: 5088 - RNA, 22 nt, Coxiella burnetii RSA 493
uagguuuucaacaaguagcccg

SEQ ID NO: 5089 - RNA, 22 nt, Coxiella burnetii RSA 493
uaguugucgcguagcgacacaa

SEQ ID NO: 5090 - RNA, 22 nt, Coxiella burnetii RSA 493
uaucgauguuuucaauaauuau

SEQ ID NO: 5091 - RNA, 21 nt, Coxiella burnetii RSA 493
uaucgauuggagaaaauuuua

SEQ ID NO: 5092 - RNA, 22 nt, Coxiella burnetii RSA 493
uaugaagcgaaacgaauacggg

SEQ ID NO: 5093 - RNA, 22 nt, Coxiella burnetii RSA 493
uaugaagcgcagcgaaaugccg

SEQ ID NO: 5094 - RNA, 22 nt, Coxiella burnetii RSA 493
uaugagcgaagcguaauacggg

SEQ ID NO: 5095 - RNA, 22 nt, Coxiella burnetii RSA 493
uaugcagcgcagcgaaauacgg

SEQ ID NO: 5096 - RNA, 22 nt, Coxiella burnetii RSA 493
uauggagcgaacgagauacggg

SEQ ID NO: 5097 - RNA, 22 nt, Coxiella burnetii RSA 493
uauggagcgaagcggaauacag

SEQ ID NO: 5098 - RNA, 22 nt, Coxiella burnetii RSA 493
uauggagcgaagcggaauacgg

SEQ ID NO: 5099 - RNA, 22 nt, Coxiella burnetii RSA 493
uauggagugaagcgaaauacgg

SEQ ID NO: 5100 - RNA, 22 nt, Coxiella burnetii RSA 493
uauggccuguugugaugacauc

SEQ ID NO: 5101 - RNA, 20 nt, Coxiella burnetii RSA 493
uaugggcacguuuuggugau

SEQ ID NO: 5102 - RNA, 22 nt, Coxiella burnetii RSA 493
uauuaauugaggguuaucgucg

SEQ ID NO: 5103 - RNA, 22 nt, Coxiella burnetii RSA 493
uauuccgcuucgcuuuauacgu

SEQ ID NO: 5104 - RNA, 22 nt, Coxiella burnetii RSA 493
uauuguccccguauuucgcuuc

SEQ ID NO: 5105 - RNA, 22 nt, Coxiella burnetii RSA 493
uauuguuuggcgucacuuauuu

SEQ ID NO: 5106 - RNA, 22 nt, Coxiella burnetii RSA 493
uauuucaaccugcucagaaacu

SEQ ID NO: 5107 - RNA, 22 nt, Coxiella burnetii RSA 493
uauuucgcuucgcucauacgua

SEQ ID NO: 5108 - RNA, 22 nt, Coxiella burnetii RSA 493
uauuuuugauggagguugauca

SEQ ID NO: 5109 - RNA, 19 nt, Coxiella burnetii RSA 493
ucaaaaaaaugcugagaug

SEQ ID NO: 5110 - RNA, 22 nt, Coxiella burnetii RSA 493
ucaggauaagggaguaaggcau

SEQ ID NO: 5111 - RNA, 22 nt, Coxiella burnetii RSA 493
uccauuaucaaugggguuaaua

SEQ ID NO: 5112 - RNA, 22 nt, Coxiella burnetii RSA 493
uccccguauuccgcugcgcuuc

SEQ ID NO: 5113 - RNA, 22 nt, Coxiella burnetii RSA 493
uccccguauuucgcuucgcugc

SEQ ID NO: 5114 - RNA, 22 nt, Coxiella burnetii RSA 493
uccccguauuucgcuucgcuuc

SEQ ID NO: 5115 - RNA, 22 nt, Coxiella burnetii RSA 493
uccccuauuccgcuucgcugca

SEQ ID NO: 5116 - RNA, 22 nt, Coxiella burnetii RSA 493
ucccguauuucgcuucgcucca

SEQ ID NO: 5117 - RNA, 22 nt, Coxiella burnetii RSA 493
uccgcuuuauucaaccguuuca

SEQ ID NO: 5118 - RNA, 22 nt, Coxiella burnetii RSA 493
ucgcaaaucauuuuuguugaaa

SEQ ID NO: 5119 - RNA, 22 nt, Coxiella burnetii RSA 493
aaaaagaagacgagugaucgcu

SEQ ID NO: 5120 - RNA, 22 nt, Coxiella burnetii RSA 493
aaaacgauuaauguaauuaccu

SEQ ID NO: 5121 - RNA, 22 nt, Coxiella burnetii RSA 493
aaaaguauuuugggaaucggcg

SEQ ID NO: 5122 - RNA, 22 nt, Coxiella burnetii RSA 493
aaaauagcacgaucgccuggcg

SEQ ID NO: 5123 - RNA, 22 nt, Coxiella burnetii RSA 493
aaaauuagcauagagcgaccca

SEQ ID NO: 5124 - RNA, 22 nt, Coxiella burnetii RSA 493
aauaagucgaacuggauagugc

SEQ ID NO: 5125 - RNA, 22 nt, Coxiella burnetii RSA 493
aauaaugcuauuuuuuuaagcg

SEQ ID NO: 5126 - RNA, 22 nt, Coxiella burnetii RSA 493
aauauuauuuuuagcgauaggg

SEQ ID NO: 5127 - RNA, 22 nt, Coxiella burnetii RSA 493
aauauugccgauguggucguuu

SEQ ID NO: 5128 - RNA, 22 nt, Coxiella burnetii RSA 493
aaugaacacaagagagacacuu

SEQ ID NO: 5129 - RNA, 19 nt, Coxiella burnetii RSA 493
aaugaugauggguaugcgu

SEQ ID NO: 5130 - RNA, 18 nt, Coxiella burnetii RSA 493
aauggccuaauuuucgau

SEQ ID NO: 5131 - RNA, 22 nt, Coxiella burnetii RSA 493
aaugucauaaaacuauuuucga

SEQ ID NO: 5132 - RNA, 22 nt, Coxiella burnetii RSA 493
aaugugaguaauuaaaacuuua

SEQ ID NO: 5133 - RNA, 22 nt, Coxiella burnetii RSA 493
aauugagcuggcuuugcuugcu

SEQ ID NO: 5134 - RNA, 22 nt, Coxiella burnetii RSA 493
acaaauuuguccagugagauga

SEQ ID NO: 5135 - RNA, 21 nt, Coxiella burnetii RSA 493
acaauccgccugagugauggc

SEQ ID NO: 5136 - RNA, 22 nt, Coxiella burnetii RSA 493
acauuucaaaaguagagcuuuu

SEQ ID NO: 5137 - RNA, 22 nt, Coxiella burnetii RSA 493
acgagguaggaaugaaugucaa

SEQ ID NO: 5138 - RNA, 22 nt, Coxiella burnetii RSA 493
acgauugaugcuaauauugacu

SEQ ID NO: 5139 - RNA, 22 nt, Coxiella burnetii RSA 493
acguaugagcgaagcgaaauac

SEQ ID NO: 5140 - RNA, 22 nt, Coxiella burnetii RSA 493
acgucauuuuccuuuauguugu

SEQ ID NO: 5141 - RNA, 22 nt, Coxiella burnetii RSA 493
acuaucaaaccgcauguugcuu

SEQ ID NO: 5142 - RNA, 22 nt, Coxiella burnetii RSA 493
acugguuuuaaacauugcgagc

SEQ ID NO: 5143 - RNA, 21 nt, Coxiella burnetii RSA 493
acuuuaaugccuauagcugcu

SEQ ID NO: 5144 - RNA, 22 nt, Coxiella burnetii RSA 493
agagaguugcauuacugaaugc

SEQ ID NO: 5145 - RNA, 22 nt, Coxiella burnetii RSA 493
agagucuguuuauuguucgauu

SEQ ID NO: 5146 - RNA, 22 nt, Coxiella burnetii RSA 493
agcaauugaucaagagagauug

SEQ ID NO: 5147 - RNA, 22 nt, Coxiella burnetii RSA 493
agcccuuguuuuugugcgguga

SEQ ID NO: 5148 - RNA, 22 nt, Coxiella burnetii RSA 493
agcgaagcgaaauacgggaaaa

SEQ ID NO: 5149 - RNA, 22 nt, Coxiella burnetii RSA 493
agcgaagcgaaauacgggacga

SEQ ID NO: 5150 - RNA, 22 nt, Coxiella burnetii RSA 493
agcgaagcgaaauacggggacg

SEQ ID NO: 5151 - RNA, 22 nt, Coxiella burnetii RSA 493
agcgaagcgaauacggggacgg

SEQ ID NO: 5152 - RNA, 22 nt, Coxiella burnetii RSA 493
aguaacugagaaaaagcguuua

SEQ ID NO: 5153 - RNA, 22 nt, Coxiella burnetii RSA 493
agugcgcuggguccccgccugc

SEQ ID NO: 5154 - RNA, 22 nt, Coxiella burnetii RSA 493
agugcgcuggguccucgccuuc

SEQ ID NO: 5155 - RNA, 22 nt, Coxiella burnetii RSA 493
aguuaaaaauugguauugaaac

SEQ ID NO: 5156 - RNA, 22 nt, Coxiella burnetii RSA 493
auacccaucaagaccaaguaag

SEQ ID NO: 5157 - RNA, 22 nt, Coxiella burnetii RSA 493
auauugguauucaucgucgccg

SEQ ID NO: 5158 - RNA, 22 nt, Coxiella burnetii RSA 493
aucaauuaauuauggccagcag

SEQ ID NO: 5159 - RNA, 22 nt, Coxiella burnetii RSA 493
aucacgaaugauaaucauauuu

SEQ ID NO: 5160 - RNA, 17 nt, Coxiella burnetii RSA 493
aucauggcaucccagcc

SEQ ID NO: 5161 - RNA, 22 nt, Coxiella burnetii RSA 493
auccacgcgaugcugaggagcu

SEQ ID NO: 5162 - RNA, 20 nt, Coxiella burnetii RSA 493
aucguauuagucgaugccaa

SEQ ID NO: 5163 - RNA, 22 nt, Coxiella burnetii RSA 493
aucucguuccaagaguuguuga

SEQ ID NO: 5164 - RNA, 22 nt, Coxiella burnetii RSA 493
augaaaaaagaaucaaggcguu

SEQ ID NO: 5165 - RNA, 22 nt, Coxiella burnetii RSA 493
augaaaugauucgauacgcuag

SEQ ID NO: 5166 - RNA, 22 nt, Coxiella burnetii RSA 493
augagcgaacgaaauacgggga

SEQ ID NO: 5167 - RNA, 21 nt, Coxiella burnetii RSA 493
augcaaugaacgaagggauug

SEQ ID NO: 5168 - RNA, 20 nt, Coxiella burnetii RSA 493
augccguuuuauuuucagac

SEQ ID NO: 5169 - RNA, 22 nt, Coxiella burnetii RSA 493
auggcguugaaauuaccgaucc

SEQ ID NO: 5170 - RNA, 22 nt, Coxiella burnetii RSA 493
auuaaguauauuugcaguuugc

SEQ ID NO: 5171 - RNA, 22 nt, Coxiella burnetii RSA 493
auuaaucguugcaacgcaaauc

SEQ ID NO: 5172 - RNA, 22 nt, Coxiella burnetii RSA 493
auuaaugaugaagauuuugaua

SEQ ID NO: 5173 - RNA, 22 nt, Coxiella burnetii RSA 493
auuacaaggcauuauucgcaaa

SEQ ID NO: 5174 - RNA, 22 nt, Coxiella burnetii RSA 493
auuccaaucuggaugaauucca

SEQ ID NO: 5175 - RNA, 22 nt, Coxiella burnetii RSA 493
auuccgcuucgcuucauauggg

SEQ ID NO: 5176 - RNA, 22 nt, Coxiella burnetii RSA 493
auugaagucgauaugauugugc

SEQ ID NO: 5177 - RNA, 22 nt, Coxiella burnetii RSA 493
auugauuuauugccuccugaug

SEQ ID NO: 5178 - RNA, 22 nt, Coxiella burnetii RSA 493
auugcgcuccgaucggcaacug

SEQ ID NO: 5179 - RNA, 22 nt, Coxiella burnetii RSA 493
auugcgcuucgcuucauacggg

SEQ ID NO: 5180 - RNA, 22 nt, Coxiella burnetii RSA 493
auugcuuuuguguuagcgcugg

SEQ ID NO: 5181 - RNA, 22 nt, Coxiella burnetii RSA 493
auuggcauuguuauugggacuu

SEQ ID NO: 5182 - RNA, 22 nt, Coxiella burnetii RSA 493
auuguccccguauuucgcuucg

SEQ ID NO: 5183 - RNA, 22 nt, Coxiella burnetii RSA 493
auuguucgauuaaaauguucgc

SEQ ID NO: 5184 - RNA, 22 nt, Coxiella burnetii RSA 493
auuguuuucccguauuccgcuu

SEQ ID NO: 5185 - RNA, 22 nt, Coxiella burnetii RSA 493
auuguuuucccguauuucgcuu

SEQ ID NO: 5186 - RNA, 20 nt, Coxiella burnetii RSA 493
auuuauugguuagaacgucg

SEQ ID NO: 5187 - RNA, 23 nt, Coxiella burnetii RSA 493
auuuuggcauuucaugacaucgg

SEQ ID NO: 5188 - RNA, 22 nt, Coxiella burnetii RSA 493
caaaaaaccuucacggccgagu

SEQ ID NO: 5189 - RNA, 22 nt, Coxiella burnetii RSA 493
caaaccauuacgcucugcgguu

SEQ ID NO: 5190 - RNA, 22 nt, Coxiella burnetii RSA 493
caaagcgaccuuaccuaucgau

SEQ ID NO: 5191 - RNA, 22 nt, Coxiella burnetii RSA 493
caacgguugagcaauuuuaugu

SEQ ID NO: 5192 - RNA, 22 nt, Coxiella burnetii RSA 493
uaaaaucuucgcuaaugcgaua

SEQ ID NO: 5193 - RNA, 22 nt, Coxiella burnetii RSA 493
uaagaugagcccaucggugaag

SEQ ID NO: 5194 - RNA, 22 nt, Coxiella burnetii RSA 493
uaaggagaggguuuuuaaagaa

SEQ ID NO: 5195 - RNA, 22 nt, Coxiella burnetii RSA 493
uacugucuaaaaaaaucguuac

SEQ ID NO: 5196 - RNA, 22 nt, Coxiella burnetii RSA 493
uagcuguaugagcgaagugaaa

SEQ ID NO: 5197 - RNA, 22 nt, Coxiella burnetii RSA 493
uagucauuuuauaccacgucuc

SEQ ID NO: 5198 - RNA, 22 nt, Coxiella burnetii RSA 493
uaguuuucaacaaguagcccgu

SEQ ID NO: 5199 - RNA, 22 nt, Coxiella burnetii RSA 493
uauaaacaauucuuggggcguu

SEQ ID NO: 5200 - RNA, 22 nt, Coxiella burnetii RSA 493
uauaugaagcgcagcgaauacg

SEQ ID NO: 5201 - RNA, 22 nt, Coxiella burnetii RSA 493
uaucauccguuuuaacggcgac

SEQ ID NO: 5202 - RNA, 22 nt, Coxiella burnetii RSA 493
uaucgccauuaaaauuaacgac

SEQ ID NO: 5203 - RNA, 22 nt, Coxiella burnetii RSA 493
uaucggcuucaagagacguuga

SEQ ID NO: 5204 - RNA, 22 nt, Coxiella burnetii RSA 493
uaugaagcgaagcgaaauacgg

SEQ ID NO: 5205 - RNA, 22 nt, Coxiella burnetii RSA 493
uaugagcgaacgaauacgggaa

SEQ ID NO: 5206 - RNA, 22 nt, Coxiella burnetii RSA 493
uaugagcgaacgaauacgggga

SEQ ID NO: 5207 - RNA, 22 nt, Coxiella burnetii RSA 493
uaugagcgaagcgaaauacgag

SEQ ID NO: 5208 - RNA, 22 nt, Coxiella burnetii RSA 493
uaugagcgaagcgaaauacggg

SEQ ID NO: 5209 - RNA, 22 nt, Coxiella burnetii RSA 493
uaugcagcgaacgaauacggga

SEQ ID NO: 5210 - RNA, 22 nt, Coxiella burnetii RSA 493
uaugcagcgaagcgaaauacgg

SEQ ID NO: 5211 - RNA, 22 nt, Coxiella burnetii RSA 493
uaugcagcgaagcggaauacgg

SEQ ID NO: 5212 - RNA, 22 nt, Coxiella burnetii RSA 493
uauggagcgccagcggaauacg

SEQ ID NO: 5213 - RNA, 22 nt, Coxiella burnetii RSA 493
uauuauuuccuguauuccgcuu

SEQ ID NO: 5214 - RNA, 22 nt, Coxiella burnetii RSA 493
uauuccgcugcgcuucauacgg

SEQ ID NO: 5215 - RNA, 20 nt, Coxiella burnetii RSA 493
uauuccgcuucgcugcauac

SEQ ID NO: 5216 - RNA, 22 nt, Coxiella burnetii RSA 493
uauuccgcuuugcuucauacgg

SEQ ID NO: 5217 - RNA, 22 nt, Coxiella burnetii RSA 493
uauucguuucgcuucauacggg

SEQ ID NO: 5218 - RNA, 21 nt, Coxiella burnetii RSA 493
uauugcgcuucgcuucauacg

SEQ ID NO: 5219 - RNA, 22 nt, Coxiella burnetii RSA 493
uauuucacuucgcucauacagc

SEQ ID NO: 5220 - RNA, 22 nt, Coxiella burnetii RSA 493
uauuucgcugcgcugcauacgg

SEQ ID NO: 5221 - RNA, 22 nt, Coxiella burnetii RSA 493
uauuucgcugcgcuucauacga

SEQ ID NO: 5222 - RNA, 20 nt, Coxiella burnetii RSA 493
uauuucgcuucgcuacauac

SEQ ID NO: 5223 - RNA, 22 nt, Coxiella burnetii RSA 493
uauuuuaauaaucggcgcaggc

SEQ ID NO: 5224 - RNA, 22 nt, Coxiella burnetii RSA 493
ucaaguuuaccucguuaauacu

SEQ ID NO: 5225 - RNA, 22 nt, Coxiella burnetii RSA 493
ucaauggcuuuggcaacggugg

SEQ ID NO: 5226 - RNA, 20 nt, Coxiella burnetii RSA 493
ucaggcugucguugguacug

SEQ ID NO: 5227 - RNA, 22 nt, Coxiella burnetii RSA 493
ucaguaccaacgacagccugaa

SEQ ID NO: 5228 - RNA, 22 nt, Coxiella burnetii RSA 493
ucaguuucugauauuuuccuau

SEQ ID NO: 5229 - RNA, 22 nt, Coxiella burnetii RSA 493
ucccaauuccucgcccgucaca

SEQ ID NO: 5230 - RNA, 22 nt, Coxiella burnetii RSA 493
uccccguauuucgcuucgcuca

SEQ ID NO: 5231 - RNA, 22 nt, Coxiella burnetii RSA 493
uccccguauuucgcuucgcucc

SEQ ID NO: 5232 - RNA, 20 nt, Coxiella burnetii RSA 493
ucccgcgccucgaugcgguu

SEQ ID NO: 5233 - RNA, 22 nt, Coxiella burnetii RSA 493
ucccgcgccucgaugcgguuug

SEQ ID NO: 5234 - RNA, 22 nt, Coxiella burnetii RSA 493
ucccguauuccgcuucgcugca

SEQ ID NO: 5235 - RNA, 22 nt, Coxiella burnetii RSA 493
ucgaauccaaacaaaaugguuu

SEQ ID NO: 5236 - RNA, 22 nt, Coxiella burnetii RSA 493
ucgcaaaauaauuccacugacu

SEQ ID NO: 5237 - RNA, 22 nt, Coxiella burnetii RSA 493
ucgcuucgcuccauacgggcua

SEQ ID NO: 5238 - RNA, 22 nt, Coxiella burnetii RSA 493
ucggccuugcuaagaugaauau

SEQ ID NO: 5239 - RNA, 22 nt, Coxiella burnetii RSA 493
ucguaugaagcgcagcgaaaua

SEQ ID NO: 5240 - RNA, 22 nt, Coxiella burnetii RSA 493
ucguccccguauuucgcuucgc

SEQ ID NO: 5241 - RNA, 22 nt, Coxiella burnetii RSA 493
ucguggcguggaaguuuuggcc

SEQ ID NO: 5242 - RNA, 22 nt, Coxiella burnetii RSA 493
ucguguggcuucgccacaauua

SEQ ID NO: 5243 - RNA, 22 nt, Coxiella burnetii RSA 493
ucucaacggcuguagcggcaau

SEQ ID NO: 5244 - RNA, 22 nt, Coxiella burnetii RSA 493
ucucacuggacaaauuugucca

SEQ ID NO: 5245 - RNA, 23 nt, Coxiella burnetii RSA 493
ucugucuaucacccaaagcccua

SEQ ID NO: 5246 - RNA, 22 nt, Coxiella burnetii RSA 493
ugaaaguauagguuuucaagcu

SEQ ID NO: 5247 - RNA, 22 nt, Coxiella burnetii RSA 493
ugaaaucgaugacgaagcggcu

SEQ ID NO: 5248 - RNA, 22 nt, Coxiella burnetii RSA 493
ugaauuuugcaaucgccaucgc

SEQ ID NO: 5249 - RNA, 22 nt, Coxiella burnetii RSA 493
ugaccgcgggacccagaaaauu

SEQ ID NO: 5250 - RNA, 22 nt, Coxiella burnetii RSA 493
ugacucaaggugaaauugaugg

SEQ ID NO: 5251 - RNA, 22 nt, Coxiella burnetii RSA 493
ugagcgaagcgaaauacgggaa

SEQ ID NO: 5252 - RNA, 22 nt, Coxiella burnetii RSA 493
ugaggaauuacuuuauagcuuu

SEQ ID NO: 5253 - RNA, 22 nt, Coxiella burnetii RSA 493
ugauuuuaugagaaauauugcu

SEQ ID NO: 5254 - RNA, 22 nt, Coxiella burnetii RSA 493
ugcagcgaagcgaaauacggga

SEQ ID NO: 5255 - RNA, 22 nt, Coxiella burnetii RSA 493
ugcagcgaagcggaauagggga

SEQ ID NO: 5256 - RNA, 22 nt, Coxiella burnetii RSA 493
ugcgaaaaagauaguaauucca

SEQ ID NO: 5257 - RNA, 22 nt, Coxiella burnetii RSA 493
ugcgauuguauuuagaaaaagg

SEQ ID NO: 5258 - RNA, 22 nt, Coxiella burnetii RSA 493
cccguauuucgcuucgcuucau

SEQ ID NO: 5259 - RNA, 22 nt, Coxiella burnetii RSA 493
cccguauuucguucgcucauac

SEQ ID NO: 5260 - RNA, 22 nt, Coxiella burnetii RSA 493
ccgauauuguguggcagcgccu

SEQ ID NO: 5261 - RNA, 22 nt, Coxiella burnetii RSA 493
ccguaugaagcgaagcgaaaua

SEQ ID NO: 5262 - RNA, 22 nt, Coxiella burnetii RSA 493
ccguaugaagcgaagcggaaaa

SEQ ID NO: 5263 - RNA, 22 nt, Coxiella burnetii RSA 493
ccguaugcagcccagcgaaaua

SEQ ID NO: 5264 - RNA, 22 nt, Coxiella burnetii RSA 493
ccguauggagcgaagcggaaua

SEQ ID NO: 5265 - RNA, 22 nt, Coxiella burnetii RSA 493
ccguauucguucgcugcauacg

SEQ ID NO: 5266 - RNA, 22 nt, Coxiella burnetii RSA 493
ccguauuucgcugcgcuucaua

SEQ ID NO: 5267 - RNA, 23 nt, Coxiella burnetii RSA 493
ccguauuucgcuucauacgggcu

SEQ ID NO: 5268 - RNA, 21 nt, Coxiella burnetii RSA 493
ccguauuucgcuucgcucaua

SEQ ID NO: 5269 - RNA, 22 nt, Coxiella burnetii RSA 493
ccuuuuucuuuagcggcguuaa

SEQ ID NO: 5270 - RNA, 22 nt, Coxiella burnetii RSA 493
cgaucgccgauaauuaauucac

SEQ ID NO: 5271 - RNA, 22 nt, Coxiella burnetii RSA 493
cgauuucaccaaaguucaaaag

SEQ ID NO: 5272 - RNA, 22 nt, Coxiella burnetii RSA 493
cgcacgcucggaaauugucgaa

SEQ ID NO: 5273 - RNA, 22 nt, Coxiella burnetii RSA 493
cgcuuuguuucauacgggcuac

SEQ ID NO: 5274 - RNA, 22 nt, Coxiella burnetii RSA 493
cggcgguaugauuuuggaagaa

SEQ ID NO: 5275 - RNA, 22 nt, Coxiella burnetii RSA 493
cggcuacguugaaggcaauacu

SEQ ID NO: 5276 - RNA, 22 nt, Coxiella burnetii RSA 493
cggcuugaccgcgguaucuaga

SEQ ID NO: 5277 - RNA, 22 nt, Coxiella burnetii RSA 493
cguauaaagcgaagcggaauac

SEQ ID NO: 5278 - RNA, 22 nt, Coxiella burnetii RSA 493
cguauuccgcuaacgccccaua

SEQ ID NO: 5279 - RNA, 22 nt, Coxiella burnetii RSA 493
cguauuccgcugcgcugcauaa

SEQ ID NO: 5280 - RNA, 22 nt, Coxiella burnetii RSA 493
cguauuucgcuucgcucauacg

SEQ ID NO: 5281 - RNA, 22 nt, Coxiella burnetii RSA 493
cguauuucgcuucgcuccauac

SEQ ID NO: 5282 - RNA, 22 nt, Coxiella burnetii RSA 493
cgucaauuaacccugucgucgu

SEQ ID NO: 5283 - RNA, 22 nt, Coxiella burnetii RSA 493
cguccccguauuucgcuucgcu

SEQ ID NO: 5284 - RNA, 22 nt, Coxiella burnetii RSA 493
cguccccguguuucgcuucgcu

SEQ ID NO: 5285 - RNA, 22 nt, Coxiella burnetii RSA 493
cguccucccgcgaggucgucug

SEQ ID NO: 5286 - RNA, 22 nt, Coxiella burnetii RSA 493
cgugcuuuuccuuaaccccgcu

SEQ ID NO: 5287 - RNA, 22 nt, Coxiella burnetii RSA 493
cuacgcuuucugcgaggugaaa

SEQ ID NO: 5288 - RNA, 22 nt, Coxiella burnetii RSA 493
cucgccggaugaguugguuuua

SEQ ID NO: 5289 - RNA, 23 nt, Coxiella burnetii RSA 493
cugcaagacaugcgucgauuauu

SEQ ID NO: 5290 - RNA, 22 nt, Coxiella burnetii RSA 493
cugguucaugcgacggaaugcg

SEQ ID NO: 5291 - RNA, 22 nt, Coxiella burnetii RSA 493
cuuaauguugggugaucauuau

SEQ ID NO: 5292 - RNA, 20 nt, Coxiella burnetii RSA 493
cuuagcgaguuuauucgggc

SEQ ID NO: 5293 - RNA, 22 nt, Coxiella burnetii RSA 493
cuucccaauuaaauauuuccuc

SEQ ID NO: 5294 - RNA, 22 nt, Coxiella burnetii RSA 493
gaaaagcauuuaauccuucugu

SEQ ID NO: 5295 - RNA, 22 nt, Coxiella burnetii RSA 493
gaaaauugaacguugauaacag

SEQ ID NO: 5296 - RNA, 17 nt, Coxiella burnetii RSA 493
gaaauguuucuacuaaa

SEQ ID NO: 5297 - RNA, 22 nt, Coxiella burnetii RSA 493
gaagcgaaauacgggaaacaau

SEQ ID NO: 5298 - RNA, 22 nt, Coxiella burnetii RSA 493
gacggcgggaccauggugguuu

SEQ ID NO: 5299 - RNA, 22 nt, Coxiella burnetii RSA 493
gagacggcgcaauuucaaaaac

SEQ ID NO: 5300 - RNA, 22 nt, Coxiella burnetii RSA 493
gagagcaggcuacggauugauu

SEQ ID NO: 5301 - RNA, 22 nt, Coxiella burnetii RSA 493
gaggcgauuggaguaaagucag

SEQ ID NO: 5302 - RNA, 22 nt, Coxiella burnetii RSA 493
gaucaaaaauaaucuuuugcuu

SEQ ID NO: 5303 - RNA, 22 nt, Coxiella burnetii RSA 493
gaugaaaucacuuacguucaca

SEQ ID NO: 5304 - RNA, 22 nt, Coxiella burnetii RSA 493
gcaaugucaugagaauaaugca

SEQ ID NO: 5305 - RNA, 18 nt, Coxiella burnetii RSA 493
gcagagggauagaaggcc

SEQ ID NO: 5306 - RNA, 22 nt, Coxiella burnetii RSA 493
gcaggcgggaauccagcgcgcu

SEQ ID NO: 5307 - RNA, 22 nt, Coxiella burnetii RSA 493
gcccaucgucauuauugccgga

SEQ ID NO: 5308 - RNA, 22 nt, Coxiella burnetii RSA 493
gcccguaugaaacgaagcgaau

SEQ ID NO: 5309 - RNA, 22 nt, Coxiella burnetii RSA 493
gcccguaugaagcgaaauacgg

SEQ ID NO: 5310 - RNA, 22 nt, Coxiella burnetii RSA 493
gccugugaauuugauuauucag

SEQ ID NO: 5311 - RNA, 21 nt, Coxiella burnetii RSA 493
gcgauuucaccaaaguucaaa

SEQ ID NO: 5312 - RNA, 22 nt, Coxiella burnetii RSA 493
gcggagcgaaauacggggacga

SEQ ID NO: 5313 - RNA, 22 nt, Coxiella burnetii RSA 493
gcggguuucucauuuuuacgaa

SEQ ID NO: 5314 - RNA, 22 nt, Coxiella burnetii RSA 493
gcuaaggcagcuuuagaagcgg

SEQ ID NO: 5315 - RNA, 22 nt, Coxiella burnetii RSA 493
gcucuuuuuucugaugaagaua

SEQ ID NO: 5316 - RNA, 22 nt, Coxiella burnetii RSA 493
gcuuaaaugaaugaaaccgauc

SEQ ID NO: 5317 - RNA, 22 nt, Coxiella burnetii RSA 493
ggcgaauucgguguuuauaucg

SEQ ID NO: 5318 - RNA, 22 nt, Coxiella burnetii RSA 493
ggcuacuuagcuacucggcccc

SEQ ID NO: 5319 - RNA, 22 nt, Coxiella burnetii RSA 493
ggcugccacaggauuuuuaaag

SEQ ID NO: 5320 - RNA, 22 nt, Coxiella burnetii RSA 493
ggcuucgcaaacucagcccaac

SEQ ID NO: 5321 - RNA, 22 nt, Coxiella burnetii RSA 493
gggaaaauaggugucuuugauc

SEQ ID NO: 5322 - RNA, 23 nt, Coxiella burnetii RSA 493
ggguguacaagcauuauuggaug

SEQ ID NO: 5323 - RNA, 22 nt, Coxiella burnetii RSA 493
gguguucgaugaggcuuucaac

SEQ ID NO: 5324 - RNA, 19 nt, Coxiella burnetii RSA 493
gguuaugauuuuauucccg

SEQ ID NO: 5325 - RNA, 22 nt, Coxiella burnetii RSA 493
uucccguauucgcuucguuuca

SEQ ID NO: 5326 - RNA, 22 nt, Coxiella burnetii RSA 493
uucccguauucguucgcucaua

SEQ ID NO: 5327 - RNA, 22 nt, Coxiella burnetii RSA 493
uucccguauuucgcuucgcuca

SEQ ID NO: 5328 - RNA, 22 nt, Coxiella burnetii RSA 493
uuccgcuucgcuucauacgggc

SEQ ID NO: 5329 - RNA, 22 nt, Coxiella burnetii RSA 493
uucgcuaucauuuaacaccaug

SEQ ID NO: 5330 - RNA, 22 nt, Coxiella burnetii RSA 493
uucuacuuccauugacaauggg

SEQ ID NO: 5331 - RNA, 22 nt, Coxiella burnetii RSA 493
uucuccguauuccgcuucgcug

SEQ ID NO: 5332 - RNA, 22 nt, Coxiella burnetii RSA 493
uucuuagccuuuuagccuggau

SEQ ID NO: 5333 - RNA, 22 nt, Coxiella burnetii RSA 493
uucuuuucggcauaaacagcgg

SEQ ID NO: 5334 - RNA, 22 nt, Coxiella burnetii RSA 493
uugauaagguugccuuuuagaa

SEQ ID NO: 5335 - RNA, 22 nt, Coxiella burnetii RSA 493
uugauucugaacgagcuaauug

SEQ ID NO: 5336 - RNA, 22 nt, Coxiella burnetii RSA 493
uugcaaaaccacaucuggccag

SEQ ID NO: 5337 - RNA, 22 nt, Coxiella burnetii RSA 493
uugcugauaaugaucaagauca

SEQ ID NO: 5338 - RNA, 18 nt, Coxiella burnetii RSA 493
uuggcgaagccacacaac

SEQ ID NO: 5339 - RNA, 19 nt, Coxiella burnetii RSA 493
uugguagauaaaaccguaa

SEQ ID NO: 5340 - RNA, 22 nt, Coxiella burnetii RSA 493
uugguuguuccacggcggcaua

SEQ ID NO: 5341 - RNA, 22 nt, Coxiella burnetii RSA 493
uuguccccguauuucgcuucgc

SEQ ID NO: 5342 - RNA, 22 nt, Coxiella burnetii RSA 493
uuguggcgaagccacacgaaca

SEQ ID NO: 5343 - RNA, 22 nt, Coxiella burnetii RSA 493
uuguuaauaucgguuugguaau

SEQ ID NO: 5344 - RNA, 22 nt, Coxiella burnetii RSA 493
uuguugaugagaaccggguuga

SEQ ID NO: 5345 - RNA, 22 nt, Coxiella burnetii RSA 493
uuguuuccccguauuucgcuuc

SEQ ID NO: 5346 - RNA, 22 nt, Coxiella burnetii RSA 493
uuguuucccguauuucgcuucg

SEQ ID NO: 5347 - RNA, 22 nt, Coxiella burnetii RSA 493
uuuaaacauauccaaugguaac

SEQ ID NO: 5348 - RNA, 19 nt, Coxiella burnetii RSA 493
uuuaggaaaccguucgcgc

SEQ ID NO: 5349 - RNA, 22 nt, Coxiella burnetii RSA 493
uuuaguagaaauauguucaaag

SEQ ID NO: 5350 - RNA, 22 nt, Coxiella burnetii RSA 493
uuucauuaauccuccauagccu

SEQ ID NO: 5351 - RNA, 22 nt, Coxiella burnetii RSA 493
uuucgacgguagcuaaaggcuu

SEQ ID NO: 5352 - RNA, 22 nt, Coxiella burnetii RSA 493
uuucggguuuguuaugcaaaag

SEQ ID NO: 5353 - RNA, 22 nt, Coxiella burnetii RSA 493
uuucuuagacuuuuagccugga

SEQ ID NO: 5354 - RNA, 22 nt, Coxiella burnetii RSA 493
uuucuuagccccuuaaccuggg

SEQ ID NO: 5355 - RNA, 22 nt, Coxiella burnetii RSA 493
uuugaaaacgcaccuuauccca

SEQ ID NO: 5356 - RNA, 22 nt, Coxiella burnetii RSA 493
uuuuagcacuuucagcagggaa

SEQ ID NO: 5357 - RNA, 22 nt, Coxiella burnetii RSA 493
uuuucccaggugccauucugag

SEQ ID NO: 5358 - RNA, 22 nt, Coxiella burnetii RSA 493
uuuucccguauucguucgcuca

SEQ ID NO: 5359 - RNA, 22 nt, Coxiella burnetii RSA 493
uuuucuuaguauuguuagucug

SEQ ID NO: 5360 - RNA, 19 nt, Coxiella burnetii RSA 493
uuuuuguuagguagaaaga

SEQ ID NO: 5361 - RNA, 22 nt, Coxiella burnetii RSA 493
aaacgagcguuuacuaauuuau

SEQ ID NO: 5362 - RNA, 22 nt, Coxiella burnetii RSA 493
aaagauggggaugcuaaucugc

SEQ ID NO: 5363 - RNA, 22 nt, Coxiella burnetii RSA 493
aaagggacaauucuuccuuauc

SEQ ID NO: 5364 - RNA, 22 nt, Coxiella burnetii RSA 493
aaaucgcuauaaucuucgacga

SEQ ID NO: 5365 - RNA, 21 nt, Coxiella burnetii RSA 493
aaauucuucuucucauugcga

SEQ ID NO: 5366 - RNA, 22 nt, Coxiella burnetii RSA 493
aacaaggauuguaaugagcagc

SEQ ID NO: 5367 - RNA, 22 nt, Coxiella burnetii RSA 493
aacauugcuguuggcagcacgu

SEQ ID NO: 5368 - RNA, 22 nt, Coxiella burnetii RSA 493
aaccgggauuuauucgagcggc

SEQ ID NO: 5369 - RNA, 22 nt, Coxiella burnetii RSA 493
aacggcuucaccgcaauuagcg

SEQ ID NO: 5370 - RNA, 20 nt, Coxiella burnetii RSA 493
aacggcuugcuugaauuagg

SEQ ID NO: 5371 - RNA, 22 nt, Coxiella burnetii RSA 493
aagcccguauggagcgaagcga

SEQ ID NO: 5372 - RNA, 22 nt, Coxiella burnetii RSA 493
aagcgaaauacgggaaacaaug

SEQ ID NO: 5373 - RNA, 22 nt, Coxiella burnetii RSA 493
aagcgaaauacgggacgauaga

SEQ ID NO: 5374 - RNA, 22 nt, Coxiella burnetii RSA 493
aagcgaaauacggggacgauaa

SEQ ID NO: 5375 - RNA, 22 nt, Coxiella burnetii RSA 493
aagcgaaauacggggacgauug

SEQ ID NO: 5376 - RNA, 22 nt, Coxiella burnetii RSA 493
aagcggaauacggggaauugua

SEQ ID NO: 5377 - RNA, 22 nt, Coxiella burnetii RSA 493
aagcggaauacggggacgauag

SEQ ID NO: 5378 - RNA, 22 nt, Coxiella burnetii RSA 493
uggcgauggaagaaaagacauc

SEQ ID NO: 5379 - RNA, 22 nt, Coxiella burnetii RSA 493
uggcgcugaugugauugcgcca

SEQ ID NO: 5380 - RNA, 22 nt, Coxiella burnetii RSA 493
uggguaaugguaggaacccguu

SEQ ID NO: 5381 - RNA, 22 nt, Coxiella burnetii RSA 493
ugguugugucgcuacgcgacaa

SEQ ID NO: 5382 - RNA, 19 nt, Coxiella burnetii RSA 493
uguaaaaauucauuggcuu

SEQ ID NO: 5383 - RNA, 22 nt, Coxiella burnetii RSA 493
ugucgcguagcgacacaaccac

SEQ ID NO: 5384 - RNA, 21 nt, Coxiella burnetii RSA 493
ugugaagugcguuguuucauc

SEQ ID NO: 5385 - RNA, 22 nt, Coxiella burnetii RSA 493
uguggcgaagccacacaaccac

SEQ ID NO: 5386 - RNA, 22 nt, Coxiella burnetii RSA 493
ugugguuucauccauucgauag

SEQ ID NO: 5387 - RNA, 22 nt, Coxiella burnetii RSA 493
uguuuucccguauuucgcuucg

SEQ ID NO: 5388 - RNA, 22 nt, Coxiella burnetii RSA 493
uguuuuucgauaucauuuaacu

SEQ ID NO: 5389 - RNA, 19 nt, Coxiella burnetii RSA 493
uuaaccacacugaugccgc

SEQ ID NO: 5390 - RNA, 22 nt, Coxiella burnetii RSA 493
uuaauccguugggcgauaaccg

SEQ ID NO: 5391 - RNA, 22 nt, Coxiella burnetii RSA 493
uuacggcagaaagaguuugcgc

SEQ ID NO: 5392 - RNA, 22 nt, Coxiella burnetii RSA 493
uuagauggauuaauaacacgag

SEQ ID NO: 5393 - RNA, 22 nt, Coxiella burnetii RSA 493
uuagccuuuuagucuggauucc

SEQ ID NO: 5394 - RNA, 22 nt, Coxiella burnetii RSA 493
uuagcugcuauugucuuuggua

SEQ ID NO: 5395 - RNA, 22 nt, Coxiella burnetii RSA 493
uuauagaaaugagcuaaagcgg

SEQ ID NO: 5396 - RNA, 22 nt, Coxiella burnetii RSA 493
uucccguacuucgcuucgcuca

SEQ ID NO: 5397 - RNA, 22 nt, Coxiella burnetii RSA 493
uucccguauuccgcuucgcugc

SEQ ID NO: 5398 - RNA, 22 nt, Coxiella burnetii RSA 493
gguugugucgcuaugcgacaac

SEQ ID NO: 5399 - RNA, 22 nt, Coxiella burnetii RSA 493
gguuuuaccgauuaaaauggcu

SEQ ID NO: 5400 - RNA, 22 nt, Coxiella burnetii RSA 493
gguuuuggccgcuaccgugaaa

SEQ ID NO: 5401 - RNA, 22 nt, Coxiella burnetii RSA 493
guaggcgggaaucuagcgcgcu

SEQ ID NO: 5402 - RNA, 22 nt, Coxiella burnetii RSA 493
guaguuaucgcucaguguuaag

SEQ ID NO: 5403 - RNA, 22 nt, Coxiella burnetii RSA 493
guaugcagcgaaguaauacggg

SEQ ID NO: 5404 - RNA, 22 nt, Coxiella burnetii RSA 493
guauggagaagcagaauacggg

SEQ ID NO: 5405 - RNA, 22 nt, Coxiella burnetii RSA 493
guauggagcgaagcgaaauacg

SEQ ID NO: 5406 - RNA, 22 nt, Coxiella burnetii RSA 493
guauucgcugcgcuucauauau

SEQ ID NO: 5407 - RNA, 22 nt, Coxiella burnetii RSA 493
guauuucgccgcgcuucauaca

SEQ ID NO: 5408 - RNA, 22 nt, Coxiella burnetii RSA 493
guauuucgcuucgcuucauacg

SEQ ID NO: 5409 - RNA, 22 nt, Coxiella burnetii RSA 493
gugaugaugggugaaaugucua

SEQ ID NO: 5410 - RNA, 22 nt, Coxiella burnetii RSA 493
gugcaggcgcuagcauuggccg

SEQ ID NO: 5411 - RNA, 22 nt, Coxiella burnetii RSA 493
gugguugugucgcuacgcgaca

SEQ ID NO: 5412 - RNA, 22 nt, Coxiella burnetii RSA 493
guuauuggaagucguuuuggca

SEQ ID NO: 5413 - RNA, 22 nt, Coxiella burnetii RSA 493
guucaaccuucaaugacuuuuc

SEQ ID NO: 5414 - RNA, 22 nt, Coxiella burnetii RSA 493
guuggcuuagauaauugaucgg

SEQ ID NO: 5415 - RNA, 22 nt, Coxiella burnetii RSA 493
guuuggcguacuuaaauuuauu

SEQ ID NO: 5416 - RNA, 17 nt, Coxiella burnetii RSA 493
guuuuuugauaccgaug

SEQ ID NO: 5417 - RNA, 22 nt, Coxiella burnetii RSA 493
caagaaauagcaagcggccagu

SEQ ID NO: 5418 - RNA, 22 nt, Coxiella burnetii RSA 493
cacaguuaaaagggggagaaug

SEQ ID NO: 5419 - RNA, 22 nt, Coxiella burnetii RSA 493
cacguuuuuauuaguaauggcg

SEQ ID NO: 5420 - RNA, 22 nt, Coxiella burnetii RSA 493
cagccguguaaguuuuggauua

SEQ ID NO: 5421 - RNA, 22 nt, Coxiella burnetii RSA 493
caguggcgcaaugaaaaugauc

SEQ ID NO: 5422 - RNA, 22 nt, Coxiella burnetii RSA 493
cauuucccguauuucgcuucgc

SEQ ID NO: 5423 - RNA, 22 nt, Coxiella burnetii RSA 493
ccaaagcauuacgcgcugcuaa

SEQ ID NO: 5424 - RNA, 22 nt, Coxiella burnetii RSA 493
ccaaauugaaaaaauagcugca

SEQ ID NO: 5425 - RNA, 22 nt, Coxiella burnetii RSA 493
ccaagaucguuuggcaggcauc

SEQ ID NO: 5426 - RNA, 23 nt, Coxiella burnetii RSA 493
ccaaguagcuaucgaccguugga

SEQ ID NO: 5427 - RNA, 22 nt, Coxiella burnetii RSA 493
cccagauuaaggggcuaagaaa

SEQ ID NO: 5428 - RNA, 22 nt, Coxiella burnetii RSA 493
cccaguggauugaucggauugu

SEQ ID NO: 5429 - RNA, 22 nt, Coxiella burnetii RSA 493
cccggauuagggggcuaagaaa

SEQ ID NO: 5430 - RNA, 22 nt, Coxiella burnetii RSA 493
cccguaugaagcgaaacgaaau

SEQ ID NO: 5431 - RNA, 22 nt, Coxiella burnetii RSA 493
cccguaugagcgaagcgaaaua

SEQ ID NO: 5432 - RNA, 22 nt, Coxiella burnetii RSA 493
cccguauuacuucgcugcauac

SEQ ID NO: 5433 - RNA, 22 nt, Coxiella burnetii RSA 493
cccguauuccgcuucgcugcau

SEQ ID NO: 5434 - RNA, 22 nt, Coxiella burnetii RSA 493
cccguauuccgcuucgcuucau

SEQ ID NO: 5435 - RNA, 22 nt, Coxiella burnetii RSA 493
aguauuuuguccauuuugaugu

SEQ ID NO: 5436 - RNA, 22 nt, Coxiella burnetii RSA 493
agucuguuuacaauucgcuagu

SEQ ID NO: 5437 - RNA, 22 nt, Coxiella burnetii RSA 493
agugcgcuggguccccgccuuc

SEQ ID NO: 5438 - RNA, 22 nt, Coxiella burnetii RSA 493
aguggaauuaucuaucgcgcca

SEQ ID NO: 5439 - RNA, 22 nt, Coxiella burnetii RSA 493
aguuuucuucaaacacguuuag

SEQ ID NO: 5440 - RNA, 18 nt, Coxiella burnetii RSA 493
auaauaaaaggccugauc

SEQ ID NO: 5441 - RNA, 22 nt, Coxiella burnetii RSA 493
auaauaaauuucggcugcuagc

SEQ ID NO: 5442 - RNA, 19 nt, Coxiella burnetii RSA 493
auacggugugaugguugau

SEQ ID NO: 5443 - RNA, 22 nt, Coxiella burnetii RSA 493
auagaaccacaugaauagugcu

SEQ ID NO: 5444 - RNA, 22 nt, Coxiella burnetii RSA 493
auagcccguaugaagcaaagcg

SEQ ID NO: 5445 - RNA, 22 nt, Coxiella burnetii RSA 493
auauaacuucguuuuacacccu

SEQ ID NO: 5446 - RNA, 22 nt, Coxiella burnetii RSA 493
aucaaugaauucuggcucagcc

SEQ ID NO: 5447 - RNA, 18 nt, Coxiella burnetii RSA 493
auccagcucucuacgucu

SEQ ID NO: 5448 - RNA, 22 nt, Coxiella burnetii RSA 493
aucguccccguauuucgcuucg

SEQ ID NO: 5449 - RNA, 22 nt, Coxiella burnetii RSA 493
augaagcgaagcggaauacggg

SEQ ID NO: 5450 - RNA, 22 nt, Coxiella burnetii RSA 493
augagcgaagcgaaauacgggg

SEQ ID NO: 5451 - RNA, 22 nt, Coxiella burnetii RSA 493
augcagcgaagcgaaauacggg

SEQ ID NO: 5452 - RNA, 22 nt, Coxiella burnetii RSA 493
augcagcgaagcggaauacgag

SEQ ID NO: 5453 - RNA, 22 nt, Coxiella burnetii RSA 493
augcagcgaagcggaauacggg

SEQ ID NO: 5454 - RNA, 21 nt, Coxiella burnetii RSA 493
augcuuuugcuuccauugcca

SEQ ID NO: 5455 - RNA, 18 nt, Coxiella burnetii RSA 493
auggcgguugcuaauuca

SEQ ID NO: 5456 - RNA, 22 nt, Coxiella burnetii RSA 493
augguugugucgcuucgcgaca

SEQ ID NO: 5457 - RNA, 22 nt, Coxiella burnetii RSA 493
augucguuaccuauuuaugacc

SEQ ID NO: 5458 - RNA, 22 nt, Coxiella burnetii RSA 493
auuaaaaugggguaaccaauuu

SEQ ID NO: 5459 - RNA, 22 nt, Coxiella burnetii RSA 493
auuagcugcaacaaccuugugg

SEQ ID NO: 5460 - RNA, 22 nt, Coxiella burnetii RSA 493
auuaggcgaaaaguagcaauua

SEQ ID NO: 5461 - RNA, 22 nt, Coxiella burnetii RSA 493
auuaugauggacugggguuagu

SEQ ID NO: 5462 - RNA, 19 nt, Coxiella burnetii RSA 493
auuccgaaugcggaaccag

SEQ ID NO: 5463 - RNA, 22 nt, Coxiella burnetii RSA 493
auuccgcuucgcuucauacggg

SEQ ID NO: 5464 - RNA, 22 nt, Coxiella burnetii RSA 493
auugauuuuauugagacuuagu

SEQ ID NO: 5465 - RNA, 22 nt, Coxiella burnetii RSA 493
cggguucugauggauguugaau

SEQ ID NO: 5466 - RNA, 22 nt, Coxiella burnetii RSA 493
cgguuaaaaaugugauuggcag

SEQ ID NO: 5467 - RNA, 22 nt, Coxiella burnetii RSA 493
cguaugcagcgaacgaauacgg

SEQ ID NO: 5468 - RNA, 22 nt, Coxiella burnetii RSA 493
cguauguagcgaagcgaaauac

SEQ ID NO: 5469 - RNA, 21 nt, Coxiella burnetii RSA 493
cguauuacgcuucgcucauac

SEQ ID NO: 5470 - RNA, 22 nt, Coxiella burnetii RSA 493
cguuauuagcuuuugguggcgu

SEQ ID NO: 5471 - RNA, 22 nt, Coxiella burnetii RSA 493
cucgcucuuuuaguugacgccu

SEQ ID NO: 5472 - RNA, 22 nt, Coxiella burnetii RSA 493
cugagaaauacugucgaaagug

SEQ ID NO: 5473 - RNA, 22 nt, Coxiella burnetii RSA 493
cugaucaucggagccgguauua

SEQ ID NO: 5474 - RNA, 22 nt, Coxiella burnetii RSA 493
cuggcaaaaauggucaauuauu

SEQ ID NO: 5475 - RNA, 22 nt, Coxiella burnetii RSA 493
cugugcaaauucgcgugcguga

SEQ ID NO: 5476 - RNA, 22 nt, Coxiella burnetii RSA 493
cuguuauugcgcuucugauuua

SEQ ID NO: 5477 - RNA, 22 nt, Coxiella burnetii RSA 493
cuuguugauagcgguguguaau

SEQ ID NO: 5478 - RNA, 19 nt, Coxiella burnetii RSA 493
cuuucguucaugaaugugg

SEQ ID NO: 5479 - RNA, 22 nt, Coxiella burnetii RSA 493
gaaagucauugauaauagcgcg

SEQ ID NO: 5480 - RNA, 22 nt, Coxiella burnetii RSA 493
gaagauauguuauuggaagaag

SEQ ID NO: 5481 - RNA, 22 nt, Coxiella burnetii RSA 493
gaagcgaaauacgggaaaugau

SEQ ID NO: 5482 - RNA, 22 nt, Coxiella burnetii RSA 493
gaagcgaaauacggggacaaua

SEQ ID NO: 5483 - RNA, 22 nt, Coxiella burnetii RSA 493
gaagcgaagcgaaauacgggga

SEQ ID NO: 5484 - RNA, 22 nt, Coxiella burnetii RSA 493
gaagcggaauacgggaaaacaa

SEQ ID NO: 5485 - RNA, 22 nt, Coxiella burnetii RSA 493
gagaaagguucuugucaaguuu

SEQ ID NO: 5486 - RNA, 22 nt, Coxiella burnetii RSA 493
gaggaauuucgaugagcuuggu

SEQ ID NO: 5487 - RNA, 22 nt, Coxiella burnetii RSA 493
gaucgccguccaaauguuuuua

SEQ ID NO: 5488 - RNA, 22 nt, Coxiella burnetii RSA 493
gaugaucaaggaaaaauuaucu

SEQ ID NO: 5489 - RNA, 22 nt, Coxiella burnetii RSA 493
gauuggaaugauugccuuuagu

SEQ ID NO: 5490 - RNA, 22 nt, Coxiella burnetii RSA 493
gcaaauugguuaccccauuuua

SEQ ID NO: 5491 - RNA, 22 nt, Coxiella burnetii RSA 493
gcaagcucagcccaaccuacgu

SEQ ID NO: 5492 - RNA, 22 nt, Coxiella burnetii RSA 493
gcaaugaggugcugcucaauuu

SEQ ID NO: 5493 - RNA, 22 nt, Coxiella burnetii RSA 493
gcagcgaagcgaaauacgggga

SEQ ID NO: 5494 - RNA, 20 nt, Coxiella burnetii RSA 493
gcagcguuaugguagaugga

SEQ ID NO: 5495 - RNA, 22 nt, Coxiella burnetii RSA 493
gcaggggggaauccagcgcgcu

SEQ ID NO: 5496 - RNA, 22 nt, Coxiella burnetii RSA 493
gccauucucuucuccgagguuu

SEQ ID NO: 5497 - RNA, 20 nt, Coxiella burnetii RSA 493
ucgccgcacaagcgggcgug

SEQ ID NO: 5498 - RNA, 22 nt, Coxiella burnetii RSA 493
ucgccguuaaaacggaugauaa

SEQ ID NO: 5499 - RNA, 22 nt, Coxiella burnetii RSA 493
ucggcacagccaugauuguuua

SEQ ID NO: 5500 - RNA, 22 nt, Coxiella burnetii RSA 493
ucuagcauaaugacgaggaaau

SEQ ID NO: 5501 - RNA, 22 nt, Coxiella burnetii RSA 493
ucucaauaccugaaagggacaa

SEQ ID NO: 5502 - RNA, 22 nt, Coxiella burnetii RSA 493
ucucgcuuugcuucauacgggc

SEQ ID NO: 5503 - RNA, 22 nt, Coxiella burnetii RSA 493
ucugcgcaggacguaaaucggc

SEQ ID NO: 5504 - RNA, 20 nt, Coxiella burnetii RSA 493
ucuuauuucuaacuugcgau

SEQ ID NO: 5505 - RNA, 16 nt, Coxiella burnetii RSA 493
ugaaauagugccucuc

SEQ ID NO: 5506 - RNA, 22 nt, Coxiella burnetii RSA 493
ugaagcgauuaugcucgcgacg

SEQ ID NO: 5507 - RNA, 22 nt, Coxiella burnetii RSA 493
ugaauuaauggcucuacguuuu

SEQ ID NO: 5508 - RNA, 22 nt, Coxiella burnetii RSA 493
ugagcaaagcgaaauacgggaa

SEQ ID NO: 5509 - RNA, 22 nt, Coxiella burnetii RSA 493
ugagcgaagcgaaauacgagga

SEQ ID NO: 5510 - RNA, 22 nt, Coxiella burnetii RSA 493
ugagcgaagcgaaauacgggga

SEQ ID NO: 5511 - RNA, 22 nt, Coxiella burnetii RSA 493
ugaggaaauugaaauccucuau

SEQ ID NO: 5512 - RNA, 22 nt, Coxiella burnetii RSA 493
ugaguuaugcuguacuuauguu

SEQ ID NO: 5513 - RNA, 22 nt, Coxiella burnetii RSA 493
ugaugccggucuugauguuauc

SEQ ID NO: 5514 - RNA, 22 nt, Coxiella burnetii RSA 493
ugauuaaaaauauuucacugac

SEQ ID NO: 5515 - RNA, 22 nt, Coxiella burnetii RSA 493
ugauugaugaucguaucgaucg

SEQ ID NO: 5516 - RNA, 22 nt, Coxiella burnetii RSA 493
ugauugggacuuggacggcgag

SEQ ID NO: 5517 - RNA, 21 nt, Coxiella burnetii RSA 493
ugcaaacgaucccggcuguua

SEQ ID NO: 5518 - RNA, 22 nt, Coxiella burnetii RSA 493
ugcagguaaauucggaacccac

SEQ ID NO: 5519 - RNA, 19 nt, Coxiella burnetii RSA 493
ugccaaaauggacgcugca

SEQ ID NO: 5520 - RNA, 22 nt, Coxiella burnetii RSA 493
ugccauuggcgcuuuuauuauc

SEQ ID NO: 5521 - RNA, 22 nt, Coxiella burnetii RSA 493
ugcgcgucauauuuuagcauuu

SEQ ID NO: 5522 - RNA, 22 nt, Coxiella burnetii RSA 493
ugcguccucaauuuuuauauac

SEQ ID NO: 5523 - RNA, 19 nt, Coxiella burnetii RSA 493
ugcuuucaucguucgcugg

SEQ ID NO: 5524 - RNA, 19 nt, Coxiella burnetii RSA 493
ugcuuuuuagcgaucuugg

SEQ ID NO: 5525 - RNA, 22 nt, Coxiella burnetii RSA 493
uggaccaaugcuuuuuuugcau

SEQ ID NO: 5526 - RNA, 22 nt, Coxiella burnetii RSA 493
uggcgacguaguaaugaugaag

SEQ ID NO: 5527 - RNA, 22 nt, Coxiella burnetii RSA 493
ugggccgguaggaauugcagau

SEQ ID NO: 5528 - RNA, 22 nt, Coxiella burnetii RSA 493
uggucagcuugggcuuaauuau

SEQ ID NO: 5529 - RNA, 22 nt, Coxiella burnetii RSA 493
ugguuuaauguuuuagugggcg

SEQ ID NO: 5530 - RNA, 22 nt, Coxiella burnetii RSA 493
ugguuucaggcaucgccuuuga

SEQ ID NO: 5531 - RNA, 22 nt, Coxiella burnetii RSA 493
uguccccguauuucgcuucgcu

SEQ ID NO: 5532 - RNA, 22 nt, Coxiella burnetii RSA 493
ugucgccaccaugcagcgagaa

SEQ ID NO: 5533 - RNA, 22 nt, Coxiella burnetii RSA 493
uguugggcaggauuucguuugu

SEQ ID NO: 5534 - RNA, 22 nt, Coxiella burnetii RSA 493
uuaacgauggucggaucgcauu

SEQ ID NO: 5535 - RNA, 22 nt, Coxiella burnetii RSA 493
uuaauccacgguaauucguuag

SEQ ID NO: 5536 - RNA, 22 nt, Coxiella burnetii RSA 493
uuacuuauggcacgauggcagc

SEQ ID NO: 5537 - RNA, 22 nt, Coxiella burnetii RSA 493
uucaacauuagcggcugcuuua

SEQ ID NO: 5538 - RNA, 22 nt, Coxiella burnetii RSA 493
uucccguauuucgcuucacucc

SEQ ID NO: 5539 - RNA, 22 nt, Coxiella burnetii RSA 493
uucccguauuucgcuucgcugc

SEQ ID NO: 5540 - RNA, 22 nt, Coxiella burnetii RSA 493
uucccguauuucgcuucgcuuc

SEQ ID NO: 5541 - RNA, 22 nt, Coxiella burnetii RSA 493
uucgugugcgauuagccgaggu

SEQ ID NO: 5542 - RNA, 22 nt, Coxiella burnetii RSA 493
uucuuagccuuuuaguuuggau

SEQ ID NO: 5543 - RNA, 22 nt, Coxiella burnetii RSA 493
uugaaauugauuaguggauacu

SEQ ID NO: 5544 - RNA, 22 nt, Coxiella burnetii RSA 493
uugaucgcuuuuugaaguugcu

SEQ ID NO: 5545 - RNA, 21 nt, Coxiella burnetii RSA 493
uugcgcuuuuugcucgucaac

SEQ ID NO: 5546 - RNA, 22 nt, Coxiella burnetii RSA 493
gcccguaugaaacaaagcggaa

SEQ ID NO: 5547 - RNA, 22 nt, Coxiella burnetii RSA 493
gcccguaugcagcgaagcgaaa

SEQ ID NO: 5548 - RNA, 22 nt, Coxiella burnetii RSA 493
gcgaagcgaaacacggggacga

SEQ ID NO: 5549 - RNA, 22 nt, Coxiella burnetii RSA 493
gcgaagcgaaauacggggacaa

SEQ ID NO: 5550 - RNA, 22 nt, Coxiella burnetii RSA 493
gcgaagcgaaauacggggacga

SEQ ID NO: 5551 - RNA, 22 nt, Coxiella burnetii RSA 493
gcgaagcgaaaugcggggacga

SEQ ID NO: 5552 - RNA, 22 nt, Coxiella burnetii RSA 493
gcgcuuuuuaaguaugguauuu

SEQ ID NO: 5553 - RNA, 22 nt, Coxiella burnetii RSA 493
gcguuggauccccgccugcgcg

SEQ ID NO: 5554 - RNA, 23 nt, Coxiella burnetii RSA 493
gcucaauaagcucuuuuaauguu

SEQ ID NO: 5555 - RNA, 22 nt, Coxiella burnetii RSA 493
gcugacuuucacgucuuucuac

SEQ ID NO: 5556 - RNA, 22 nt, Coxiella burnetii RSA 493
gcuugaaaaccuauacuuucaa

SEQ ID NO: 5557 - RNA, 22 nt, Coxiella burnetii RSA 493
gcuuuucucagcauuuuagccc

SEQ ID NO: 5558 - RNA, 22 nt, Coxiella burnetii RSA 493
ggagaauccaugacguuuaaag

SEQ ID NO: 5559 - RNA, 22 nt, Coxiella burnetii RSA 493
ggagcgaagcgaaauacgggga

SEQ ID NO: 5560 - RNA, 22 nt, Coxiella burnetii RSA 493
ggaugcuuauuguauacuaguu

SEQ ID NO: 5561 - RNA, 22 nt, Coxiella burnetii RSA 493
ggcaguuaucgcaauagcgggu

SEQ ID NO: 5562 - RNA, 22 nt, Coxiella burnetii RSA 493
ggcgauagagcggaugcuuauu

SEQ ID NO: 5563 - RNA, 22 nt, Coxiella burnetii RSA 493
ggcuacuuagcuacucggcccg

SEQ ID NO: 5564 - RNA, 22 nt, Coxiella burnetii RSA 493
gggaaauuguagguacgaaugc

SEQ ID NO: 5565 - RNA, 22 nt, Coxiella burnetii RSA 493
ggguucuuuuguguggccaugc

SEQ ID NO: 5566 - RNA, 22 nt, Coxiella burnetii RSA 493
ggucaggccuuuauuaucaggg

SEQ ID NO: 5567 - RNA, 22 nt, Coxiella burnetii RSA 493
gguuauuuggaacuugcgcaac

SEQ ID NO: 5568 - RNA, 22 nt, Coxiella burnetii RSA 493
guaugaagcgcggcgaaauaca

SEQ ID NO: 5569 - RNA, 22 nt, Coxiella burnetii RSA 493
guaugagcgaagcggaauacgg

SEQ ID NO: 5570 - RNA, 22 nt, Coxiella burnetii RSA 493
guaugcagcgaagcggaauacg

SEQ ID NO: 5571 - RNA, 22 nt, Coxiella burnetii RSA 493
guaugcagcgcagcggaauacg

SEQ ID NO: 5572 - RNA, 22 nt, Coxiella burnetii RSA 493
gucgcgcuggugcccguagacc

SEQ ID NO: 5573 - RNA, 22 nt, Coxiella burnetii RSA 493
gucuaugguggccucaugggug

SEQ ID NO: 5574 - RNA, 22 nt, Coxiella burnetii RSA 493
gucuguuuacgauucuacuagu

SEQ ID NO: 5575 - RNA, 22 nt, Coxiella burnetii RSA 493
gucuuuuuggaagcuuuugaag

SEQ ID NO: 5576 - RNA, 21 nt, Coxiella burnetii RSA 493
gugaaaucuuacaaccuguga

SEQ ID NO: 5577 - RNA, 22 nt, Coxiella burnetii RSA 493
gugagaaaauuaauuauuuauu

SEQ ID NO: 5578 - RNA, 22 nt, Coxiella burnetii RSA 493
gugauugacgauugucuaaaac

SEQ ID NO: 5579 - RNA, 22 nt, Coxiella burnetii RSA 493
gugguuguguggcuucgccaca

SEQ ID NO: 5580 - RNA, 22 nt, Coxiella burnetii RSA 493
guucccguauuucgcuucgcuc

SEQ ID NO: 5581 - RNA, 18 nt, Coxiella burnetii RSA 493
guugauccaaauuggcgu

SEQ ID NO: 5582 - RNA, 22 nt, Coxiella burnetii RSA 493
guugauuugcauauugcgccga

SEQ ID NO: 5583 - RNA, 22 nt, Coxiella burnetii RSA 493
guugcggguggaaaauaauaga

SEQ ID NO: 5584 - RNA, 22 nt, Coxiella burnetii RSA 493
guuggcggggaagcguuaauca

SEQ ID NO: 5585 - RNA, 22 nt, Coxiella burnetii RSA 493
guugggcugagcuugcgaagcc

SEQ ID NO: 5586 - RNA, 22 nt, Coxiella burnetii RSA 493
guugucuuuugcgauuccuuau

SEQ ID NO: 5587 - RNA, 22 nt, Coxiella burnetii RSA 493
guugugguaauauuucaucgac

SEQ ID NO: 5588 - RNA, 22 nt, Coxiella burnetii RSA 493
guugugucgcuaugcgacaacu

SEQ ID NO: 5589 - RNA, 21 nt, Coxiella burnetii RSA 493
guuuuauuagguuuucccgcu

SEQ ID NO: 5590 - RNA, 22 nt, Coxiella burnetii RSA 493
guuuugcauggcagaaacgaua

SEQ ID NO: 5591 - RNA, 22 nt, Coxiella burnetii RSA 493
uaaacguuuuauucucguuguc

SEQ ID NO: 5592 - RNA, 22 nt, Coxiella burnetii RSA 493
uaaaguuuguucuucggaagga

SEQ ID NO: 5593 - RNA, 22 nt, Coxiella burnetii RSA 493
uaaaucaaucagcguuuugcua

SEQ ID NO: 5594 - RNA, 22 nt, Coxiella burnetii RSA 493
uaauaaaugucugguaugcugg

SEQ ID NO: 5595 - RNA, 22 nt, Coxiella burnetii RSA 493
uaauaaggcaaaauauacgucg

SEQ ID NO: 5596 - RNA, 22 nt, Coxiella burnetii RSA 493
uaaucguccguaggaagcgcgg

SEQ ID NO: 5597 - RNA, 22 nt, Coxiella burnetii RSA 493
uaauuuuaaucgugaccaucug

SEQ ID NO: 5598 - RNA, 22 nt, Escherichia coli CFT073
guccggcaguaaccgugauguc

SEQ ID NO: 5599 - RNA, 22 nt, Escherichia coli CFT073
gucgccagcaauucauccagug

SEQ ID NO: 5600 - RNA, 22 nt, Escherichia coli CFT073
gucgcggaagagcuuguggaga

SEQ ID NO: 5601 - RNA, 22 nt, Escherichia coli CFT073
gucggcaguucaaaaucucuau

SEQ ID NO: 5602 - RNA, 22 nt, Escherichia coli CFT073
gucgggcguuggccgggcgaca

SEQ ID NO: 5603 - RNA, 22 nt, Escherichia coli CFT073
gucuccccucgcccgcaugaca

SEQ ID NO: 5604 - RNA, 22 nt, Escherichia coli CFT073
gugaaauugaaaucugagguug

SEQ ID NO: 5605 - RNA, 22 nt, Escherichia coli CFT073
gugacaauagcgccggaggaca

SEQ ID NO: 5606 - RNA, 22 nt, Escherichia coli CFT073
gugacgaaguugagaauaccgc

SEQ ID NO: 5607 - RNA, 22 nt, Escherichia coli CFT073
gugauguggaacgagucgaucu

SEQ ID NO: 5608 - RNA, 22 nt, Escherichia coli CFT073
gugcaaaugcccuugauacguc

SEQ ID NO: 5609 - RNA, 22 nt, Escherichia coli CFT073
gugcauaaagguaaucaggcag

SEQ ID NO: 5610 - RNA, 22 nt, Escherichia coli CFT073
gugccguuguugcgugacgacg

SEQ ID NO: 5611 - RNA, 20 nt, Escherichia coli CFT073
gugcgagucgccugaacagu

SEQ ID NO: 5612 - RNA, 22 nt, Escherichia coli CFT073
gugcgccggguuuaucaagauu

SEQ ID NO: 5613 - RNA, 22 nt, Escherichia coli CFT073
gugcggcgcgugcaucgggauu

SEQ ID NO: 5614 - RNA, 22 nt, Escherichia coli CFT073
gugcugauacucuucuucgcag

SEQ ID NO: 5615 - RNA, 22 nt, Escherichia coli CFT073
gugcugccgaauccguuuuauc

SEQ ID NO: 5616 - RNA, 22 nt, Escherichia coli CFT073
gugcugggcggguacauuguua

SEQ ID NO: 5617 - RNA, 22 nt, Escherichia coli CFT073
gugcugguucuugucgauggug

SEQ ID NO: 5618 - RNA, 22 nt, Escherichia coli CFT073
gugcugugcccaaucgucuuua

SEQ ID NO: 5619 - RNA, 22 nt, Escherichia coli CFT073
guggggaaccagguucgccuuc

SEQ ID NO: 5620 - RNA, 22 nt, Escherichia coli CFT073
guggggauguacguauaguucu

SEQ ID NO: 5621 - RNA, 22 nt, Escherichia coli CFT073
guguaaguaaggugguaagguc

SEQ ID NO: 5622 - RNA, 22 nt, Escherichia coli CFT073
gugucgcugccgaaaaagaugc

SEQ ID NO: 5623 - RNA, 22 nt, Escherichia coli CFT073
gugugaccaucuaaugaucgac

SEQ ID NO: 5624 - RNA, 20 nt, Escherichia coli CFT073
guguucguuccuuuucugac

SEQ ID NO: 5625 - RNA, 22 nt, Escherichia coli CFT073
guuaaacagacugagguagguc

SEQ ID NO: 5626 - RNA, 22 nt, Escherichia coli CFT073
guuaaugacuaacacaccggca

SEQ ID NO: 5627 - RNA, 22 nt, Escherichia coli CFT073
guuacggcaguugccgcgucag

SEQ ID NO: 5628 - RNA, 22 nt, Escherichia coli CFT073
guuagcaaagaggaaauuuaca

SEQ ID NO: 5629 - RNA, 21 nt, Escherichia coli CFT073
guuaguggaauggcuggaaaa

SEQ ID NO: 5630 - RNA, 19 nt, Escherichia coli CFT073
guuaucucugcaccaugcg

SEQ ID NO: 5631 - RNA, 22 nt, Escherichia coli CFT073
guucaauggauucagugauggc

SEQ ID NO: 5632 - RNA, 22 nt, Escherichia coli CFT073
guugaugccaucgggauuucuc

SEQ ID NO: 5633 - RNA, 22 nt, Escherichia coli CFT073
guugaugcgcuggauuuguucg

SEQ ID NO: 5634 - RNA, 22 nt, Escherichia coli CFT073
guugauugagcgagugggcgag

SEQ ID NO: 5635 - RNA, 22 nt, Escherichia coli CFT073
uuaucacuugugcguuauaacg

SEQ ID NO: 5636 - RNA, 22 nt, Escherichia coli CFT073
uuauccgauacagcguucaguu

SEQ ID NO: 5637 - RNA, 22 nt, Escherichia coli CFT073
uuaucgcugcgacuaaccgucc

SEQ ID NO: 5638 - RNA, 21 nt, Escherichia coli CFT073
uuauguacagaucuugcgcca

SEQ ID NO: 5639 - RNA, 22 nt, Escherichia coli CFT073
uuauguuacccagcauaucgga

SEQ ID NO: 5640 - RNA, 22 nt, Escherichia coli CFT073
uuauucacacucccuucacuua

SEQ ID NO: 5641 - RNA, 22 nt, Escherichia coli CFT073
uucaccagcgccagcgcuucug

SEQ ID NO: 5642 - RNA, 22 nt, Escherichia coli CFT073
uucacugccgcuggcggguggu

SEQ ID NO: 5643 - RNA, 22 nt, Escherichia coli CFT073
uucagccagaagccugggcacc

SEQ ID NO: 5644 - RNA, 22 nt, Escherichia coli CFT073
uucagucugaauucagccuugc

SEQ ID NO: 5645 - RNA, 23 nt, Escherichia coli CFT073
uucaguggugucauucagugcga

SEQ ID NO: 5646 - RNA, 22 nt, Escherichia coli CFT073
uucaguguaaugguauuggucc

SEQ ID NO: 5647 - RNA, 22 nt, Escherichia coli CFT073
uucaucacuguggcguugauug

SEQ ID NO: 5648 - RNA, 21 nt, Escherichia coli CFT073
uucauguuaauacgcaacguu

SEQ ID NO: 5649 - RNA, 22 nt, Escherichia coli CFT073
uucauuguuaaaaaaugauauu

SEQ ID NO: 5650 - RNA, 23 nt, Escherichia coli CFT073
uuccagccacucaaacucaauca

SEQ ID NO: 5651 - RNA, 22 nt, Escherichia coli CFT073
uuccagccagucagccugacga

SEQ ID NO: 5652 - RNA, 22 nt, Escherichia coli CFT073
uucccuggcaauauccgcuuca

SEQ ID NO: 5653 - RNA, 22 nt, Escherichia coli CFT073
uuccgccagcggcacgcuuuuu

SEQ ID NO: 5654 - RNA, 22 nt, Escherichia coli CFT073
uuccggaguuggaucaaccgga

SEQ ID NO: 5655 - RNA, 22 nt, Escherichia coli CFT073
uuccgguggaaaugcuugagcg

SEQ ID NO: 5656 - RNA, 19 nt, Escherichia coli CFT073
uuccgguuucggacacuca

SEQ ID NO: 5657 - RNA, 22 nt, Escherichia coli CFT073
uuccguuugucgcagcauaucu

SEQ ID NO: 5658 - RNA, 22 nt, Escherichia coli CFT073
uuccugaaauaucugacggcuc

SEQ ID NO: 5659 - RNA, 21 nt, Escherichia coli CFT073
uuccuggcauaguucuagccu

SEQ ID NO: 5660 - RNA, 22 nt, Escherichia coli CFT073
uuccuguucgcgcugcucuuca

SEQ ID NO: 5661 - RNA, 22 nt, Escherichia coli CFT073
uuccuucguugauggaguaggu

SEQ ID NO: 5662 - RNA, 22 nt, Escherichia coli CFT073
uucgaggccgagcauuuucacc

SEQ ID NO: 5663 - RNA, 22 nt, Escherichia coli CFT073
uucgaguugaucgucagagaug

SEQ ID NO: 5664 - RNA, 22 nt, Escherichia coli CFT073
uucgccaggcggaauauugaaa

SEQ ID NO: 5665 - RNA, 22 nt, Escherichia coli CFT073
uucgcggcauguguucgcugau

SEQ ID NO: 5666 - RNA, 22 nt, Escherichia coli CFT073
uucgcguaaacgccaggcgugu

SEQ ID NO: 5667 - RNA, 22 nt, Escherichia coli CFT073
uucgcugaccaccggaauauca

SEQ ID NO: 5668 - RNA, 22 nt, Escherichia coli CFT073
uucggcgcaaugaugggcgcac

SEQ ID NO: 5669 - RNA, 22 nt, Escherichia coli CFT073
uucggggaggcacuggcggaag

SEQ ID NO: 5670 - RNA, 22 nt, Escherichia coli CFT073
uucggguaaucgcaacuuuggu

SEQ ID NO: 5671 - RNA, 22 nt, Escherichia coli CFT073
uucuccuucaacaaacagugcg

SEQ ID NO: 5672 - RNA, 22 nt, Escherichia coli CFT073
uucucggccucggugcgcagcc

SEQ ID NO: 5673 - RNA, 22 nt, Escherichia coli CFT073
uucucguugaaaaauacgcgcu

SEQ ID NO: 5674 - RNA, 23 nt, Escherichia coli CFT073
uucugcucgcuaccugcuguggc

SEQ ID NO: 5675 - RNA, 22 nt, Escherichia coli CFT073
uucugcugauugugcgccgucu

SEQ ID NO: 5676 - RNA, 20 nt, Escherichia coli CFT073
uucuggauuuugccaucaau

SEQ ID NO: 5677 - RNA, 22 nt, Escherichia coli CFT073
uucuggcagugaucgucccugc

SEQ ID NO: 5678 - RNA, 22 nt, Escherichia coli CFT073
uucuggcguuuucaugucgggc

SEQ ID NO: 5679 - RNA, 22 nt, Escherichia coli CFT073
uucuggucuucuuuacugacgc

SEQ ID NO: 5680 - RNA, 19 nt, Escherichia coli CFT073
uucugguuuagauauuuau

SEQ ID NO: 5681 - RNA, 22 nt, Escherichia coli CFT073
uucuguagacaacguuguugcg

SEQ ID NO: 5682 - RNA, 22 nt, Escherichia coli CFT073
uucuucaaccugcguaaaacca

SEQ ID NO: 5683 - RNA, 22 nt, Escherichia coli CFT073
uucuucugguuauuaugccugc

SEQ ID NO: 5684 - RNA, 21 nt, Escherichia coli CFT073
uugaccauugacgccgcugcg

SEQ ID NO: 5685 - RNA, 22 nt, Escherichia coli CFT073
uugaccccgcugaguugaauaa

SEQ ID NO: 5686 - RNA, 22 nt, Escherichia coli CFT073
uugacgcugaaaaucugcgggu

SEQ ID NO: 5687 - RNA, 22 nt, Escherichia coli CFT073
uugagcaagcguugacgcagca

SEQ ID NO: 5688 - RNA, 22 nt, Escherichia coli CFT073
uugaugucaucagccagcuuac

SEQ ID NO: 5689 - RNA, 22 nt, Escherichia coli CFT073
uugcaagauuuuguaggucggg

SEQ ID NO: 5690 - RNA, 22 nt, Escherichia coli CFT073
uugcaagcuucgggcggucuug

SEQ ID NO: 5691 - RNA, 22 nt, Escherichia coli CFT073
uugcacgcuugucagaaacagu

SEQ ID NO: 5692 - RNA, 22 nt, Escherichia coli CFT073
uugcagcgaacguguaggccug

SEQ ID NO: 5693 - RNA, 22 nt, Escherichia coli CFT073
uugccacgcaaaucgguuuugc

SEQ ID NO: 5694 - RNA, 22 nt, Escherichia coli CFT073
uugcccguuggagacggcuuca

SEQ ID NO: 5695 - RNA, 20 nt, Escherichia coli CFT073
uugcccuuccagugacggua

SEQ ID NO: 5696 - RNA, 22 nt, Escherichia coli CFT073
uugccgacgcugcggcgaaauc

SEQ ID NO: 5697 - RNA, 22 nt, Escherichia coli CFT073
uugccggugucugggggcauag

SEQ ID NO: 5698 - RNA, 22 nt, Escherichia coli CFT073
uugccgucaguaagucgauguu

SEQ ID NO: 5699 - RNA, 22 nt, Escherichia coli CFT073
uugcgauucuccucaacgugau

SEQ ID NO: 5700 - RNA, 22 nt, Escherichia coli CFT073
uugcgggagagcuuaucgauau

SEQ ID NO: 5701 - RNA, 22 nt, Escherichia coli CFT073
uugcgguuaacgugggucggca

SEQ ID NO: 5702 - RNA, 22 nt, Escherichia coli CFT073
uugcgguugguaauaaaagucu

SEQ ID NO: 5703 - RNA, 22 nt, Escherichia coli CFT073
uugcguugguagguuugugcau

SEQ ID NO: 5704 - RNA, 22 nt, Escherichia coli CFT073
uugcucauauagauaauuuacu

SEQ ID NO: 5705 - RNA, 22 nt, Escherichia coli CFT073
uugcugaauaucggcgaagugc

SEQ ID NO: 5706 - RNA, 22 nt, Escherichia coli CFT073
uugcugagauugauaaacugau

SEQ ID NO: 5707 - RNA, 22 nt, Escherichia coli CFT073
uugcuuguacaggucaacgaaa

SEQ ID NO: 5708 - RNA, 22 nt, Escherichia coli CFT073
uugcuuuugguuauuaucugca

SEQ ID NO: 5709 - RNA, 22 nt, Escherichia coli CFT073
uuggcaaagggaaauuuaugaa

SEQ ID NO: 5710 - RNA, 22 nt, Escherichia coli CFT073
uuggcagucaggccaggaugcu

SEQ ID NO: 5711 - RNA, 22 nt, Escherichia coli CFT073
uuggccugaauaucgccacugg

SEQ ID NO: 5712 - RNA, 22 nt, Escherichia coli CFT073
uuggcggcacaaagugagugcc

SEQ ID NO: 5713 - RNA, 23 nt, Escherichia coli CFT073
uuggcggcugaagcuuaauuagu

SEQ ID NO: 5714 - RNA, 22 nt, Escherichia coli CFT073
uugggccaggaaagcauaacuu

SEQ ID NO: 5715 - RNA, 22 nt, Escherichia coli CFT073
uuggugaaaauaaagaugccug

SEQ ID NO: 5716 - RNA, 22 nt, Escherichia coli CFT073
uuggugauaaagaaauauuugg

SEQ ID NO: 5717 - RNA, 22 nt, Escherichia coli CFT073
uugguguaguuguucacaacga

SEQ ID NO: 5718 - RNA, 22 nt, Escherichia coli CFT073
uugguguaugugcgcacugcua

SEQ ID NO: 5719 - RNA, 18 nt, Escherichia coli CFT073
uuguaaguccccacuuug

SEQ ID NO: 5720 - RNA, 22 nt, Escherichia coli CFT073
uuguagcaggcguucuacagcc

SEQ ID NO: 5721 - RNA, 22 nt, Escherichia coli CFT073
uuguaggugcgaauuggccaau

SEQ ID NO: 5722 - RNA, 18 nt, Escherichia coli CFT073
uugugguacucaccgaua

SEQ ID NO: 5723 - RNA, 22 nt, Escherichia coli CFT073
gauggggcagguguggaucagc

SEQ ID NO: 5724 - RNA, 22 nt, Escherichia coli CFT073
gaugguugacggccuugaucua

SEQ ID NO: 5725 - RNA, 23 nt, Escherichia coli CFT073
gaugucguacagggcauugccca

SEQ ID NO: 5726 - RNA, 22 nt, Escherichia coli CFT073
gaugugguucagcuuuacgcca

SEQ ID NO: 5727 - RNA, 22 nt, Escherichia coli CFT073
gauguuauccacacccagguaa

SEQ ID NO: 5728 - RNA, 22 nt, Escherichia coli CFT073
gauugauagacaugccgaucau

SEQ ID NO: 5729 - RNA, 22 nt, Escherichia coli CFT073
gcaacgaaaaucaugcuggggu

SEQ ID NO: 5730 - RNA, 22 nt, Escherichia coli CFT073
gcacauugauuuccugaaaguu

SEQ ID NO: 5731 - RNA, 22 nt, Escherichia coli CFT073
gcaccggaggauugcguuucgg

SEQ ID NO: 5732 - RNA, 22 nt, Escherichia coli CFT073
gcacgucuucgacuucgagaau

SEQ ID NO: 5733 - RNA, 22 nt, Escherichia coli CFT073
gcagaaaaucccucccgcuggu

SEQ ID NO: 5734 - RNA, 22 nt, Escherichia coli CFT073
gcagaaauaaccggugacuuua

SEQ ID NO: 5735 - RNA, 22 nt, Escherichia coli CFT073
gcagacgaugaugcagauaacc

SEQ ID NO: 5736 - RNA, 22 nt, Escherichia coli CFT073
gcagcaccgguccgucugggag

SEQ ID NO: 5737 - RNA, 22 nt, Escherichia coli CFT073
gcagcacguugcggcugcguuu

SEQ ID NO: 5738 - RNA, 22 nt, Escherichia coli CFT073
gcagcgacgauggaaaaaggga

SEQ ID NO: 5739 - RNA, 22 nt, Escherichia coli CFT073
gcaggauaacgaccagcgaggc

SEQ ID NO: 5740 - RNA, 22 nt, Escherichia coli CFT073
gcagggcgcggaaauggccccg

SEQ ID NO: 5741 - RNA, 23 nt, Escherichia coli CFT073
gcaggucugaucuuguauauugc

SEQ ID NO: 5742 - RNA, 22 nt, Escherichia coli CFT073
gcauaaguuguaucacuuccgu

SEQ ID NO: 5743 - RNA, 22 nt, Escherichia coli CFT073
gcaucguuguaggccugauaag

SEQ ID NO: 5744 - RNA, 22 nt, Escherichia coli CFT073
gcauguacaugcagcugauaau

SEQ ID NO: 5745 - RNA, 22 nt, Escherichia coli CFT073
gcauuagguaugggauuugaua

SEQ ID NO: 5746 - RNA, 22 nt, Escherichia coli CFT073
gcauuaggugccgaucuggugu

SEQ ID NO: 5747 - RNA, 22 nt, Escherichia coli CFT073
gccaacuggaaugcacugacaa

SEQ ID NO: 5748 - RNA, 22 nt, Escherichia coli CFT073
gccacgcgcaguugcccaaagg

SEQ ID NO: 5749 - RNA, 19 nt, Escherichia coli CFT073
gccagcaaaaaaaucagcc

SEQ ID NO: 5750 - RNA, 22 nt, Escherichia coli CFT073
gccagcacaccgucaaaacgcu

SEQ ID NO: 5751 - RNA, 22 nt, Escherichia coli CFT073
gccagccgcuacugcgguuuuc

SEQ ID NO: 5752 - RNA, 19 nt, Escherichia coli CFT073
gccagucuccggugcacag

SEQ ID NO: 5753 - RNA, 22 nt, Escherichia coli CFT073
gccauugccgagcgcagugaau

SEQ ID NO: 5754 - RNA, 22 nt, Escherichia coli CFT073
gcccggaaagacagaugagcac

SEQ ID NO: 5755 - RNA, 22 nt, Escherichia coli CFT073
gcccgucugcuggugcaaucau

SEQ ID NO: 5756 - RNA, 22 nt, Escherichia coli CFT073
gcccuuuuuuacuuaguagaga

SEQ ID NO: 5757 - RNA, 22 nt, Escherichia coli CFT073
gccgaagaaaaagucggagcau

SEQ ID NO: 5758 - RNA, 19 nt, Escherichia coli CFT073
gccgaagucgcucauagcg

SEQ ID NO: 5759 - RNA, 22 nt, Escherichia coli CFT073
gccgaccugugacugccggaug

SEQ ID NO: 5760 - RNA, 22 nt, Escherichia coli CFT073
gccgauggaguaugaauguaca

SEQ ID NO: 5761 - RNA, 22 nt, Escherichia coli CFT073
gccgcacguucaugccuggcau

SEQ ID NO: 5762 - RNA, 22 nt, Escherichia coli CFT073
gccgcagacaacgacuuauugc

SEQ ID NO: 5763 - RNA, 22 nt, Escherichia coli CFT073
gccgccguuuuaccggugccug

SEQ ID NO: 5764 - RNA, 22 nt, Escherichia coli CFT073
gccgcuccaccgucgggcugac

SEQ ID NO: 5765 - RNA, 22 nt, Escherichia coli CFT073
gccggaaugggggcguuacugg

SEQ ID NO: 5766 - RNA, 22 nt, Escherichia coli CFT073
gccggacauucucucuuuuggu

SEQ ID NO: 5767 - RNA, 22 nt, Escherichia coli CFT073
gccggaggucaucaccagcggg

SEQ ID NO: 5768 - RNA, 22 nt, Escherichia coli CFT073
gccggauacaaaacauugccga

SEQ ID NO: 5769 - RNA, 22 nt, Escherichia coli CFT073
gccggugaaacgcgcgaaauuu

SEQ ID NO: 5770 - RNA, 22 nt, Escherichia coli CFT073
gccggugcuaacccgugaacca

SEQ ID NO: 5771 - RNA, 22 nt, Escherichia coli CFT073
gccgguuguaacgauaagggag

SEQ ID NO: 5772 - RNA, 22 nt, Escherichia coli CFT073
gccgugaaguagaagauauuuu

SEQ ID NO: 5773 - RNA, 22 nt, Escherichia coli CFT073
gccuguccgacaugagagagca

SEQ ID NO: 5774 - RNA, 22 nt, Escherichia coli CFT073
gccuugaagggggugaucguua

SEQ ID NO: 5775 - RNA, 21 nt, Escherichia coli CFT073
gcgaaagacaaaggaaauuua

SEQ ID NO: 5776 - RNA, 22 nt, Escherichia coli CFT073
gcgacaguaaugauucaucgcc

SEQ ID NO: 5777 - RNA, 22 nt, Escherichia coli CFT073
gcgacuguucucccgacguucc

SEQ ID NO: 5778 - RNA, 22 nt, Escherichia coli CFT073
gcgagcagcaucagacgcuugc

SEQ ID NO: 5779 - RNA, 23 nt, Escherichia coli CFT073
gcgaggggaccguucguacacgg

SEQ ID NO: 5780 - RNA, 22 nt, Escherichia coli CFT073
gcgagugccaugcucagucagg

SEQ ID NO: 5781 - RNA, 20 nt, Escherichia coli CFT073
gcgcaauccgacuaaaaggu

SEQ ID NO: 5782 - RNA, 22 nt, Escherichia coli CFT073
gcgcaauucuggggucgaugga

SEQ ID NO: 5783 - RNA, 22 nt, Escherichia coli CFT073
gcgcacgcucagcaggugacca

SEQ ID NO: 5784 - RNA, 22 nt, Escherichia coli CFT073
gcgcacuugaaucgcgggaucg

SEQ ID NO: 5785 - RNA, 22 nt, Escherichia coli CFT073
gcgcauuccaguauugcugacg

SEQ ID NO: 5786 - RNA, 22 nt, Escherichia coli CFT073
gcgccacguuguagggcguuaa

SEQ ID NO: 5787 - RNA, 22 nt, Escherichia coli CFT073
gcgcccugaauucugguaaaaa

SEQ ID NO: 5788 - RNA, 22 nt, Escherichia coli CFT073
gcgccgagcgucagugggaauu

SEQ ID NO: 5789 - RNA, 22 nt, Escherichia coli CFT073
gcgcgaucacagugagcaagaa

SEQ ID NO: 5790 - RNA, 22 nt, Escherichia coli CFT073
gcgcggcggaucugcgucugau

SEQ ID NO: 5791 - RNA, 22 nt, Escherichia coli CFT073
gcgcguaaguauuccagcgaac

SEQ ID NO: 5792 - RNA, 22 nt, Escherichia coli CFT073
gcgcguugaaucuccucuguau

SEQ ID NO: 5793 - RNA, 22 nt, Escherichia coli CFT073
gcgcugauggugauguccugcu

SEQ ID NO: 5794 - RNA, 22 nt, Escherichia coli CFT073
gcgcugccggucgauauugaug

SEQ ID NO: 5795 - RNA, 22 nt, Escherichia coli CFT073
gcgcuucacaggaugaaugucc

SEQ ID NO: 5796 - RNA, 22 nt, Escherichia coli CFT073
gcgcuucugguagauucgggau

SEQ ID NO: 5797 - RNA, 22 nt, Escherichia coli CFT073
gcggcgaugaaagccuggcugg

SEQ ID NO: 5798 - RNA, 22 nt, Escherichia coli CFT073
gcgggaucaacaucgacaaccg

SEQ ID NO: 5799 - RNA, 22 nt, Escherichia coli CFT073
gcgggcgaggcgcauagacguu

SEQ ID NO: 5800 - RNA, 22 nt, Escherichia coli CFT073
gcgggugaugacauucuugcug

SEQ ID NO: 5801 - RNA, 22 nt, Escherichia coli CFT073
gcgguaguuggugcccagacaa

SEQ ID NO: 5802 - RNA, 22 nt, Escherichia coli CFT073
gcgguauagaaguuauugguac

SEQ ID NO: 5803 - RNA, 22 nt, Escherichia coli CFT073
gcgguuuucagguauucgcuga

SEQ ID NO: 5804 - RNA, 22 nt, Escherichia coli CFT073
gcguaauaccgaacaguucaac

SEQ ID NO: 5805 - RNA, 22 nt, Escherichia coli CFT073
gcguaucaucaacccgaugcgc

SEQ ID NO: 5806 - RNA, 22 nt, Escherichia coli CFT073
gcgucaugcagucacgguugaa

SEQ ID NO: 5807 - RNA, 22 nt, Escherichia coli CFT073
gcgucggaguuuguugauguaa

SEQ ID NO: 5808 - RNA, 22 nt, Escherichia coli CFT073
gcgugcauuugaacguucgcgg

SEQ ID NO: 5809 - RNA, 22 nt, Escherichia coli CFT073
gcguggcggccuguggucuggc

SEQ ID NO: 5810 - RNA, 22 nt, Escherichia coli CFT073
gcguggucugguguacgccggu

SEQ ID NO: 5811 - RNA, 22 nt, Escherichia coli CFT073
ucagcaacagcgguacccugcu

SEQ ID NO: 5812 - RNA, 22 nt, Escherichia coli CFT073
ucagcaagaguaucgcgccugu

SEQ ID NO: 5813 - RNA, 22 nt, Escherichia coli CFT073
ucaggaugccgaaguggaugau

SEQ ID NO: 5814 - RNA, 22 nt, Escherichia coli CFT073
ucaggcauuguguaggcagcag

SEQ ID NO: 5815 - RNA, 22 nt, Escherichia coli CFT073
ucagggguugagaaaugcguaa

SEQ ID NO: 5816 - RNA, 22 nt, Escherichia coli CFT073
ucaggucguucugccacgaacu

SEQ ID NO: 5817 - RNA, 22 nt, Escherichia coli CFT073
ucauaaugggaguuuugauacu

SEQ ID NO: 5818 - RNA, 22 nt, Escherichia coli CFT073
ucauacucgucauacuucaucg

SEQ ID NO: 5819 - RNA, 22 nt, Escherichia coli CFT073
ucaucguggugguagcgucagu

SEQ ID NO: 5820 - RNA, 22 nt, Escherichia coli CFT073
ucaucugcgcaucgcuuaacgu

SEQ ID NO: 5821 - RNA, 22 nt, Escherichia coli CFT073
ucaugaaaucgacauguacgca

SEQ ID NO: 5822 - RNA, 22 nt, Escherichia coli CFT073
uccaggcaaacgccaguaaaaa

SEQ ID NO: 5823 - RNA, 22 nt, Escherichia coli CFT073
uccaguucgauuucccgcggau

SEQ ID NO: 5824 - RNA, 22 nt, Escherichia coli CFT073
ucccacaaugccaauacacuug

SEQ ID NO: 5825 - RNA, 22 nt, Escherichia coli CFT073
uccgcaucggcauugaacugga

SEQ ID NO: 5826 - RNA, 23 nt, Escherichia coli CFT073
uccgccugccaguaggcaaugaa

SEQ ID NO: 5827 - RNA, 18 nt, Escherichia coli CFT073
uccgcuggacucccugaa

SEQ ID NO: 5828 - RNA, 22 nt, Escherichia coli CFT073
uccgcuucgccucgaccaucgc

SEQ ID NO: 5829 - RNA, 22 nt, Escherichia coli CFT073
uccgcuuuccggguuuauuccc

SEQ ID NO: 5830 - RNA, 22 nt, Escherichia coli CFT073
uccggcaacagguagucgcgca

SEQ ID NO: 5831 - RNA, 22 nt, Escherichia coli CFT073
uccggcaucuuuccuaacgccg

SEQ ID NO: 5832 - RNA, 22 nt, Escherichia coli CFT073
uccgggaaguagugcagcaugu

SEQ ID NO: 5833 - RNA, 17 nt, Escherichia coli CFT073
uccggugucaucaucaa

SEQ ID NO: 5834 - RNA, 22 nt, Escherichia coli CFT073
uccguuuauucuguugaucagg

SEQ ID NO: 5835 - RNA, 22 nt, Escherichia coli CFT073
uccuggcguaaguaaucgcgga

SEQ ID NO: 5836 - RNA, 22 nt, Escherichia coli CFT073
uccuuauuugcaagagguggcg

SEQ ID NO: 5837 - RNA, 22 nt, Escherichia coli CFT073
uccuuuuucaaauauacuguga

SEQ ID NO: 5838 - RNA, 22 nt, Escherichia coli CFT073
ucgaaaauggauugccacugcg

SEQ ID NO: 5839 - RNA, 17 nt, Escherichia coli CFT073
ucgacgaucggguugaa

SEQ ID NO: 5840 - RNA, 20 nt, Escherichia coli CFT073
ucgacggcaaauuugugcag

SEQ ID NO: 5841 - RNA, 22 nt, Escherichia coli CFT073
ucgauauacccguacuuuguua

SEQ ID NO: 5842 - RNA, 22 nt, Escherichia coli CFT073
ucgauauuguauuuuauuaaga

SEQ ID NO: 5843 - RNA, 22 nt, Escherichia coli CFT073
ucgaucgucaggagcgucuggu

SEQ ID NO: 5844 - RNA, 22 nt, Escherichia coli CFT073
ucgauuuuuauaccaacgugcu

SEQ ID NO: 5845 - RNA, 22 nt, Escherichia coli CFT073
ucgcagauggcgcgccgcuguu

SEQ ID NO: 5846 - RNA, 22 nt, Escherichia coli CFT073
ucgccgcagccaacucuucuuc

SEQ ID NO: 5847 - RNA, 22 nt, Escherichia coli CFT073
ucgcgccauuauggaacgcuug

SEQ ID NO: 5848 - RNA, 22 nt, Escherichia coli CFT073
ucgcggguggugguagucgaua

SEQ ID NO: 5849 - RNA, 22 nt, Escherichia coli CFT073
ucgcucaauguuggggcguaag

SEQ ID NO: 5850 - RNA, 22 nt, Escherichia coli CFT073
ucgcuucgguuaaaaaaaggca

SEQ ID NO: 5851 - RNA, 22 nt, Escherichia coli CFT073
ucgcuuucaucaguucaaaggc

SEQ ID NO: 5852 - RNA, 22 nt, Escherichia coli CFT073
ucgcuuuuacucuucagauugu

SEQ ID NO: 5853 - RNA, 22 nt, Escherichia coli CFT073
ucggcaacaugcacaaccuguu

SEQ ID NO: 5854 - RNA, 22 nt, Escherichia coli CFT073
ucggcagaacggcagcuacgaa

SEQ ID NO: 5855 - RNA, 22 nt, Escherichia coli CFT073
ucggcagcggcggcgacaggga

SEQ ID NO: 5856 - RNA, 20 nt, Escherichia coli CFT073
ucggcgcugucaucaccggg

SEQ ID NO: 5857 - RNA, 22 nt, Escherichia coli CFT073
ucggcggaugguauuguuccag

SEQ ID NO: 5858 - RNA, 23 nt, Escherichia coli CFT073
ucggcggugcgacggucgaauuu

SEQ ID NO: 5859 - RNA, 22 nt, Escherichia coli CFT073
ucgggcguuugauucuuggcuu

SEQ ID NO: 5860 - RNA, 22 nt, Escherichia coli CFT073
ucgguagccaccagggaggaua

SEQ ID NO: 5861 - RNA, 21 nt, Escherichia coli CFT073
ucgguggcugaccaguuuggu

SEQ ID NO: 5862 - RNA, 22 nt, Escherichia coli CFT073
ucgguggucgcuaaauagccgu

SEQ ID NO: 5863 - RNA, 22 nt, Escherichia coli CFT073
ucggugucuucuucucacgcuu

SEQ ID NO: 5864 - RNA, 22 nt, Escherichia coli CFT073
ucgguucuucuggugguguaaa

SEQ ID NO: 5865 - RNA, 22 nt, Escherichia coli CFT073
ucgguugcuguucccgccacug

SEQ ID NO: 5866 - RNA, 22 nt, Escherichia coli CFT073
ucgucauucauuaucagaugcc

SEQ ID NO: 5867 - RNA, 22 nt, Escherichia coli CFT073
ucgugcuggcugguuuuaugcg

SEQ ID NO: 5868 - RNA, 22 nt, Escherichia coli CFT073
ucguuaauauucacuucgcagc

SEQ ID NO: 5869 - RNA, 22 nt, Escherichia coli CFT073
ucguuaucgcgauaguucaggc

SEQ ID NO: 5870 - RNA, 22 nt, Escherichia coli CFT073
ucguuggaucagauccgccagg

SEQ ID NO: 5871 - RNA, 18 nt, Escherichia coli CFT073
ucguuggucaccaugcgg

SEQ ID NO: 5872 - RNA, 22 nt, Escherichia coli CFT073
ucguuguuauccggaguuggag

SEQ ID NO: 5873 - RNA, 22 nt, Escherichia coli CFT073
ucuaaauuauaauguacaccau

SEQ ID NO: 5874 - RNA, 22 nt, Escherichia coli CFT073
ucuaugauuaugaggcgaagua

SEQ ID NO: 5875 - RNA, 22 nt, Escherichia coli CFT073
ucucaauauggaauuucgcucg

SEQ ID NO: 5876 - RNA, 20 nt, Escherichia coli CFT073
ucucccuguugucuggcuga

SEQ ID NO: 5877 - RNA, 20 nt, Escherichia coli CFT073
ucucgccagcgacucgccuc

SEQ ID NO: 5878 - RNA, 22 nt, Escherichia coli CFT073
ucucgcugcugauugcuaacgu

SEQ ID NO: 5879 - RNA, 22 nt, Escherichia coli CFT073
ucugacgauagauuaauguggu

SEQ ID NO: 5880 - RNA, 22 nt, Escherichia coli CFT073
ucugaugggucgacaccggcug

SEQ ID NO: 5881 - RNA, 22 nt, Escherichia coli CFT073
ucugauuaaaucugcccguguu

SEQ ID NO: 5882 - RNA, 22 nt, Escherichia coli CFT073
ucugccagucggggggaggcug

SEQ ID NO: 5883 - RNA, 22 nt, Escherichia coli CFT073
ucugccgccgcaggaagggcgc

SEQ ID NO: 5884 - RNA, 22 nt, Escherichia coli CFT073
ucugccgcguaaaaagucuucg

SEQ ID NO: 5885 - RNA, 22 nt, Escherichia coli CFT073
ucugcgguacacccgggaucau

SEQ ID NO: 5886 - RNA, 22 nt, Escherichia coli CFT073
ucugcguauugcaguugacguc

SEQ ID NO: 5887 - RNA, 22 nt, Escherichia coli CFT073
ucugcguuauccagcgaaccgu

SEQ ID NO: 5888 - RNA, 22 nt, Escherichia coli CFT073
ucuggaguaguguagucaaugg

SEQ ID NO: 5889 - RNA, 23 nt, Escherichia coli CFT073
ucuggcaucacuucuuuguucgg

SEQ ID NO: 5890 - RNA, 22 nt, Escherichia coli CFT073
ucuggccauguucaguuguauc

SEQ ID NO: 5891 - RNA, 23 nt, Escherichia coli CFT073
ucuggcuuguuucugcucaccgu

SEQ ID NO: 5892 - RNA, 22 nt, Escherichia coli CFT073
ucuggggguaacaauucguaaa

SEQ ID NO: 5893 - RNA, 22 nt, Escherichia coli CFT073
ucugguuguggccuuccacguc

SEQ ID NO: 5894 - RNA, 22 nt, Escherichia coli CFT073
ucuguaauuacaaacaacagug

SEQ ID NO: 5895 - RNA, 22 nt, Escherichia coli CFT073
ucuguucagcggccuggugcuu

SEQ ID NO: 5896 - RNA, 22 nt, Escherichia coli CFT073
ucuguuggcggggaagugaucg

SEQ ID NO: 5897 - RNA, 22 nt, Escherichia coli CFT073
ucuucuucgacauguuccaggc

SEQ ID NO: 5898 - RNA, 22 nt, Escherichia coli CFT073
ucuuuaccggaaagcucggcug

SEQ ID NO: 5899 - RNA, 22 nt, Escherichia coli CFT073
ucuuugaugcggugccagcucu

SEQ ID NO: 5900 - RNA, 22 nt, Escherichia coli CFT073
ugaaacugaaacuuaccggcaa

SEQ ID NO: 5901 - RNA, 22 nt, Escherichia coli CFT073
ugaaagagcuggggaugcauuc

SEQ ID NO: 5902 - RNA, 19 nt, Escherichia coli CFT073
ugaaaggcgcuggaugacg

SEQ ID NO: 5903 - RNA, 23 nt, Escherichia coli CFT073
ugaaauccuuaugaaacaaagua

SEQ ID NO: 5904 - RNA, 22 nt, Escherichia coli CFT073
ugaaauccuucacgcgcugcgu

SEQ ID NO: 5905 - RNA, 22 nt, Escherichia coli CFT073
ugaacgccuuaucuggccuacg

SEQ ID NO: 5906 - RNA, 22 nt, Escherichia coli CFT073
ugaagcacuauauuggugcaac

SEQ ID NO: 5907 - RNA, 23 nt, Escherichia coli CFT073
ugaagcugguaauaacguggcga

SEQ ID NO: 5908 - RNA, 22 nt, Escherichia coli CFT073
ugaaguauagccaagacaaccc

SEQ ID NO: 5909 - RNA, 22 nt, Escherichia coli CFT073
ugaauaaaccaucaugauuuuu

SEQ ID NO: 5910 - RNA, 22 nt, Escherichia coli CFT073
ugaauacacagugcaguguuua

SEQ ID NO: 5911 - RNA, 22 nt, Escherichia coli CFT073
ugaauacacggagcaaugucgc

SEQ ID NO: 5912 - RNA, 22 nt, Escherichia coli CFT073
ugaaugguuauuuaucggcauc

SEQ ID NO: 5913 - RNA, 22 nt, Escherichia coli CFT073
ugacaauuauuccuucaaguca

SEQ ID NO: 5914 - RNA, 22 nt, Escherichia coli CFT073
ugacagguuugccauccagcaa

SEQ ID NO: 5915 - RNA, 22 nt, Escherichia coli CFT073
ugaccacugguagugucuggcu

SEQ ID NO: 5916 - RNA, 22 nt, Escherichia coli CFT073
ugaccguaaaggucgucgugaa

SEQ ID NO: 5917 - RNA, 23 nt, Escherichia coli CFT073
ugacgaaacgcuguuugaguucu

SEQ ID NO: 5918 - RNA, 22 nt, Escherichia coli CFT073
ugacgcuguacaugccguacgu

SEQ ID NO: 5919 - RNA, 20 nt, Escherichia coli CFT073
ugacggccccgacauccauc

SEQ ID NO: 5920 - RNA, 22 nt, Escherichia coli CFT073
ugacgguaugaauugccagacg

SEQ ID NO: 5921 - RNA, 16 nt, Escherichia coli CFT073
ugacguugauuauuga

SEQ ID NO: 5922 - RNA, 22 nt, Escherichia coli CFT073
ugacuggcucuuuuucggggcu

SEQ ID NO: 5923 - RNA, 22 nt, Escherichia coli CFT073
ugacugugaaugaaagguuauu

SEQ ID NO: 5924 - RNA, 22 nt, Escherichia coli CFT073
ugagaacggacguuugucgcgc

SEQ ID NO: 5925 - RNA, 22 nt, Escherichia coli CFT073
ugagcauuuauuaaaaccgcua

SEQ ID NO: 5926 - RNA, 22 nt, Escherichia coli CFT073
ugagcgguccguuagguggucg

SEQ ID NO: 5927 - RNA, 22 nt, Escherichia coli CFT073
ugaggcguaaauucucgcgcgu

SEQ ID NO: 5928 - RNA, 20 nt, Escherichia coli CFT073
ugagugauauagcuuugcag

SEQ ID NO: 5929 - RNA, 22 nt, Escherichia coli CFT073
ugaguuuugagcaggcgaugaa

SEQ ID NO: 5930 - RNA, 22 nt, Escherichia coli CFT073
ugauacagcacauggacguaau

SEQ ID NO: 5931 - RNA, 21 nt, Escherichia coli CFT073
ugauaguuuucgcauuccguu

SEQ ID NO: 5932 - RNA, 22 nt, Escherichia coli CFT073
ugauaugaccuuuauauacuca

SEQ ID NO: 5933 - RNA, 22 nt, Escherichia coli CFT073
ugauccgccgccaugacaaagc

SEQ ID NO: 5934 - RNA, 22 nt, Escherichia coli CFT073
ugauggaugucggggccgucag

SEQ ID NO: 5935 - RNA, 23 nt, Escherichia coli CFT073
ugauggugcgcuguagcugauug

SEQ ID NO: 5936 - RNA, 22 nt, Escherichia coli CFT073
ugaugucgaugcugcguuugug

SEQ ID NO: 5937 - RNA, 22 nt, Escherichia coli CFT073
ugauuuuccgaaucaggcugcu

SEQ ID NO: 5938 - RNA, 22 nt, Escherichia coli CFT073
ugcaaauaguaaugagaacgac

SEQ ID NO: 5939 - RNA, 22 nt, Escherichia coli CFT073
ugcaacauuugucgccgcagga

SEQ ID NO: 5940 - RNA, 22 nt, Escherichia coli CFT073
ugcaaccuaucguaacaacgac

SEQ ID NO: 5941 - RNA, 22 nt, Escherichia coli CFT073
ugcaauggcuggcauccggcgu

SEQ ID NO: 5942 - RNA, 21 nt, Escherichia coli CFT073
ugcacaauuaagggauacguc

SEQ ID NO: 5943 - RNA, 22 nt, Escherichia coli CFT073
ugcacgaucuuguaggccggau

SEQ ID NO: 5944 - RNA, 22 nt, Escherichia coli CFT073
ugcacguuacggaaggcaaaaa

SEQ ID NO: 5945 - RNA, 22 nt, Escherichia coli CFT073
ugcagaugcucauauucucgcc

SEQ ID NO: 5946 - RNA, 23 nt, Escherichia coli CFT073
ugcaggacgugacuuuuucguca

SEQ ID NO: 5947 - RNA, 22 nt, Escherichia coli CFT073
ugcaggggcuauguaggccuga

SEQ ID NO: 5948 - RNA, 19 nt, Escherichia coli CFT073
ugcaggguuuuuaaucgga

SEQ ID NO: 5949 - RNA, 22 nt, Escherichia coli CFT073
ugcaggucuugucuaaaagcga

SEQ ID NO: 5950 - RNA, 22 nt, Escherichia coli CFT073
ugcaguuaagugcgguuucgau

SEQ ID NO: 5951 - RNA, 22 nt, Escherichia coli CFT073
ugcaguugcugugucagugauu

SEQ ID NO: 5952 - RNA, 22 nt, Escherichia coli CFT073
ugcaucgguaaacagguugcca

SEQ ID NO: 5953 - RNA, 19 nt, Escherichia coli CFT073
ugcaucguguuauuuucug

SEQ ID NO: 5954 - RNA, 22 nt, Escherichia coli CFT073
ugcauugaagcuagccugugcg

SEQ ID NO: 5955 - RNA, 20 nt, Escherichia coli CFT073
ugccaguuacugacccacgg

SEQ ID NO: 5956 - RNA, 22 nt, Escherichia coli CFT073
ugcccagcaccauagcaaacag

SEQ ID NO: 5957 - RNA, 21 nt, Escherichia coli CFT073
ugcccugagcgaguuuaccgg

SEQ ID NO: 5958 - RNA, 22 nt, Escherichia coli CFT073
ugccgcgcugcucacgcuguuu

SEQ ID NO: 5959 - RNA, 22 nt, Escherichia coli CFT073
ugccguccauuauuaucgcgga

SEQ ID NO: 5960 - RNA, 22 nt, Escherichia coli CFT073
ugccgugucgccggugguugcu

SEQ ID NO: 5961 - RNA, 22 nt, Escherichia coli CFT073
ugccguuacgcugcggugccag

SEQ ID NO: 5962 - RNA, 22 nt, Escherichia coli CFT073
ugccuggacuuuugaauugcgc

SEQ ID NO: 5963 - RNA, 22 nt, Escherichia coli CFT073
ugcgaaaugagaacaacgauga

SEQ ID NO: 5964 - RNA, 21 nt, Escherichia coli CFT073
ugcgacgccaugcacuuugcc

SEQ ID NO: 5965 - RNA, 22 nt, Escherichia coli CFT073
ugcgagaauucuggucguugcc

SEQ ID NO: 5966 - RNA, 22 nt, Escherichia coli CFT073
ugcgcggauaauuauuuuguga

SEQ ID NO: 5967 - RNA, 22 nt, Escherichia coli CFT073
ugcgcuccaguucgccaugacg

SEQ ID NO: 5968 - RNA, 22 nt, Escherichia coli CFT073
ugcgcugguggaacaguggcaa

SEQ ID NO: 5969 - RNA, 22 nt, Escherichia coli CFT073
ugcggucagaauucagccccuu

SEQ ID NO: 5970 - RNA, 22 nt, Escherichia coli CFT073
ugcgugccauccaccagucguu

SEQ ID NO: 5971 - RNA, 22 nt, Escherichia coli CFT073
ugcgugcucagccauucgccaa

SEQ ID NO: 5972 - RNA, 23 nt, Escherichia coli CFT073
ugcuaccgcuaucguccugacgc

SEQ ID NO: 5973 - RNA, 22 nt, Escherichia coli CFT073
ugcuaucuggugagagugucgg

SEQ ID NO: 5974 - RNA, 22 nt, Escherichia coli CFT073
ugcugccgaugcucauucaucg

SEQ ID NO: 5975 - RNA, 22 nt, Escherichia coli CFT073
ugcugcgcaaaacccacuucga

SEQ ID NO: 5976 - RNA, 22 nt, Escherichia coli CFT073
ugcugguacuuaaucgcaccua

SEQ ID NO: 5977 - RNA, 18 nt, Escherichia coli CFT073
ugcuuguauacucacgag

SEQ ID NO: 5978 - RNA, 22 nt, Escherichia coli CFT073
ugcuuugacgaauucuacgacg

SEQ ID NO: 5979 - RNA, 22 nt, Escherichia coli CFT073
uggacacuguauggucuggucu

SEQ ID NO: 5980 - RNA, 20 nt, Escherichia coli CFT073
uggacaggaucggcgguuuu

SEQ ID NO: 5981 - RNA, 22 nt, Escherichia coli CFT073
uggagcuggaugcggguugugc

SEQ ID NO: 5982 - RNA, 22 nt, Escherichia coli CFT073
uggaggucugccagccguucug

SEQ ID NO: 5983 - RNA, 22 nt, Escherichia coli CFT073
uggauagccaggcaggguugua

SEQ ID NO: 5984 - RNA, 22 nt, Escherichia coli CFT073
uggauccgucguuaacgcaaau

SEQ ID NO: 5985 - RNA, 22 nt, Escherichia coli CFT073
uggauguugauauuuaagucug

SEQ ID NO: 5986 - RNA, 22 nt, Escherichia coli CFT073
uggcaaugugccggagcuggcg

SEQ ID NO: 5987 - RNA, 22 nt, Escherichia coli CFT073
uggcaccuucauucuuaauggc

SEQ ID NO: 5988 - RNA, 22 nt, Escherichia coli CFT073
uggcagcguuaauucaaaaccu

SEQ ID NO: 5989 - RNA, 22 nt, Escherichia coli CFT073
uggcaggagguucucguucagg

SEQ ID NO: 5990 - RNA, 19 nt, Escherichia coli CFT073
uggccaacguuuauuacag

SEQ ID NO: 5991 - RNA, 22 nt, Escherichia coli CFT073
uggccagccagaugccacgcau

SEQ ID NO: 5992 - RNA, 22 nt, Escherichia coli CFT073
uggccugaugcgucagauugaa

SEQ ID NO: 5993 - RNA, 22 nt, Escherichia coli CFT073
uggccuuggaacgauguauccu

SEQ ID NO: 5994 - RNA, 22 nt, Escherichia coli CFT073
uggcgacugcugcgcagccuca

SEQ ID NO: 5995 - RNA, 22 nt, Escherichia coli CFT073
uggcgcguggccacaucaucaa

SEQ ID NO: 5996 - RNA, 19 nt, Escherichia coli CFT073
uggcgcuaacuggcgcgca

SEQ ID NO: 5997 - RNA, 22 nt, Escherichia coli CFT073
uggcgcugccgcugcauccgga

SEQ ID NO: 5998 - RNA, 22 nt, Escherichia coli CFT073
uggcggagaaguccaugccgca

SEQ ID NO: 5999 - RNA, 23 nt, Escherichia coli CFT073
uggcggcaaccgggauccugaaa

SEQ ID NO: 6000 - RNA, 22 nt, Escherichia coli CFT073
uggcggcaaucggugcugcgau

SEQ ID NO: 6001 - RNA, 22 nt, Escherichia coli CFT073
uggcggcgguugcaggaauuau

SEQ ID NO: 6002 - RNA, 22 nt, Escherichia coli CFT073
uggcguacucuuuuuccagcgc

SEQ ID NO: 6003 - RNA, 20 nt, Escherichia coli CFT073
uggcguaggcaagugaaauc

SEQ ID NO: 6004 - RNA, 22 nt, Escherichia coli CFT073
uggcgucguguagcgaugacca

SEQ ID NO: 6005 - RNA, 22 nt, Escherichia coli CFT073
uggcgucugcugcacggcgagu

SEQ ID NO: 6006 - RNA, 21 nt, Escherichia coli CFT073
uggcugagaagaagauucugc

SEQ ID NO: 6007 - RNA, 22 nt, Escherichia coli CFT073
uggcugaugaugaccacuuugu

SEQ ID NO: 6008 - RNA, 22 nt, Escherichia coli CFT073
uggcuggcgaucaaucugguua

SEQ ID NO: 6009 - RNA, 22 nt, Escherichia coli CFT073
uggcuuggcgaauggcugagca

SEQ ID NO: 6010 - RNA, 22 nt, Escherichia coli CFT073
uggcuuucgaauauuuuacugu

SEQ ID NO: 6011 - RNA, 22 nt, Escherichia coli CFT073
ugggauauuccagaggagguca

SEQ ID NO: 6012 - RNA, 22 nt, Escherichia coli CFT073
ugggcaaugcccuguacgacau

SEQ ID NO: 6013 - RNA, 22 nt, Escherichia coli CFT073
ugggcgaagauuauauccgcac

SEQ ID NO: 6014 - RNA, 22 nt, Escherichia coli CFT073
ugggcguggauguucgucgguu

SEQ ID NO: 6015 - RNA, 22 nt, Escherichia coli CFT073
ugggucugcggauggaugccuu

SEQ ID NO: 6016 - RNA, 22 nt, Escherichia coli CFT073
uggguggugauuaccagcgccu

SEQ ID NO: 6017 - RNA, 22 nt, Escherichia coli CFT073
uggguuugccgguuaucguuaa

SEQ ID NO: 6018 - RNA, 22 nt, Escherichia coli CFT073
uggguuuugaagcgccgggaga

SEQ ID NO: 6019 - RNA, 22 nt, Escherichia coli CFT073
ugguacgcacguuauguacgug

SEQ ID NO: 6020 - RNA, 22 nt, Escherichia coli CFT073
ugguagauaucgcgcaggaagc

SEQ ID NO: 6021 - RNA, 19 nt, Escherichia coli CFT073
uggucgcguccguggccug

SEQ ID NO: 6022 - RNA, 20 nt, Escherichia coli CFT073
uggucgggauugccguuguu

SEQ ID NO: 6023 - RNA, 22 nt, Escherichia coli CFT073
uggugccgggucagguagaaga

SEQ ID NO: 6024 - RNA, 22 nt, Escherichia coli CFT073
uggugcguuccuuggcaaagug

SEQ ID NO: 6025 - RNA, 22 nt, Escherichia coli CFT073
uggugucguuugccuucaacgu

SEQ ID NO: 6026 - RNA, 22 nt, Escherichia coli CFT073
ugguucaaugauuucugaugaa

SEQ ID NO: 6027 - RNA, 22 nt, Escherichia coli CFT073
ugguugugacaacuuugugauu

SEQ ID NO: 6028 - RNA, 22 nt, Escherichia coli CFT073
ugguuuauuuugauaccguuga

SEQ ID NO: 6029 - RNA, 17 nt, Escherichia coli CFT073
ugguuucucugccguuc

SEQ ID NO: 6030 - RNA, 22 nt, Escherichia coli CFT073
ugguuugcggugaaagccugca

SEQ ID NO: 6031 - RNA, 22 nt, Escherichia coli CFT073
uguacuggcuguacgcaauaau

SEQ ID NO: 6032 - RNA, 20 nt, Escherichia coli CFT073
uguagagcagggccaugauc

SEQ ID NO: 6033 - RNA, 22 nt, Escherichia coli CFT073
ugucacgauugagauuuuuuaa

SEQ ID NO: 6034 - RNA, 22 nt, Escherichia coli CFT073
ugucaguggcgguucaaugcgg

SEQ ID NO: 6035 - RNA, 17 nt, Escherichia coli CFT073
ugucaucagcaaauccg

SEQ ID NO: 6036 - RNA, 22 nt, Escherichia coli CFT073
uguccggcagggcggguuacgc

SEQ ID NO: 6037 - RNA, 22 nt, Escherichia coli CFT073
ugucgcucaacgguuucgcugg

SEQ ID NO: 6038 - RNA, 22 nt, Escherichia coli CFT073
ugucggcgauuucaccacgucg

SEQ ID NO: 6039 - RNA, 22 nt, Escherichia coli CFT073
ugucggcuuuaaccucucuuua

SEQ ID NO: 6040 - RNA, 22 nt, Escherichia coli CFT073
ugucggucaggacuaucgccuc

SEQ ID NO: 6041 - RNA, 22 nt, Escherichia coli CFT073
ugugauacagcacgaugucagc

SEQ ID NO: 6042 - RNA, 20 nt, Escherichia coli CFT073
ugugcgcguaacuugucgau

SEQ ID NO: 6043 - RNA, 22 nt, Escherichia coli CFT073
ugugcguuggcaaacaccaucg

SEQ ID NO: 6044 - RNA, 20 nt, Escherichia coli CFT073
ugugcugccccguggcuuuu

SEQ ID NO: 6045 - RNA, 22 nt, Escherichia coli CFT073
ugugguguaagcacaguaguag

SEQ ID NO: 6046 - RNA, 22 nt, Escherichia coli CFT073
ugugguuuuacuaaaggacacc

SEQ ID NO: 6047 - RNA, 22 nt, Escherichia coli CFT073
uguguacucauguuuaacuaua

SEQ ID NO: 6048 - RNA, 22 nt, Escherichia coli CFT073
uguuaauucugcgacgauuacc

SEQ ID NO: 6049 - RNA, 22 nt, Escherichia coli CFT073
uguuaccgcgggauuuacgccg

SEQ ID NO: 6050 - RNA, 23 nt, Escherichia coli CFT073
uguuacggugguacucacggcgc

SEQ ID NO: 6051 - RNA, 22 nt, Escherichia coli CFT073
uguuagcuaugacggcgauugu

SEQ ID NO: 6052 - RNA, 22 nt, Escherichia coli CFT073
uguucucugguggugcucucag

SEQ ID NO: 6053 - RNA, 22 nt, Escherichia coli CFT073
uguucucuuauaccggcagcgc

SEQ ID NO: 6054 - RNA, 18 nt, Escherichia coli CFT073
uguucuggaaaccggcga

SEQ ID NO: 6055 - RNA, 22 nt, Escherichia coli CFT073
uguugcggaacaucugguugcu

SEQ ID NO: 6056 - RNA, 22 nt, Escherichia coli CFT073
uguugcugcuggguucaaggcu

SEQ ID NO: 6057 - RNA, 22 nt, Escherichia coli CFT073
uguuggcaaucugcugcgccgu

SEQ ID NO: 6058 - RNA, 23 nt, Escherichia coli CFT073
uguuggcgagcagauggugaauc

SEQ ID NO: 6059 - RNA, 22 nt, Escherichia coli CFT073
uguugguaugucguaucacuua

SEQ ID NO: 6060 - RNA, 22 nt, Escherichia coli CFT073
uuaaacugaauauugaagcuaa

SEQ ID NO: 6061 - RNA, 22 nt, Escherichia coli CFT073
uuaacgcgucuuaucaggccua

SEQ ID NO: 6062 - RNA, 22 nt, Escherichia coli CFT073
uuaacgguaaccugauccccac

SEQ ID NO: 6063 - RNA, 22 nt, Escherichia coli CFT073
uuaauagucuucaaucuguauc

SEQ ID NO: 6064 - RNA, 22 nt, Escherichia coli CFT073
uuaaucagcgucuguuuacccu

SEQ ID NO: 6065 - RNA, 22 nt, Escherichia coli CFT073
uuaaucgucaugguuuauggaa

SEQ ID NO: 6066 - RNA, 22 nt, Escherichia coli CFT073
uuaauguucguaaauggcacug

SEQ ID NO: 6067 - RNA, 20 nt, Escherichia coli CFT073
uuacagaggauaaucaaggu

SEQ ID NO: 6068 - RNA, 22 nt, Escherichia coli CFT073
uuaccauaaugauuuucaugug

SEQ ID NO: 6069 - RNA, 23 nt, Escherichia coli CFT073
uuaccgaugaauuuauucguggu

SEQ ID NO: 6070 - RNA, 22 nt, Escherichia coli CFT073
uuacgcagcaguuccaggugcg

SEQ ID NO: 6071 - RNA, 22 nt, Escherichia coli CFT073
uuacggugagcuuuuuacgugg

SEQ ID NO: 6072 - RNA, 22 nt, Escherichia coli CFT073
uuacugcgcgcuuauccucgua

SEQ ID NO: 6073 - RNA, 22 nt, Escherichia coli CFT073
uuagcggcaagcgacgcgacau

SEQ ID NO: 6074 - RNA, 22 nt, Escherichia coli CFT073
uuagcgggugacggauucggua

SEQ ID NO: 6075 - RNA, 22 nt, Escherichia coli CFT073
uagcugaaauggcaucgcgugc

SEQ ID NO: 6076 - RNA, 22 nt, Escherichia coli CFT073
uaggccaguuugaugaucgaaa

SEQ ID NO: 6077 - RNA, 22 nt, Escherichia coli CFT073
uaggccggauaaggcguucacg

SEQ ID NO: 6078 - RNA, 22 nt, Escherichia coli CFT073
uagguggcuuucgaaauggcgg

SEQ ID NO: 6079 - RNA, 22 nt, Escherichia coli CFT073
uagucuggugcgcggcggcgau

SEQ ID NO: 6080 - RNA, 22 nt, Escherichia coli CFT073
uauacgcugccgccauauucaa

SEQ ID NO: 6081 - RNA, 15 nt, Escherichia coli CFT073
uaucaauggcuggcu

SEQ ID NO: 6082 - RNA, 22 nt, Escherichia coli CFT073
uaucaauuuaucgaccugcagc

SEQ ID NO: 6083 - RNA, 22 nt, Escherichia coli CFT073
uaucacgcacuuuucccaguuc

SEQ ID NO: 6084 - RNA, 22 nt, Escherichia coli CFT073
uauccgcucuguucauugauug

SEQ ID NO: 6085 - RNA, 22 nt, Escherichia coli CFT073
uauccuuuugccugggcagaaa

SEQ ID NO: 6086 - RNA, 22 nt, Escherichia coli CFT073
uaucgacggcucagaagugucu

SEQ ID NO: 6087 - RNA, 22 nt, Escherichia coli CFT073
uaucggugaugcuugacgccuu

SEQ ID NO: 6088 - RNA, 22 nt, Escherichia coli CFT073
uaucgugcagcaaaacugcgca

SEQ ID NO: 6089 - RNA, 22 nt, Escherichia coli CFT073
uaucuacgaagaguuuaaaggu

SEQ ID NO: 6090 - RNA, 22 nt, Escherichia coli CFT073
uaucugggaagugccuggcggu

SEQ ID NO: 6091 - RNA, 22 nt, Escherichia coli CFT073
uaucuucgagagugauaacacc

SEQ ID NO: 6092 - RNA, 22 nt, Escherichia coli CFT073
uaucuugugcuuguggcugauc

SEQ ID NO: 6093 - RNA, 22 nt, Escherichia coli CFT073
uaugcacugugaagauccgggc

SEQ ID NO: 6094 - RNA, 22 nt, Escherichia coli CFT073
uaugcauaaaaagcagcggcug

SEQ ID NO: 6095 - RNA, 22 nt, Escherichia coli CFT073
uaugcgcuggggaagauggaua

SEQ ID NO: 6096 - RNA, 22 nt, Escherichia coli CFT073
uaugcgucauaacuucacguau

SEQ ID NO: 6097 - RNA, 20 nt, Escherichia coli CFT073
uauggcaucgucaucgaccg

SEQ ID NO: 6098 - RNA, 22 nt, Escherichia coli CFT073
uaugguaauacugcgaugauua

SEQ ID NO: 6099 - RNA, 22 nt, Escherichia coli CFT073
uauguacaauaauaagcgaaau

SEQ ID NO: 6100 - RNA, 22 nt, Escherichia coli CFT073
uauguuaucugcacuaccauug

SEQ ID NO: 6101 - RNA, 22 nt, Escherichia coli CFT073
uauuaaauaugaaaaguuauga

SEQ ID NO: 6102 - RNA, 22 nt, Escherichia coli CFT073
uauugaugagcguggagcacug

SEQ ID NO: 6103 - RNA, 22 nt, Escherichia coli CFT073
uauugcuaaugcauuggcgagu

SEQ ID NO: 6104 - RNA, 22 nt, Escherichia coli CFT073
uauugcugacggaagcaggaaa

SEQ ID NO: 6105 - RNA, 22 nt, Escherichia coli CFT073
uauugcuggugugaaggucugg

SEQ ID NO: 6106 - RNA, 22 nt, Escherichia coli CFT073
uauuggauuuaucucgcgaaaa

SEQ ID NO: 6107 - RNA, 22 nt, Escherichia coli CFT073
uauugguggugcacauaacgca

SEQ ID NO: 6108 - RNA, 22 nt, Escherichia coli CFT073
uauuuucagcguuaaucaggcu

SEQ ID NO: 6109 - RNA, 22 nt, Escherichia coli CFT073
ucaaacucccuuuacuuaccuu

SEQ ID NO: 6110 - RNA, 22 nt, Escherichia coli CFT073
ucaacguaagcgucacgcagau

SEQ ID NO: 6111 - RNA, 22 nt, Escherichia coli CFT073
ucaacguugguaacaaacagcg

SEQ ID NO: 6112 - RNA, 19 nt, Escherichia coli CFT073
ucaacuggcgcaaaacugg

SEQ ID NO: 6113 - RNA, 23 nt, Escherichia coli CFT073
aacagguugauaacgguagagcc

SEQ ID NO: 6114 - RNA, 22 nt, Escherichia coli CFT073
aacaucuauccgguacgccagg

SEQ ID NO: 6115 - RNA, 22 nt, Escherichia coli CFT073
aaccggcugaaauccuggcaga

SEQ ID NO: 6116 - RNA, 22 nt, Escherichia coli CFT073
aaccgggugaaucagcguuuau

SEQ ID NO: 6117 - RNA, 22 nt, Escherichia coli CFT073
aaccgggugauaaagaccguga

SEQ ID NO: 6118 - RNA, 22 nt, Escherichia coli CFT073
aaccgguugugcacuggucgcc

SEQ ID NO: 6119 - RNA, 22 nt, Escherichia coli CFT073
aacgacgaacgcaaacugaaug

SEQ ID NO: 6120 - RNA, 22 nt, Escherichia coli CFT073
aacgaguaaaaaugacucgccu

SEQ ID NO: 6121 - RNA, 22 nt, Escherichia coli CFT073
aacgauggugucagguuuaaau

SEQ ID NO: 6122 - RNA, 22 nt, Escherichia coli CFT073
aacgccuuauccggccuacaaa

SEQ ID NO: 6123 - RNA, 22 nt, Escherichia coli CFT073
aacgcuuuaauaucuuucggau

SEQ ID NO: 6124 - RNA, 22 nt, Escherichia coli CFT073
aacggcuggcuugaugacgaag

SEQ ID NO: 6125 - RNA, 22 nt, Escherichia coli CFT073
aacgguuaaggaucaauacggc

SEQ ID NO: 6126 - RNA, 22 nt, Escherichia coli CFT073
aacgucgauuccuucuuggcaa

SEQ ID NO: 6127 - RNA, 22 nt, Escherichia coli CFT073
aacgucggcaucgcggaaggcu

SEQ ID NO: 6128 - RNA, 22 nt, Escherichia coli CFT073
aacguuauucggccguucacac

SEQ ID NO: 6129 - RNA, 22 nt, Escherichia coli CFT073
aacguuugcguauuuucaugga

SEQ ID NO: 6130 - RNA, 22 nt, Escherichia coli CFT073
aacucucuguuccagccgugcu

SEQ ID NO: 6131 - RNA, 19 nt, Escherichia coli CFT073
aacugcccgcuuccgcuuc

SEQ ID NO: 6132 - RNA, 21 nt, Escherichia coli CFT073
aacugcuccauucguuguuga

SEQ ID NO: 6133 - RNA, 22 nt, Escherichia coli CFT073
aacuggaacacaaaacucgucg

SEQ ID NO: 6134 - RNA, 22 nt, Escherichia coli CFT073
aacuuacugaugaucaaugcgc

SEQ ID NO: 6135 - RNA, 22 nt, Escherichia coli CFT073
aacuuacuuuacugcagauuuu

SEQ ID NO: 6136 - RNA, 22 nt, Escherichia coli CFT073
aagaaauauucguuguugcgga

SEQ ID NO: 6137 - RNA, 22 nt, Escherichia coli CFT073
aagaaugucaucacccgcguua

SEQ ID NO: 6138 - RNA, 22 nt, Escherichia coli CFT073
aagaccaacuguucaguauuug

SEQ ID NO: 6139 - RNA, 22 nt, Escherichia coli CFT073
aagaccgccggucuuguccauu

SEQ ID NO: 6140 - RNA, 22 nt, Escherichia coli CFT073
aagagaugucauuacugaugcu

SEQ ID NO: 6141 - RNA, 22 nt, Escherichia coli CFT073
aagauacagugauggggauugu

SEQ ID NO: 6142 - RNA, 22 nt, Escherichia coli CFT073
aagauuucguucagcgcgugaa

SEQ ID NO: 6143 - RNA, 22 nt, Escherichia coli CFT073
aagcagcaaauaucgaugauga

SEQ ID NO: 6144 - RNA, 22 nt, Escherichia coli CFT073
aagcaucaaugcaggcgguaag

SEQ ID NO: 6145 - RNA, 22 nt, Escherichia coli CFT073
aaggacaaaaucaauccggugg

SEQ ID NO: 6146 - RNA, 22 nt, Escherichia coli CFT073
aaggcauuuuuacggaugcaga

SEQ ID NO: 6147 - RNA, 22 nt, Escherichia coli CFT073
aagguacgacccggcggaaaga

SEQ ID NO: 6148 - RNA, 22 nt, Escherichia coli CFT073
aagucgauuuccgcuuccugcg

SEQ ID NO: 6149 - RNA, 22 nt, Escherichia coli CFT073
aagugcgaaggucgcaauaugc

SEQ ID NO: 6150 - RNA, 22 nt, Escherichia coli CFT073
aaguggaugacuuugccgccag

SEQ ID NO: 6151 - RNA, 22 nt, Escherichia coli CFT073
aaguuugccguggcaguggcga

SEQ ID NO: 6152 - RNA, 22 nt, Escherichia coli CFT073
aauauucagguuggcaucgguc

SEQ ID NO: 6153 - RNA, 22 nt, Escherichia coli CFT073
aauauuugugguuuaccuucug

SEQ ID NO: 6154 - RNA, 22 nt, Escherichia coli CFT073
aauccgguguuugcauuuuuga

SEQ ID NO: 6155 - RNA, 22 nt, Escherichia coli CFT073
aaucgcuggcuggcgucgcggc

SEQ ID NO: 6156 - RNA, 22 nt, Escherichia coli CFT073
aaucggucacuuaugauauugc

SEQ ID NO: 6157 - RNA, 22 nt, Escherichia coli CFT073
aaugaaacuggcagcgcaguua

SEQ ID NO: 6158 - RNA, 22 nt, Escherichia coli CFT073
aaugaacugguugcguaauuuu

SEQ ID NO: 6159 - RNA, 22 nt, Escherichia coli CFT073
aaugaccaguaaugcuuugccc

SEQ ID NO: 6160 - RNA, 22 nt, Escherichia coli CFT073
aaugagcguacuuuucuggcgu

SEQ ID NO: 6161 - RNA, 22 nt, Escherichia coli CFT073
aaugccccgaucgguugccacg

SEQ ID NO: 6162 - RNA, 22 nt, Escherichia coli CFT073
ucccggugucgaucgacuggau

SEQ ID NO: 6163 - RNA, 22 nt, Escherichia coli CFT073
uccgaaaauaaagccgaguaug

SEQ ID NO: 6164 - RNA, 22 nt, Escherichia coli CFT073
uccgagugguuccggcaaaacc

SEQ ID NO: 6165 - RNA, 22 nt, Escherichia coli CFT073
uccgcaaagacgguuuucgcuu

SEQ ID NO: 6166 - RNA, 22 nt, Escherichia coli CFT073
uccgcgauaauaauggacggca

SEQ ID NO: 6167 - RNA, 22 nt, Escherichia coli CFT073
uccgcguuguacgacaccgaac

SEQ ID NO: 6168 - RNA, 22 nt, Escherichia coli CFT073
uccggaugcagcggcagcgcca

SEQ ID NO: 6169 - RNA, 22 nt, Escherichia coli CFT073
uccggcacuguuuugaggcuua

SEQ ID NO: 6170 - RNA, 22 nt, Escherichia coli CFT073
uccggccuacaaaccguucaaa

SEQ ID NO: 6171 - RNA, 22 nt, Escherichia coli CFT073
uccggccuacaaagucuugcua

SEQ ID NO: 6172 - RNA, 22 nt, Escherichia coli CFT073
uccggguguguacuucgccaug

SEQ ID NO: 6173 - RNA, 22 nt, Escherichia coli CFT073
uccgugaugguucgaugauugg

SEQ ID NO: 6174 - RNA, 22 nt, Escherichia coli CFT073
uccguuuauuuugggcguuguc

SEQ ID NO: 6175 - RNA, 22 nt, Escherichia coli CFT073
uccuccuuucagagugcuccgc

SEQ ID NO: 6176 - RNA, 22 nt, Escherichia coli CFT073
uccugaauuggaagaauaucaa

SEQ ID NO: 6177 - RNA, 19 nt, Escherichia coli CFT073
uccugaccgaagaauuugc

SEQ ID NO: 6178 - RNA, 22 nt, Escherichia coli CFT073
uccugauagacggugccgaugc

SEQ ID NO: 6179 - RNA, 22 nt, Escherichia coli CFT073
uccugauugcggugcucggaua

SEQ ID NO: 6180 - RNA, 22 nt, Escherichia coli CFT073
uccuggugauguaucuguucuu

SEQ ID NO: 6181 - RNA, 22 nt, Escherichia coli CFT073
ucgaagcgggcaacaagccgaa

SEQ ID NO: 6182 - RNA, 22 nt, Escherichia coli CFT073
ucgacacgcugcagaacacgca

SEQ ID NO: 6183 - RNA, 22 nt, Escherichia coli CFT073
ucgacgaauuugcuauauuugc

SEQ ID NO: 6184 - RNA, 22 nt, Escherichia coli CFT073
ucgacguaguaagugacaccac

SEQ ID NO: 6185 - RNA, 22 nt, Escherichia coli CFT073
ucgauaaagcgauggccgacca

SEQ ID NO: 6186 - RNA, 22 nt, Escherichia coli CFT073
ucgauauggugcagucgcugac

SEQ ID NO: 6187 - RNA, 22 nt, Escherichia coli CFT073
ucgaucucuauuccgacguuga

SEQ ID NO: 6188 - RNA, 22 nt, Escherichia coli CFT073
ucgauucaccgauaugcaucag

SEQ ID NO: 6189 - RNA, 22 nt, Escherichia coli CFT073
ucgcacagcgucagcuucugcu

SEQ ID NO: 6190 - RNA, 22 nt, Escherichia coli CFT073
ucgccaaccugcaguuuauagu

SEQ ID NO: 6191 - RNA, 22 nt, Escherichia coli CFT073
ucgccagcauucugcggcuggg

SEQ ID NO: 6192 - RNA, 22 nt, Escherichia coli CFT073
ucgccgauaaucuguacauguu

SEQ ID NO: 6193 - RNA, 22 nt, Escherichia coli CFT073
ucgccgcaccacaacugucagc

SEQ ID NO: 6194 - RNA, 22 nt, Escherichia coli CFT073
ucgccgggcgauguuuucccgg

SEQ ID NO: 6195 - RNA, 22 nt, Escherichia coli CFT073
ucgccgugagagcugcuaaugu

SEQ ID NO: 6196 - RNA, 22 nt, Escherichia coli CFT073
ucgccguguucugcgaaggacg

SEQ ID NO: 6197 - RNA, 22 nt, Escherichia coli CFT073
ucgcgccugaaccgugcuggug

SEQ ID NO: 6198 - RNA, 22 nt, Escherichia coli CFT073
ucgcgccuggcugccagugccg

SEQ ID NO: 6199 - RNA, 21 nt, Escherichia coli CFT073
ucgcguuugaugauauccagc

SEQ ID NO: 6200 - RNA, 22 nt, Escherichia coli CFT073
ucgcuauaacagcgcauggaac

SEQ ID NO: 6201 - RNA, 22 nt, Escherichia coli CFT073
ucgcucauaaucagaucuaaaa

SEQ ID NO: 6202 - RNA, 19 nt, Escherichia coli CFT073
accuuauccauauuuacgc

SEQ ID NO: 6203 - RNA, 22 nt, Escherichia coli CFT073
accuuuuaccagacgcugcauc

SEQ ID NO: 6204 - RNA, 22 nt, Escherichia coli CFT073
acgaagaucgucagccggaacu

SEQ ID NO: 6205 - RNA, 22 nt, Escherichia coli CFT073
acgaugcguauccugauauuga

SEQ ID NO: 6206 - RNA, 22 nt, Escherichia coli CFT073
acgauuuguccgcagcgaguuu

SEQ ID NO: 6207 - RNA, 22 nt, Escherichia coli CFT073
acgccaguaucgugauucaugu

SEQ ID NO: 6208 - RNA, 22 nt, Escherichia coli CFT073
acgccgaagcauuaaaacagcc

SEQ ID NO: 6209 - RNA, 22 nt, Escherichia coli CFT073
acgcgccgucugaaaccgcuga

SEQ ID NO: 6210 - RNA, 22 nt, Escherichia coli CFT073
acgcggcggugguggaagucau

SEQ ID NO: 6211 - RNA, 22 nt, Escherichia coli CFT073
acgcggugguuuuguucguucu

SEQ ID NO: 6212 - RNA, 22 nt, Escherichia coli CFT073
acgcugcgcauaaaacuggcac

SEQ ID NO: 6213 - RNA, 22 nt, Escherichia coli CFT073
acgcugguguuugccgccgccg

SEQ ID NO: 6214 - RNA, 22 nt, Escherichia coli CFT073
acggaagcucccccgccuguga

SEQ ID NO: 6215 - RNA, 22 nt, Escherichia coli CFT073
acggauaaucguuugcaugaug

SEQ ID NO: 6216 - RNA, 22 nt, Escherichia coli CFT073
acggauggucggcucgacgugg

SEQ ID NO: 6217 - RNA, 20 nt, Escherichia coli CFT073
acggcaguuugacguucggc

SEQ ID NO: 6218 - RNA, 22 nt, Escherichia coli CFT073
acggcaugagguugucacguac

SEQ ID NO: 6219 - RNA, 22 nt, Escherichia coli CFT073
acggcgaauuugcuggugcagg

SEQ ID NO: 6220 - RNA, 22 nt, Escherichia coli CFT073
acggcgguauacaucgcgguga

SEQ ID NO: 6221 - RNA, 22 nt, Escherichia coli CFT073
acggcuuguccgguuaaugcuc

SEQ ID NO: 6222 - RNA, 22 nt, Escherichia coli CFT073
acggugacagaacgcuaagauu

SEQ ID NO: 6223 - RNA, 22 nt, Escherichia coli CFT073
acguaaaaacgcaaauccgacu

SEQ ID NO: 6224 - RNA, 23 nt, Escherichia coli CFT073
acguaucaagggcauuugcacca

SEQ ID NO: 6225 - RNA, 22 nt, Escherichia coli CFT073
acgugcagaaauauuuaccgcc

SEQ ID NO: 6226 - RNA, 22 nt, Escherichia coli CFT073
acgugcauuugccgcuuaaccu

SEQ ID NO: 6227 - RNA, 22 nt, Escherichia coli CFT073
acguucauuaccggcgcauaca

SEQ ID NO: 6228 - RNA, 22 nt, Escherichia coli CFT073
acguugaaagcguucaccuauu

SEQ ID NO: 6229 - RNA, 23 nt, Escherichia coli CFT073
acguuucgcuuccauggcucgcg

SEQ ID NO: 6230 - RNA, 22 nt, Escherichia coli CFT073
acguuucugaccagguuccggc

SEQ ID NO: 6231 - RNA, 22 nt, Escherichia coli CFT073
acuaauuagccaucgauaaaaa

SEQ ID NO: 6232 - RNA, 22 nt, Escherichia coli CFT073
acuaugugacccaucaacacgc

SEQ ID NO: 6233 - RNA, 22 nt, Escherichia coli CFT073
acugacguugguuuuuggugaa

SEQ ID NO: 6234 - RNA, 22 nt, Escherichia coli CFT073
acugccuacaacauggaugcac

SEQ ID NO: 6235 - RNA, 22 nt, Escherichia coli CFT073
acugcgaaucagggauuaucuu

SEQ ID NO: 6236 - RNA, 22 nt, Escherichia coli CFT073
acugcggguguaugacacugau

SEQ ID NO: 6237 - RNA, 22 nt, Escherichia coli CFT073
acugcggucugacuggucguaa

SEQ ID NO: 6238 - RNA, 22 nt, Escherichia coli CFT073
acuggaagaucaagagaaaguu

SEQ ID NO: 6239 - RNA, 22 nt, Escherichia coli CFT073
acuggcaauugccagccacggu

SEQ ID NO: 6240 - RNA, 22 nt, Escherichia coli CFT073
acuggcgugccacccaugcuuu

SEQ ID NO: 6241 - RNA, 22 nt, Escherichia coli CFT073
acuggugaaaucggcguauuaa

SEQ ID NO: 6242 - RNA, 22 nt, Escherichia coli CFT073
acuguauaaaaacccuauacug

SEQ ID NO: 6243 - RNA, 22 nt, Escherichia coli CFT073
acuuaaugcguuuguaauaaau

SEQ ID NO: 6244 - RNA, 22 nt, Escherichia coli CFT073
acuuucggguuaucgauaagga

SEQ ID NO: 6245 - RNA, 22 nt, Escherichia coli CFT073
acuuucuucugcggcucaugug

SEQ ID NO: 6246 - RNA, 22 nt, Escherichia coli CFT073
agaaaggaaacgacaggugcug

SEQ ID NO: 6247 - RNA, 22 nt, Escherichia coli CFT073
agacaacaguuggaugcucauu

SEQ ID NO: 6248 - RNA, 22 nt, Escherichia coli CFT073
agaccgauauucaaauagagcg

SEQ ID NO: 6249 - RNA, 22 nt, Escherichia coli CFT073
ugacaacguuucgcggcuauuc

SEQ ID NO: 6250 - RNA, 22 nt, Escherichia coli CFT073
ugaccguuaugugaauauggcc

SEQ ID NO: 6251 - RNA, 22 nt, Escherichia coli CFT073
ugagaaugcgcgggcuggcgug

SEQ ID NO: 6252 - RNA, 22 nt, Escherichia coli CFT073
ugagaaugucaucuucagugac

SEQ ID NO: 6253 - RNA, 22 nt, Escherichia coli CFT073
ugagcaaugcagaugcagauac

SEQ ID NO: 6254 - RNA, 22 nt, Escherichia coli CFT073
ugagcggacuggaugcggcaau

SEQ ID NO: 6255 - RNA, 22 nt, Escherichia coli CFT073
ugaggcugcgcagcagucgcca

SEQ ID NO: 6256 - RNA, 20 nt, Escherichia coli CFT073
ugaguacgcgcuuaccacug

SEQ ID NO: 6257 - RNA, 19 nt, Escherichia coli CFT073
ugagugaagguacgaguaa

SEQ ID NO: 6258 - RNA, 22 nt, Escherichia coli CFT073
ugaucacaguauuaucaaugac

SEQ ID NO: 6259 - RNA, 22 nt, Escherichia coli CFT073
ugaucucuuccugcugagcuuu

SEQ ID NO: 6260 - RNA, 20 nt, Escherichia coli CFT073
ugaugaauuaaccguacugg

SEQ ID NO: 6261 - RNA, 22 nt, Escherichia coli CFT073
ugaugccgugguuaaguacuca

SEQ ID NO: 6262 - RNA, 22 nt, Escherichia coli CFT073
ugaugcgauugcucauggaaaa

SEQ ID NO: 6263 - RNA, 20 nt, Escherichia coli CFT073
ugauggccaccacauucuca

SEQ ID NO: 6264 - RNA, 19 nt, Escherichia coli CFT073
ugauggcgcuuauaaaccg

SEQ ID NO: 6265 - RNA, 22 nt, Escherichia coli CFT073
ugauuuuggacaaguaucaaaa

SEQ ID NO: 6266 - RNA, 22 nt, Escherichia coli CFT073
ugcaaccugcgacgguuucuuc

SEQ ID NO: 6267 - RNA, 22 nt, Escherichia coli CFT073
ugcaacuggaguuaauuucguu

SEQ ID NO: 6268 - RNA, 22 nt, Escherichia coli CFT073
ugcaacuuacguuucggaucga

SEQ ID NO: 6269 - RNA, 22 nt, Escherichia coli CFT073
ugcaaguuaaugaucuaucggc

SEQ ID NO: 6270 - RNA, 22 nt, Escherichia coli CFT073
ugcaauauaaucuuuagcuucu

SEQ ID NO: 6271 - RNA, 22 nt, Escherichia coli CFT073
ugcagauguaguagugauuggu

SEQ ID NO: 6272 - RNA, 22 nt, Escherichia coli CFT073
ugcagcagcaaaauaucuucug

SEQ ID NO: 6273 - RNA, 22 nt, Escherichia coli CFT073
ugcagcaugucaucugcauuuu

SEQ ID NO: 6274 - RNA, 22 nt, Escherichia coli CFT073
ugcagcguucuguaggcuggau

SEQ ID NO: 6275 - RNA, 22 nt, Escherichia coli CFT073
ugcaggaccacguaggccugau

SEQ ID NO: 6276 - RNA, 18 nt, Escherichia coli CFT073
ugcauaauccuucugagc

SEQ ID NO: 6277 - RNA, 22 nt, Escherichia coli CFT073
ugcaucacaaaccugaaaagaa

SEQ ID NO: 6278 - RNA, 22 nt, Escherichia coli CFT073
ugcauccgccugcaguacacca

SEQ ID NO: 6279 - RNA, 22 nt, Escherichia coli CFT073
ugcaugagcuggcuuucgcuga

SEQ ID NO: 6280 - RNA, 22 nt, Escherichia coli CFT073
ugccagcugaucuucgaaguga

SEQ ID NO: 6281 - RNA, 22 nt, Escherichia coli CFT073
ugccaggcccaacccuuucaua

SEQ ID NO: 6282 - RNA, 22 nt, Escherichia coli CFT073
ugccaguacgcagcuucuugcu

SEQ ID NO: 6283 - RNA, 22 nt, Escherichia coli CFT073
ugccaucacgucgauuaucgcc

SEQ ID NO: 6284 - RNA, 22 nt, Escherichia coli CFT073
ugccaucgaugugguuucuauc

SEQ ID NO: 6285 - RNA, 22 nt, Escherichia coli CFT073
ugccauuaaccguuucagccuc

SEQ ID NO: 6286 - RNA, 22 nt, Escherichia coli CFT073
ugccgacaauauugucagccuc

SEQ ID NO: 6287 - RNA, 22 nt, Escherichia coli CFT073
ugccgacaggguggcugugcga

SEQ ID NO: 6288 - RNA, 22 nt, Escherichia coli CFT073
ugccgcauccggcgauuuucau

SEQ ID NO: 6289 - RNA, 22 nt, Escherichia coli CFT073
ugccgccgcgucuguaucaucg

SEQ ID NO: 6290 - RNA, 22 nt, Escherichia coli CFT073
ugccgcucuucuuuaccgguug

SEQ ID NO: 6291 - RNA, 22 nt, Escherichia coli CFT073
ugcgauguccaucaccccuucg

SEQ ID NO: 6292 - RNA, 22 nt, Escherichia coli CFT073
ugcgcgaucgcgggcauacggu

SEQ ID NO: 6293 - RNA, 19 nt, Escherichia coli CFT073
ugcgcgcguuuuauucauc

SEQ ID NO: 6294 - RNA, 23 nt, Escherichia coli CFT073
ugcgugguuaaugcugaugaugc

SEQ ID NO: 6295 - RNA, 19 nt, Escherichia coli CFT073
ugcguugccaaacauggug

SEQ ID NO: 6296 - RNA, 22 nt, Escherichia coli CFT073
ugcguugcgcaguugcgucaau

SEQ ID NO: 6297 - RNA, 22 nt, Escherichia coli CFT073
ugcuaccgacugcuuuuuuggc

SEQ ID NO: 6298 - RNA, 22 nt, Escherichia coli CFT073
ugcuacgcgcuguuguugcagu

SEQ ID NO: 6299 - RNA, 22 nt, Escherichia coli CFT073
ugcucaguccgguuggugauuu

SEQ ID NO: 6300 - RNA, 22 nt, Escherichia coli CFT073
ugcucgauaauuuuggcugcgc

SEQ ID NO: 6301 - RNA, 22 nt, Escherichia coli CFT073
ugcugaucggcacaucgcaguu

SEQ ID NO: 6302 - RNA, 22 nt, Escherichia coli CFT073
ugcugauugcgcacguuugcgg

SEQ ID NO: 6303 - RNA, 22 nt, Escherichia coli CFT073
ugcugcugaaguuccgagcggc

SEQ ID NO: 6304 - RNA, 16 nt, Escherichia coli CFT073
ugcuggaacaaccgga

SEQ ID NO: 6305 - RNA, 22 nt, Escherichia coli CFT073
ugcuggagcuuggcaccagcga

SEQ ID NO: 6306 - RNA, 22 nt, Escherichia coli CFT073
ugcuggauaugaccaucgaaga

SEQ ID NO: 6307 - RNA, 22 nt, Escherichia coli CFT073
ugcuggcauggcaccuuuuucc

SEQ ID NO: 6308 - RNA, 22 nt, Escherichia coli CFT073
ugcugggcaagcgccugacgcc

SEQ ID NO: 6309 - RNA, 22 nt, Escherichia coli CFT073
ugcuggggaaaacauggucgau

SEQ ID NO: 6310 - RNA, 22 nt, Escherichia coli CFT073
ugcuuaaaucgagagccuccua

SEQ ID NO: 6311 - RNA, 22 nt, Escherichia coli CFT073
ugcuuaacaguuugaccggcgc

SEQ ID NO: 6312 - RNA, 22 nt, Escherichia coli CFT073
ugcuucgcucacugccagccac

SEQ ID NO: 6313 - RNA, 22 nt, Escherichia coli CFT073
ugcuucuguuagcggcucuuca

SEQ ID NO: 6314 - RNA, 22 nt, Escherichia coli CFT073
uggaaucugacgaaaauauguu

SEQ ID NO: 6315 - RNA, 22 nt, Escherichia coli CFT073
uggacgccgauaucuacggccc

SEQ ID NO: 6316 - RNA, 22 nt, Escherichia coli CFT073
uggacgcugauuuucugcgccc

SEQ ID NO: 6317 - RNA, 22 nt, Escherichia coli CFT073
uggagcauggcaauauuuugcc

SEQ ID NO: 6318 - RNA, 22 nt, Escherichia coli CFT073
uggagccgucguuaacgcaaau

SEQ ID NO: 6319 - RNA, 22 nt, Escherichia coli CFT073
uggaguacuucaacaucacgcu

SEQ ID NO: 6320 - RNA, 22 nt, Escherichia coli CFT073
uggaugaacccgaaugaacuga

SEQ ID NO: 6321 - RNA, 22 nt, Escherichia coli CFT073
uggaugcuggcaaccgguacag

SEQ ID NO: 6322 - RNA, 22 nt, Escherichia coli CFT073
uggcaacccguuccugcaugau

SEQ ID NO: 6323 - RNA, 22 nt, Escherichia coli CFT073
uggcaggccauuggguugagaa

SEQ ID NO: 6324 - RNA, 20 nt, Escherichia coli CFT073
uggccuguggcuguaugcgc

SEQ ID NO: 6325 - RNA, 22 nt, Escherichia coli CFT073
uggcgaaucagcgauuuuugcu

SEQ ID NO: 6326 - RNA, 22 nt, Escherichia coli CFT073
uggcgaaugugcuggagccaga

SEQ ID NO: 6327 - RNA, 22 nt, Escherichia coli CFT073
uggcgacauguuuccggcgaaa

SEQ ID NO: 6328 - RNA, 22 nt, Escherichia coli CFT073
uggcgcaugaaguacguaaucc

SEQ ID NO: 6329 - RNA, 22 nt, Escherichia coli CFT073
uggcggcacaaaagcagaugaa

SEQ ID NO: 6330 - RNA, 22 nt, Escherichia coli CFT073
uggcggcgcugaccauuuauga

SEQ ID NO: 6331 - RNA, 22 nt, Escherichia coli CFT073
uggcgggcgacuggugcggcug

SEQ ID NO: 6332 - RNA, 22 nt, Escherichia coli CFT073
uggcucaucgcuuucguugugu

SEQ ID NO: 6333 - RNA, 22 nt, Escherichia coli CFT073
ugggauggugguaacgucacau

SEQ ID NO: 6334 - RNA, 22 nt, Escherichia coli CFT073
ugggccguuguuaucgccgugc

SEQ ID NO: 6335 - RNA, 22 nt, Escherichia coli CFT073
ugggcggcgguaacagcgaauc

SEQ ID NO: 6336 - RNA, 20 nt, Escherichia coli CFT073
aguuuggccgagaggauuug

SEQ ID NO: 6337 - RNA, 22 nt, Escherichia coli CFT073
auaaacgccuggcuggcugguu

SEQ ID NO: 6338 - RNA, 22 nt, Escherichia coli CFT073
auaacggcuacaggcauuuucc

SEQ ID NO: 6339 - RNA, 21 nt, Escherichia coli CFT073
auacucucgcgucgugguauc

SEQ ID NO: 6340 - RNA, 22 nt, Escherichia coli CFT073
auagacacaggcuuuggaacga

SEQ ID NO: 6341 - RNA, 22 nt, Escherichia coli CFT073
auaggguggauggaggugaugu

SEQ ID NO: 6342 - RNA, 22 nt, Escherichia coli CFT073
auaucugaacggucacucugac

SEQ ID NO: 6343 - RNA, 22 nt, Escherichia coli CFT073
auaugaccaccaucuugucucu

SEQ ID NO: 6344 - RNA, 22 nt, Escherichia coli CFT073
auauguccacacuccggcggau

SEQ ID NO: 6345 - RNA, 22 nt, Escherichia coli CFT073
auauuacguaacaccgcuggcg

SEQ ID NO: 6346 - RNA, 20 nt, Escherichia coli CFT073
aucaaaaggcagauaacguc

SEQ ID NO: 6347 - RNA, 22 nt, Escherichia coli CFT073
aucaacuguugcugggggcacg

SEQ ID NO: 6348 - RNA, 19 nt, Escherichia coli CFT073
aucaaguguaugcggcguu

SEQ ID NO: 6349 - RNA, 22 nt, Escherichia coli CFT073
aucacaaucgcuguuaucaaca

SEQ ID NO: 6350 - RNA, 22 nt, Escherichia coli CFT073
aucacgccaauacgugaucgca

SEQ ID NO: 6351 - RNA, 22 nt, Escherichia coli CFT073
aucacuucuucucggauuucac

SEQ ID NO: 6352 - RNA, 22 nt, Escherichia coli CFT073
aucagacagggagguagauacg

SEQ ID NO: 6353 - RNA, 22 nt, Escherichia coli CFT073
aucagguuacaacguuccggca

SEQ ID NO: 6354 - RNA, 21 nt, Escherichia coli CFT073
aucauucaccuguuguaacuc

SEQ ID NO: 6355 - RNA, 22 nt, Escherichia coli CFT073
auccaauggcaguagauaaacu

SEQ ID NO: 6356 - RNA, 22 nt, Escherichia coli CFT073
auccagacgauaauaccggcga

SEQ ID NO: 6357 - RNA, 22 nt, Escherichia coli CFT073
auccaucggguuauggcuggcg

SEQ ID NO: 6358 - RNA, 22 nt, Escherichia coli CFT073
auccgcgaauuguuaccgcgug

SEQ ID NO: 6359 - RNA, 22 nt, Escherichia coli CFT073
auccguuuccagucgccgcucu

SEQ ID NO: 6360 - RNA, 22 nt, Escherichia coli CFT073
auccuucccgaaaaauauguau

SEQ ID NO: 6361 - RNA, 22 nt, Escherichia coli CFT073
aucgcaggcgguauuggcggaa

SEQ ID NO: 6362 - RNA, 22 nt, Escherichia coli CFT073
aucgccccuucaagagcuaagc

SEQ ID NO: 6363 - RNA, 22 nt, Escherichia coli CFT073
aucgcucugcaacuggaguuaa

SEQ ID NO: 6364 - RNA, 22 nt, Escherichia coli CFT073
aucggagaauugcagcguaccu

SEQ ID NO: 6365 - RNA, 22 nt, Escherichia coli CFT073
aucggcugaugcauacugcugg

SEQ ID NO: 6366 - RNA, 22 nt, Escherichia coli CFT073
aucggugucuaucuugggcaau

SEQ ID NO: 6367 - RNA, 22 nt, Escherichia coli CFT073
aucguuguagaguuugaucagg

SEQ ID NO: 6368 - RNA, 22 nt, Escherichia coli CFT073
aucugcauuaucaguuuuagcc

SEQ ID NO: 6369 - RNA, 22 nt, Escherichia coli CFT073
aucuggugcagccguuugugga

SEQ ID NO: 6370 - RNA, 22 nt, Escherichia coli CFT073
aucuguuaccguuucaucagua

SEQ ID NO: 6371 - RNA, 22 nt, Escherichia coli CFT073
aucuuaaaauaagagguaggcu

SEQ ID NO: 6372 - RNA, 22 nt, Escherichia coli CFT073
aucuuuauaaaggugguaaacg

SEQ ID NO: 6373 - RNA, 22 nt, Escherichia coli CFT073
augaauauuuagacuaaagagu

SEQ ID NO: 6374 - RNA, 20 nt, Escherichia coli CFT073
augaaucagagaaaaaguga

SEQ ID NO: 6375 - RNA, 22 nt, Escherichia coli CFT073
augaaugaucaaggccuggcau

SEQ ID NO: 6376 - RNA, 22 nt, Escherichia coli CFT073
augacggugaauggccuggcac

SEQ ID NO: 6377 - RNA, 20 nt, Escherichia coli CFT073
augagagaaaaguuauggau

SEQ ID NO: 6378 - RNA, 22 nt, Escherichia coli CFT073
augauaaaacucacuaaacugu

SEQ ID NO: 6379 - RNA, 22 nt, Escherichia coli CFT073
augaugguuggcacuauucugg

SEQ ID NO: 6380 - RNA, 22 nt, Escherichia coli CFT073
ugugcgcuguuggucagcagca

SEQ ID NO: 6381 - RNA, 22 nt, Escherichia coli CFT073
ugugcugauaucagcggugugg

SEQ ID NO: 6382 - RNA, 22 nt, Escherichia coli CFT073
uguggcauauguucgcgcaugg

SEQ ID NO: 6383 - RNA, 22 nt, Escherichia coli CFT073
uguggcguggguaaugcuuugc

SEQ ID NO: 6384 - RNA, 23 nt, Escherichia coli CFT073
uguggcuuuucuugccgauuaug

SEQ ID NO: 6385 - RNA, 22 nt, Escherichia coli CFT073
ugugguacauggggaaagugau

SEQ ID NO: 6386 - RNA, 21 nt, Escherichia coli CFT073
uguuacucgauuuccugccug

SEQ ID NO: 6387 - RNA, 22 nt, Escherichia coli CFT073
uguuaugacuuacgcuuuccag

SEQ ID NO: 6388 - RNA, 22 nt, Escherichia coli CFT073
uguucgcaguggaaguaccguu

SEQ ID NO: 6389 - RNA, 22 nt, Escherichia coli CFT073
uguugaaacuguagcccguucc

SEQ ID NO: 6390 - RNA, 22 nt, Escherichia coli CFT073
uguugccacugcacauggugaa

SEQ ID NO: 6391 - RNA, 19 nt, Escherichia coli CFT073
uguuggcaucaccaguggu

SEQ ID NO: 6392 - RNA, 22 nt, Escherichia coli CFT073
uguuguaccacugguuacgggc

SEQ ID NO: 6393 - RNA, 22 nt, Escherichia coli CFT073
uguuugguaucguuauuguuaa

SEQ ID NO: 6394 - RNA, 22 nt, Escherichia coli CFT073
uguuuuccuguaugaaaaacca

SEQ ID NO: 6395 - RNA, 22 nt, Escherichia coli CFT073
uguuuuugaagagaugacgguc

SEQ ID NO: 6396 - RNA, 22 nt, Escherichia coli CFT073
uuaaaucgcgcaggaaaaugcc

SEQ ID NO: 6397 - RNA, 22 nt, Escherichia coli CFT073
uuaaauuguuuaaugguauuga

SEQ ID NO: 6398 - RNA, 22 nt, Escherichia coli CFT073
uuaacugcugagccggugcguu

SEQ ID NO: 6399 - RNA, 22 nt, Escherichia coli CFT073
uuacccgaccgagccgcgccau

SEQ ID NO: 6400 - RNA, 22 nt, Escherichia coli CFT073
uuacccgcauuucaaugaagga

SEQ ID NO: 6401 - RNA, 22 nt, Escherichia coli CFT073
uuaccgacggugauuuacgccg

SEQ ID NO: 6402 - RNA, 22 nt, Escherichia coli CFT073
uuacggaacauagcacgaccca

SEQ ID NO: 6403 - RNA, 22 nt, Escherichia coli CFT073
uuacugaugcgucugguagugg

SEQ ID NO: 6404 - RNA, 22 nt, Escherichia coli CFT073
uuacugauguugcgaaaacgcu

SEQ ID NO: 6405 - RNA, 22 nt, Escherichia coli CFT073
uuacugcgucagggaaaaccag

SEQ ID NO: 6406 - RNA, 22 nt, Escherichia coli CFT073
uuacuguacgauuucagucaaa

SEQ ID NO: 6407 - RNA, 22 nt, Escherichia coli CFT073
uuagcgccgcaaaaacgggcgc

SEQ ID NO: 6408 - RNA, 21 nt, Escherichia coli CFT073
uuaggguugucauuagucgcg

SEQ ID NO: 6409 - RNA, 20 nt, Escherichia coli CFT073
uuagguaauaucucggcuua

SEQ ID NO: 6410 - RNA, 22 nt, Escherichia coli CFT073
uuaucucggugcgggaacaucc

SEQ ID NO: 6411 - RNA, 22 nt, Escherichia coli CFT073
uuauggcaaaacauuucacucc

SEQ ID NO: 6412 - RNA, 22 nt, Escherichia coli CFT073
uuaugguuuuauaugggauaag

SEQ ID NO: 6413 - RNA, 22 nt, Escherichia coli CFT073
uuauucacuccgcgugguggau

SEQ ID NO: 6414 - RNA, 22 nt, Escherichia coli CFT073
uucaauguugcaugccgcaucu

SEQ ID NO: 6415 - RNA, 22 nt, Escherichia coli CFT073
uucagaauuuggcgaucugaaa

SEQ ID NO: 6416 - RNA, 22 nt, Escherichia coli CFT073
uucagcgacauguacuuacugg

SEQ ID NO: 6417 - RNA, 22 nt, Escherichia coli CFT073
uucagcgcggugauguucuggu

SEQ ID NO: 6418 - RNA, 22 nt, Escherichia coli CFT073
uucaucgaugguuugcgucgug

SEQ ID NO: 6419 - RNA, 22 nt, Escherichia coli CFT073
uucaucuguacugguaaugucu

SEQ ID NO: 6420 - RNA, 22 nt, Escherichia coli CFT073
uuccaucugcggguuggugcug

SEQ ID NO: 6421 - RNA, 22 nt, Escherichia coli CFT073
uucccguucuguuaucggcuga

SEQ ID NO: 6422 - RNA, 19 nt, Escherichia coli CFT073
uuccgcagcgcguguuuua

SEQ ID NO: 6423 - RNA, 22 nt, Escherichia coli CFT073
auuuagaccucuaucucggugu

SEQ ID NO: 6424 - RNA, 17 nt, Escherichia coli CFT073
auuucugcucauccagc

SEQ ID NO: 6425 - RNA, 22 nt, Escherichia coli CFT073
auuucuggcagguugaggaaga

SEQ ID NO: 6426 - RNA, 22 nt, Escherichia coli CFT073
auuugcaaugauuguaggccgg

SEQ ID NO: 6427 - RNA, 22 nt, Escherichia coli CFT073
auuuguguauugucuugccggu

SEQ ID NO: 6428 - RNA, 22 nt, Escherichia coli CFT073
auuuuccgaacaucagugauaa

SEQ ID NO: 6429 - RNA, 19 nt, Escherichia coli CFT073
auuuucuggcucagucucg

SEQ ID NO: 6430 - RNA, 22 nt, Escherichia coli CFT073
caaacgcaguucuggcaacugg

SEQ ID NO: 6431 - RNA, 22 nt, Escherichia coli CFT073
caaagugugucgucggcauggu

SEQ ID NO: 6432 - RNA, 22 nt, Escherichia coli CFT073
caaauugccgagaagcugcugc

SEQ ID NO: 6433 - RNA, 22 nt, Escherichia coli CFT073
caacaaagacguuguucgcgaa

SEQ ID NO: 6434 - RNA, 22 nt, Escherichia coli CFT073
caacgccuuccacaacggcgcu

SEQ ID NO: 6435 - RNA, 22 nt, Escherichia coli CFT073
caaugaaagcguucgucgugac

SEQ ID NO: 6436 - RNA, 22 nt, Escherichia coli CFT073
caaugcucaugaaggugaagaa

SEQ ID NO: 6437 - RNA, 22 nt, Escherichia coli CFT073
cacagcuaaaguccagccaggu

SEQ ID NO: 6438 - RNA, 22 nt, Escherichia coli CFT073
caccaaagcgcugguggaaggu

SEQ ID NO: 6439 - RNA, 22 nt, Escherichia coli CFT073
caccagcaacuggggggccgcu

SEQ ID NO: 6440 - RNA, 22 nt, Escherichia coli CFT073
caccgaaagauaaguauaucgu

SEQ ID NO: 6441 - RNA, 22 nt, Escherichia coli CFT073
caccgcuguuagucagaacugu

SEQ ID NO: 6442 - RNA, 22 nt, Escherichia coli CFT073
caccggguauacuaucuccagg

SEQ ID NO: 6443 - RNA, 20 nt, Escherichia coli CFT073
cacgaauauuaucgacguaa

SEQ ID NO: 6444 - RNA, 22 nt, Escherichia coli CFT073
cacgaugauauucaccacgccg

SEQ ID NO: 6445 - RNA, 22 nt, Escherichia coli CFT073
cacgcaguagcuuuccuguccu

SEQ ID NO: 6446 - RNA, 20 nt, Escherichia coli CFT073
cacgcggcuagucaguuuag

SEQ ID NO: 6447 - RNA, 22 nt, Escherichia coli CFT073
cacuuuggugccauugguuaaa

SEQ ID NO: 6448 - RNA, 22 nt, Escherichia coli CFT073
cagaaagucgagucgcuguggc

SEQ ID NO: 6449 - RNA, 22 nt, Escherichia coli CFT073
cagaaagugacuacgcgugcac

SEQ ID NO: 6450 - RNA, 22 nt, Escherichia coli CFT073
cagaacuggugauauagcggcu

SEQ ID NO: 6451 - RNA, 22 nt, Escherichia coli CFT073
cagaccaugaucgcgacauuaa

SEQ ID NO: 6452 - RNA, 22 nt, Escherichia coli CFT073
cagacgguucauuuuguagcgc

SEQ ID NO: 6453 - RNA, 22 nt, Escherichia coli CFT073
cagagcauuaacgguagggucg

SEQ ID NO: 6454 - RNA, 22 nt, Escherichia coli CFT073
cagaggaaagcuguugggacug

SEQ ID NO: 6455 - RNA, 22 nt, Escherichia coli CFT073
cagaugcuguauauucaggugg

SEQ ID NO: 6456 - RNA, 22 nt, Escherichia coli CFT073
cagccaaagacuggaaacuggu

SEQ ID NO: 6457 - RNA, 22 nt, Escherichia coli CFT073
cagcgcguaguacgcaucgagg

SEQ ID NO: 6458 - RNA, 22 nt, Escherichia coli CFT073
cagcggcucgccuuuugccgug

SEQ ID NO: 6459 - RNA, 22 nt, Escherichia coli CFT073
cagcgguaacgucugacuauac

SEQ ID NO: 6460 - RNA, 22 nt, Escherichia coli CFT073
cagcgugagcagcgcggcagac

SEQ ID NO: 6461 - RNA, 23 nt, Escherichia coli CFT073
cagcguuauuaccggagagacgc

SEQ ID NO: 6462 - RNA, 20 nt, Escherichia coli CFT073
cagcuccaccugcagcccgu

SEQ ID NO: 6463 - RNA, 22 nt, Escherichia coli CFT073
caggauaaugaauacagagggg

SEQ ID NO: 6464 - RNA, 22 nt, Escherichia coli CFT073
caggccgucgaugacaaaaaua

SEQ ID NO: 6465 - RNA, 22 nt, Escherichia coli CFT073
caggccuacgaucuucuugcaa

SEQ ID NO: 6466 - RNA, 22 nt, Escherichia coli CFT073
caggccuacugggugaguugca

SEQ ID NO: 6467 - RNA, 22 nt, Escherichia coli CFT073
caggcugcguucaaggugaugg

SEQ ID NO: 6468 - RNA, 22 nt, Escherichia coli CFT073
cagggugcggaccugcugguga

SEQ ID NO: 6469 - RNA, 19 nt, Escherichia coli CFT073
uugcuucugaauauaucua

SEQ ID NO: 6470 - RNA, 22 nt, Escherichia coli CFT073
uuggaucauaguuucuggaacu

SEQ ID NO: 6471 - RNA, 22 nt, Escherichia coli CFT073
uuggcacuacgcuuucuggcua

SEQ ID NO: 6472 - RNA, 22 nt, Escherichia coli CFT073
uuggcuguaagcccccagaugg

SEQ ID NO: 6473 - RNA, 22 nt, Escherichia coli CFT073
uugggugaguuauggcguggcg

SEQ ID NO: 6474 - RNA, 22 nt, Escherichia coli CFT073
uugguaucaacgauagcaaaua

SEQ ID NO: 6475 - RNA, 22 nt, Escherichia coli CFT073
uuggugaugauuuaccggauca

SEQ ID NO: 6476 - RNA, 22 nt, Escherichia coli CFT073
uuguaaauuuccucuuugcuaa

SEQ ID NO: 6477 - RNA, 19 nt, Escherichia coli CFT073
uuguaggccugauaagcgu

SEQ ID NO: 6478 - RNA, 21 nt, Escherichia coli CFT073
uuguccgcuaucuggcggcac

SEQ ID NO: 6479 - RNA, 23 nt, Escherichia coli CFT073
uugucgcuggaagguauuggcgc

SEQ ID NO: 6480 - RNA, 22 nt, Escherichia coli CFT073
uugugcgucgcgaacugcgggu

SEQ ID NO: 6481 - RNA, 22 nt, Escherichia coli CFT073
uugugcuggaugaaguaccaga

SEQ ID NO: 6482 - RNA, 22 nt, Escherichia coli CFT073
uugugggguauaaaacgcggcg

SEQ ID NO: 6483 - RNA, 22 nt, Escherichia coli CFT073
uugugguugguacaagcccguc

SEQ ID NO: 6484 - RNA, 22 nt, Escherichia coli CFT073
uuguuaaugccgaugauuuugg

SEQ ID NO: 6485 - RNA, 22 nt, Escherichia coli CFT073
uuguuaauuccugauucaggug

SEQ ID NO: 6486 - RNA, 22 nt, Escherichia coli CFT073
uuguucaguucauucggguuca

SEQ ID NO: 6487 - RNA, 20 nt, Escherichia coli CFT073
uuguugacuggcaauccagc

SEQ ID NO: 6488 - RNA, 22 nt, Escherichia coli CFT073
uuguugugaauuacuggcuuag

SEQ ID NO: 6489 - RNA, 23 nt, Escherichia coli CFT073
uuguuguuuuaucacgguauuga

SEQ ID NO: 6490 - RNA, 22 nt, Escherichia coli CFT073
uuuaacucccagggcuugaacg

SEQ ID NO: 6491 - RNA, 22 nt, Escherichia coli CFT073
uuucaacauagucuucuccuuu

SEQ ID NO: 6492 - RNA, 22 nt, Escherichia coli CFT073
uuucaauacuuaucgauuccuu

SEQ ID NO: 6493 - RNA, 18 nt, Escherichia coli CFT073
uuucacacaacaugccgc

SEQ ID NO: 6494 - RNA, 22 nt, Escherichia coli CFT073
uuucacagucuggucaggauau

SEQ ID NO: 6495 - RNA, 22 nt, Escherichia coli CFT073
uuucaucgccugcucaaaacuc

SEQ ID NO: 6496 - RNA, 22 nt, Escherichia coli CFT073
uuuccaguugcucaaccagguu

SEQ ID NO: 6497 - RNA, 22 nt, Escherichia coli CFT073
uuucccagcuggaaauggugcu

SEQ ID NO: 6498 - RNA, 22 nt, Escherichia coli CFT073
uuucguuggaaucgugugcugc

SEQ ID NO: 6499 - RNA, 22 nt, Escherichia coli CFT073
uuucugguagcgcaggcuggcg

SEQ ID NO: 6500 - RNA, 22 nt, Escherichia coli CFT073
uuugauuuguuaaaacaccuug

SEQ ID NO: 6501 - RNA, 22 nt, Escherichia coli CFT073
uuugcgcuuuuguaggucggau

SEQ ID NO: 6502 - RNA, 21 nt, Escherichia coli CFT073
uuugcguugccgccugccaca

SEQ ID NO: 6503 - RNA, 22 nt, Escherichia coli CFT073
uuugcguuugcggcuugggauc

SEQ ID NO: 6504 - RNA, 20 nt, Escherichia coli CFT073
uuugcuaucguugauaccaa

SEQ ID NO: 6505 - RNA, 18 nt, Escherichia coli CFT073
uuugcugaaacaucgcua

SEQ ID NO: 6506 - RNA, 22 nt, Escherichia coli CFT073
uuugcuguuuucgccuucgcac

SEQ ID NO: 6507 - RNA, 16 nt, Escherichia coli CFT073
uuuggcagcgaucgcc

SEQ ID NO: 6508 - RNA, 22 nt, Escherichia coli CFT073
uuuggcauggugguggaucgug

SEQ ID NO: 6509 - RNA, 22 nt, Escherichia coli CFT073
uuuggcgaauauuauucccauc

SEQ ID NO: 6510 - RNA, 22 nt, Escherichia coli CFT073
ccgcgauagugucgacauucag

SEQ ID NO: 6511 - RNA, 19 nt, Escherichia coli CFT073
ccgcgcgcaggcugguugc

SEQ ID NO: 6512 - RNA, 22 nt, Escherichia coli CFT073
ccgcugguugcgcgaagccugg

SEQ ID NO: 6513 - RNA, 22 nt, Escherichia coli CFT073
ccggaaaccaauggucagguag

SEQ ID NO: 6514 - RNA, 22 nt, Escherichia coli CFT073
ccggaauugagugaccaauaua

SEQ ID NO: 6515 - RNA, 22 nt, Escherichia coli CFT073
ccggaucguaaaccuggaagaa

SEQ ID NO: 6516 - RNA, 22 nt, Escherichia coli CFT073
ccggccuacaaaaaucuugcca

SEQ ID NO: 6517 - RNA, 22 nt, Escherichia coli CFT073
ccggcgugccaacaggcguaac

SEQ ID NO: 6518 - RNA, 22 nt, Escherichia coli CFT073
ccggcuggauuggugaaauugc

SEQ ID NO: 6519 - RNA, 22 nt, Escherichia coli CFT073
ccgguaagaccaccacuuucua

SEQ ID NO: 6520 - RNA, 22 nt, Escherichia coli CFT073
ccguaaaacgcaaucaaaauga

SEQ ID NO: 6521 - RNA, 22 nt, Escherichia coli CFT073
ccguaagccgcuggaugagauu

SEQ ID NO: 6522 - RNA, 22 nt, Escherichia coli CFT073
ccguagcgguugcggcuuggca

SEQ ID NO: 6523 - RNA, 19 nt, Escherichia coli CFT073
ccgucagguaguaaaaccu

SEQ ID NO: 6524 - RNA, 22 nt, Escherichia coli CFT073
ccgugcucuuucacugcguucg

SEQ ID NO: 6525 - RNA, 22 nt, Escherichia coli CFT073
ccguuaacggggaucauucugg

SEQ ID NO: 6526 - RNA, 20 nt, Escherichia coli CFT073
ccguuacugggguuuugugc

SEQ ID NO: 6527 - RNA, 22 nt, Escherichia coli CFT073
ccguuuauuguauucaucaccg

SEQ ID NO: 6528 - RNA, 22 nt, Escherichia coli CFT073
ccuaccuggcggaugacgccau

SEQ ID NO: 6529 - RNA, 22 nt, Escherichia coli CFT073
ccuccuuuauucugaucuccgc

SEQ ID NO: 6530 - RNA, 21 nt, Escherichia coli CFT073
ccucgcuggucguuauccugc

SEQ ID NO: 6531 - RNA, 22 nt, Escherichia coli CFT073
ccucugccauugcaagaaguga

SEQ ID NO: 6532 - RNA, 22 nt, Escherichia coli CFT073
ccugaacaaagcgcucggagug

SEQ ID NO: 6533 - RNA, 22 nt, Escherichia coli CFT073
ccugauguuugacgaguauuua

SEQ ID NO: 6534 - RNA, 22 nt, Escherichia coli CFT073
ccugcgaauccagcucgacgcu

SEQ ID NO: 6535 - RNA, 22 nt, Escherichia coli CFT073
ccugcgguccaggaguagaaag

SEQ ID NO: 6536 - RNA, 22 nt, Escherichia coli CFT073
ccugcucgaugaagccagacga

SEQ ID NO: 6537 - RNA, 22 nt, Escherichia coli CFT073
ccuggcgagcaucccccacaau

SEQ ID NO: 6538 - RNA, 22 nt, Escherichia coli CFT073
ccugggaagauguaagccgcca

SEQ ID NO: 6539 - RNA, 22 nt, Escherichia coli CFT073
ccuguagacggacguucgcggc

SEQ ID NO: 6540 - RNA, 22 nt, Escherichia coli CFT073
ccuuuaccgcucugauagagau

SEQ ID NO: 6541 - RNA, 22 nt, Escherichia coli CFT073
cgaagcugaacaguuuaucggg

SEQ ID NO: 6542 - RNA, 22 nt, Escherichia coli CFT073
cgaagucagaacggauaucgua

SEQ ID NO: 6543 - RNA, 22 nt, Escherichia coli CFT073
cgaaucugcuccgccagauuuu

SEQ ID NO: 6544 - RNA, 22 nt, Escherichia coli CFT073
cgacguagacaacgguacugaa

SEQ ID NO: 6545 - RNA, 22 nt, Escherichia coli CFT073
cgacucuuuuucgauaaucagu

SEQ ID NO: 6546 - RNA, 23 nt, Escherichia coli CFT073
cgagugauuuugccaucuccagc

SEQ ID NO: 6547 - RNA, 22 nt, Escherichia coli CFT073
cgauaaaaccaauuucaccuuc

SEQ ID NO: 6548 - RNA, 22 nt, Escherichia coli CFT073
cgauaugucgcguucacguaag

SEQ ID NO: 6549 - RNA, 22 nt, Escherichia coli CFT073
cgauccgcagguguugaucaag

SEQ ID NO: 6550 - RNA, 22 nt, Escherichia coli CFT073
cgaugauaugcaucaccuggga

SEQ ID NO: 6551 - RNA, 22 nt, Escherichia coli CFT073
cgauggcugaaugucuggcagc

SEQ ID NO: 6552 - RNA, 22 nt, Escherichia coli CFT073
cgauuuuauucaggucaaugcg

SEQ ID NO: 6553 - RNA, 22 nt, Escherichia coli CFT073
cgcaaaacgcuccauggagaug

SEQ ID NO: 6554 - RNA, 22 nt, Escherichia coli CFT073
cgcaauuugugcagucggugca

SEQ ID NO: 6555 - RNA, 22 nt, Escherichia coli CFT073
cgcacguugaccgauguugagg

SEQ ID NO: 6556 - RNA, 22 nt, Escherichia coli CFT073
cgcagacugaccauccugcgcu

SEQ ID NO: 6557 - RNA, 22 nt, Escherichia coli CFT073
cgcagugcugauuuacaacaug

SEQ ID NO: 6558 - RNA, 22 nt, Escherichia coli CFT073
gaaaaucaguuugcuucgcgcu

SEQ ID NO: 6559 - RNA, 18 nt, Escherichia coli CFT073
gaaaccgcaaugaaagcc

SEQ ID NO: 6560 - RNA, 22 nt, Escherichia coli CFT073
gaaacgcucgaaaaacuggcag

SEQ ID NO: 6561 - RNA, 22 nt, Escherichia coli CFT073
gaaacuuugucgcguggaccca

SEQ ID NO: 6562 - RNA, 22 nt, Escherichia coli CFT073
gaaagauauuauuguccgcggc

SEQ ID NO: 6563 - RNA, 22 nt, Escherichia coli CFT073
gaaauggcaacgauagaggcga

SEQ ID NO: 6564 - RNA, 22 nt, Escherichia coli CFT073
gaaccgcccgcagaaaaaacgu

SEQ ID NO: 6565 - RNA, 21 nt, Escherichia coli CFT073
gaaccgugaccugacuggcga

SEQ ID NO: 6566 - RNA, 22 nt, Escherichia coli CFT073
gaacuaaugacauacugcuguu

SEQ ID NO: 6567 - RNA, 22 nt, Escherichia coli CFT073
gaagcguuggucagugguuguu

SEQ ID NO: 6568 - RNA, 22 nt, Escherichia coli CFT073
gaaggcaagacggguuuuaucu

SEQ ID NO: 6569 - RNA, 22 nt, Escherichia coli CFT073
gaagggauugaagagccgcugg

SEQ ID NO: 6570 - RNA, 22 nt, Escherichia coli CFT073
gaagguuaacccgcugggcggc

SEQ ID NO: 6571 - RNA, 22 nt, Escherichia coli CFT073
gaaguggcagcgcagcagguuu

SEQ ID NO: 6572 - RNA, 22 nt, Escherichia coli CFT073
gaaugauaaaccggauuagugu

SEQ ID NO: 6573 - RNA, 22 nt, Escherichia coli CFT073
gaauuuuuuccgcaaucuucgc

SEQ ID NO: 6574 - RNA, 22 nt, Escherichia coli CFT073
gacauguucaaugacggucugg

SEQ ID NO: 6575 - RNA, 22 nt, Escherichia coli CFT073
gacgaacauuacuggcuucauu

SEQ ID NO: 6576 - RNA, 22 nt, Escherichia coli CFT073
gacgagcugcaggaacguaugg

SEQ ID NO: 6577 - RNA, 22 nt, Escherichia coli CFT073
gacgaugcucacacauacggaa

SEQ ID NO: 6578 - RNA, 22 nt, Escherichia coli CFT073
gacgauggggauauucgucugu

SEQ ID NO: 6579 - RNA, 22 nt, Escherichia coli CFT073
gacgcgacuuaucaggccuacg

SEQ ID NO: 6580 - RNA, 22 nt, Escherichia coli CFT073
gacguuaucugccuuuugauga

SEQ ID NO: 6581 - RNA, 22 nt, Escherichia coli CFT073
gacguuccgggucgauagucag

SEQ ID NO: 6582 - RNA, 22 nt, Escherichia coli CFT073
gacucggugucguugcuugccg

SEQ ID NO: 6583 - RNA, 22 nt, Escherichia coli CFT073
gagaauguugaugccgcauugc

SEQ ID NO: 6584 - RNA, 21 nt, Escherichia coli CFT073
gagcgcaggcggaauggcggc

SEQ ID NO: 6585 - RNA, 22 nt, Escherichia coli CFT073
gagcgucuuuccggcgaggugg

SEQ ID NO: 6586 - RNA, 22 nt, Escherichia coli CFT073
gagcugcaccaaggucgacaac

SEQ ID NO: 6587 - RNA, 22 nt, Escherichia coli CFT073
gaggaugacucacuggcgcucg

SEQ ID NO: 6588 - RNA, 22 nt, Escherichia coli CFT073
gaggcgaaagccgggcgcagcu

SEQ ID NO: 6589 - RNA, 22 nt, Escherichia coli CFT073
gagggcgguaauucuacggcaa

SEQ ID NO: 6590 - RNA, 22 nt, Escherichia coli CFT073
gaggucaguuuguuucacauug

SEQ ID NO: 6591 - RNA, 22 nt, Escherichia coli CFT073
gagguugcuacaagaucuuuua

SEQ ID NO: 6592 - RNA, 22 nt, Escherichia coli CFT073
gaguaaguuauuaucaguagcc

SEQ ID NO: 6593 - RNA, 22 nt, Escherichia coli CFT073
gauaauuuuauuaaucgcccag

SEQ ID NO: 6594 - RNA, 22 nt, Escherichia coli CFT073
gauauacauggcucggcuaacu

SEQ ID NO: 6595 - RNA, 22 nt, Escherichia coli CFT073
gauauuuuacgcgcaauaacug

SEQ ID NO: 6596 - RNA, 22 nt, Escherichia coli CFT073
gauccgggcuaucugcgcuggu

SEQ ID NO: 6597 - RNA, 22 nt, Escherichia coli CFT073
gaucggcggagcagggugaaca

SEQ ID NO: 6598 - RNA, 22 nt, Escherichia coli CFT073
gaucuucuucacagauuauagc

SEQ ID NO: 6599 - RNA, 22 nt, Escherichia coli CFT073
gaugauccgcagguuuuugccg

SEQ ID NO: 6600 - RNA, 22 nt, Escherichia coli CFT073
gaugcaacgcuguguaaagguu

SEQ ID NO: 6601 - RNA, 22 nt, Escherichia coli CFT073
gaugcagcgcgaugcccgucag

SEQ ID NO: 6602 - RNA, 22 nt, Escherichia coli CFT073
gaugcgacgcugacgcgucuua

SEQ ID NO: 6603 - RNA, 22 nt, Escherichia coli CFT073
gauggccuuuuuucuggugaug

SEQ ID NO: 6604 - RNA, 22 nt, Escherichia coli CFT073
gauguaguaucauuccucggcg

SEQ ID NO: 6605 - RNA, 22 nt, Escherichia coli CFT073
gaugucuguuugguuucaggcg

SEQ ID NO: 6606 - RNA, 22 nt, Escherichia coli CFT073
gauguguucaugacuggucgca

SEQ ID NO: 6607 - RNA, 22 nt, Escherichia coli CFT073
gauuaacgguauucguaguuau

SEQ ID NO: 6608 - RNA, 22 nt, Escherichia coli CFT073
gauuucaccaauuaagccgagg

SEQ ID NO: 6609 - RNA, 22 nt, Escherichia coli CFT073
gauuuuuacuggcguuugccug

SEQ ID NO: 6610 - RNA, 22 nt, Escherichia coli CFT073
gauuuuuuugcuggcuaucaug

SEQ ID NO: 6611 - RNA, 22 nt, Escherichia coli CFT073
gcaaauccugaccaaucgcgau

SEQ ID NO: 6612 - RNA, 22 nt, Escherichia coli CFT073
gcaaccaaccugacucgcggug

SEQ ID NO: 6613 - RNA, 22 nt, Escherichia coli CFT073
gcaacguuugucauaguggcga

SEQ ID NO: 6614 - RNA, 22 nt, Escherichia coli CFT073
gcacagaagugguauaugcguu

SEQ ID NO: 6615 - RNA, 22 nt, Escherichia coli CFT073
gcacauaacucauacugagcaa

SEQ ID NO: 6616 - RNA, 22 nt, Escherichia coli CFT073
gcacguuccagaaucggauuaa

SEQ ID NO: 6617 - RNA, 22 nt, Escherichia coli CFT073
gcagaauuuuguccgauagugg

SEQ ID NO: 6618 - RNA, 23 nt, Escherichia coli CFT073
gcagauuauucugcugaucagag

SEQ ID NO: 6619 - RNA, 22 nt, Escherichia coli CFT073
gcagcgcguuggugaagugcgg

SEQ ID NO: 6620 - RNA, 22 nt, Escherichia coli CFT073
gcaggaaggucgcgaugccgau

SEQ ID NO: 6621 - RNA, 22 nt, Escherichia coli CFT073
gcaguacgugccuaaaaugcug

SEQ ID NO: 6622 - RNA, 22 nt, Escherichia coli CFT073
gcauaagaagcuuucauuucag

SEQ ID NO: 6623 - RNA, 20 nt, Escherichia coli CFT073
gcauccucgcacuggguggu

SEQ ID NO: 6624 - RNA, 18 nt, Escherichia coli CFT073
gcauggucagcggccugc

SEQ ID NO: 6625 - RNA, 19 nt, Escherichia coli CFT073
gcauuauugguagcgccuu

SEQ ID NO: 6626 - RNA, 22 nt, Escherichia coli CFT073
gccaaccacggucaugccauuu

SEQ ID NO: 6627 - RNA, 22 nt, Escherichia coli CFT073
gccacggcguccagcacggugg

SEQ ID NO: 6628 - RNA, 22 nt, Escherichia coli CFT073
gccagcgaccuuaauuccgcgc

SEQ ID NO: 6629 - RNA, 22 nt, Escherichia coli CFT073
gccaggagucauuuauugguuu

SEQ ID NO: 6630 - RNA, 22 nt, Escherichia coli CFT073
gccagugucgaucauaucaucg

SEQ ID NO: 6631 - RNA, 22 nt, Escherichia coli CFT073
gcccgcuguuuacgcuaacugc

SEQ ID NO: 6632 - RNA, 22 nt, Escherichia coli CFT073
gcccgguucuuacaacaauauc

SEQ ID NO: 6633 - RNA, 22 nt, Escherichia coli CFT073
gcccuguggggagaucugcuuu

SEQ ID NO: 6634 - RNA, 22 nt, Escherichia coli CFT073
gccgcagaaguggcgcuguuug

SEQ ID NO: 6635 - RNA, 21 nt, Escherichia coli CFT073
gccgcuggccccuaccgguga

SEQ ID NO: 6636 - RNA, 22 nt, Escherichia coli CFT073
gccgugauggcuccacugauau

SEQ ID NO: 6637 - RNA, 22 nt, Escherichia coli CFT073
gccgugauggugaucuucguca

SEQ ID NO: 6638 - RNA, 22 nt, Escherichia coli CFT073
gccguggugggaucgccaguug

SEQ ID NO: 6639 - RNA, 22 nt, Escherichia coli CFT073
gccguuuggcuguuucacgccg

SEQ ID NO: 6640 - RNA, 18 nt, Escherichia coli CFT073
gccguuuuuuuaugugua

SEQ ID NO: 6641 - RNA, 23 nt, Escherichia coli CFT073
gccugauguacaugucuucaacc

SEQ ID NO: 6642 - RNA, 22 nt, Escherichia coli CFT073
gccugccagucaauauguuccg

SEQ ID NO: 6643 - RNA, 21 nt, Escherichia coli CFT073
gccuggacagcagcugucugc

SEQ ID NO: 6644 - RNA, 19 nt, Escherichia coli CFT073
gcgaacacuucaucuuuac

SEQ ID NO: 6645 - RNA, 22 nt, Escherichia coli CFT073
gcgacauugcuccguguauuca

SEQ ID NO: 6646 - RNA, 22 nt, Escherichia coli CFT073
auugcaucaugcaaacaugcgu

SEQ ID NO: 6647 - RNA, 22 nt, Escherichia coli CFT073
auugcccguuuuacagcguuac

SEQ ID NO: 6648 - RNA, 22 nt, Escherichia coli CFT073
auugcugggagaaggcagacgu

SEQ ID NO: 6649 - RNA, 22 nt, Escherichia coli CFT073
auugucaucgccgguggccagg

SEQ ID NO: 6650 - RNA, 23 nt, Escherichia coli CFT073
auuguugcgucguggcugguggc

SEQ ID NO: 6651 - RNA, 22 nt, Escherichia coli CFT073
auuugcgugucaaucaaggguu

SEQ ID NO: 6652 - RNA, 22 nt, Escherichia coli CFT073
auuugcguuugacuuccgccau

SEQ ID NO: 6653 - RNA, 22 nt, Escherichia coli CFT073
auuuuauggcggaacggcguug

SEQ ID NO: 6654 - RNA, 22 nt, Escherichia coli CFT073
auuuucaggaauuucgccagug

SEQ ID NO: 6655 - RNA, 21 nt, Escherichia coli CFT073
auuuucgcaaucaccuuacau

SEQ ID NO: 6656 - RNA, 22 nt, Escherichia coli CFT073
auuuuguuggucgaugcugguu

SEQ ID NO: 6657 - RNA, 23 nt, Escherichia coli CFT073
caaaaccguauucccgcagcacc

SEQ ID NO: 6658 - RNA, 22 nt, Escherichia coli CFT073
caaacugcuuuccccggaguuu

SEQ ID NO: 6659 - RNA, 22 nt, Escherichia coli CFT073
caacacuuuuugcugauugccg

SEQ ID NO: 6660 - RNA, 22 nt, Escherichia coli CFT073
caagaacugccuguccguucau

SEQ ID NO: 6661 - RNA, 22 nt, Escherichia coli CFT073
caagauacgaaacgggugcuga

SEQ ID NO: 6662 - RNA, 22 nt, Escherichia coli CFT073
caagccuuccauuacgcugacc

SEQ ID NO: 6663 - RNA, 21 nt, Escherichia coli CFT073
caaugcucuccaguccggugu

SEQ ID NO: 6664 - RNA, 22 nt, Escherichia coli CFT073
caaugugaucuuugucuucgcu

SEQ ID NO: 6665 - RNA, 22 nt, Escherichia coli CFT073
caauugcuucuuaccugcugaa

SEQ ID NO: 6666 - RNA, 22 nt, Escherichia coli CFT073
caccaacguuggggcuggauua

SEQ ID NO: 6667 - RNA, 22 nt, Escherichia coli CFT073
caccagguugaagcguggccgu

SEQ ID NO: 6668 - RNA, 22 nt, Escherichia coli CFT073
cacccggacacgauccuuggca

SEQ ID NO: 6669 - RNA, 22 nt, Escherichia coli CFT073
caccgucaggguacggaaagua

SEQ ID NO: 6670 - RNA, 22 nt, Escherichia coli CFT073
caccguggccuuuuccgguaua

SEQ ID NO: 6671 - RNA, 22 nt, Escherichia coli CFT073
caccugauaaccguucucuucg

SEQ ID NO: 6672 - RNA, 20 nt, Escherichia coli CFT073
cacgccugcggcaguuccag

SEQ ID NO: 6673 - RNA, 22 nt, Escherichia coli CFT073
cacguaaaucgacgcgacuggc

SEQ ID NO: 6674 - RNA, 22 nt, Escherichia coli CFT073
cacguuuuuauugaucacuacg

SEQ ID NO: 6675 - RNA, 22 nt, Escherichia coli CFT073
cacugaagcugaguaauaacgg

SEQ ID NO: 6676 - RNA, 22 nt, Escherichia coli CFT073
cacugacugaaacguuuuugcc

SEQ ID NO: 6677 - RNA, 22 nt, Escherichia coli CFT073
cacuuucugccaguaaccgcug

SEQ ID NO: 6678 - RNA, 22 nt, Escherichia coli CFT073
cagaccguaaaugccucgccug

SEQ ID NO: 6679 - RNA, 22 nt, Escherichia coli CFT073
cagaugauguucucucccguug

SEQ ID NO: 6680 - RNA, 22 nt, Escherichia coli CFT073
cagauucaucagguaaugccag

SEQ ID NO: 6681 - RNA, 22 nt, Escherichia coli CFT073
cagauuugcgcgacgagcucua

SEQ ID NO: 6682 - RNA, 17 nt, Escherichia coli CFT073
cagcaccguuacgugaa

SEQ ID NO: 6683 - RNA, 22 nt, Escherichia coli CFT073
cagcaguucgcgaauacgcugc

SEQ ID NO: 6684 - RNA, 19 nt, Escherichia coli CFT073
cagcaguuuuuucgcacag

SEQ ID NO: 6685 - RNA, 22 nt, Escherichia coli CFT073
cagccaguuguuguuggauaug

SEQ ID NO: 6686 - RNA, 22 nt, Escherichia coli CFT073
cagccuacagaacgcugcaauu

SEQ ID NO: 6687 - RNA, 22 nt, Escherichia coli CFT073
cagcgacgcgccagcaggaaag

SEQ ID NO: 6688 - RNA, 22 nt, Escherichia coli CFT073
cagcgaggcaccaucauugaga

SEQ ID NO: 6689 - RNA, 22 nt, Escherichia coli CFT073
cagcgggcugcaauugagcaag

SEQ ID NO: 6690 - RNA, 22 nt, Escherichia coli CFT073
cagcuacaggccguucccugga

SEQ ID NO: 6691 - RNA, 22 nt, Escherichia coli CFT073
cagcuucgauggcgcuauugag

SEQ ID NO: 6692 - RNA, 22 nt, Escherichia coli CFT073
caggaguuggcgaugaaugacc

SEQ ID NO: 6693 - RNA, 23 nt, Escherichia coli CFT073
caggcccagcgcccagguggugc

SEQ ID NO: 6694 - RNA, 22 nt, Escherichia coli CFT073
caggccuacacguucgcugcaa

SEQ ID NO: 6695 - RNA, 22 nt, Escherichia coli CFT073
caggccuacaucguuccugcaa

SEQ ID NO: 6696 - RNA, 22 nt, Escherichia coli CFT073
caggccuacgaaaacucugcaa

SEQ ID NO: 6697 - RNA, 22 nt, Escherichia coli CFT073
cagggauaucguggcggaauga

SEQ ID NO: 6698 - RNA, 22 nt, Escherichia coli CFT073
cagggcgauuaccuggugggua

SEQ ID NO: 6699 - RNA, 22 nt, Escherichia coli CFT073
cagggcgucacggaaggccgga

SEQ ID NO: 6700 - RNA, 22 nt, Escherichia coli CFT073
caggggauaggcggcgcaauga

SEQ ID NO: 6701 - RNA, 22 nt, Escherichia coli CFT073
caggugguuagagcgcaccccu

SEQ ID NO: 6702 - RNA, 22 nt, Escherichia coli CFT073
cagguuaucuucauguuccacg

SEQ ID NO: 6703 - RNA, 22 nt, Escherichia coli CFT073
cagguuguugaacucguacgcc

SEQ ID NO: 6704 - RNA, 22 nt, Escherichia coli CFT073
caguaccagcaucagcugucgg

SEQ ID NO: 6705 - RNA, 22 nt, Escherichia coli CFT073
caguauuugccgccagagauga

SEQ ID NO: 6706 - RNA, 22 nt, Escherichia coli CFT073
cagugguuugagauugaucugu

SEQ ID NO: 6707 - RNA, 23 nt, Escherichia coli CFT073
cgcccgcgauuuguucugauugg

SEQ ID NO: 6708 - RNA, 22 nt, Escherichia coli CFT073
cgccucggagaagcaccugauu

SEQ ID NO: 6709 - RNA, 22 nt, Escherichia coli CFT073
cgcgaacguucuuuuccagcug

SEQ ID NO: 6710 - RNA, 22 nt, Escherichia coli CFT073
cgcgauauacguguacguugau

SEQ ID NO: 6711 - RNA, 22 nt, Escherichia coli CFT073
cgcgauguugugugcagcaagc

SEQ ID NO: 6712 - RNA, 22 nt, Escherichia coli CFT073
cgcggucuucguuggcguaggc

SEQ ID NO: 6713 - RNA, 22 nt, Escherichia coli CFT073
cgcguaggcuucgauaucgucg

SEQ ID NO: 6714 - RNA, 22 nt, Escherichia coli CFT073
cgcgucuuaucaugccuacagg

SEQ ID NO: 6715 - RNA, 22 nt, Escherichia coli CFT073
cgcuauguuuauuugacccgca

SEQ ID NO: 6716 - RNA, 22 nt, Escherichia coli CFT073
cgcuccggugguggcgacgggu

SEQ ID NO: 6717 - RNA, 22 nt, Escherichia coli CFT073
cgcucucuaccgauuuccguaa

SEQ ID NO: 6718 - RNA, 22 nt, Escherichia coli CFT073
cgcugauaucagcacaggauga

SEQ ID NO: 6719 - RNA, 20 nt, Escherichia coli CFT073
cgcugaugcggugcuuauca

SEQ ID NO: 6720 - RNA, 22 nt, Escherichia coli CFT073
cgcugauugcuuucuuucacgg

SEQ ID NO: 6721 - RNA, 22 nt, Escherichia coli CFT073
cgcugcccuacacaaugccuga

SEQ ID NO: 6722 - RNA, 22 nt, Escherichia coli CFT073
cgcuggaugauggcgagcugga

SEQ ID NO: 6723 - RNA, 18 nt, Escherichia coli CFT073
cgcugguuguuauggcga

SEQ ID NO: 6724 - RNA, 22 nt, Escherichia coli CFT073
cgcuuauaugguggcauauauc

SEQ ID NO: 6725 - RNA, 22 nt, Escherichia coli CFT073
cgcuuuuugaacgacgucaccg

SEQ ID NO: 6726 - RNA, 22 nt, Escherichia coli CFT073
cggaauauuaagccgcuggcga

SEQ ID NO: 6727 - RNA, 22 nt, Escherichia coli CFT073
cggaugaugcuguaggcgguaa

SEQ ID NO: 6728 - RNA, 22 nt, Escherichia coli CFT073
cggcaucuggaucgcccgguuu

SEQ ID NO: 6729 - RNA, 22 nt, Escherichia coli CFT073
cggcggaaugggaaugggcauu

SEQ ID NO: 6730 - RNA, 22 nt, Escherichia coli CFT073
cggcgggaaccagaaaucgucg

SEQ ID NO: 6731 - RNA, 22 nt, Escherichia coli CFT073
cggcguaucaucggugagauca

SEQ ID NO: 6732 - RNA, 22 nt, Escherichia coli CFT073
cggcuacgaaaguacagcguuu

SEQ ID NO: 6733 - RNA, 22 nt, Escherichia coli CFT073
cggcugauuguguaaugcacag

SEQ ID NO: 6734 - RNA, 22 nt, Escherichia coli CFT073
cgggaugagaaaccgaugcuca

SEQ ID NO: 6735 - RNA, 22 nt, Escherichia coli CFT073
cgggcgagcuggcuuccuggcu

SEQ ID NO: 6736 - RNA, 22 nt, Escherichia coli CFT073
cggggauugguuuuauaaaccu

SEQ ID NO: 6737 - RNA, 22 nt, Escherichia coli CFT073
cggguaugguucugaccguaga

SEQ ID NO: 6738 - RNA, 22 nt, Escherichia coli CFT073
cgggugcaguaauaucgcccug

SEQ ID NO: 6739 - RNA, 22 nt, Escherichia coli CFT073
cggguugucugacuuacgagaa

SEQ ID NO: 6740 - RNA, 18 nt, Escherichia coli CFT073
cgguauuacgccagugcc

SEQ ID NO: 6741 - RNA, 22 nt, Escherichia coli CFT073
cggucagcagcaggcugccuuu

SEQ ID NO: 6742 - RNA, 22 nt, Escherichia coli CFT073
cggugccggacaucggauuuuu

SEQ ID NO: 6743 - RNA, 23 nt, Escherichia coli CFT073
cgguuguucaguugaaggugugc

SEQ ID NO: 6744 - RNA, 22 nt, Escherichia coli CFT073
cgguuuauaagcgccaucagug

SEQ ID NO: 6745 - RNA, 22 nt, Escherichia coli CFT073
cguaauguuaacuggggcuuuu

SEQ ID NO: 6746 - RNA, 22 nt, Escherichia coli CFT073
cguaauugccggaugcgacgca

SEQ ID NO: 6747 - RNA, 22 nt, Escherichia coli CFT073
cguagccgugagcguuuugaca

SEQ ID NO: 6748 - RNA, 22 nt, Escherichia coli CFT073
cguaggccaaucaggggguuua

SEQ ID NO: 6749 - RNA, 22 nt, Escherichia coli CFT073
cguaugcucggucagaugagca

SEQ ID NO: 6750 - RNA, 22 nt, Escherichia coli CFT073
cguauuaacagauuaugucaga

SEQ ID NO: 6751 - RNA, 23 nt, Escherichia coli CFT073
cgucgccagaaguugaggaggau

SEQ ID NO: 6752 - RNA, 22 nt, Escherichia coli CFT073
cgucggcacugugcggcacucg

SEQ ID NO: 6753 - RNA, 22 nt, Escherichia coli CFT073
cgucggcuggcuucaccgcaga

SEQ ID NO: 6754 - RNA, 22 nt, Escherichia coli CFT073
cgugauaacuaucgucugguug

SEQ ID NO: 6755 - RNA, 22 nt, Escherichia coli CFT073
cgugauggauaguaaagcgucg

SEQ ID NO: 6756 - RNA, 22 nt, Escherichia coli CFT073
cgugcugcugcauaagcugccg

SEQ ID NO: 6757 - RNA, 22 nt, Escherichia coli CFT073
cguggcuacauuggcauuggug

SEQ ID NO: 6758 - RNA, 22 nt, Escherichia coli CFT073
cgugguugcggaaauuguguug

SEQ ID NO: 6759 - RNA, 22 nt, Escherichia coli CFT073
cguguugccugccgcgucggua

SEQ ID NO: 6760 - RNA, 22 nt, Escherichia coli CFT073
cguuauuauugcagggcagcgc

SEQ ID NO: 6761 - RNA, 22 nt, Escherichia coli CFT073
cguuccauuuucuauaucaccu

SEQ ID NO: 6762 - RNA, 22 nt, Escherichia coli CFT073
cguuccguaugaccgacgccaa

SEQ ID NO: 6763 - RNA, 22 nt, Escherichia coli CFT073
cguuccugcuccugcuccaucc

SEQ ID NO: 6764 - RNA, 22 nt, Escherichia coli CFT073
cguugaugucaucggcacagag

SEQ ID NO: 6765 - RNA, 22 nt, Escherichia coli CFT073
cguuuaggaagauuugaaauug

SEQ ID NO: 6766 - RNA, 22 nt, Escherichia coli CFT073
cguuucgccaucgcggaucucu

SEQ ID NO: 6767 - RNA, 22 nt, Escherichia coli CFT073
cguuuggucuaugaugcaguug

SEQ ID NO: 6768 - RNA, 22 nt, Escherichia coli CFT073
cguuuuauccggccuacaauga

SEQ ID NO: 6769 - RNA, 22 nt, Escherichia coli CFT073
cuaagucaugggaaaggugcca

SEQ ID NO: 6770 - RNA, 22 nt, Escherichia coli CFT073
cuaaguuucguaaugacccacu

SEQ ID NO: 6771 - RNA, 22 nt, Escherichia coli CFT073
cuacgcuuaucaggccuacgag

SEQ ID NO: 6772 - RNA, 22 nt, Escherichia coli CFT073
cuacgcuuaucaggccuacggg

SEQ ID NO: 6773 - RNA, 22 nt, Escherichia coli CFT073
cuacgcuuaucaggccugcaaa

SEQ ID NO: 6774 - RNA, 22 nt, Escherichia coli CFT073
cuacguugagaugcuggcgcgu

SEQ ID NO: 6775 - RNA, 22 nt, Escherichia coli CFT073
cuaucgauuacgcuauuaacgg

SEQ ID NO: 6776 - RNA, 22 nt, Escherichia coli CFT073
cuaucgguggucgucgagcaac

SEQ ID NO: 6777 - RNA, 22 nt, Escherichia coli CFT073
cucagucugauccaucagggga

SEQ ID NO: 6778 - RNA, 22 nt, Escherichia coli CFT073
cuccguuagcgcggcggauuga

SEQ ID NO: 6779 - RNA, 22 nt, Escherichia coli CFT073
cucgggauaucagcuaaaacau

SEQ ID NO: 6780 - RNA, 22 nt, Escherichia coli CFT073
cucugcgacgggaagcggugcu

SEQ ID NO: 6781 - RNA, 22 nt, Escherichia coli CFT073
cucugcugucggggaaucgcgu

SEQ ID NO: 6782 - RNA, 22 nt, Escherichia coli CFT073
cugacagauaugguacuucccg

SEQ ID NO: 6783 - RNA, 22 nt, Escherichia coli CFT073
cugacggaaguggugcagcguc

SEQ ID NO: 6784 - RNA, 22 nt, Escherichia coli CFT073
cugaugaggaucgcgaugcacu

SEQ ID NO: 6785 - RNA, 22 nt, Escherichia coli CFT073
cugaugcgacgcugacgcgucu

SEQ ID NO: 6786 - RNA, 22 nt, Escherichia coli CFT073
cugcaacuggcugauggcagca

SEQ ID NO: 6787 - RNA, 22 nt, Escherichia coli CFT073
cugccagacgcuacugaaucac

SEQ ID NO: 6788 - RNA, 22 nt, Escherichia coli CFT073
cugccagcuacuuugugucagu

SEQ ID NO: 6789 - RNA, 22 nt, Escherichia coli CFT073
cugccguacuucuacauuccgg

SEQ ID NO: 6790 - RNA, 22 nt, Escherichia coli CFT073
cugcgcggcaauaauuugguug

SEQ ID NO: 6791 - RNA, 22 nt, Escherichia coli CFT073
cugcugguaaaccuggcuaucu

SEQ ID NO: 6792 - RNA, 22 nt, Escherichia coli CFT073
cgcauggucaucggcucauuau

SEQ ID NO: 6793 - RNA, 22 nt, Escherichia coli CFT073
cgccagauggagaauuagcgca

SEQ ID NO: 6794 - RNA, 22 nt, Escherichia coli CFT073
cgccauccacaccgagauggaa

SEQ ID NO: 6795 - RNA, 22 nt, Escherichia coli CFT073
cgccgcucaaaauccugaugcu

SEQ ID NO: 6796 - RNA, 22 nt, Escherichia coli CFT073
cgccguaugccccguuuagcgu

SEQ ID NO: 6797 - RNA, 22 nt, Escherichia coli CFT073
cgccguugaugacacauaucaa

SEQ ID NO: 6798 - RNA, 22 nt, Escherichia coli CFT073
cgccugaaucaaacgguucguc

SEQ ID NO: 6799 - RNA, 22 nt, Escherichia coli CFT073
cgcgaagaaaccagucgcgggu

SEQ ID NO: 6800 - RNA, 22 nt, Escherichia coli CFT073
cgcgacuucggucagggugucg

SEQ ID NO: 6801 - RNA, 18 nt, Escherichia coli CFT073
cgcgcugaaccuggcuac

SEQ ID NO: 6802 - RNA, 22 nt, Escherichia coli CFT073
cgcggcuaaugagaggcuuuac

SEQ ID NO: 6803 - RNA, 22 nt, Escherichia coli CFT073
cgcgucgucauaugcgcacccu

SEQ ID NO: 6804 - RNA, 22 nt, Escherichia coli CFT073
cgcgucuuaucuggccuacgaa

SEQ ID NO: 6805 - RNA, 22 nt, Escherichia coli CFT073
cgcugaaauaauuuccucuccg

SEQ ID NO: 6806 - RNA, 22 nt, Escherichia coli CFT073
cgcugccgcguaacugucugcg

SEQ ID NO: 6807 - RNA, 22 nt, Escherichia coli CFT073
cgcuggaaguugugaaaaagua

SEQ ID NO: 6808 - RNA, 22 nt, Escherichia coli CFT073
cgcuggcacaaaugcccauuaa

SEQ ID NO: 6809 - RNA, 22 nt, Escherichia coli CFT073
cgcuggugcuaaagccggggca

SEQ ID NO: 6810 - RNA, 22 nt, Escherichia coli CFT073
cgcugguuucugcgccauuucc

SEQ ID NO: 6811 - RNA, 22 nt, Escherichia coli CFT073
cggaaaauguguaauaagccgu

SEQ ID NO: 6812 - RNA, 22 nt, Escherichia coli CFT073
cggaagacgaacuugccagcga

SEQ ID NO: 6813 - RNA, 22 nt, Escherichia coli CFT073
cggaauaaacgauacaacccag

SEQ ID NO: 6814 - RNA, 22 nt, Escherichia coli CFT073
cggaaugcuggacuuguugugu

SEQ ID NO: 6815 - RNA, 22 nt, Escherichia coli CFT073
cggacucagccaugauggaguu

SEQ ID NO: 6816 - RNA, 22 nt, Escherichia coli CFT073
cggacugauguacugcaauggu

SEQ ID NO: 6817 - RNA, 22 nt, Escherichia coli CFT073
cggagacgaaacagucaggcgc

SEQ ID NO: 6818 - RNA, 22 nt, Escherichia coli CFT073
cggagcgaaacggcacaaccau

SEQ ID NO: 6819 - RNA, 22 nt, Escherichia coli CFT073
cggaguauuucauggggaauuu

SEQ ID NO: 6820 - RNA, 22 nt, Escherichia coli CFT073
cggcaaugucaguaaggggaug

SEQ ID NO: 6821 - RNA, 22 nt, Escherichia coli CFT073
cggcauagcuucaccuuuggcg

SEQ ID NO: 6822 - RNA, 21 nt, Escherichia coli CFT073
cggcauggcgaauuuauuugu

SEQ ID NO: 6823 - RNA, 22 nt, Escherichia coli CFT073
cggcccagcuuuucccucucuc

SEQ ID NO: 6824 - RNA, 22 nt, Escherichia coli CFT073
cggcgauuagcgucgaauuugu

SEQ ID NO: 6825 - RNA, 22 nt, Escherichia coli CFT073
cggcgcaucguggagcacggca

SEQ ID NO: 6826 - RNA, 22 nt, Escherichia coli CFT073
cggcgguacguuaggugcggcg

SEQ ID NO: 6827 - RNA, 22 nt, Escherichia coli CFT073
cgggaucuucgcaaguuuagcu

SEQ ID NO: 6828 - RNA, 22 nt, Escherichia coli CFT073
cgggaugggauucaaaugcuuu

SEQ ID NO: 6829 - RNA, 22 nt, Escherichia coli CFT073
cgggauugucuacaucgaugaa

SEQ ID NO: 6830 - RNA, 22 nt, Escherichia coli CFT073
cgggcgaaaagccagcguggca

SEQ ID NO: 6831 - RNA, 22 nt, Escherichia coli CFT073
cgggcguugauacggcuguugg

SEQ ID NO: 6832 - RNA, 22 nt, Escherichia coli CFT073
cggguuaugcuauugacguugc

SEQ ID NO: 6833 - RNA, 22 nt, Escherichia coli CFT073
cggugauguuggcgggaguggu

SEQ ID NO: 6834 - RNA, 21 nt, Escherichia coli CFT073
cgguggaagcauuugaacugg

SEQ ID NO: 6835 - RNA, 22 nt, Escherichia coli CFT073
cgguuaaagauguucgcguguu

SEQ ID NO: 6836 - RNA, 22 nt, Escherichia coli CFT073
cgguuuaaaggcgcuaugagcg

SEQ ID NO: 6837 - RNA, 22 nt, Escherichia coli CFT073
cguaccggcaucaaggacgacg

SEQ ID NO: 6838 - RNA, 22 nt, Escherichia coli CFT073
cguagcacagcaggacgauuug

SEQ ID NO: 6839 - RNA, 22 nt, Escherichia coli CFT073
cguauguguuuggagagcaacu

SEQ ID NO: 6840 - RNA, 22 nt, Escherichia coli CFT073
cguauucaacuguacguugcaa

SEQ ID NO: 6841 - RNA, 22 nt, Escherichia coli CFT073
cguauugcguaaucgucuggac

SEQ ID NO: 6842 - RNA, 22 nt, Escherichia coli CFT073
cgucacgcugguggaucagggc

SEQ ID NO: 6843 - RNA, 22 nt, Escherichia coli CFT073
cgucaguagcgguaugaaaggc

SEQ ID NO: 6844 - RNA, 22 nt, Escherichia coli CFT073
cgucauccuggugguuuucacc

SEQ ID NO: 6845 - RNA, 22 nt, Escherichia coli CFT073
cgucgcacaagggguggaugcg

SEQ ID NO: 6846 - RNA, 22 nt, Escherichia coli CFT073
cgucuccaccaacgugauugcc

SEQ ID NO: 6847 - RNA, 22 nt, Escherichia coli CFT073
cgucuggcugauggcggcguag

SEQ ID NO: 6848 - RNA, 22 nt, Escherichia coli CFT073
cgucuucaauaucgcguuuuuc

SEQ ID NO: 6849 - RNA, 22 nt, Escherichia coli CFT073
cgugaugcauugcucugaaagc

SEQ ID NO: 6850 - RNA, 19 nt, Escherichia coli CFT073
cgugaugcuggcuaacaaa

SEQ ID NO: 6851 - RNA, 22 nt, Escherichia coli CFT073
cgugcagcaagaaccguauuga

SEQ ID NO: 6852 - RNA, 22 nt, Escherichia coli CFT073
cgugcaggcgcaguaaggggua

SEQ ID NO: 6853 - RNA, 22 nt, Escherichia coli CFT073
cgugcggugaucgaacguagua

SEQ ID NO: 6854 - RNA, 22 nt, Escherichia coli CFT073
cgugcgucuucuauucagggga

SEQ ID NO: 6855 - RNA, 22 nt, Escherichia coli CFT073
cgugcugcggcuggaugcuauu

SEQ ID NO: 6856 - RNA, 22 nt, Escherichia coli CFT073
cguggagagcacaaucugcuug

SEQ ID NO: 6857 - RNA, 22 nt, Escherichia coli CFT073
cgugguaugcacgcauggugcg

SEQ ID NO: 6858 - RNA, 22 nt, Escherichia coli CFT073
cguuauaacgcacgaggugacu

SEQ ID NO: 6859 - RNA, 22 nt, Escherichia coli CFT073
cguugugaagaaguuggcugcc

SEQ ID NO: 6860 - RNA, 22 nt, Escherichia coli CFT073
cguuuauuacgugcugucgaug

SEQ ID NO: 6861 - RNA, 22 nt, Escherichia coli CFT073
cguuugguaaugaagccucuac

SEQ ID NO: 6862 - RNA, 22 nt, Escherichia coli CFT073
cguuuugccucgccccaauaua

SEQ ID NO: 6863 - RNA, 21 nt, Escherichia coli CFT073
cuaccgccaagcgcagggagu

SEQ ID NO: 6864 - RNA, 20 nt, Escherichia coli CFT073
cuaccgguacuuuaaucgug

SEQ ID NO: 6865 - RNA, 22 nt, Escherichia coli CFT073
cuaucaauauuuugcguauuca

SEQ ID NO: 6866 - RNA, 22 nt, Escherichia coli CFT073
cuaucuacccucucuaccugau

SEQ ID NO: 6867 - RNA, 22 nt, Escherichia coli CFT073
cucagaaagaaaggccagcuca

SEQ ID NO: 6868 - RNA, 22 nt, Escherichia coli CFT073
cucagcacucauuaacuaccgg

SEQ ID NO: 6869 - RNA, 22 nt, Escherichia coli CFT073
cucaugguaucugagcguaucu

SEQ ID NO: 6870 - RNA, 22 nt, Escherichia coli CFT073
cucgaacagaauggccgugguc

SEQ ID NO: 6871 - RNA, 22 nt, Escherichia coli CFT073
cucguucacguaucaccgcauc

SEQ ID NO: 6872 - RNA, 22 nt, Escherichia coli CFT073
cucuaacgccagcugcgaagug

SEQ ID NO: 6873 - RNA, 22 nt, Escherichia coli CFT073
cucuuuagccgcagccaggucu

SEQ ID NO: 6874 - RNA, 18 nt, Escherichia coli CFT073
cugaaggucaugccauag

SEQ ID NO: 6875 - RNA, 22 nt, Escherichia coli CFT073
cugaaugcagaauaggucagac

SEQ ID NO: 6876 - RNA, 22 nt, Escherichia coli CFT073
cugaauguugaaaaugcgcgcc

SEQ ID NO: 6877 - RNA, 20 nt, Escherichia coli CFT073
cugaccggacuggagcguau

SEQ ID NO: 6878 - RNA, 22 nt, Escherichia coli CFT073
cugacgcgucuuaucaugccua

SEQ ID NO: 6879 - RNA, 22 nt, Escherichia coli CFT073
cugagaagugaugcugucagca

SEQ ID NO: 6880 - RNA, 22 nt, Escherichia coli CFT073
cugauauuugauaauaucgccu

SEQ ID NO: 6881 - RNA, 22 nt, Escherichia coli CFT073
cugaugaucgagaaucgcuaug

SEQ ID NO: 6882 - RNA, 22 nt, Escherichia coli CFT073
cugaugcgacgcuggcgcgucu

SEQ ID NO: 6883 - RNA, 22 nt, Escherichia coli CFT073
cugauuagugcagaguggaacu

SEQ ID NO: 6884 - RNA, 22 nt, Escherichia coli CFT073
cugauuucccagcgacaacaua

SEQ ID NO: 6885 - RNA, 22 nt, Escherichia coli CFT073
cugcaagguauagccgcucacc

SEQ ID NO: 6886 - RNA, 23 nt, Escherichia coli CFT073
cugcaagguauuuuugugcucgc

SEQ ID NO: 6887 - RNA, 22 nt, Escherichia coli CFT073
cugcaauugaccaucgcgguua

SEQ ID NO: 6888 - RNA, 22 nt, Escherichia coli CFT073
cugccccggugaugacagcgcc

SEQ ID NO: 6889 - RNA, 20 nt, Escherichia coli CFT073
cugccgugggacaguuugcu

SEQ ID NO: 6890 - RNA, 22 nt, Escherichia coli CFT073
cugcgacgagccugcgugacca

SEQ ID NO: 6891 - RNA, 22 nt, Escherichia coli CFT073
cugcgcaaaugcagguuguuga

SEQ ID NO: 6892 - RNA, 22 nt, Escherichia coli CFT073
cugcgcgucuguagcccguuug

SEQ ID NO: 6893 - RNA, 22 nt, Escherichia coli CFT073
cugcuaacugcuuaucguuaag

SEQ ID NO: 6894 - RNA, 22 nt, Escherichia coli CFT073
cugcugugcagucgcggucaua

SEQ ID NO: 6895 - RNA, 22 nt, Escherichia coli CFT073
cuggagcgcgucguaagcgggu

SEQ ID NO: 6896 - RNA, 22 nt, Escherichia coli CFT073
cuggaugauugaugaguguuua

SEQ ID NO: 6897 - RNA, 22 nt, Escherichia coli CFT073
cuggcggaaaaaggcauuccuu

SEQ ID NO: 6898 - RNA, 22 nt, Escherichia coli CFT073
cugggaggccaguggcaagaaa

SEQ ID NO: 6899 - RNA, 22 nt, Escherichia coli CFT073
cuggggaucugacgaccauuga

SEQ ID NO: 6900 - RNA, 22 nt, Escherichia coli CFT073
cuggggcugacugccacgccuu

SEQ ID NO: 6901 - RNA, 22 nt, Escherichia coli CFT073
cuggguuguaucguuuauuccg

SEQ ID NO: 6902 - RNA, 22 nt, Escherichia coli CFT073
cugguuuucaaugcgcguauca

SEQ ID NO: 6903 - RNA, 22 nt, Escherichia coli CFT073
cuguugcuggcagguuuuggcc

SEQ ID NO: 6904 - RNA, 22 nt, Escherichia coli CFT073
cuuaccagcggaaaaaaagaug

SEQ ID NO: 6905 - RNA, 22 nt, Escherichia coli CFT073
cuuaucaggccuacaagggaac

SEQ ID NO: 6906 - RNA, 22 nt, Escherichia coli CFT073
cuuccgcugagguaauaccagg

SEQ ID NO: 6907 - RNA, 22 nt, Escherichia coli CFT073
cuucgcgcuccagcugacggca

SEQ ID NO: 6908 - RNA, 22 nt, Escherichia coli CFT073
cuugccgugacaaauaaugaug

SEQ ID NO: 6909 - RNA, 22 nt, Escherichia coli CFT073
cuuucccuuugacguauugcag

SEQ ID NO: 6910 - RNA, 22 nt, Escherichia coli CFT073
cuuuucuaccgucaucguaccg

SEQ ID NO: 6911 - RNA, 23 nt, Escherichia coli CFT073
cuuuuucauucacgcggcgcugg

SEQ ID NO: 6912 - RNA, 22 nt, Escherichia coli CFT073
cuuuuucgaaaggcagaaaugc

SEQ ID NO: 6913 - RNA, 22 nt, Escherichia coli CFT073
cuuuuucucugauucaucaaau

SEQ ID NO: 6914 - RNA, 22 nt, Escherichia coli CFT073
gaaaucagccuauaggaggaaa

SEQ ID NO: 6915 - RNA, 22 nt, Escherichia coli CFT073
gaacaauuucucugcacuggcu

SEQ ID NO: 6916 - RNA, 22 nt, Escherichia coli CFT073
gaacaggaagauaagccacuga

SEQ ID NO: 6917 - RNA, 22 nt, Escherichia coli CFT073
gaacgcgugcuucaggaagcgg

SEQ ID NO: 6918 - RNA, 23 nt, Escherichia coli CFT073
gaacugaauaccaaugaggagac

SEQ ID NO: 6919 - RNA, 22 nt, Escherichia coli CFT073
gaagaagccuuuaaaggccgug

SEQ ID NO: 6920 - RNA, 22 nt, Escherichia coli CFT073
gaagagaaucuguuggcauuua

SEQ ID NO: 6921 - RNA, 22 nt, Escherichia coli CFT073
gaagccaugcuauacgguucca

SEQ ID NO: 6922 - RNA, 22 nt, Escherichia coli CFT073
gaagcgcugggccugucgcagc

SEQ ID NO: 6923 - RNA, 22 nt, Escherichia coli CFT073
gaaggagaucauccaauaacgg

SEQ ID NO: 6924 - RNA, 22 nt, Escherichia coli CFT073
gaaguaugacgaguaugaaaga

SEQ ID NO: 6925 - RNA, 22 nt, Escherichia coli CFT073
gacauugaggaacacuuccaga

SEQ ID NO: 6926 - RNA, 22 nt, Escherichia coli CFT073
gaccaguugcaggagaucguua

SEQ ID NO: 6927 - RNA, 19 nt, Escherichia coli CFT073
gaccgagcagcaagccaag

SEQ ID NO: 6928 - RNA, 22 nt, Escherichia coli CFT073
gaccgcucuuuucgcccgcuuu

SEQ ID NO: 6929 - RNA, 22 nt, Escherichia coli CFT073
gaccggucguuucguuaucggu

SEQ ID NO: 6930 - RNA, 22 nt, Escherichia coli CFT073
gacgaacggcaguauugcuucc

SEQ ID NO: 6931 - RNA, 22 nt, Escherichia coli CFT073
gacgaucaugaugucggcaucu

SEQ ID NO: 6932 - RNA, 22 nt, Escherichia coli CFT073
gacucguccauuuuguugacga

SEQ ID NO: 6933 - RNA, 22 nt, Escherichia coli CFT073
gacuucauggagucgaguugca

SEQ ID NO: 6934 - RNA, 22 nt, Escherichia coli CFT073
gacuuucucguugcuuuucaga

SEQ ID NO: 6935 - RNA, 22 nt, Escherichia coli CFT073
gagaucgauccgcccgugcaug

SEQ ID NO: 6936 - RNA, 22 nt, Escherichia coli CFT073
gagaugcggguucgucaaaggu

SEQ ID NO: 6937 - RNA, 18 nt, Escherichia coli CFT073
gagauuguugaagaauuc

SEQ ID NO: 6938 - RNA, 22 nt, Escherichia coli CFT073
gagccggaaacugguuauuacg

SEQ ID NO: 6939 - RNA, 22 nt, Escherichia coli CFT073
gagcgucaggaagaguggaccg

SEQ ID NO: 6940 - RNA, 22 nt, Escherichia coli CFT073
gaggcggagaaugaugccacag

SEQ ID NO: 6941 - RNA, 22 nt, Escherichia coli CFT073
gaggcuguaacgaucaauuucu

SEQ ID NO: 6942 - RNA, 22 nt, Escherichia coli CFT073
gagugaugauccgcuuuuugcc

SEQ ID NO: 6943 - RNA, 22 nt, Escherichia coli CFT073
gaguucgaauaugacauucugg

SEQ ID NO: 6944 - RNA, 22 nt, Escherichia coli CFT073
gauaaaguccuaugccaucaau

SEQ ID NO: 6945 - RNA, 22 nt, Escherichia coli CFT073
gauaaggcguuuacgccgcauc

SEQ ID NO: 6946 - RNA, 22 nt, Escherichia coli CFT073
gauaagguauagucacaaaaua

SEQ ID NO: 6947 - RNA, 22 nt, Escherichia coli CFT073
gauaaucccugauucgcaguca

SEQ ID NO: 6948 - RNA, 18 nt, Escherichia coli CFT073
gauaccgguaugucauuc

SEQ ID NO: 6949 - RNA, 22 nt, Escherichia coli CFT073
gauacgcugaaugaaaucgaac

SEQ ID NO: 6950 - RNA, 22 nt, Escherichia coli CFT073
gauagcguacaacuggacgagc

SEQ ID NO: 6951 - RNA, 22 nt, Escherichia coli CFT073
gauauguuuaccaucaucggug

SEQ ID NO: 6952 - RNA, 22 nt, Escherichia coli CFT073
gaucauuuucgcuauuuugccu

SEQ ID NO: 6953 - RNA, 22 nt, Escherichia coli CFT073
gaucgacccugugggguguugg

SEQ ID NO: 6954 - RNA, 22 nt, Escherichia coli CFT073
gaucgccgccugcauucagaug

SEQ ID NO: 6955 - RNA, 22 nt, Escherichia coli CFT073
gaucgcugacgccaagcgccug

SEQ ID NO: 6956 - RNA, 22 nt, Escherichia coli CFT073
gaucgguaucgucaaacagcga

SEQ ID NO: 6957 - RNA, 22 nt, Escherichia coli CFT073
gaugaacccguuuugugugguu

SEQ ID NO: 6958 - RNA, 22 nt, Escherichia coli CFT073
gaugaacuguaggcugcugcgg

SEQ ID NO: 6959 - RNA, 22 nt, Escherichia coli CFT073
gaugaccgguuuccgcguagcg

SEQ ID NO: 6960 - RNA, 22 nt, Escherichia coli CFT073
gaugagcguuucccgcauccgc

SEQ ID NO: 6961 - RNA, 22 nt, Escherichia coli CFT073
gaugauauugcuccagauguug

SEQ ID NO: 6962 - RNA, 22 nt, Escherichia coli CFT073
gaugauguugcauuucagauua

SEQ ID NO: 6963 - RNA, 22 nt, Escherichia coli CFT073
gaugauuauguuguugauaucc

SEQ ID NO: 6964 - RNA, 22 nt, Escherichia coli CFT073
gaugcgggugauuaucguccau

SEQ ID NO: 6965 - RNA, 22 nt, Escherichia coli CFT073
gaugcgucuuauccgaccuacg

SEQ ID NO: 6966 - RNA, 22 nt, Escherichia coli CFT073
gauggaaaugguguugauggca

SEQ ID NO: 6967 - RNA, 22 nt, Escherichia coli CFT073
gauggcggagguucuguucguc

SEQ ID NO: 6968 - RNA, 22 nt, Escherichia coli CFT073
aacguuuacaguaauaccgcgu

SEQ ID NO: 6969 - RNA, 22 nt, Escherichia coli CFT073
aacuggcgcgcaauguuggggg

SEQ ID NO: 6970 - RNA, 20 nt, Escherichia coli CFT073
aacugggcggcgagcguauc

SEQ ID NO: 6971 - RNA, 22 nt, Escherichia coli CFT073
aacugggcuugaguuaccgcau

SEQ ID NO: 6972 - RNA, 22 nt, Escherichia coli CFT073
aagaaaagguuuuagccuggua

SEQ ID NO: 6973 - RNA, 22 nt, Escherichia coli CFT073
aagaacgaacuacaugcucaau

SEQ ID NO: 6974 - RNA, 22 nt, Escherichia coli CFT073
aagaaugguuugugccuccgga

SEQ ID NO: 6975 - RNA, 22 nt, Escherichia coli CFT073
aagaauuagcugacccagcguu

SEQ ID NO: 6976 - RNA, 23 nt, Escherichia coli CFT073
aagaguugauaaaaaucgacagg

SEQ ID NO: 6977 - RNA, 19 nt, Escherichia coli CFT073
aagauagucgaauggugga

SEQ ID NO: 6978 - RNA, 22 nt, Escherichia coli CFT073
aagcaaccagcguauggcggac

SEQ ID NO: 6979 - RNA, 22 nt, Escherichia coli CFT073
aagcaauugauuuuuaucaucg

SEQ ID NO: 6980 - RNA, 22 nt, Escherichia coli CFT073
aagcaccaggcuugcccgccga

SEQ ID NO: 6981 - RNA, 22 nt, Escherichia coli CFT073
aagcagccagaacagggagaca

SEQ ID NO: 6982 - RNA, 22 nt, Escherichia coli CFT073
aagcauuacuggucauugcaga

SEQ ID NO: 6983 - RNA, 22 nt, Escherichia coli CFT073
aagccaguuacugacgggcgcu

SEQ ID NO: 6984 - RNA, 22 nt, Escherichia coli CFT073
aagccaguugcuggcauuuugu

SEQ ID NO: 6985 - RNA, 22 nt, Escherichia coli CFT073
aagccucaguuucuaugcaaau

SEQ ID NO: 6986 - RNA, 22 nt, Escherichia coli CFT073
aagcgguugacguguucgucuu

SEQ ID NO: 6987 - RNA, 22 nt, Escherichia coli CFT073
aagcgguuguacacgugccggu

SEQ ID NO: 6988 - RNA, 22 nt, Escherichia coli CFT073
aagcgucccguuucgaucuuag

SEQ ID NO: 6989 - RNA, 22 nt, Escherichia coli CFT073
aagcguugucguugucuuccgg

SEQ ID NO: 6990 - RNA, 22 nt, Escherichia coli CFT073
auagauguugaacugacggaga

SEQ ID NO: 6991 - RNA, 22 nt, Escherichia coli CFT073
auaguauguuuguuauggaaug

SEQ ID NO: 6992 - RNA, 22 nt, Escherichia coli CFT073
auaguuacuggugucugcuucu

SEQ ID NO: 6993 - RNA, 22 nt, Escherichia coli CFT073
auaucaccaccagcccauugag

SEQ ID NO: 6994 - RNA, 22 nt, Escherichia coli CFT073
auaucguugcuaauaauucuaa

SEQ ID NO: 6995 - RNA, 22 nt, Escherichia coli CFT073
auaugcgguucaucagaugcau

SEQ ID NO: 6996 - RNA, 22 nt, Escherichia coli CFT073
auauggcacuggcugacagugu

SEQ ID NO: 6997 - RNA, 22 nt, Escherichia coli CFT073
auauugaugagcgugagguuau

SEQ ID NO: 6998 - RNA, 22 nt, Escherichia coli CFT073
aucaaacaggugcuggaguggu

SEQ ID NO: 6999 - RNA, 23 nt, Escherichia coli CFT073
aucaaaucacugccuucgcugcc

SEQ ID NO: 7000 - RNA, 22 nt, Escherichia coli CFT073
aucaacaagaacaugcugcuau

SEQ ID NO: 7001 - RNA, 19 nt, Escherichia coli CFT073
aucacccgcauaaagacgc

SEQ ID NO: 7002 - RNA, 22 nt, Escherichia coli CFT073
aucacggagugcuccugcaggu

SEQ ID NO: 7003 - RNA, 22 nt, Escherichia coli CFT073
aucacguaggccugauaagcgu

SEQ ID NO: 7004 - RNA, 22 nt, Escherichia coli CFT073
aucacgucaccucgacgcuguu

SEQ ID NO: 7005 - RNA, 22 nt, Escherichia coli CFT073
aucacugaggaugucguuauca

SEQ ID NO: 7006 - RNA, 22 nt, Escherichia coli CFT073
aucagcaacgcauuguggcggu

SEQ ID NO: 7007 - RNA, 22 nt, Escherichia coli CFT073
aucagcaccgaaaaacuccccu

SEQ ID NO: 7008 - RNA, 22 nt, Escherichia coli CFT073
aucagccucucucugaggguga

SEQ ID NO: 7009 - RNA, 22 nt, Escherichia coli CFT073
aucaggaguuuaccugccagcc

SEQ ID NO: 7010 - RNA, 21 nt, Escherichia coli CFT073
aucaggcauuacaagggcugc

SEQ ID NO: 7011 - RNA, 22 nt, Escherichia coli CFT073
aucauaaugguacacuuuauag

SEQ ID NO: 7012 - RNA, 22 nt, Escherichia coli CFT073
aucaucugguugauggaacguu

SEQ ID NO: 7013 - RNA, 22 nt, Escherichia coli CFT073
auccacuugcagcacuacgcgg

SEQ ID NO: 7014 - RNA, 22 nt, Escherichia coli CFT073
auccagcaugaacaaagcgcgc

SEQ ID NO: 7015 - RNA, 22 nt, Escherichia coli CFT073
aucccuauaacaguagaacccu

SEQ ID NO: 7016 - RNA, 23 nt, Escherichia coli CFT073
auccgauaaaacauccggcacac

SEQ ID NO: 7017 - RNA, 22 nt, Escherichia coli CFT073
auccggagauuuuuucgcagac

SEQ ID NO: 7018 - RNA, 22 nt, Escherichia coli CFT073
auccggccgggaguggagguga

SEQ ID NO: 7019 - RNA, 22 nt, Escherichia coli CFT073
auccugauuugcucucucauua

SEQ ID NO: 7020 - RNA, 22 nt, Escherichia coli CFT073
aucgagcgucaaguuucugaga

SEQ ID NO: 7021 - RNA, 22 nt, Escherichia coli CFT073
aucgauaucggcgggcauagca

SEQ ID NO: 7022 - RNA, 22 nt, Escherichia coli CFT073
aucgauuauaugcaggguuauc

SEQ ID NO: 7023 - RNA, 22 nt, Escherichia coli CFT073
aucgcuucgcggauaauuuccc

SEQ ID NO: 7024 - RNA, 22 nt, Escherichia coli CFT073
aucggagauuaguaauaugcga

SEQ ID NO: 7025 - RNA, 22 nt, Escherichia coli CFT073
aucggcccaaaugaucugguua

SEQ ID NO: 7026 - RNA, 22 nt, Escherichia coli CFT073
aucgucacccacgauccgcagg

SEQ ID NO: 7027 - RNA, 23 nt, Escherichia coli CFT073
aucgugacagguucaacugacaa

SEQ ID NO: 7028 - RNA, 22 nt, Escherichia coli CFT073
aucgugugaaagcaggggaacu

SEQ ID NO: 7029 - RNA, 22 nt, Escherichia coli CFT073
aucguuuuuaucuggauagcau

SEQ ID NO: 7030 - RNA, 22 nt, Escherichia coli CFT073
aucuaugugaauaaacaugacg

SEQ ID NO: 7031 - RNA, 22 nt, Escherichia coli CFT073
aucucgaacgggccuggaggua

SEQ ID NO: 7032 - RNA, 18 nt, Escherichia coli CFT073
aucugaguuuaugggaau

SEQ ID NO: 7033 - RNA, 18 nt, Escherichia coli CFT073
aucugcucaaugcuggug

SEQ ID NO: 7034 - RNA, 22 nt, Escherichia coli CFT073
aucuggcaccgccugcugcauu

SEQ ID NO: 7035 - RNA, 22 nt, Escherichia coli CFT073
aucuggcgaaugcguccuggau

SEQ ID NO: 7036 - RNA, 22 nt, Escherichia coli CFT073
aucugucaguacuucuggugcu

SEQ ID NO: 7037 - RNA, 22 nt, Escherichia coli CFT073
aucuucucugcuuuuggcuggg

SEQ ID NO: 7038 - RNA, 22 nt, Escherichia coli CFT073
aucuucuucuuccagggcguug

SEQ ID NO: 7039 - RNA, 22 nt, Escherichia coli CFT073
aucuuucaccagauuaauggug

SEQ ID NO: 7040 - RNA, 22 nt, Escherichia coli CFT073
augagacacgguuguagccuga

SEQ ID NO: 7041 - RNA, 22 nt, Escherichia coli CFT073
augauguucuuaucaaugcaga

SEQ ID NO: 7042 - RNA, 22 nt, Escherichia coli CFT073
augcagagcagguauuccagcu

SEQ ID NO: 7043 - RNA, 22 nt, Escherichia coli CFT073
augccuuaucaggccuacaaau

SEQ ID NO: 7044 - RNA, 22 nt, Escherichia coli CFT073
augcgauuggugaaacgccauu

SEQ ID NO: 7045 - RNA, 22 nt, Escherichia coli CFT073
augcgcuucgcuuauccggccu

SEQ ID NO: 7046 - RNA, 22 nt, Escherichia coli CFT073
augcggcguaaacgccuuaucu

SEQ ID NO: 7047 - RNA, 22 nt, Escherichia coli CFT073
augcguuucgcuuaucugaccu

SEQ ID NO: 7048 - RNA, 22 nt, Escherichia coli CFT073
augcugcauuuugcugaccgga

SEQ ID NO: 7049 - RNA, 22 nt, Escherichia coli CFT073
augcugggcgauauauuuuuuc

SEQ ID NO: 7050 - RNA, 22 nt, Escherichia coli CFT073
auggaaggaucuggauucugga

SEQ ID NO: 7051 - RNA, 22 nt, Escherichia coli CFT073
auggccgccccgguuggggacg

SEQ ID NO: 7052 - RNA, 23 nt, Escherichia coli CFT073
agguggugguggucagugccgac

SEQ ID NO: 7053 - RNA, 22 nt, Escherichia coli CFT073
aguaaacaggcggccaaugugu

SEQ ID NO: 7054 - RNA, 22 nt, Escherichia coli CFT073
aguaaguucuaugacgcaucgu

SEQ ID NO: 7055 - RNA, 22 nt, Escherichia coli CFT073
aguaucaauagugauaucgcca

SEQ ID NO: 7056 - RNA, 22 nt, Escherichia coli CFT073
aguauggcuuccgggucuucca

SEQ ID NO: 7057 - RNA, 19 nt, Escherichia coli CFT073
aguauucuuaagggaagga

SEQ ID NO: 7058 - RNA, 22 nt, Escherichia coli CFT073
agucaauauuuauucauggaau

SEQ ID NO: 7059 - RNA, 22 nt, Escherichia coli CFT073
agucagccaguugauaaaccgg

SEQ ID NO: 7060 - RNA, 22 nt, Escherichia coli CFT073
agugaagcaaucaucgaaacca

SEQ ID NO: 7061 - RNA, 22 nt, Escherichia coli CFT073
agugggucgccgacugccagca

SEQ ID NO: 7062 - RNA, 22 nt, Escherichia coli CFT073
agugugcguugaaugccgaccu

SEQ ID NO: 7063 - RNA, 22 nt, Escherichia coli CFT073
agugugucugacacgauaaagu

SEQ ID NO: 7064 - RNA, 22 nt, Escherichia coli CFT073
aguuaucuccuuugccaguggu

SEQ ID NO: 7065 - RNA, 22 nt, Escherichia coli CFT073
aguuccuuauaauauucaauga

SEQ ID NO: 7066 - RNA, 22 nt, Escherichia coli CFT073
aguugcgaugucgaaaucauuc

SEQ ID NO: 7067 - RNA, 22 nt, Escherichia coli CFT073
aguuuacaacgcauuguuaaag

SEQ ID NO: 7068 - RNA, 22 nt, Escherichia coli CFT073
aguuucaguuuaccgguauaug

SEQ ID NO: 7069 - RNA, 22 nt, Escherichia coli CFT073
aguuucuugagugguaagggaa

SEQ ID NO: 7070 - RNA, 22 nt, Escherichia coli CFT073
auaaagaguacuggucgccgca

SEQ ID NO: 7071 - RNA, 22 nt, Escherichia coli CFT073
auaaccugugucaccguguccu

SEQ ID NO: 7072 - RNA, 22 nt, Escherichia coli CFT073
auaacgcugaaccaggcaguau

SEQ ID NO: 7073 - RNA, 22 nt, Escherichia coli CFT073
auaagacgcgucagcgucgcau

SEQ ID NO: 7074 - RNA, 22 nt, Escherichia coli CFT073
auaagccuaauggagcgaauua

SEQ ID NO: 7075 - RNA, 22 nt, Escherichia coli CFT073
auaauucauauacuuguugucu

SEQ ID NO: 7076 - RNA, 22 nt, Escherichia coli CFT073
auacagaaagcuuauaaugcga

SEQ ID NO: 7077 - RNA, 22 nt, Escherichia coli CFT073
acguaccacugacucucgaaag

SEQ ID NO: 7078 - RNA, 22 nt, Escherichia coli CFT073
acguagcguuaaaacuuuuagc

SEQ ID NO: 7079 - RNA, 22 nt, Escherichia coli CFT073
acgucgacuucgauuggcagug

SEQ ID NO: 7080 - RNA, 22 nt, Escherichia coli CFT073
acgugaggaagcggugaagggg

SEQ ID NO: 7081 - RNA, 22 nt, Escherichia coli CFT073
acguuaaucgucaaucuugaua

SEQ ID NO: 7082 - RNA, 22 nt, Escherichia coli CFT073
acguuaucagcguuaauuugcu

SEQ ID NO: 7083 - RNA, 22 nt, Escherichia coli CFT073
acguucaguuguucgguucaca

SEQ ID NO: 7084 - RNA, 22 nt, Escherichia coli CFT073
acguuggcuggugaaauuacuu

SEQ ID NO: 7085 - RNA, 19 nt, Escherichia coli CFT073
acguuuauuaagugaugau

SEQ ID NO: 7086 - RNA, 22 nt, Escherichia coli CFT073
acguuucccaggugaugcauau

SEQ ID NO: 7087 - RNA, 22 nt, Escherichia coli CFT073
acuacuucauuaugagcaaacu

SEQ ID NO: 7088 - RNA, 22 nt, Escherichia coli CFT073
acuauuaauaugguaagugaca

SEQ ID NO: 7089 - RNA, 22 nt, Escherichia coli CFT073
acuccagcaccuguuugaucug

SEQ ID NO: 7090 - RNA, 22 nt, Escherichia coli CFT073
acucgccagcagcacaaggccg

SEQ ID NO: 7091 - RNA, 21 nt, Escherichia coli CFT073
acugaaauugcugggagucau

SEQ ID NO: 7092 - RNA, 23 nt, Escherichia coli CFT073
acugacuggcggucaggcgcugc

SEQ ID NO: 7093 - RNA, 22 nt, Escherichia coli CFT073
acugaugggcgugcugccagug

SEQ ID NO: 7094 - RNA, 20 nt, Escherichia coli CFT073
acugcacgugucucaggaug

SEQ ID NO: 7095 - RNA, 22 nt, Escherichia coli CFT073
acugcgaaucgggaauuaucuu

SEQ ID NO: 7096 - RNA, 23 nt, Escherichia coli CFT073
acugcggucguugggauuacauc

SEQ ID NO: 7097 - RNA, 22 nt, Escherichia coli CFT073
acuggcucuggaagcggguuug

SEQ ID NO: 7098 - RNA, 22 nt, Escherichia coli CFT073
acuggguuaugucugagccgau

SEQ ID NO: 7099 - RNA, 22 nt, Escherichia coli CFT073
acuggugcuuuaaaguguucuu

SEQ ID NO: 7100 - RNA, 22 nt, Escherichia coli CFT073
acugucaucaaucaucuugaca

SEQ ID NO: 7101 - RNA, 22 nt, Escherichia coli CFT073
aaaaagaucugaucgcgcagcg

SEQ ID NO: 7102 - RNA, 22 nt, Escherichia coli CFT073
aaaaaguggcggagaucccgga

SEQ ID NO: 7103 - RNA, 22 nt, Escherichia coli CFT073
aaaaccuuacauuaacgcuggu

SEQ ID NO: 7104 - RNA, 22 nt, Escherichia coli CFT073
aaaagugauauuacggucucgu

SEQ ID NO: 7105 - RNA, 22 nt, Escherichia coli CFT073
aaaaguggaaacagguuauccc

SEQ ID NO: 7106 - RNA, 20 nt, Escherichia coli CFT073
aaaaugucaaugacacugua

SEQ ID NO: 7107 - RNA, 23 nt, Escherichia coli CFT073
aaacagccaaugcauuauugaua

SEQ ID NO: 7108 - RNA, 22 nt, Escherichia coli CFT073
aaacgcaucgguaugauugcgc

SEQ ID NO: 7109 - RNA, 22 nt, Escherichia coli CFT073
aaacgucgauggcuuuugcgau

SEQ ID NO: 7110 - RNA, 22 nt, Escherichia coli CFT073
aaacugaggcugaugccagcgu

SEQ ID NO: 7111 - RNA, 22 nt, Escherichia coli CFT073
aaagcggugaccgcuaugucga

SEQ ID NO: 7112 - RNA, 22 nt, Escherichia coli CFT073
aaauacagccuggcggaacuga

SEQ ID NO: 7113 - RNA, 20 nt, Escherichia coli CFT073
aaaucguucggggaaaccuu

SEQ ID NO: 7114 - RNA, 21 nt, Escherichia coli CFT073
aaauuuaacuacugaugauug

SEQ ID NO: 7115 - RNA, 19 nt, Escherichia coli CFT073
aacaccauuacggaugaac

SEQ ID NO: 7116 - RNA, 22 nt, Escherichia coli CFT073
aacagcauggggaaugaucaga

SEQ ID NO: 7117 - RNA, 22 nt, Escherichia coli CFT073
aacagccguugcauacgccguu

SEQ ID NO: 7118 - RNA, 22 nt, Escherichia coli CFT073
aaccaacugcguuggcagcauu

SEQ ID NO: 7119 - RNA, 22 nt, Escherichia coli CFT073
aaccgcaagauuacaacgaaca

SEQ ID NO: 7120 - RNA, 22 nt, Escherichia coli CFT073
aaccgcacgaccugaccguucc

SEQ ID NO: 7121 - RNA, 22 nt, Escherichia coli CFT073
aaccuguuuguuaccaggcugg

SEQ ID NO: 7122 - RNA, 22 nt, Escherichia coli CFT073
aacgacgagcaucggcgagggu

SEQ ID NO: 7123 - RNA, 22 nt, Escherichia coli CFT073
aacgaguuaaucaauaucacaa

SEQ ID NO: 7124 - RNA, 22 nt, Escherichia coli CFT073
aacgaugaacuuuuuugccauu

SEQ ID NO: 7125 - RNA, 23 nt, Escherichia coli CFT073
aacgccuggggucgacaucugcc

SEQ ID NO: 7126 - RNA, 22 nt, Escherichia coli CFT073
aacgccuuauccgaccuacgcg

SEQ ID NO: 7127 - RNA, 20 nt, Escherichia coli CFT073
aacgcuggaguaucagcggu

SEQ ID NO: 7128 - RNA, 22 nt, Escherichia coli CFT073
aacggucaggcgacugcgcugg

SEQ ID NO: 7129 - RNA, 22 nt, Escherichia coli CFT073
aacggucaucaagaaaucacau

SEQ ID NO: 7130 - RNA, 22 nt, Escherichia coli CFT073
aaggaaacaguaugaaccuguu

SEQ ID NO: 7131 - RNA, 22 nt, Escherichia coli CFT073
aaggccgugaccgcgaaacugg

SEQ ID NO: 7132 - RNA, 20 nt, Escherichia coli CFT073
aaggcgauugcaggaagcag

SEQ ID NO: 7133 - RNA, 22 nt, Escherichia coli CFT073
aaggcguuauuauuaauugccg

SEQ ID NO: 7134 - RNA, 22 nt, Escherichia coli CFT073
aaggcuggauuuaucaguucca

SEQ ID NO: 7135 - RNA, 22 nt, Escherichia coli CFT073
aaggcuuauuaguuaucgauau

SEQ ID NO: 7136 - RNA, 18 nt, Escherichia coli CFT073
aagggcagggcaaguacc

SEQ ID NO: 7137 - RNA, 22 nt, Escherichia coli CFT073
aaggguauuuucgcaaaucagg

SEQ ID NO: 7138 - RNA, 23 nt, Escherichia coli CFT073
aagguaaacgucgucugguuauc

SEQ ID NO: 7139 - RNA, 22 nt, Escherichia coli CFT073
aagguuaaccacaugaaaauca

SEQ ID NO: 7140 - RNA, 22 nt, Escherichia coli CFT073
aagguuuucccugagcaaauuu

SEQ ID NO: 7141 - RNA, 22 nt, Escherichia coli CFT073
aagguuuuguacaacugcgggu

SEQ ID NO: 7142 - RNA, 19 nt, Escherichia coli CFT073
aagugcgcucgacgugaca

SEQ ID NO: 7143 - RNA, 22 nt, Escherichia coli CFT073
aaucacaguagucgaaguuuuu

SEQ ID NO: 7144 - RNA, 22 nt, Escherichia coli CFT073
aaucauccacuuccuggggggu

SEQ ID NO: 7145 - RNA, 22 nt, Escherichia coli CFT073
aaucaucuccguucaccagucc

SEQ ID NO: 7146 - RNA, 22 nt, Escherichia coli CFT073
aaucgcuacauguuaacacaca

SEQ ID NO: 7147 - RNA, 20 nt, Escherichia coli CFT073
aaucggcguuaucccuggcc

SEQ ID NO: 7148 - RNA, 22 nt, Escherichia coli CFT073
aaucucucagguggaaaucagc

SEQ ID NO: 7149 - RNA, 22 nt, Escherichia coli CFT073
aaucuucauguaauuggaauga

SEQ ID NO: 7150 - RNA, 22 nt, Escherichia coli CFT073
aaugagcgccgccuguuuuucu

SEQ ID NO: 7151 - RNA, 22 nt, Escherichia coli CFT073
aaugcaguagucgcagcggaag

SEQ ID NO: 7152 - RNA, 22 nt, Escherichia coli CFT073
aaugcgcugguugaaguguuac

SEQ ID NO: 7153 - RNA, 22 nt, Escherichia coli CFT073
aauggaccagucuguuuauucu

SEQ ID NO: 7154 - RNA, 22 nt, Escherichia coli CFT073
aauggcggaguguugcucaaaa

SEQ ID NO: 7155 - RNA, 20 nt, Escherichia coli CFT073
aauggcuguaggguggggaa

SEQ ID NO: 7156 - RNA, 22 nt, Escherichia coli CFT073
aauucguuuauuuucgaacgua

SEQ ID NO: 7157 - RNA, 22 nt, Escherichia coli CFT073
aauuuguuccuggcuauggaug

SEQ ID NO: 7158 - RNA, 22 nt, Escherichia coli CFT073
acacuaguucuaauuuugagau

SEQ ID NO: 7159 - RNA, 22 nt, Escherichia coli CFT073
acagagauguuuaauccuggcg

SEQ ID NO: 7160 - RNA, 22 nt, Escherichia coli CFT073
acagagccugucucagcaauga

SEQ ID NO: 7161 - RNA, 20 nt, Escherichia coli CFT073
acagcacugccgcaggaggu

SEQ ID NO: 7162 - RNA, 22 nt, Escherichia coli CFT073
acagccuggaaggcaacgcggu

SEQ ID NO: 7163 - RNA, 22 nt, Escherichia coli CFT073
acagcgccaauaagcgcgccga

SEQ ID NO: 7164 - RNA, 22 nt, Escherichia coli CFT073
acaggcaguugcguagauuucu

SEQ ID NO: 7165 - RNA, 22 nt, Escherichia coli CFT073
acaggucaauguuaucguuuau

SEQ ID NO: 7166 - RNA, 22 nt, Escherichia coli CFT073
acaguauaggguuuuuauacag

SEQ ID NO: 7167 - RNA, 22 nt, Escherichia coli CFT073
acaucgacaggaagcgucaguc

SEQ ID NO: 7168 - RNA, 22 nt, Escherichia coli CFT073
acaugaagauaaccugaucguu

SEQ ID NO: 7169 - RNA, 22 nt, Escherichia coli CFT073
accaaugugauuauagccaucg

SEQ ID NO: 7170 - RNA, 22 nt, Escherichia coli CFT073
accaccuguguauugagccgcc

SEQ ID NO: 7171 - RNA, 22 nt, Escherichia coli CFT073
accgaagcgcauccagcggcgu

SEQ ID NO: 7172 - RNA, 22 nt, Escherichia coli CFT073
accgauguaggaagucacuucg

SEQ ID NO: 7173 - RNA, 22 nt, Escherichia coli CFT073
accgcgacgcagaccgucggag

SEQ ID NO: 7174 - RNA, 22 nt, Escherichia coli CFT073
accggaggaggcgaauacuggc

SEQ ID NO: 7175 - RNA, 22 nt, Escherichia coli CFT073
accguuggcgugcuguuccugc

SEQ ID NO: 7176 - RNA, 20 nt, Escherichia coli CFT073
accugauuaaaaauaucggc

SEQ ID NO: 7177 - RNA, 22 nt, Escherichia coli CFT073
accugcgaaccaacauugaucc

SEQ ID NO: 7178 - RNA, 22 nt, Escherichia coli CFT073
accugcuucagcucugcgucug

SEQ ID NO: 7179 - RNA, 22 nt, Escherichia coli CFT073
accuuguaaaaaugcguugcug

SEQ ID NO: 7180 - RNA, 22 nt, Escherichia coli CFT073
acgaaacuggacggcacggcga

SEQ ID NO: 7181 - RNA, 20 nt, Escherichia coli CFT073
acgaucgucaccaucuaaca

SEQ ID NO: 7182 - RNA, 23 nt, Escherichia coli CFT073
acgaugaagccuuccugcaacag

SEQ ID NO: 7183 - RNA, 22 nt, Escherichia coli CFT073
acgcacgcuugaagaugauguu

SEQ ID NO: 7184 - RNA, 21 nt, Escherichia coli CFT073
acgcaucauccgaaucaccag

SEQ ID NO: 7185 - RNA, 22 nt, Escherichia coli CFT073
acgcgaucagcaucgcggcgua

SEQ ID NO: 7186 - RNA, 22 nt, Escherichia coli CFT073
acgcgcuuaagcgucuggaugu

SEQ ID NO: 7187 - RNA, 22 nt, Escherichia coli CFT073
acggcguugcuggaagaaaaac

SEQ ID NO: 7188 - RNA, 22 nt, Escherichia coli CFT073
acggcugagagcaccaccagag

SEQ ID NO: 7189 - RNA, 22 nt, Escherichia coli CFT073
acggcugccaccggagcgugaa

SEQ ID NO: 7190 - RNA, 22 nt, Escherichia coli CFT073
acggcuggcgcuaucaggaaca

SEQ ID NO: 7191 - RNA, 22 nt, Escherichia coli CFT073
acgggccauuuguacgguuaau

SEQ ID NO: 7192 - RNA, 22 nt, Escherichia coli CFT073
acgguaaaaaaugccgugcgca

SEQ ID NO: 7193 - RNA, 22 nt, Escherichia coli CFT073
acggucugcacggugguggugg

SEQ ID NO: 7194 - RNA, 22 nt, Escherichia coli CFT073
auggcgaucaggugcuggcuca

SEQ ID NO: 7195 - RNA, 22 nt, Escherichia coli CFT073
auggcgucgauaauagcgcggg

SEQ ID NO: 7196 - RNA, 21 nt, Escherichia coli CFT073
augggcaucaaccuguuccgc

SEQ ID NO: 7197 - RNA, 22 nt, Escherichia coli CFT073
auggguuccuggggugcggagu

SEQ ID NO: 7198 - RNA, 22 nt, Escherichia coli CFT073
auggugcugccaucaucgguca

SEQ ID NO: 7199 - RNA, 22 nt, Escherichia coli CFT073
augguugugccguuucgcuccg

SEQ ID NO: 7200 - RNA, 22 nt, Escherichia coli CFT073
auguaaaaacgcaaauccggcu

SEQ ID NO: 7201 - RNA, 22 nt, Escherichia coli CFT073
auguaggguuacgcgcaguuuc

SEQ ID NO: 7202 - RNA, 23 nt, Escherichia coli CFT073
augucuguucccugcugccggac

SEQ ID NO: 7203 - RNA, 22 nt, Escherichia coli CFT073
augugugaagcaacagccgcca

SEQ ID NO: 7204 - RNA, 22 nt, Escherichia coli CFT073
auguguuuuacagcgugaugga

SEQ ID NO: 7205 - RNA, 22 nt, Escherichia coli CFT073
auguuaauccugcguggucagg

SEQ ID NO: 7206 - RNA, 22 nt, Escherichia coli CFT073
auguuuuaagaacauuccguaa

SEQ ID NO: 7207 - RNA, 22 nt, Escherichia coli CFT073
auguuuuaagcucugugagcga

SEQ ID NO: 7208 - RNA, 23 nt, Escherichia coli CFT073
auuaccccaaacgaacaggcaag

SEQ ID NO: 7209 - RNA, 22 nt, Escherichia coli CFT073
auuagcccccgugauguuguca

SEQ ID NO: 7210 - RNA, 22 nt, Escherichia coli CFT073
auuagcgacaacauucgugcca

SEQ ID NO: 7211 - RNA, 20 nt, Escherichia coli CFT073
auuauuccugccuguacugu

SEQ ID NO: 7212 - RNA, 22 nt, Escherichia coli CFT073
auucagcaugguucguucauug

SEQ ID NO: 7213 - RNA, 22 nt, Escherichia coli CFT073
auucaguugauacugauuuucc

SEQ ID NO: 7214 - RNA, 22 nt, Escherichia coli CFT073
auuccaggagugaguauucagg

SEQ ID NO: 7215 - RNA, 22 nt, Escherichia coli CFT073
auucccuucauggucgauagcg

SEQ ID NO: 7216 - RNA, 20 nt, Escherichia coli CFT073
auuccgcggcgugcgucugu

SEQ ID NO: 7217 - RNA, 22 nt, Escherichia coli CFT073
auuccgcguaaaacaaugggga

SEQ ID NO: 7218 - RNA, 22 nt, Escherichia coli CFT073
auucuggguggaaccgccgcgu

SEQ ID NO: 7219 - RNA, 22 nt, Escherichia coli CFT073
auucuuuggccugggugcguac

SEQ ID NO: 7220 - RNA, 22 nt, Escherichia coli CFT073
acugugcaaaaucgugcagcau

SEQ ID NO: 7221 - RNA, 22 nt, Escherichia coli CFT073
acuucccguaugugcugaugaa

SEQ ID NO: 7222 - RNA, 20 nt, Escherichia coli CFT073
acuugcgcaccuugugcgcc

SEQ ID NO: 7223 - RNA, 22 nt, Escherichia coli CFT073
agaaaaucauaucgccaucuug

SEQ ID NO: 7224 - RNA, 22 nt, Escherichia coli CFT073
agaaacuggcggcagaugacga

SEQ ID NO: 7225 - RNA, 22 nt, Escherichia coli CFT073
agaaauaccaucaaaaucguga

SEQ ID NO: 7226 - RNA, 22 nt, Escherichia coli CFT073
agaaauauuugcccggcgcguu

SEQ ID NO: 7227 - RNA, 22 nt, Escherichia coli CFT073
agaaccgguuuugaaucagcgg

SEQ ID NO: 7228 - RNA, 22 nt, Escherichia coli CFT073
agaauggcguaucggagcggug

SEQ ID NO: 7229 - RNA, 23 nt, Escherichia coli CFT073
agaauugagccucgaucagcagg

SEQ ID NO: 7230 - RNA, 20 nt, Escherichia coli CFT073
agacuuuuuaccgcuguaau

SEQ ID NO: 7231 - RNA, 22 nt, Escherichia coli CFT073
agagcgaaucgaaaagcguggg

SEQ ID NO: 7232 - RNA, 22 nt, Escherichia coli CFT073
agagcggcggucugaucacccg

SEQ ID NO: 7233 - RNA, 19 nt, Escherichia coli CFT073
agauccggaagaggguggu

SEQ ID NO: 7234 - RNA, 22 nt, Escherichia coli CFT073
agauccuccuguuugauagugu

SEQ ID NO: 7235 - RNA, 23 nt, Escherichia coli CFT073
agaugaucgaugccuuuuacgcc

SEQ ID NO: 7236 - RNA, 22 nt, Escherichia coli CFT073
agauggugauuggcagcggcga

SEQ ID NO: 7237 - RNA, 22 nt, Escherichia coli CFT073
agauucagcacgguugccuuug

SEQ ID NO: 7238 - RNA, 22 nt, Escherichia coli CFT073
agauugcauacagccauugaau

SEQ ID NO: 7239 - RNA, 22 nt, Escherichia coli CFT073
agcaacugacgcuucggauccc

SEQ ID NO: 7240 - RNA, 22 nt, Escherichia coli CFT073
agcagcaacgcuggcuggagca

SEQ ID NO: 7241 - RNA, 22 nt, Escherichia coli CFT073
agcaggccaucacgaccuugcu

SEQ ID NO: 7242 - RNA, 22 nt, Escherichia coli CFT073
agcaguuuuucaucccugaaua

SEQ ID NO: 7243 - RNA, 19 nt, Escherichia coli CFT073
agcaucguuuauucccuau

SEQ ID NO: 7244 - RNA, 22 nt, Escherichia coli CFT073
agcauucaguugaugaaaucgc

SEQ ID NO: 7245 - RNA, 22 nt, Escherichia coli CFT073
agccgcuauaucaccaguucug

SEQ ID NO: 7246 - RNA, 20 nt, Escherichia coli CFT073
agccgggauucagcgcagga

SEQ ID NO: 7247 - RNA, 22 nt, Escherichia coli CFT073
agcgaaagccagcucaugcagg

SEQ ID NO: 7248 - RNA, 19 nt, Escherichia coli CFT073
agcgcaccgaaaguggucg

SEQ ID NO: 7249 - RNA, 22 nt, Escherichia coli CFT073
agcgccgcaaaauacccuguuc

SEQ ID NO: 7250 - RNA, 22 nt, Escherichia coli CFT073
agcgccgcuuccauguccugga

SEQ ID NO: 7251 - RNA, 22 nt, Escherichia coli CFT073
agcgcgagguaacguacuggcu

SEQ ID NO: 7252 - RNA, 22 nt, Escherichia coli CFT073
agcgggugucccaggucaggcu

SEQ ID NO: 7253 - RNA, 22 nt, Escherichia coli CFT073
agcggugugugaaauugucagu

SEQ ID NO: 7254 - RNA, 22 nt, Escherichia coli CFT073
agcguugaccuuccugauugcg

SEQ ID NO: 7255 - RNA, 22 nt, Escherichia coli CFT073
agcguuuuacaucugauggacg

SEQ ID NO: 7256 - RNA, 19 nt, Escherichia coli CFT073
agcucagacggggaguggu

SEQ ID NO: 7257 - RNA, 22 nt, Escherichia coli CFT073
agcugccggaagcagacagcag

SEQ ID NO: 7258 - RNA, 22 nt, Escherichia coli CFT073
agcugcgcccgauaaugacggu

SEQ ID NO: 7259 - RNA, 22 nt, Escherichia coli CFT073
agcugcugacgcaccaguucua

SEQ ID NO: 7260 - RNA, 19 nt, Escherichia coli CFT073
agcuggguuuggauuugau

SEQ ID NO: 7261 - RNA, 22 nt, Escherichia coli CFT073
aggaagaugccucucaguugcg

SEQ ID NO: 7262 - RNA, 22 nt, Escherichia coli CFT073
aggauaaaacagauucggcagu

SEQ ID NO: 7263 - RNA, 21 nt, Escherichia coli CFT073
aggauggcuucgaugauuucu

SEQ ID NO: 7264 - RNA, 22 nt, Escherichia coli CFT073
aggcacauaacagcuaaguauu

SEQ ID NO: 7265 - RNA, 22 nt, Escherichia coli CFT073
aggccggauaagcgaagcgcau

SEQ ID NO: 7266 - RNA, 22 nt, Escherichia coli CFT073
aggccggauaaggcguucacgc

SEQ ID NO: 7267 - RNA, 22 nt, Escherichia coli CFT073
aggcggaaauacucgccgcgga

SEQ ID NO: 7268 - RNA, 22 nt, Escherichia coli CFT073
aggcgugucaucagcauggagc

SEQ ID NO: 7269 - RNA, 22 nt, Escherichia coli CFT073
aggcucaguacgcagcugaaga

SEQ ID NO: 7270 - RNA, 22 nt, Escherichia coli CFT073
agggcggugaaaaugguuugau

SEQ ID NO: 7271 - RNA, 22 nt, Escherichia coli CFT073
agggcguauccgggcagaagau

SEQ ID NO: 7272 - RNA, 22 nt, Escherichia coli CFT073
agggcgugggcaaggcacugcu

SEQ ID NO: 7273 - RNA, 22 nt, Escherichia coli CFT073
aggguugacgugauagagguuu

SEQ ID NO: 7274 - RNA, 22 nt, Escherichia coli CFT073
agguacugcaaacgcugcagaa

SEQ ID NO: 7275 - RNA, 22 nt, Escherichia coli CFT073
aggucaaugcguuugagaaugu

SEQ ID NO: 7276 - RNA, 22 nt, Escherichia coli CFT073
aggucagauaagcgaaacgcau

SEQ ID NO: 7277 - RNA, 22 nt, Escherichia coli CFT073
aggucgauaccaaagcaauuga

SEQ ID NO: 7278 - RNA, 20 nt, Escherichia coli CFT073
aggucgaugccgagaucauc

SEQ ID NO: 7279 - RNA, 19 nt, Escherichia coli CFT073
aggugauugaaaccgaucu

SEQ ID NO: 7280 - RNA, 22 nt, Escherichia coli CFT073
aggugcgaugcucgccgucaau

SEQ ID NO: 7281 - RNA, 22 nt, Escherichia coli CFT073
aggugcguaauaagcugguggc

SEQ ID NO: 7282 - RNA, 22 nt, Escherichia coli CFT073
agguggcgaagcacaacguuaa

SEQ ID NO: 7283 - RNA, 22 nt, Escherichia coli CFT073
gcgagaaacaggaugaggugaa

SEQ ID NO: 7284 - RNA, 22 nt, Escherichia coli CFT073
gcgagagaugauuugugaacau

SEQ ID NO: 7285 - RNA, 20 nt, Escherichia coli CFT073
gcgauaaccugacgguagag

SEQ ID NO: 7286 - RNA, 19 nt, Escherichia coli CFT073
gcgauacuuucuggugggc

SEQ ID NO: 7287 - RNA, 22 nt, Escherichia coli CFT073
gcgaugauaugguugcuggcgg

SEQ ID NO: 7288 - RNA, 22 nt, Escherichia coli CFT073
gcgcacgauuguacgguaggua

SEQ ID NO: 7289 - RNA, 22 nt, Escherichia coli CFT073
gcgcagaauggugcaaacggug

SEQ ID NO: 7290 - RNA, 23 nt, Escherichia coli CFT073
gcgcaugaaagaagaggucgcca

SEQ ID NO: 7291 - RNA, 22 nt, Escherichia coli CFT073
gcgcgccagugauuuacugaag

SEQ ID NO: 7292 - RNA, 22 nt, Escherichia coli CFT073
gcgcgccaguuggcgaucuaca

SEQ ID NO: 7293 - RNA, 22 nt, Escherichia coli CFT073
gcgcggaauuaaggucgcuggc

SEQ ID NO: 7294 - RNA, 22 nt, Escherichia coli CFT073
gcgcggcauauucugcaaguau

SEQ ID NO: 7295 - RNA, 22 nt, Escherichia coli CFT073
gcgcgguugcccaaguucgucg

SEQ ID NO: 7296 - RNA, 22 nt, Escherichia coli CFT073
gcgcguaucagcccgugggcca

SEQ ID NO: 7297 - RNA, 22 nt, Escherichia coli CFT073
gcgcugaugugggcaguacugg

SEQ ID NO: 7298 - RNA, 22 nt, Escherichia coli CFT073
gcggaucucgguauugccuucg

SEQ ID NO: 7299 - RNA, 22 nt, Escherichia coli CFT073
gcggaucugauuuucagcuacu

SEQ ID NO: 7300 - RNA, 22 nt, Escherichia coli CFT073
gcggaucugcggaggcgcgguu

SEQ ID NO: 7301 - RNA, 22 nt, Escherichia coli CFT073
gcggccagccggagcuggcaag

SEQ ID NO: 7302 - RNA, 22 nt, Escherichia coli CFT073
gcggcgauauguucugguugau

SEQ ID NO: 7303 - RNA, 22 nt, Escherichia coli CFT073
gcggucguuguagagauacucc

SEQ ID NO: 7304 - RNA, 22 nt, Escherichia coli CFT073
gcgguugguuacggcaccgaac

SEQ ID NO: 7305 - RNA, 22 nt, Escherichia coli CFT073
gcgucguuugccaugcgaaggu

SEQ ID NO: 7306 - RNA, 22 nt, Escherichia coli CFT073
gcgucuggaagaagaacgccgu

SEQ ID NO: 7307 - RNA, 21 nt, Escherichia coli CFT073
gcgugccacaucaacgaucuc

SEQ ID NO: 7308 - RNA, 21 nt, Escherichia coli CFT073
gcguggaucuggaguucagca

SEQ ID NO: 7309 - RNA, 22 nt, Escherichia coli CFT073
gcgugggcgguguuuuucggug

SEQ ID NO: 7310 - RNA, 23 nt, Escherichia coli CFT073
gcguuauagccgccaaauccugc

SEQ ID NO: 7311 - RNA, 22 nt, Escherichia coli CFT073
gcguuggucaucgcuucacugc

SEQ ID NO: 7312 - RNA, 22 nt, Escherichia coli CFT073
gcguuuuaucggugaugucugc

SEQ ID NO: 7313 - RNA, 22 nt, Escherichia coli CFT073
gcguuuugugucgucguugccc

SEQ ID NO: 7314 - RNA, 22 nt, Escherichia coli CFT073
gcuacuggaugauagccaacau

SEQ ID NO: 7315 - RNA, 22 nt, Escherichia coli CFT073
gcuaugaacaugcaaaucacca

SEQ ID NO: 7316 - RNA, 22 nt, Escherichia coli CFT073
gcuauguugagaacggugaguu

SEQ ID NO: 7317 - RNA, 22 nt, Escherichia coli CFT073
gcucaaggauaccgaugauuuu

SEQ ID NO: 7318 - RNA, 22 nt, Escherichia coli CFT073
gcucugccuauuuugaaaacgc

SEQ ID NO: 7319 - RNA, 22 nt, Escherichia coli CFT073
gcugacgcgucuuaucaggccu

SEQ ID NO: 7320 - RNA, 21 nt, Escherichia coli CFT073
gcugauccugguaaaugcucg

SEQ ID NO: 7321 - RNA, 22 nt, Escherichia coli CFT073
gcugauggcgcagguagcgccu

SEQ ID NO: 7322 - RNA, 22 nt, Escherichia coli CFT073
gcugccagccugccauccggcg

SEQ ID NO: 7323 - RNA, 22 nt, Escherichia coli CFT073
gcugccaucugauuaaucgacg

SEQ ID NO: 7324 - RNA, 22 nt, Escherichia coli CFT073
gcugccuacacaaugccugaug

SEQ ID NO: 7325 - RNA, 22 nt, Escherichia coli CFT073
gcugcgcgauccaggucugcac

SEQ ID NO: 7326 - RNA, 22 nt, Escherichia coli CFT073
gcugcggaggucgcagaacgua

SEQ ID NO: 7327 - RNA, 22 nt, Escherichia coli CFT073
gcugcggugauaaacaguuuug

SEQ ID NO: 7328 - RNA, 22 nt, Escherichia coli CFT073
gcuggcagguccagucguugac

SEQ ID NO: 7329 - RNA, 22 nt, Escherichia coli CFT073
gcuggcagugagcgaagcacug

SEQ ID NO: 7330 - RNA, 21 nt, Escherichia coli CFT073
gcuggccuucagccgcuacgc

SEQ ID NO: 7331 - RNA, 22 nt, Escherichia coli CFT073
gcuggguuggggagaaauaagc

SEQ ID NO: 7332 - RNA, 22 nt, Escherichia coli CFT073
gcuggugcacugguugaagcgu

SEQ ID NO: 7333 - RNA, 22 nt, Escherichia coli CFT073
gcugguuaagcguauuagccaa

SEQ ID NO: 7334 - RNA, 22 nt, Escherichia coli CFT073
gcugguuaucggaagagaugaa

SEQ ID NO: 7335 - RNA, 22 nt, Escherichia coli CFT073
gcuguggucgagcguuugcgua

SEQ ID NO: 7336 - RNA, 22 nt, Escherichia coli CFT073
gcuuauugucuucauuauacuu

SEQ ID NO: 7337 - RNA, 20 nt, Escherichia coli CFT073
gcuuccauugcaucacaaua

SEQ ID NO: 7338 - RNA, 22 nt, Escherichia coli CFT073
gcuucgcggagguaucagagau

SEQ ID NO: 7339 - RNA, 22 nt, Escherichia coli CFT073
gcuugaucaccagcaccgguau

SEQ ID NO: 7340 - RNA, 22 nt, Escherichia coli CFT073
ggaaagaauaugcgccaggcgu

SEQ ID NO: 7341 - RNA, 22 nt, Escherichia coli CFT073
ggaacggaugucgauucgcucc

SEQ ID NO: 7342 - RNA, 22 nt, Escherichia coli CFT073
ggaagggaauaaaguucgcgag

SEQ ID NO: 7343 - RNA, 22 nt, Escherichia coli CFT073
ggaagucaugugccauccggcg

SEQ ID NO: 7344 - RNA, 22 nt, Escherichia coli CFT073
ggaagucauugagcccgagauc

SEQ ID NO: 7345 - RNA, 22 nt, Escherichia coli CFT073
ggaauauugccaccuucguuuu

SEQ ID NO: 7346 - RNA, 22 nt, Escherichia coli CFT073
ggacaucaugcccgaggucgcg

SEQ ID NO: 7347 - RNA, 22 nt, Escherichia coli CFT073
ggaccgcaugggugcgaacuuc

SEQ ID NO: 7348 - RNA, 22 nt, Escherichia coli CFT073
ggacuggugacggucgaagaua

SEQ ID NO: 7349 - RNA, 22 nt, Escherichia coli CFT073
ggagcgaaucgacauccguucc

SEQ ID NO: 7350 - RNA, 22 nt, Escherichia coli CFT073
ggauaugggcgucguauucguc

SEQ ID NO: 7351 - RNA, 22 nt, Escherichia coli CFT073
ggauauugguucccgucuggua

SEQ ID NO: 7352 - RNA, 22 nt, Escherichia coli CFT073
ggaucguagauaaaggucaggu

SEQ ID NO: 7353 - RNA, 22 nt, Escherichia coli CFT073
ggauguuaauggcauuagauau

SEQ ID NO: 7354 - RNA, 22 nt, Escherichia coli CFT073
ggcaacgaccagaauucucgca

SEQ ID NO: 7355 - RNA, 22 nt, Escherichia coli CFT073
ggcaaugaaaucagcuacuuug

SEQ ID NO: 7356 - RNA, 22 nt, Escherichia coli CFT073
ggcagcaagugcagcucgcugg

SEQ ID NO: 7357 - RNA, 22 nt, Escherichia coli CFT073
ggcagcgcguagaauuuaccuu

SEQ ID NO: 7358 - RNA, 22 nt, Escherichia coli CFT073
ggcaggcucuggcgaaacaggg

SEQ ID NO: 7359 - RNA, 22 nt, Escherichia coli CFT073
ggcaucgcugcuguugcuguuc

SEQ ID NO: 7360 - RNA, 22 nt, Escherichia coli CFT073
ggcaugaccacuacucugguau

SEQ ID NO: 7361 - RNA, 22 nt, Escherichia coli CFT073
ggcauuuuccugcgcgauuuaa

SEQ ID NO: 7362 - RNA, 22 nt, Escherichia coli CFT073
ggccauccugugaaacuggaaa

SEQ ID NO: 7363 - RNA, 22 nt, Escherichia coli CFT073
ggccauugucgcagccuguccg

SEQ ID NO: 7364 - RNA, 22 nt, Escherichia coli CFT073
ggccuguaugagcuuuuccccg

SEQ ID NO: 7365 - RNA, 22 nt, Escherichia coli CFT073
ggccuuaacgauaagcaguuag

SEQ ID NO: 7366 - RNA, 22 nt, Escherichia coli CFT073
ggcgauguugcuaaaagccauu

SEQ ID NO: 7367 - RNA, 22 nt, Escherichia coli CFT073
ggcgauuauagccauauguugg

SEQ ID NO: 7368 - RNA, 22 nt, Escherichia coli CFT073
ggcgccgcucaauauggggauu

SEQ ID NO: 7369 - RNA, 22 nt, Escherichia coli CFT073
ggcgcgucgcgggagauauccc

SEQ ID NO: 7370 - RNA, 22 nt, Escherichia coli CFT073
ggcgcuaagaaucaucauugac

SEQ ID NO: 7371 - RNA, 22 nt, Escherichia coli CFT073
ggcggacucaaugaugacauca

SEQ ID NO: 7372 - RNA, 22 nt, Escherichia coli CFT073
ggcggcgaugggugugcugugu

SEQ ID NO: 7373 - RNA, 22 nt, Escherichia coli CFT073
ggcgguggaacuggcuucuaug

SEQ ID NO: 7374 - RNA, 22 nt, Escherichia coli CFT073
ggcgugagguuuuugacguuga

SEQ ID NO: 7375 - RNA, 22 nt, Escherichia coli CFT073
ggcuaaccaauaugcuuuauua

SEQ ID NO: 7376 - RNA, 22 nt, Escherichia coli CFT073
ggcuacugaaacugaugacaaa

SEQ ID NO: 7377 - RNA, 23 nt, Escherichia coli CFT073
ggcuagauucuacguaugaugau

SEQ ID NO: 7378 - RNA, 23 nt, Escherichia coli CFT073
ggcugcugucaucaucgggcggg

SEQ ID NO: 7379 - RNA, 22 nt, Escherichia coli CFT073
ggcuuugucuucaccaaguugu

SEQ ID NO: 7380 - RNA, 22 nt, Escherichia coli CFT073
gggacugaaguuggucagacgc

SEQ ID NO: 7381 - RNA, 22 nt, Escherichia coli CFT073
gggcaacauugauacccaccau

SEQ ID NO: 7382 - RNA, 20 nt, Escherichia coli CFT073
gggcgacggcaggagccagu

SEQ ID NO: 7383 - RNA, 22 nt, Escherichia coli CFT073
gggcgaggacgcuggcaggugc

SEQ ID NO: 7384 - RNA, 22 nt, Escherichia coli CFT073
gggcgcagaaaaucagcgucca

SEQ ID NO: 7385 - RNA, 22 nt, Escherichia coli CFT073
gggcgggcagcauguuaacagg

SEQ ID NO: 7386 - RNA, 22 nt, Escherichia coli CFT073
ggggcaauacugucaccaucga

SEQ ID NO: 7387 - RNA, 22 nt, Escherichia coli CFT073
ggggcgaucgccaggcagguac

SEQ ID NO: 7388 - RNA, 22 nt, Escherichia coli CFT073
ggguauuuuaucugcgauuuca

SEQ ID NO: 7389 - RNA, 22 nt, Escherichia coli CFT073
gggucgaugaugcgcagacguu

SEQ ID NO: 7390 - RNA, 22 nt, Escherichia coli CFT073
gguaaaggaguucgagaaaaau

SEQ ID NO: 7391 - RNA, 22 nt, Escherichia coli CFT073
gguaaagugcuuuccuguggca

SEQ ID NO: 7392 - RNA, 22 nt, Escherichia coli CFT073
gguacagguacguggcaauacc

SEQ ID NO: 7393 - RNA, 22 nt, Escherichia coli CFT073
gguagcccuggauggagaguua

SEQ ID NO: 7394 - RNA, 22 nt, Escherichia coli CFT073
gguaugcguggcgcgcguguuc

SEQ ID NO: 7395 - RNA, 22 nt, Escherichia coli CFT073
ggucacagacuccgcuggaaga

SEQ ID NO: 7396 - RNA, 22 nt, Escherichia coli CFT073
ggucagauugucuauaugaacu

SEQ ID NO: 7397 - RNA, 22 nt, Escherichia coli CFT073
ggucgagcgucaguguccgcgu

SEQ ID NO: 7398 - RNA, 22 nt, Escherichia coli CFT073
ggucgccugcggcaacggcuuu

SEQ ID NO: 7399 - RNA, 22 nt, Escherichia coli CFT073
ggucuuuuuccugcuggcggca

SEQ ID NO: 7400 - RNA, 22 nt, Escherichia coli CFT073
ggugagaaugugguggccauca

SEQ ID NO: 7401 - RNA, 22 nt, Escherichia coli CFT073
ggugcacuacgaauuggcgcaa

SEQ ID NO: 7402 - RNA, 22 nt, Escherichia coli CFT073
ggugcagacauggucuuuauug

SEQ ID NO: 7403 - RNA, 22 nt, Escherichia coli CFT073
gguguugauuaacccaagcguu

SEQ ID NO: 7404 - RNA, 22 nt, Escherichia coli CFT073
gguguuggagcgguaggccgga

SEQ ID NO: 7405 - RNA, 22 nt, Escherichia coli CFT073
gguucacuggugguuuuacugg

SEQ ID NO: 7406 - RNA, 22 nt, Escherichia coli CFT073
gguucugaaacuaagauucuua

SEQ ID NO: 7407 - RNA, 22 nt, Escherichia coli CFT073
gguugcagacaggucguuguug

SEQ ID NO: 7408 - RNA, 22 nt, Escherichia coli CFT073
gguugcggcagcaaggauucau

SEQ ID NO: 7409 - RNA, 22 nt, Escherichia coli CFT073
gguuggacgcccacugcuggca

SEQ ID NO: 7410 - RNA, 22 nt, Escherichia coli CFT073
guaaaagguauguaacagacca

SEQ ID NO: 7411 - RNA, 22 nt, Escherichia coli CFT073
guaaacauugcaccagcgccca

SEQ ID NO: 7412 - RNA, 22 nt, Escherichia coli CFT073
guaauuuucuguuucauguugc

SEQ ID NO: 7413 - RNA, 22 nt, Escherichia coli CFT073
guacagcgcacugauuuucgca

SEQ ID NO: 7414 - RNA, 19 nt, Escherichia coli CFT073
guaccgaucgcguguaucu

SEQ ID NO: 7415 - RNA, 18 nt, Escherichia coli CFT073
guauccacugccugugcu

SEQ ID NO: 7416 - RNA, 22 nt, Escherichia coli CFT073
guauuccauguuaagcauccac

SEQ ID NO: 7417 - RNA, 22 nt, Escherichia coli CFT073
gucagaaagagaugcugaaucu

SEQ ID NO: 7418 - RNA, 22 nt, Escherichia coli CFT073
gucagggauaguaaagcgcguu

SEQ ID NO: 7419 - RNA, 22 nt, Escherichia coli CFT073
gucaggugguuucccgugagca

SEQ ID NO: 7420 - RNA, 22 nt, Escherichia coli CFT073
guccgacaugaaaguguccgaa

SEQ ID NO: 7421 - RNA, 22 nt, Escherichia coli CFT073
guccgccauacgcugguugcuu

SEQ ID NO: 7422 - RNA, 22 nt, Escherichia coli CFT073
caggucuuucaguuucugcugg

SEQ ID NO: 7423 - RNA, 22 nt, Escherichia coli CFT073
cagguguuuccagauugcugga

SEQ ID NO: 7424 - RNA, 21 nt, Escherichia coli CFT073
caguaaaacgcaccauacugu

SEQ ID NO: 7425 - RNA, 23 nt, Escherichia coli CFT073
caguaagaaucagaauauugcug

SEQ ID NO: 7426 - RNA, 22 nt, Escherichia coli CFT073
caguuccgcagaagauugaucg

SEQ ID NO: 7427 - RNA, 22 nt, Escherichia coli CFT073
caguucgacaacaccguuaauu

SEQ ID NO: 7428 - RNA, 22 nt, Escherichia coli CFT073
caguuuagugaguuuuaucaug

SEQ ID NO: 7429 - RNA, 22 nt, Escherichia coli CFT073
caucacuuuugaccagcuggug

SEQ ID NO: 7430 - RNA, 22 nt, Escherichia coli CFT073
caucauguauggcuuuacguag

SEQ ID NO: 7431 - RNA, 22 nt, Escherichia coli CFT073
cauccugagaagcuugcaguga

SEQ ID NO: 7432 - RNA, 22 nt, Escherichia coli CFT073
cauccugagacacgugcagugg

SEQ ID NO: 7433 - RNA, 22 nt, Escherichia coli CFT073
caugaaaacaguguuauguugu

SEQ ID NO: 7434 - RNA, 22 nt, Escherichia coli CFT073
cauggucauauuggcgauaugg

SEQ ID NO: 7435 - RNA, 22 nt, Escherichia coli CFT073
caugguguucucuauguugcug

SEQ ID NO: 7436 - RNA, 22 nt, Escherichia coli CFT073
cauguguaguaucgcaaacaua

SEQ ID NO: 7437 - RNA, 22 nt, Escherichia coli CFT073
cauuaggacgcaauggcguaca

SEQ ID NO: 7438 - RNA, 22 nt, Escherichia coli CFT073
cauuauuacuguugcuucagca

SEQ ID NO: 7439 - RNA, 23 nt, Escherichia coli CFT073
cauucaugaaacugucagccuuc

SEQ ID NO: 7440 - RNA, 22 nt, Escherichia coli CFT073
cauugauaucgauaagcugcga

SEQ ID NO: 7441 - RNA, 22 nt, Escherichia coli CFT073
cauugcaccaauauggugcuua

SEQ ID NO: 7442 - RNA, 21 nt, Escherichia coli CFT073
ccaccaucagcgcgucguggc

SEQ ID NO: 7443 - RNA, 22 nt, Escherichia coli CFT073
ccacgcugacgcaucaguucac

SEQ ID NO: 7444 - RNA, 22 nt, Escherichia coli CFT073
ccagaagggguaaugccaguca

SEQ ID NO: 7445 - RNA, 20 nt, Escherichia coli CFT073
ccagaccacagagaaugccc

SEQ ID NO: 7446 - RNA, 22 nt, Escherichia coli CFT073
ccagccgugcggaucuggucuu

SEQ ID NO: 7447 - RNA, 21 nt, Escherichia coli CFT073
ccagcgaaccggcaauugcca

SEQ ID NO: 7448 - RNA, 22 nt, Escherichia coli CFT073
ccagcuauugcugacgcugcug

SEQ ID NO: 7449 - RNA, 22 nt, Escherichia coli CFT073
ccagcuccggcacauugccaac

SEQ ID NO: 7450 - RNA, 22 nt, Escherichia coli CFT073
ccagggcgucaaacagccggau

SEQ ID NO: 7451 - RNA, 22 nt, Escherichia coli CFT073
ccaguaaucaagacaguaccag

SEQ ID NO: 7452 - RNA, 18 nt, Escherichia coli CFT073
ccaguuccggcaccacag

SEQ ID NO: 7453 - RNA, 22 nt, Escherichia coli CFT073
ccaguuugauuugcuccgguuu

SEQ ID NO: 7454 - RNA, 22 nt, Escherichia coli CFT073
ccaguuugucucagguacggcu

SEQ ID NO: 7455 - RNA, 22 nt, Escherichia coli CFT073
ccauugcugguucagaguuggu

SEQ ID NO: 7456 - RNA, 22 nt, Escherichia coli CFT073
cccgcguaauuuauccggcagg

SEQ ID NO: 7457 - RNA, 22 nt, Escherichia coli CFT073
cccggaagucaucaagcaguuu

SEQ ID NO: 7458 - RNA, 22 nt, Escherichia coli CFT073
cccgggcgugaguuaaugcuga

SEQ ID NO: 7459 - RNA, 22 nt, Escherichia coli CFT073
ccgacuugcauaagauaaacga

SEQ ID NO: 7460 - RNA, 22 nt, Escherichia coli CFT073
ccgcaaauacgcagucagcaga

SEQ ID NO: 7461 - RNA, 22 nt, Escherichia coli CFT073
ccgccacaccgcuuugaucgcc

SEQ ID NO: 7462 - RNA, 22 nt, Escherichia coli CFT073
gcguugauacuauguauggggu

SEQ ID NO: 7463 - RNA, 22 nt, Escherichia coli CFT073
gcguuugcacuaccagacccca

SEQ ID NO: 7464 - RNA, 20 nt, Escherichia coli CFT073
gcucagcguuguauguguua

SEQ ID NO: 7465 - RNA, 22 nt, Escherichia coli CFT073
gcucgucgagaauauacagcgu

SEQ ID NO: 7466 - RNA, 22 nt, Escherichia coli CFT073
gcucuugaucgaagccccggua

SEQ ID NO: 7467 - RNA, 22 nt, Escherichia coli CFT073
gcugacuggcagauugcggcaa

SEQ ID NO: 7468 - RNA, 22 nt, Escherichia coli CFT073
gcugagcgccagauuuuugucc

SEQ ID NO: 7469 - RNA, 22 nt, Escherichia coli CFT073
gcugauggucugucguagagcc

SEQ ID NO: 7470 - RNA, 22 nt, Escherichia coli CFT073
gcugccagcgcuguuucacggc

SEQ ID NO: 7471 - RNA, 21 nt, Escherichia coli CFT073
gcugccguaugccguggcucc

SEQ ID NO: 7472 - RNA, 22 nt, Escherichia coli CFT073
gcugcgaugcuucagguuucau

SEQ ID NO: 7473 - RNA, 19 nt, Escherichia coli CFT073
gcugcgcccggcuuucgcc

SEQ ID NO: 7474 - RNA, 22 nt, Escherichia coli CFT073
gcugcgcugacgccacugcuga

SEQ ID NO: 7475 - RNA, 22 nt, Escherichia coli CFT073
gcugcuggcaacccacgcugau

SEQ ID NO: 7476 - RNA, 22 nt, Escherichia coli CFT073
gcugcugggaugcgcuguacag

SEQ ID NO: 7477 - RNA, 22 nt, Escherichia coli CFT073
gcuggcauuaaccaccuggccu

SEQ ID NO: 7478 - RNA, 22 nt, Escherichia coli CFT073
gcugggcuguugauaaugucau

SEQ ID NO: 7479 - RNA, 22 nt, Escherichia coli CFT073
gcugguauuuucaaucgguacg

SEQ ID NO: 7480 - RNA, 22 nt, Escherichia coli CFT073
gcugguggcgcugucuuuguca

SEQ ID NO: 7481 - RNA, 22 nt, Escherichia coli CFT073
gcuguggucgucuuuaaucugc

SEQ ID NO: 7482 - RNA, 22 nt, Escherichia coli CFT073
gcuuccucauauucuuccugug

SEQ ID NO: 7483 - RNA, 22 nt, Escherichia coli CFT073
gcuucgagauugcaucgccaaa

SEQ ID NO: 7484 - RNA, 22 nt, Escherichia coli CFT073
gcuucggcauugcaucccacag

SEQ ID NO: 7485 - RNA, 18 nt, Escherichia coli CFT073
gcuugcugugaucgucaa

SEQ ID NO: 7486 - RNA, 22 nt, Escherichia coli CFT073
gcuuuccagcaugacaguuugg

SEQ ID NO: 7487 - RNA, 22 nt, Escherichia coli CFT073
gcuuuucucgcguucaaguuug

SEQ ID NO: 7488 - RNA, 22 nt, Escherichia coli CFT073
ggaacagaucgccagcaaauuu

SEQ ID NO: 7489 - RNA, 22 nt, Escherichia coli CFT073
ggaaguugaugaucauaugcuc

SEQ ID NO: 7490 - RNA, 22 nt, Escherichia coli CFT073
ggaaucggcaauguucaugugc

SEQ ID NO: 7491 - RNA, 22 nt, Escherichia coli CFT073
ggacugaccaaugaauuucacc

SEQ ID NO: 7492 - RNA, 22 nt, Escherichia coli CFT073
ggaguacaucgugcgcggcagu

SEQ ID NO: 7493 - RNA, 22 nt, Escherichia coli CFT073
ggauaaggcguucacgccgcau

SEQ ID NO: 7494 - RNA, 22 nt, Escherichia coli CFT073
ggauaaggcguuuacgccgcau

SEQ ID NO: 7495 - RNA, 22 nt, Escherichia coli CFT073
ggaugaugaggguuauacggua

SEQ ID NO: 7496 - RNA, 18 nt, Escherichia coli CFT073
ggaugcuuaacguaaugc

SEQ ID NO: 7497 - RNA, 19 nt, Escherichia coli CFT073
ggauuagagaccugucaga

SEQ ID NO: 7498 - RNA, 19 nt, Escherichia coli CFT073
ggauuugaagcacuauuaa

SEQ ID NO: 7499 - RNA, 22 nt, Escherichia coli CFT073
ggauuuucgcugugguugcugg

SEQ ID NO: 7500 - RNA, 22 nt, Escherichia coli CFT073
ggcaagcgauuugugucauugc

SEQ ID NO: 7501 - RNA, 22 nt, Escherichia coli CFT073
ggcaaugcucaaugaggcacga

SEQ ID NO: 7502 - RNA, 22 nt, Escherichia coli CFT073
ggcagaaagacgggcgccgccg

SEQ ID NO: 7503 - RNA, 16 nt, Escherichia coli CFT073
ggcagcuggugccauu

SEQ ID NO: 7504 - RNA, 19 nt, Escherichia coli CFT073
ggcagcugucaggugugcg

SEQ ID NO: 7505 - RNA, 22 nt, Escherichia coli CFT073
ggcauaggaggccucggugcag

SEQ ID NO: 7506 - RNA, 22 nt, Escherichia coli CFT073
ggcauccucuuuuggcagauuu

SEQ ID NO: 7507 - RNA, 22 nt, Escherichia coli CFT073
ggcaugcaggagaacaauggcu

SEQ ID NO: 7508 - RNA, 22 nt, Escherichia coli CFT073
ggcauguucccaagccagaugu

SEQ ID NO: 7509 - RNA, 20 nt, Escherichia coli CFT073
ggccaucgccaguuguuccu

SEQ ID NO: 7510 - RNA, 23 nt, Escherichia coli CFT073
ggccauugacgcaucgcccgguu

SEQ ID NO: 7511 - RNA, 22 nt, Escherichia coli CFT073
ggccgggcguuaucugauugaa

SEQ ID NO: 7512 - RNA, 22 nt, Escherichia coli CFT073
ggcgacaauuguugguuauggg

SEQ ID NO: 7513 - RNA, 22 nt, Escherichia coli CFT073
ggcgauaaucgacgugauggca

SEQ ID NO: 7514 - RNA, 22 nt, Escherichia coli CFT073
ggcgcagugccaggguuuugau

SEQ ID NO: 7515 - RNA, 22 nt, Escherichia coli CFT073
ggcgcgcagggcaucaucgacc

SEQ ID NO: 7516 - RNA, 22 nt, Escherichia coli CFT073
ggcgcguuuccacaacguuaca

SEQ ID NO: 7517 - RNA, 22 nt, Escherichia coli CFT073
ggcggcgcccgucuuucugcca

SEQ ID NO: 7518 - RNA, 22 nt, Escherichia coli CFT073
ggcggcuuucaacgagaaucgg

SEQ ID NO: 7519 - RNA, 22 nt, Escherichia coli CFT073
ggcguacagggcgcugcgggug

SEQ ID NO: 7520 - RNA, 22 nt, Escherichia coli CFT073
ggcgugaagaaaucagccaccg

SEQ ID NO: 7521 - RNA, 22 nt, Escherichia coli CFT073
ggcgugagacguuacggcaacu

SEQ ID NO: 7522 - RNA, 22 nt, Escherichia coli CFT073
ggcguuaugccgcugguuauca

SEQ ID NO: 7523 - RNA, 22 nt, Escherichia coli CFT073
ggcguuggguaauaucgccgcu

SEQ ID NO: 7524 - RNA, 22 nt, Escherichia coli CFT073
ggcuaucccuuaauugugcaug

SEQ ID NO: 7525 - RNA, 22 nt, Escherichia coli CFT073
ggcugcugaagguguucugcgc

SEQ ID NO: 7526 - RNA, 22 nt, Escherichia coli CFT073
ggcuggcaguucaccauugccc

SEQ ID NO: 7527 - RNA, 22 nt, Escherichia coli CFT073
ggcuuccugcauucguucagcc

SEQ ID NO: 7528 - RNA, 22 nt, Escherichia coli CFT073
gggaaaaggccaaagcguuuga

SEQ ID NO: 7529 - RNA, 22 nt, Escherichia coli CFT073
gggaaucaauaucggauugauu

SEQ ID NO: 7530 - RNA, 22 nt, Escherichia coli CFT073
gggagucauugcaucgucaacu

SEQ ID NO: 7531 - RNA, 22 nt, Escherichia coli CFT073
gggcagaaacuggcgauuaaug

SEQ ID NO: 7532 - RNA, 21 nt, Escherichia coli CFT073
gggcggcgcaaaucugguggc

SEQ ID NO: 7533 - RNA, 22 nt, Escherichia coli CFT073
gggcugaucuuacguggaccac

SEQ ID NO: 7534 - RNA, 22 nt, Escherichia coli CFT073
ggggaaauugucggucugcugg

SEQ ID NO: 7535 - RNA, 22 nt, Escherichia coli CFT073
ggggcguaucacaucauuccgu

SEQ ID NO: 7536 - RNA, 22 nt, Escherichia coli CFT073
ggggcguguccugcuggagccu

SEQ ID NO: 7537 - RNA, 23 nt, Escherichia coli CFT073
gggugagugcaucgggcaucagc

SEQ ID NO: 7538 - RNA, 22 nt, Escherichia coli CFT073
gggugauuaugcgcaaggauca

SEQ ID NO: 7539 - RNA, 22 nt, Escherichia coli CFT073
ggguuuauugccccgauccugc

SEQ ID NO: 7540 - RNA, 22 nt, Escherichia coli CFT073
gguagauuguuuugccggugac

SEQ ID NO: 7541 - RNA, 22 nt, Escherichia coli CFT073
gguaugagagccagaugcugag

SEQ ID NO: 7542 - RNA, 22 nt, Escherichia coli CFT073
gguauucgcuuugcuuuuacga

SEQ ID NO: 7543 - RNA, 22 nt, Escherichia coli CFT073
gguauugcucacuggcagaccg

SEQ ID NO: 7544 - RNA, 22 nt, Escherichia coli CFT073
ggucaaggaaggcguuaucggc

SEQ ID NO: 7545 - RNA, 22 nt, Escherichia coli CFT073
ggucagaugguagguauuugcg

SEQ ID NO: 7546 - RNA, 22 nt, Escherichia coli CFT073
ggucaucggcaugugcagcaga

SEQ ID NO: 7547 - RNA, 21 nt, Escherichia coli CFT073
ggucauggucgcacaagacau

SEQ ID NO: 7548 - RNA, 22 nt, Escherichia coli CFT073
ggucgcgccgggauccugguga

SEQ ID NO: 7549 - RNA, 19 nt, Escherichia coli CFT073
ggucgugacaaguuagcgc

SEQ ID NO: 7550 - RNA, 23 nt, Escherichia coli CFT073
ggucuuccagcucaaucacuucc

SEQ ID NO: 7551 - RNA, 22 nt, Escherichia coli CFT073
ggugaaaaaacuugaugcacgu

SEQ ID NO: 7552 - RNA, 22 nt, Escherichia coli CFT073
ggugaaggguauuacacacacg

SEQ ID NO: 7553 - RNA, 22 nt, Escherichia coli CFT073
ggugauguugauaaggcguuaa

SEQ ID NO: 7554 - RNA, 22 nt, Escherichia coli CFT073
ggugauugaugacgauggcuac

SEQ ID NO: 7555 - RNA, 22 nt, Escherichia coli CFT073
ggugauuggcagugggauuuug

SEQ ID NO: 7556 - RNA, 22 nt, Escherichia coli CFT073
gguggauuuaccggagccugau

SEQ ID NO: 7557 - RNA, 22 nt, Escherichia coli CFT073
gguggcguauauuaagguuuuu

SEQ ID NO: 7558 - RNA, 22 nt, Escherichia coli CFT073
gguggugguguauuuggcguuc

SEQ ID NO: 7559 - RNA, 22 nt, Escherichia coli CFT073
gguguagcccagccgagaucac

SEQ ID NO: 7560 - RNA, 23 nt, Escherichia coli CFT073
gguuacucuguucauugcugacc

SEQ ID NO: 7561 - RNA, 22 nt, Escherichia coli CFT073
gguuaugucuacgaugugauug

SEQ ID NO: 7562 - RNA, 22 nt, Escherichia coli CFT073
gguugccgguccaguuauggaa

SEQ ID NO: 7563 - RNA, 22 nt, Escherichia coli CFT073
guaaaguccagccuuccguaug

SEQ ID NO: 7564 - RNA, 22 nt, Escherichia coli CFT073
guaagcggauugagauguggac

SEQ ID NO: 7565 - RNA, 22 nt, Escherichia coli CFT073
guacaggccggaacagacggaa

SEQ ID NO: 7566 - RNA, 22 nt, Escherichia coli CFT073
guaccggaaaaauuaugcguga

SEQ ID NO: 7567 - RNA, 22 nt, Escherichia coli CFT073
guacgaugaacggcgguaaaga

SEQ ID NO: 7568 - RNA, 22 nt, Escherichia coli CFT073
guacugaguagggugaucgcgu

SEQ ID NO: 7569 - RNA, 22 nt, Escherichia coli CFT073
guagacagccagugugcgggug

SEQ ID NO: 7570 - RNA, 22 nt, Escherichia coli CFT073
guagccagguuuaaucgugcug

SEQ ID NO: 7571 - RNA, 22 nt, Escherichia coli CFT073
guauaucaauaaaguccggcuc

SEQ ID NO: 7572 - RNA, 22 nt, Escherichia coli CFT073
guauuacucagcaucgauuuca

SEQ ID NO: 7573 - RNA, 22 nt, Escherichia coli CFT073
guauuauuucugcggcagguuu

SEQ ID NO: 7574 - RNA, 22 nt, Escherichia coli CFT073
gucauagcauucgccguugaug

SEQ ID NO: 7575 - RNA, 22 nt, Escherichia coli CFT073
gucaucguuacgcgugucagca

SEQ ID NO: 7576 - RNA, 22 nt, Escherichia coli CFT073
guccacaucaagaucguguccg

SEQ ID NO: 7577 - RNA, 22 nt, Escherichia coli CFT073
guccggguaaaccagcggcgga

SEQ ID NO: 7578 - RNA, 22 nt, Escherichia coli CFT073
gucgaaauggaagcguuaaccg

SEQ ID NO: 7579 - RNA, 22 nt, Escherichia coli CFT073
gucgagaaaacgggauagcaca

SEQ ID NO: 7580 - RNA, 22 nt, Escherichia coli CFT073
gucgccauuauccguccagccu

SEQ ID NO: 7581 - RNA, 22 nt, Escherichia coli CFT073
gucgcggauaugcugcaucgca

SEQ ID NO: 7582 - RNA, 22 nt, Escherichia coli CFT073
gucgcugggauuugucgucacc

SEQ ID NO: 7583 - RNA, 22 nt, Escherichia coli CFT073
gucgguauugaugagugggcgu

SEQ ID NO: 7584 - RNA, 22 nt, Escherichia coli CFT073
gucgucucuauuuaugaugccg

SEQ ID NO: 7585 - RNA, 21 nt, Escherichia coli CFT073
gucucccuguucuggcugcuu

SEQ ID NO: 7586 - RNA, 22 nt, Escherichia coli CFT073
gucugaccaugguugaugagag

SEQ ID NO: 7587 - RNA, 22 nt, Escherichia coli CFT073
gucuggauaugccggaaguuuc

SEQ ID NO: 7588 - RNA, 22 nt, Escherichia coli CFT073
gucuggcguuaaucguauuggg

SEQ ID NO: 7589 - RNA, 22 nt, Escherichia coli CFT073
gucugguuuauucugcauuuuu

SEQ ID NO: 7590 - RNA, 22 nt, Escherichia coli CFT073
gugacgucuuccucgcuuucgc

SEQ ID NO: 7591 - RNA, 22 nt, Escherichia coli CFT073
gugagcaaacgcaaaaagccgu

SEQ ID NO: 7592 - RNA, 22 nt, Escherichia coli CFT073
gugaguucucugucggcaguga

SEQ ID NO: 7593 - RNA, 22 nt, Escherichia coli CFT073
gugauagcggguuuacucauua

SEQ ID NO: 7594 - RNA, 22 nt, Escherichia coli CFT073
gugaugcggauggguaaugucc

SEQ ID NO: 7595 - RNA, 22 nt, Escherichia coli CFT073
gugauuauggaugaaccgacuu

SEQ ID NO: 7596 - RNA, 22 nt, Escherichia coli CFT073
gugcaguugacguaauucauga

SEQ ID NO: 7597 - RNA, 22 nt, Escherichia coli CFT073
gugcugcugaauccguuuuauc

SEQ ID NO: 7598 - RNA, 22 nt, Escherichia coli CFT073
gugcuuauguauugcgaaugaa

SEQ ID NO: 7599 - RNA, 22 nt, Escherichia coli CFT073
guggcgauuauugucguacucg

SEQ ID NO: 7600 - RNA, 22 nt, Escherichia coli CFT073
guggcggaaaauugcugccaca

SEQ ID NO: 7601 - RNA, 22 nt, Escherichia coli CFT073
guggcggcgcuggcgacauuaa

SEQ ID NO: 7602 - RNA, 22 nt, Escherichia coli CFT073
guggcucgccgugcaucacuuu

SEQ ID NO: 7603 - RNA, 22 nt, Escherichia coli CFT073
guggcuguguaagaauccggaa

SEQ ID NO: 7604 - RNA, 19 nt, Escherichia coli CFT073
gugggcgaaacgaugcauc

SEQ ID NO: 7605 - RNA, 22 nt, Escherichia coli CFT073
guguaauggcugaaugcagcac

SEQ ID NO: 7606 - RNA, 22 nt, Escherichia coli CFT073
gugucgaugaacaacguugugg

SEQ ID NO: 7607 - RNA, 22 nt, Escherichia coli CFT073
gugucgguguauucgucagcga

SEQ ID NO: 7608 - RNA, 22 nt, Escherichia coli CFT073
gugugcaaagacugauagccgu

SEQ ID NO: 7609 - RNA, 22 nt, Escherichia coli CFT073
guguuucuggugcgcguuggcu

SEQ ID NO: 7610 - RNA, 22 nt, Escherichia coli CFT073
guguuuuaucuggccuacaaug

SEQ ID NO: 7611 - RNA, 22 nt, Escherichia coli CFT073
guuaaugucgcgaucauggucu

SEQ ID NO: 7612 - RNA, 22 nt, Escherichia coli CFT073
guuagauaauugcaauggcagu

SEQ ID NO: 7613 - RNA, 22 nt, Escherichia coli CFT073
guuaucgacguauuccagacgg

SEQ ID NO: 7614 - RNA, 20 nt, Escherichia coli CFT073
guuaugccagcccgucgcaa

SEQ ID NO: 7615 - RNA, 22 nt, Escherichia coli CFT073
guucggugagcgccugagcguc

SEQ ID NO: 7616 - RNA, 22 nt, Escherichia coli CFT073
guucuguucauggucagcgugc

SEQ ID NO: 7617 - RNA, 22 nt, Escherichia coli CFT073
guugauggcgcaaaaccgaacg

SEQ ID NO: 7618 - RNA, 22 nt, Escherichia coli CFT073
guugccguuccccagcuggaua

SEQ ID NO: 7619 - RNA, 22 nt, Escherichia coli CFT073
guuggauuaggaagggaaacau

SEQ ID NO: 7620 - RNA, 22 nt, Escherichia coli CFT073
guuggccgcaucagauuuauca

SEQ ID NO: 7621 - RNA, 22 nt, Escherichia coli CFT073
guuggcuuuugcuucaaucacg

SEQ ID NO: 7622 - RNA, 22 nt, Escherichia coli CFT073
guuggugcuggggcuacaugcc

SEQ ID NO: 7623 - RNA, 22 nt, Escherichia coli CFT073
guugugcucguuacccgcguaa

SEQ ID NO: 7624 - RNA, 22 nt, Escherichia coli CFT073
guuguuguugucgggaugcguu

SEQ ID NO: 7625 - RNA, 22 nt, Escherichia coli CFT073
guuuaucacgcggugguugauu

SEQ ID NO: 7626 - RNA, 22 nt, Escherichia coli CFT073
guuucucugauugcaggcguau

SEQ ID NO: 7627 - RNA, 20 nt, Escherichia coli CFT073
guuugcuucuuugauagcaa

SEQ ID NO: 7628 - RNA, 22 nt, Escherichia coli CFT073
guuugucggacguaggucggau

SEQ ID NO: 7629 - RNA, 22 nt, Escherichia coli CFT073
guuuguugauuggcgcagaggu

SEQ ID NO: 7630 - RNA, 22 nt, Escherichia coli CFT073
guuuugccgagaagcacggcgu

SEQ ID NO: 7631 - RNA, 22 nt, Escherichia coli CFT073
uaaacaaguaacauggccgccu

SEQ ID NO: 7632 - RNA, 22 nt, Escherichia coli CFT073
uaaacacugcacuguguauuca

SEQ ID NO: 7633 - RNA, 22 nt, Escherichia coli CFT073
uaaaccgaugguggugaugacc

SEQ ID NO: 7634 - RNA, 22 nt, Escherichia coli CFT073
uaaagcaccgcggccuuuuuug

SEQ ID NO: 7635 - RNA, 22 nt, Escherichia coli CFT073
uaaagccgcagaagaguugggu

SEQ ID NO: 7636 - RNA, 22 nt, Escherichia coli CFT073
uaaagcggccgugaaaguguug

SEQ ID NO: 7637 - RNA, 22 nt, Escherichia coli CFT073
uaaagugaucuucuaagcccgc

SEQ ID NO: 7638 - RNA, 19 nt, Escherichia coli CFT073
aaaaacucacucgcagguc

SEQ ID NO: 7639 - RNA, 20 nt, Escherichia coli CFT073
aaaacgugauuuuuacuggc

SEQ ID NO: 7640 - RNA, 22 nt, Escherichia coli CFT073
aaaacugucugaaguggauuuu

SEQ ID NO: 7641 - RNA, 22 nt, Escherichia coli CFT073
aaaagcgaucgcgcguuaauau

SEQ ID NO: 7642 - RNA, 16 nt, Escherichia coli CFT073
aaaaggagaaaacguc

SEQ ID NO: 7643 - RNA, 22 nt, Escherichia coli CFT073
aaaaugcauuauacgguucugg

SEQ ID NO: 7644 - RNA, 22 nt, Escherichia coli CFT073
aaacacuguugcggugagcgga

SEQ ID NO: 7645 - RNA, 22 nt, Escherichia coli CFT073
aaaccgcugccgcuucgucgca

SEQ ID NO: 7646 - RNA, 22 nt, Escherichia coli CFT073
aaacugcucaauccguugcagg

SEQ ID NO: 7647 - RNA, 22 nt, Escherichia coli CFT073
aaacuucugccauuuugugugg

SEQ ID NO: 7648 - RNA, 22 nt, Escherichia coli CFT073
aaagaaauggcgcaaauuaguu

SEQ ID NO: 7649 - RNA, 23 nt, Escherichia coli CFT073
aaagccggugcgcauccgcuuga

SEQ ID NO: 7650 - RNA, 20 nt, Escherichia coli CFT073
aaagcuaaccaguuauuuuu

SEQ ID NO: 7651 - RNA, 22 nt, Escherichia coli CFT073
aaaggccaucauugcggucaua

SEQ ID NO: 7652 - RNA, 18 nt, Escherichia coli CFT073
aaauaugcuggccauugu

SEQ ID NO: 7653 - RNA, 22 nt, Escherichia coli CFT073
aaaucagcgguaucguuuccuu

SEQ ID NO: 7654 - RNA, 22 nt, Escherichia coli CFT073
aaaucgucugcgcuaucuggua

SEQ ID NO: 7655 - RNA, 22 nt, Escherichia coli CFT073
aaaucugccaaaagaggaugcc

SEQ ID NO: 7656 - RNA, 22 nt, Escherichia coli CFT073
aaauugguuuucguacccgcua

SEQ ID NO: 7657 - RNA, 22 nt, Escherichia coli CFT073
aacagaucauucaacgccugcg

SEQ ID NO: 7658 - RNA, 22 nt, Escherichia coli CFT073
aacagguuacggucgccguaaa

SEQ ID NO: 7659 - RNA, 22 nt, Escherichia coli CFT073
guugccgguacucaaacggggu

SEQ ID NO: 7660 - RNA, 22 nt, Escherichia coli CFT073
guugugaugggguucaccggga

SEQ ID NO: 7661 - RNA, 23 nt, Escherichia coli CFT073
guuuacccaaugaagaugcgccg

SEQ ID NO: 7662 - RNA, 22 nt, Escherichia coli CFT073
guuuaccguuuuauagaugaca

SEQ ID NO: 7663 - RNA, 22 nt, Escherichia coli CFT073
guuucacuccaaccuguucaag

SEQ ID NO: 7664 - RNA, 20 nt, Escherichia coli CFT073
guuucugcaauucauugagc

SEQ ID NO: 7665 - RNA, 22 nt, Escherichia coli CFT073
guuugaucagaauacgaucguu

SEQ ID NO: 7666 - RNA, 21 nt, Escherichia coli CFT073
guuuggcaucgcuuaucaguc

SEQ ID NO: 7667 - RNA, 22 nt, Escherichia coli CFT073
guuuugcccaugcagccgcugc

SEQ ID NO: 7668 - RNA, 22 nt, Escherichia coli CFT073
guuuugugaaaucgucaaccgc

SEQ ID NO: 7669 - RNA, 22 nt, Escherichia coli CFT073
guuuugugugauucugccaggc

SEQ ID NO: 7670 - RNA, 22 nt, Escherichia coli CFT073
guuuuuucgcgaauguucugug

SEQ ID NO: 7671 - RNA, 22 nt, Escherichia coli CFT073
uaaacgauguuguucugcugca

SEQ ID NO: 7672 - RNA, 22 nt, Escherichia coli CFT073
uaaccgggcuuugcacgccggg

SEQ ID NO: 7673 - RNA, 22 nt, Escherichia coli CFT073
uaacgauaaccggcaaacccag

SEQ ID NO: 7674 - RNA, 22 nt, Escherichia coli CFT073
uaacggcagugaagauucgugg

SEQ ID NO: 7675 - RNA, 22 nt, Escherichia coli CFT073
uaacggcgaucgcgccagcgga

SEQ ID NO: 7676 - RNA, 22 nt, Escherichia coli CFT073
uaagagguagugaaauggacau

SEQ ID NO: 7677 - RNA, 22 nt, Escherichia coli CFT073
uaagcguuuucucgcgggggau

SEQ ID NO: 7678 - RNA, 22 nt, Escherichia coli CFT073
uaagcuuuguuacuucugcggu

SEQ ID NO: 7679 - RNA, 22 nt, Escherichia coli CFT073
uaaggcgaggcguuuucaucca

SEQ ID NO: 7680 - RNA, 22 nt, Escherichia coli CFT073
uaaggcggucguugcugcgguu

SEQ ID NO: 7681 - RNA, 22 nt, Escherichia coli CFT073
uaaggcguucacgccgcaucug

SEQ ID NO: 7682 - RNA, 22 nt, Escherichia coli CFT073
uaaggcguuuacgccgcauccg

SEQ ID NO: 7683 - RNA, 22 nt, Escherichia coli CFT073
uaagggaaagacucgucagcca

SEQ ID NO: 7684 - RNA, 22 nt, Escherichia coli CFT073
uaaguaaagggaguuugauaug

SEQ ID NO: 7685 - RNA, 18 nt, Escherichia coli CFT073
uaagugaagggaguguga

SEQ ID NO: 7686 - RNA, 22 nt, Escherichia coli CFT073
uaauaaagcaaauauuacacag

SEQ ID NO: 7687 - RNA, 22 nt, Escherichia coli CFT073
uaaucgggucaccaaauaugaa

SEQ ID NO: 7688 - RNA, 22 nt, Escherichia coli CFT073
uaauguuauuuaaauaccauug

SEQ ID NO: 7689 - RNA, 22 nt, Escherichia coli CFT073
uacaauaucgcuguguguaggc

SEQ ID NO: 7690 - RNA, 22 nt, Escherichia coli CFT073
uacacaccugugaugccguauu

SEQ ID NO: 7691 - RNA, 22 nt, Escherichia coli CFT073
uacagaaaaaguuuggcaucuu

SEQ ID NO: 7692 - RNA, 22 nt, Escherichia coli CFT073
uacagaauauccaucagcggcu

SEQ ID NO: 7693 - RNA, 22 nt, Escherichia coli CFT073
uacccguugcagcggucaguga

SEQ ID NO: 7694 - RNA, 22 nt, Escherichia coli CFT073
uaccgauccgauucugcuaacg

SEQ ID NO: 7695 - RNA, 22 nt, Escherichia coli CFT073
uacgcagugguaucccgcgcgu

SEQ ID NO: 7696 - RNA, 22 nt, Escherichia coli CFT073
uacgccaacucaugcgucaggc

SEQ ID NO: 7697 - RNA, 22 nt, Escherichia coli CFT073
uacgccuuucuggcgcaccaug

SEQ ID NO: 7698 - RNA, 22 nt, Escherichia coli CFT073
uacgcgauugcaucuucaucau

SEQ ID NO: 7699 - RNA, 22 nt, Escherichia coli CFT073
uacgcuggcaucacaggcgucg

SEQ ID NO: 7700 - RNA, 20 nt, Escherichia coli CFT073
uacggugcuccucaugcagu

SEQ ID NO: 7701 - RNA, 22 nt, Escherichia coli CFT073
uacuggagguggaagggaugaa

SEQ ID NO: 7702 - RNA, 22 nt, Escherichia coli CFT073
uacugguugcccgguggagcug

SEQ ID NO: 7703 - RNA, 22 nt, Escherichia coli CFT073
uacuguguauucguaagcauca

SEQ ID NO: 7704 - RNA, 22 nt, Escherichia coli CFT073
uacuucuucaccccguucggaa

SEQ ID NO: 7705 - RNA, 22 nt, Escherichia coli CFT073
uagaacuggugcgucagcagcu

SEQ ID NO: 7706 - RNA, 22 nt, Escherichia coli CFT073
uagaagacucggucacucaggu

SEQ ID NO: 7707 - RNA, 22 nt, Escherichia coli CFT073
uagccauaauaugccucuuuua

SEQ ID NO: 7708 - RNA, 22 nt, Escherichia coli CFT073
uagcgacccauuuugccgguuc

SEQ ID NO: 7709 - RNA, 22 nt, Escherichia coli CFT073
aaugccgcaguggcugcucggu

SEQ ID NO: 7710 - RNA, 22 nt, Escherichia coli CFT073
aaugcgucagcauuaugcucaa

SEQ ID NO: 7711 - RNA, 22 nt, Escherichia coli CFT073
aaugcguugguagugcguaaca

SEQ ID NO: 7712 - RNA, 22 nt, Escherichia coli CFT073
aauggcuggcagguaauuuugc

SEQ ID NO: 7713 - RNA, 22 nt, Escherichia coli CFT073
aauggggucuggcugguuuuuc

SEQ ID NO: 7714 - RNA, 22 nt, Escherichia coli CFT073
aauggugcugccugccggagca

SEQ ID NO: 7715 - RNA, 22 nt, Escherichia coli CFT073
aaugguuuacccaugcagguag

SEQ ID NO: 7716 - RNA, 22 nt, Escherichia coli CFT073
aauguugucggucgccauauaa

SEQ ID NO: 7717 - RNA, 22 nt, Escherichia coli CFT073
aauuacucauuguuuaaaaaga

SEQ ID NO: 7718 - RNA, 22 nt, Escherichia coli CFT073
aauuucaaucgcgucgcccagc

SEQ ID NO: 7719 - RNA, 22 nt, Escherichia coli CFT073
aauuuuauccaguaacgccugg

SEQ ID NO: 7720 - RNA, 22 nt, Escherichia coli CFT073
acaaguauaugaauuaucggag

SEQ ID NO: 7721 - RNA, 22 nt, Escherichia coli CFT073
acaaugguuagcauacuuuucc

SEQ ID NO: 7722 - RNA, 22 nt, Escherichia coli CFT073
acaccagcaaacaggaggguua

SEQ ID NO: 7723 - RNA, 22 nt, Escherichia coli CFT073
acacgcagcauacugacccgcg

SEQ ID NO: 7724 - RNA, 22 nt, Escherichia coli CFT073
acacgguagcgcgaccugcaac

SEQ ID NO: 7725 - RNA, 20 nt, Escherichia coli CFT073
acagcgcugucuuuguggcc

SEQ ID NO: 7726 - RNA, 22 nt, Escherichia coli CFT073
acagcggaggugaugaugaaag

SEQ ID NO: 7727 - RNA, 22 nt, Escherichia coli CFT073
acaggcuaaaccaucggaugag

SEQ ID NO: 7728 - RNA, 22 nt, Escherichia coli CFT073
acaugguacgguauuguugugu

SEQ ID NO: 7729 - RNA, 22 nt, Escherichia coli CFT073
accaaccguuguaugcuggcua

SEQ ID NO: 7730 - RNA, 22 nt, Escherichia coli CFT073
accaaugaaaaugaucaggugg

SEQ ID NO: 7731 - RNA, 22 nt, Escherichia coli CFT073
accacugaagccuuuaaccagc

SEQ ID NO: 7732 - RNA, 22 nt, Escherichia coli CFT073
accagcagcagcguauucaguu

SEQ ID NO: 7733 - RNA, 23 nt, Escherichia coli CFT073
accagcggcaaccagccagacua

SEQ ID NO: 7734 - RNA, 22 nt, Escherichia coli CFT073
accaguauugucgauaaauuau

SEQ ID NO: 7735 - RNA, 22 nt, Escherichia coli CFT073
accaucugcggcauacuuucgc

SEQ ID NO: 7736 - RNA, 22 nt, Escherichia coli CFT073
accauuuuuaucgauggcuaau

SEQ ID NO: 7737 - RNA, 22 nt, Escherichia coli CFT073
acccaucaauuucaacucaucu

SEQ ID NO: 7738 - RNA, 22 nt, Escherichia coli CFT073
accgccuguaugugcagaacgg

SEQ ID NO: 7739 - RNA, 22 nt, Escherichia coli CFT073
accgcgagaugccaggcuuugg

SEQ ID NO: 7740 - RNA, 19 nt, Escherichia coli CFT073
accgcguggguuggcuggc

SEQ ID NO: 7741 - RNA, 22 nt, Escherichia coli CFT073
accgggugaugcaaaaguagcc

SEQ ID NO: 7742 - RNA, 22 nt, Escherichia coli CFT073
accgguguaugucuggcgagcg

SEQ ID NO: 7743 - RNA, 22 nt, Escherichia coli CFT073
accguuucuugauggcgaguau

SEQ ID NO: 7744 - RNA, 22 nt, Escherichia coli CFT073
accucgacagcaugagcccgga

SEQ ID NO: 7745 - RNA, 22 nt, Escherichia coli CFT073
accugcgacugagcauccagcg

SEQ ID NO: 7746 - RNA, 22 nt, Escherichia coli CFT073
accugucuggcaauauuacugg

SEQ ID NO: 7747 - RNA, 17 nt, Escherichia coli CFT073
accuuacccaacgcuuc

SEQ ID NO: 7748 - RNA, 22 nt, Escherichia coli CFT073
ucaaggagagcuauaucgcagc

SEQ ID NO: 7749 - RNA, 22 nt, Escherichia coli CFT073
ucaccacguuucaggacaaacg

SEQ ID NO: 7750 - RNA, 22 nt, Escherichia coli CFT073
ucaccagcaacagacggcgaau

SEQ ID NO: 7751 - RNA, 22 nt, Escherichia coli CFT073
ucaccauuugagcagugaggag

SEQ ID NO: 7752 - RNA, 23 nt, Escherichia coli CFT073
ucaccgagauaacuggcgcggcc

SEQ ID NO: 7753 - RNA, 22 nt, Escherichia coli CFT073
ucaccgguauuuggggcuguuu

SEQ ID NO: 7754 - RNA, 22 nt, Escherichia coli CFT073
ucaccguauuauugccggaugg

SEQ ID NO: 7755 - RNA, 22 nt, Escherichia coli CFT073
ucaccugaucgucgccguacug

SEQ ID NO: 7756 - RNA, 22 nt, Escherichia coli CFT073
ucaccuuguagcguuuggcgau

SEQ ID NO: 7757 - RNA, 22 nt, Escherichia coli CFT073
ucacgauaaacagcccugcguu

SEQ ID NO: 7758 - RNA, 22 nt, Escherichia coli CFT073
ucacggaguuugcgagucaacu

SEQ ID NO: 7759 - RNA, 18 nt, Escherichia coli CFT073
ucacucuuaaucucggua

SEQ ID NO: 7760 - RNA, 22 nt, Escherichia coli CFT073
ucacugaauuuaugggggacgc

SEQ ID NO: 7761 - RNA, 22 nt, Escherichia coli CFT073
ucacugaugagccagguucugg

SEQ ID NO: 7762 - RNA, 22 nt, Escherichia coli CFT073
ucacugguuacaggaugguaau

SEQ ID NO: 7763 - RNA, 22 nt, Escherichia coli CFT073
ucagaagaguaagaucaauauu

SEQ ID NO: 7764 - RNA, 22 nt, Escherichia coli CFT073
ucagauguuuucgacaguguua

SEQ ID NO: 7765 - RNA, 22 nt, Escherichia coli CFT073
ucagauuuggcgggcuuaucuu

SEQ ID NO: 7766 - RNA, 22 nt, Escherichia coli CFT073
ucagcagguugaaacggugggu

SEQ ID NO: 7767 - RNA, 22 nt, Escherichia coli CFT073
ucagcgguaucauacagcgccg

SEQ ID NO: 7768 - RNA, 22 nt, Escherichia coli CFT073
ucagcucugauauacucgcagg

SEQ ID NO: 7769 - RNA, 23 nt, Escherichia coli CFT073
ucagcuggaauaccugcucugca

SEQ ID NO: 7770 - RNA, 22 nt, Escherichia coli CFT073
ucaggcaaaugccaguaaaaac

SEQ ID NO: 7771 - RNA, 22 nt, Escherichia coli CFT073
ucaggcaucgaucucuuauuuu

SEQ ID NO: 7772 - RNA, 22 nt, Escherichia coli CFT073
ucagguauuuuuacgccucuga

SEQ ID NO: 7773 - RNA, 22 nt, Escherichia coli CFT073
ucaguaaucagcgucaauguug

SEQ ID NO: 7774 - RNA, 21 nt, Escherichia coli CFT073
ucagucggcagugcuacgcgc

SEQ ID NO: 7775 - RNA, 22 nt, Escherichia coli CFT073
ucagugacugacuuaaccggga

SEQ ID NO: 7776 - RNA, 22 nt, Escherichia coli CFT073
ucagugguggcgucgguuguuu

SEQ ID NO: 7777 - RNA, 22 nt, Escherichia coli CFT073
ucaguuugcccugauauucguc

SEQ ID NO: 7778 - RNA, 22 nt, Escherichia coli CFT073
ucaguuuuucuccugaucauga

SEQ ID NO: 7779 - RNA, 22 nt, Escherichia coli CFT073
ucaucaaauucaagauggggaa

SEQ ID NO: 7780 - RNA, 22 nt, Escherichia coli CFT073
ucaucaggcguuucauacugca

SEQ ID NO: 7781 - RNA, 22 nt, Escherichia coli CFT073
ucaucauucuggcagcaugggc

SEQ ID NO: 7782 - RNA, 21 nt, Escherichia coli CFT073
ucaucgauguagacaaucccg

SEQ ID NO: 7783 - RNA, 22 nt, Escherichia coli CFT073
ucaucgguuucaaugacuuucg

SEQ ID NO: 7784 - RNA, 22 nt, Escherichia coli CFT073
ucaucguuauucauuaacggca

SEQ ID NO: 7785 - RNA, 18 nt, Escherichia coli CFT073
ucaugcaguggaagcgug

SEQ ID NO: 7786 - RNA, 22 nt, Escherichia coli CFT073
ucauuacgauccguuuaucguc

SEQ ID NO: 7787 - RNA, 19 nt, Escherichia coli CFT073
ucauuacguucacugcaca

SEQ ID NO: 7788 - RNA, 22 nt, Escherichia coli CFT073
ucauuaucucaaucaggccggg

SEQ ID NO: 7789 - RNA, 22 nt, Escherichia coli CFT073
ucauugacagaaagcagcggag

SEQ ID NO: 7790 - RNA, 22 nt, Escherichia coli CFT073
ucauugcauaucaugaagguau

SEQ ID NO: 7791 - RNA, 22 nt, Escherichia coli CFT073
ucauugcugagacaggcucugu

SEQ ID NO: 7792 - RNA, 23 nt, Escherichia coli CFT073
ucauuuucauugguuaacucggc

SEQ ID NO: 7793 - RNA, 22 nt, Escherichia coli CFT073
uccagaacaagaagguaagaau

SEQ ID NO: 7794 - RNA, 22 nt, Escherichia coli CFT073
uccagcguuuugguguguucgc

SEQ ID NO: 7795 - RNA, 22 nt, Escherichia coli CFT073
uccccauuucugcaguguaagg

SEQ ID NO: 7796 - RNA, 22 nt, Escherichia coli CFT073
agacggauuuaaccgauugucc

SEQ ID NO: 7797 - RNA, 20 nt, Escherichia coli CFT073
agauaucaacgccgcugaaa

SEQ ID NO: 7798 - RNA, 22 nt, Escherichia coli CFT073
agaucgcacaauccgggcugag

SEQ ID NO: 7799 - RNA, 20 nt, Escherichia coli CFT073
agaucggcacgauaucgagg

SEQ ID NO: 7800 - RNA, 22 nt, Escherichia coli CFT073
agaucggcccagcuggugacag

SEQ ID NO: 7801 - RNA, 22 nt, Escherichia coli CFT073
agauggaugguuuugaagguaa

SEQ ID NO: 7802 - RNA, 23 nt, Escherichia coli CFT073
agauugguguagugaaacaggau

SEQ ID NO: 7803 - RNA, 22 nt, Escherichia coli CFT073
agauuggugucaaucauguguu

SEQ ID NO: 7804 - RNA, 20 nt, Escherichia coli CFT073
agauugucguacauagcguu

SEQ ID NO: 7805 - RNA, 23 nt, Escherichia coli CFT073
agauuucuucaaaaccacgacca

SEQ ID NO: 7806 - RNA, 22 nt, Escherichia coli CFT073
agcaccggacuggagcuggggg

SEQ ID NO: 7807 - RNA, 22 nt, Escherichia coli CFT073
agcagacaaacagcgucgaggu

SEQ ID NO: 7808 - RNA, 22 nt, Escherichia coli CFT073
agcagauacagaagguucaggu

SEQ ID NO: 7809 - RNA, 22 nt, Escherichia coli CFT073
agcagcgagagcgcgcaucaca

SEQ ID NO: 7810 - RNA, 18 nt, Escherichia coli CFT073
agcagcggcgcaauggca

SEQ ID NO: 7811 - RNA, 22 nt, Escherichia coli CFT073
agcaggaaaaaccgauuuagcg

SEQ ID NO: 7812 - RNA, 22 nt, Escherichia coli CFT073
agcaggauacgaaggcuaugug

SEQ ID NO: 7813 - RNA, 22 nt, Escherichia coli CFT073
agcaguuucguggcggcaccga

SEQ ID NO: 7814 - RNA, 22 nt, Escherichia coli CFT073
agcaugauuucuccggugguca

SEQ ID NO: 7815 - RNA, 22 nt, Escherichia coli CFT073
agcauugaggaacagcguaauc

SEQ ID NO: 7816 - RNA, 22 nt, Escherichia coli CFT073
agcauugcuacugcccgcugca

SEQ ID NO: 7817 - RNA, 22 nt, Escherichia coli CFT073
agccacauguucccgcuuuggg

SEQ ID NO: 7818 - RNA, 22 nt, Escherichia coli CFT073
agccagcgaucucggcguggug

SEQ ID NO: 7819 - RNA, 22 nt, Escherichia coli CFT073
agccgggacuuugcccugcucu

SEQ ID NO: 7820 - RNA, 22 nt, Escherichia coli CFT073
agccugcuguaucuggcaaccu

SEQ ID NO: 7821 - RNA, 22 nt, Escherichia coli CFT073
agcgaacugucgcugcuggaag

SEQ ID NO: 7822 - RNA, 22 nt, Escherichia coli CFT073
agcgacgcauaaaucgaugggg

SEQ ID NO: 7823 - RNA, 22 nt, Escherichia coli CFT073
agcgccaagguugagagagucg

SEQ ID NO: 7824 - RNA, 22 nt, Escherichia coli CFT073
agcgcuuauacaccgacauuga

SEQ ID NO: 7825 - RNA, 22 nt, Escherichia coli CFT073
agcggcggaucacaaaauugcg

SEQ ID NO: 7826 - RNA, 22 nt, Escherichia coli CFT073
agcgggcaauuuucgguggugc

SEQ ID NO: 7827 - RNA, 22 nt, Escherichia coli CFT073
agcgggggaucaugaugucgcg

SEQ ID NO: 7828 - RNA, 21 nt, Escherichia coli CFT073
agcguuauggcguacgucugc

SEQ ID NO: 7829 - RNA, 22 nt, Escherichia coli CFT073
agcuggucagagucgcuccgcu

SEQ ID NO: 7830 - RNA, 18 nt, Escherichia coli CFT073
agcuuaucugagacaaug

SEQ ID NO: 7831 - RNA, 22 nt, Escherichia coli CFT073
agcuugacaaagugcgggaucg

SEQ ID NO: 7832 - RNA, 22 nt, Escherichia coli CFT073
aggaagcaucacuuucugccca

SEQ ID NO: 7833 - RNA, 17 nt, Escherichia coli CFT073
aggaauagguaaaaaua

SEQ ID NO: 7834 - RNA, 22 nt, Escherichia coli CFT073
aggaguugguguuaccauugca

SEQ ID NO: 7835 - RNA, 22 nt, Escherichia coli CFT073
aggaguuugaaggccauugucu

SEQ ID NO: 7836 - RNA, 22 nt, Escherichia coli CFT073
aggauaaaacggauucggcagc

SEQ ID NO: 7837 - RNA, 23 nt, Escherichia coli CFT073
ucgcugguuaaguauucaugugc

SEQ ID NO: 7838 - RNA, 22 nt, Escherichia coli CFT073
ucgcuguugauaaauacuuccg

SEQ ID NO: 7839 - RNA, 22 nt, Escherichia coli CFT073
ucggccucucuugcggucuggu

SEQ ID NO: 7840 - RNA, 22 nt, Escherichia coli CFT073
ucggcucgcccagcggaguuuc

SEQ ID NO: 7841 - RNA, 22 nt, Escherichia coli CFT073
ucgguacuguucgagacggcgg

SEQ ID NO: 7842 - RNA, 22 nt, Escherichia coli CFT073
ucgguaucgggauuauuuauca

SEQ ID NO: 7843 - RNA, 22 nt, Escherichia coli CFT073
ucggucacccagaccuggugau

SEQ ID NO: 7844 - RNA, 22 nt, Escherichia coli CFT073
ucggugagaucuuacaugucgg

SEQ ID NO: 7845 - RNA, 22 nt, Escherichia coli CFT073
ucguaggccggauaagacgcgg

SEQ ID NO: 7846 - RNA, 21 nt, Escherichia coli CFT073
ucgucgccuccggcauguuga

SEQ ID NO: 7847 - RNA, 22 nt, Escherichia coli CFT073
ucgucguuauugcuuuacgcau

SEQ ID NO: 7848 - RNA, 22 nt, Escherichia coli CFT073
ucgucuguugauaacagcgauu

SEQ ID NO: 7849 - RNA, 22 nt, Escherichia coli CFT073
ucgugauguucgcacuggaccc

SEQ ID NO: 7850 - RNA, 22 nt, Escherichia coli CFT073
ucgugguguaacucaggcagcg

SEQ ID NO: 7851 - RNA, 22 nt, Escherichia coli CFT073
ucguuauucagauguacguuuc

SEQ ID NO: 7852 - RNA, 21 nt, Escherichia coli CFT073
ucguugaaaaagccaucuacg

SEQ ID NO: 7853 - RNA, 22 nt, Escherichia coli CFT073
ucguugaaccucgcgccgaucg

SEQ ID NO: 7854 - RNA, 21 nt, Escherichia coli CFT073
ucguuuugauauuauuaugca

SEQ ID NO: 7855 - RNA, 22 nt, Escherichia coli CFT073
ucucccgcuaugccuguuaccu

SEQ ID NO: 7856 - RNA, 22 nt, Escherichia coli CFT073
ucucgcgcaauggcguuccaca

SEQ ID NO: 7857 - RNA, 22 nt, Escherichia coli CFT073
ucucuuuucuggaauuugguac

SEQ ID NO: 7858 - RNA, 22 nt, Escherichia coli CFT073
ucugaaugaagccaguaauguu

SEQ ID NO: 7859 - RNA, 22 nt, Escherichia coli CFT073
ucugaugcuggaguuacaggaa

SEQ ID NO: 7860 - RNA, 22 nt, Escherichia coli CFT073
ucugcggguauucaggcguucg

SEQ ID NO: 7861 - RNA, 22 nt, Escherichia coli CFT073
ucugcguauuuaucuuuugcaa

SEQ ID NO: 7862 - RNA, 22 nt, Escherichia coli CFT073
ucugcugcgucuggcucauacc

SEQ ID NO: 7863 - RNA, 22 nt, Escherichia coli CFT073
ucugcuuaaccagaacgacguu

SEQ ID NO: 7864 - RNA, 20 nt, Escherichia coli CFT073
ucuggcgcauuccgggcugu

SEQ ID NO: 7865 - RNA, 22 nt, Escherichia coli CFT073
ucuggcggcacucucugucccu

SEQ ID NO: 7866 - RNA, 22 nt, Escherichia coli CFT073
ucuggcgguggcacugucgaug

SEQ ID NO: 7867 - RNA, 21 nt, Escherichia coli CFT073
ucuguuugccuucagcuccau

SEQ ID NO: 7868 - RNA, 22 nt, Escherichia coli CFT073
ucuuaagcguaguaauuuuagc

SEQ ID NO: 7869 - RNA, 22 nt, Escherichia coli CFT073
ucuuacggucgauuucaacaga

SEQ ID NO: 7870 - RNA, 22 nt, Escherichia coli CFT073
ucuuauuucaucgguucaugug

SEQ ID NO: 7871 - RNA, 22 nt, Escherichia coli CFT073
ucuucacgccagaguuuuugca

SEQ ID NO: 7872 - RNA, 22 nt, Escherichia coli CFT073
ucuucgguaaaucugcugaacc

SEQ ID NO: 7873 - RNA, 23 nt, Escherichia coli CFT073
ucuugcccgguguagcgauagau

SEQ ID NO: 7874 - RNA, 22 nt, Escherichia coli CFT073
ucuuguuuuaugugaucguggu

SEQ ID NO: 7875 - RNA, 22 nt, Escherichia coli CFT073
ucuuucagacugagcuggaacc

SEQ ID NO: 7876 - RNA, 22 nt, Escherichia coli CFT073
ugaaaaacggcugcggaauuag

SEQ ID NO: 7877 - RNA, 22 nt, Escherichia coli CFT073
ugaaaaugacucugucggguuu

SEQ ID NO: 7878 - RNA, 22 nt, Escherichia coli CFT073
ugaaacagcgcuggcagcagca

SEQ ID NO: 7879 - RNA, 22 nt, Escherichia coli CFT073
ugaaccgaacaacugaacguca

SEQ ID NO: 7880 - RNA, 22 nt, Escherichia coli CFT073
ugaauugauuaaagauaagcca

SEQ ID NO: 7881 - RNA, 20 nt, Escherichia coli CFT073
ugaauuguuuggucgucagc

SEQ ID NO: 7882 - RNA, 22 nt, Escherichia coli CFT073
ugaauuuccgaaguaucucgcg

SEQ ID NO: 7883 - RNA, 22 nt, Escherichia coli CFT073
ugggcuacuucucuucugaccg

SEQ ID NO: 7884 - RNA, 22 nt, Escherichia coli CFT073
uggggauguuaagcuggaguug

SEQ ID NO: 7885 - RNA, 22 nt, Escherichia coli CFT073
uggggcggguaugaaucguuga

SEQ ID NO: 7886 - RNA, 22 nt, Escherichia coli CFT073
uggguaaaaaccucggcgacgg

SEQ ID NO: 7887 - RNA, 22 nt, Escherichia coli CFT073
uggguaucgucgaagauaaagu

SEQ ID NO: 7888 - RNA, 22 nt, Escherichia coli CFT073
uggguauuuaucaaccgcagau

SEQ ID NO: 7889 - RNA, 22 nt, Escherichia coli CFT073
uggguguuauuuuaaggccgca

SEQ ID NO: 7890 - RNA, 21 nt, Escherichia coli CFT073
uggguuaauggagcuuuugua

SEQ ID NO: 7891 - RNA, 22 nt, Escherichia coli CFT073
ugguaagcgcggcaugacguau

SEQ ID NO: 7892 - RNA, 22 nt, Escherichia coli CFT073
ugguaauucacucccuguucgc

SEQ ID NO: 7893 - RNA, 22 nt, Escherichia coli CFT073
ugguacucgaaguugucuuuau

SEQ ID NO: 7894 - RNA, 20 nt, Escherichia coli CFT073
ugguauucaugacugaccuc

SEQ ID NO: 7895 - RNA, 22 nt, Escherichia coli CFT073
uggucggugcggcugcacaaua

SEQ ID NO: 7896 - RNA, 22 nt, Escherichia coli CFT073
uggucguaaaguuugucauggc

SEQ ID NO: 7897 - RNA, 22 nt, Escherichia coli CFT073
uggucgugaucaucaucaucgc

SEQ ID NO: 7898 - RNA, 22 nt, Escherichia coli CFT073
uggucugucauacuuuguuacc

SEQ ID NO: 7899 - RNA, 22 nt, Escherichia coli CFT073
uggucuucucugcuggcgcugc

SEQ ID NO: 7900 - RNA, 22 nt, Escherichia coli CFT073
uggugacguaacgcgccaccag

SEQ ID NO: 7901 - RNA, 23 nt, Escherichia coli CFT073
uggugcacggacaagaaucagcg

SEQ ID NO: 7902 - RNA, 21 nt, Escherichia coli CFT073
uggugguacuaaugauuugga

SEQ ID NO: 7903 - RNA, 22 nt, Escherichia coli CFT073
uggugguuauugaugaucaaca

SEQ ID NO: 7904 - RNA, 22 nt, Escherichia coli CFT073
uggugucggcacacaguaaaaa

SEQ ID NO: 7905 - RNA, 22 nt, Escherichia coli CFT073
ugguuccggcgcgcagaacgca

SEQ ID NO: 7906 - RNA, 22 nt, Escherichia coli CFT073
ugguuuaaccaggaugaagucg

SEQ ID NO: 7907 - RNA, 22 nt, Escherichia coli CFT073
ugguuucugcccgagauagccg

SEQ ID NO: 7908 - RNA, 22 nt, Escherichia coli CFT073
ugguuugcugauuacgccgugg

SEQ ID NO: 7909 - RNA, 22 nt, Escherichia coli CFT073
ugguuuggcgcugacgucauua

SEQ ID NO: 7910 - RNA, 22 nt, Escherichia coli CFT073
ugguuuuauauacaguaaagag

SEQ ID NO: 7911 - RNA, 20 nt, Escherichia coli CFT073
ugguuuucuucgaucagucc

SEQ ID NO: 7912 - RNA, 22 nt, Escherichia coli CFT073
uguaaucagcagacgggauuca

SEQ ID NO: 7913 - RNA, 22 nt, Escherichia coli CFT073
uguaauuaaaaccuggcucaua

SEQ ID NO: 7914 - RNA, 22 nt, Escherichia coli CFT073
uguagcuugucggagcugaucg

SEQ ID NO: 7915 - RNA, 22 nt, Escherichia coli CFT073
uguaggccggauaaggcguuua

SEQ ID NO: 7916 - RNA, 22 nt, Escherichia coli CFT073
uguaggucggauaagacgcaua

SEQ ID NO: 7917 - RNA, 22 nt, Escherichia coli CFT073
ugucacgcgaggucacauugau

SEQ ID NO: 7918 - RNA, 19 nt, Escherichia coli CFT073
ugucacuuugcuguauuuc

SEQ ID NO: 7919 - RNA, 22 nt, Escherichia coli CFT073
ugucauuaaccgauuguccgau

SEQ ID NO: 7920 - RNA, 19 nt, Escherichia coli CFT073
ugucgaugccauucgccgc

SEQ ID NO: 7921 - RNA, 22 nt, Escherichia coli CFT073
ugucgcaucgcuaucuggcuga

SEQ ID NO: 7922 - RNA, 22 nt, Escherichia coli CFT073
ugucgcuaugguagugcaggua

SEQ ID NO: 7923 - RNA, 22 nt, Escherichia coli CFT073
ugucugucucugggccuugaua

SEQ ID NO: 7924 - RNA, 22 nt, Escherichia coli CFT073
ugucuguuauucaacaauuuag

SEQ ID NO: 7925 - RNA, 22 nt, Escherichia coli CFT073
ugugccaacggguuccccucac

SEQ ID NO: 7926 - RNA, 22 nt, Escherichia coli CFT073
aggaucgcggcuggcugacgug

SEQ ID NO: 7927 - RNA, 22 nt, Escherichia coli CFT073
aggcaacaaucaacgaggccac

SEQ ID NO: 7928 - RNA, 22 nt, Escherichia coli CFT073
aggcaaucgccuguugguggua

SEQ ID NO: 7929 - RNA, 22 nt, Escherichia coli CFT073
aggccgaagcgaucgauaagcu

SEQ ID NO: 7930 - RNA, 22 nt, Escherichia coli CFT073
aggccgcaucaucgcuugcgau

SEQ ID NO: 7931 - RNA, 22 nt, Escherichia coli CFT073
aggccguugcuguuggucaagc

SEQ ID NO: 7932 - RNA, 22 nt, Escherichia coli CFT073
aggccuacaaggggaauugcaa

SEQ ID NO: 7933 - RNA, 22 nt, Escherichia coli CFT073
aggcgaaaagugggugaugcca

SEQ ID NO: 7934 - RNA, 19 nt, Escherichia coli CFT073
aggcgcgccgucggcggag

SEQ ID NO: 7935 - RNA, 22 nt, Escherichia coli CFT073
aggcggcuaacauaaaaagcca

SEQ ID NO: 7936 - RNA, 16 nt, Escherichia coli CFT073
aggcguuucagucaug

SEQ ID NO: 7937 - RNA, 22 nt, Escherichia coli CFT073
aggcguuugcccgugcggcaau

SEQ ID NO: 7938 - RNA, 22 nt, Escherichia coli CFT073
aggcugggcgcuaauaggagau

SEQ ID NO: 7939 - RNA, 22 nt, Escherichia coli CFT073
aggcuguuccgcuccggugcgu

SEQ ID NO: 7940 - RNA, 22 nt, Escherichia coli CFT073
aggcuuuuuuacuggcaaauca

SEQ ID NO: 7941 - RNA, 22 nt, Escherichia coli CFT073
agggcgagagcguuugguuuuc

SEQ ID NO: 7942 - RNA, 22 nt, Escherichia coli CFT073
agggcgagcagcugcgcgugac

SEQ ID NO: 7943 - RNA, 22 nt, Escherichia coli CFT073
agggcgaucagauauucaugaa

SEQ ID NO: 7944 - RNA, 22 nt, Escherichia coli CFT073
agggcgcugauucaucgaccag

SEQ ID NO: 7945 - RNA, 23 nt, Escherichia coli CFT073
agggugaaaauacguugauaggc

SEQ ID NO: 7946 - RNA, 22 nt, Escherichia coli CFT073
aggucaaucaucuguucacuau

SEQ ID NO: 7947 - RNA, 22 nt, Escherichia coli CFT073
agguggcaaaauuugggacaaa

SEQ ID NO: 7948 - RNA, 22 nt, Escherichia coli CFT073
agguuaauuauuuuccugguuu

SEQ ID NO: 7949 - RNA, 22 nt, Escherichia coli CFT073
agguuagcgugcuugugcuuaa

SEQ ID NO: 7950 - RNA, 22 nt, Escherichia coli CFT073
agguugaacaacugaugacgcu

SEQ ID NO: 7951 - RNA, 23 nt, Escherichia coli CFT073
agguuugaccguucuccaugacc

SEQ ID NO: 7952 - RNA, 22 nt, Escherichia coli CFT073
aguaugcuggcgcuguugcugg

SEQ ID NO: 7953 - RNA, 23 nt, Escherichia coli CFT073
agucaugaauucacuacguccgg

SEQ ID NO: 7954 - RNA, 22 nt, Escherichia coli CFT073
agucgcgaccaaaaucuuucuc

SEQ ID NO: 7955 - RNA, 20 nt, Escherichia coli CFT073
agugaaauccaacaguagcc

SEQ ID NO: 7956 - RNA, 22 nt, Escherichia coli CFT073
agugaacgaacugaucgccgca

SEQ ID NO: 7957 - RNA, 22 nt, Escherichia coli CFT073
agugauuaacgucucuuucaga

SEQ ID NO: 7958 - RNA, 22 nt, Escherichia coli CFT073
agugccauuuacgaacauuaag

SEQ ID NO: 7959 - RNA, 22 nt, Escherichia coli CFT073
agugccgggauguuaaucggcu

SEQ ID NO: 7960 - RNA, 22 nt, Escherichia coli CFT073
aguggagaugcgguaaauauug

SEQ ID NO: 7961 - RNA, 22 nt, Escherichia coli CFT073
agugggauugcagagaaacagu

SEQ ID NO: 7962 - RNA, 22 nt, Escherichia coli CFT073
agugggggcuaccgacguucgc

SEQ ID NO: 7963 - RNA, 22 nt, Escherichia coli CFT073
aguguuccauggugcccgcgcc

SEQ ID NO: 7964 - RNA, 22 nt, Escherichia coli CFT073
aguguuucauuuuuaccaugug

SEQ ID NO: 7965 - RNA, 22 nt, Escherichia coli CFT073
aguuccuuauaguauucaauga

SEQ ID NO: 7966 - RNA, 19 nt, Escherichia coli CFT073
aguugucguuccucaacuc

SEQ ID NO: 7967 - RNA, 22 nt, Escherichia coli CFT073
aguuucucgucaacauacugcu

SEQ ID NO: 7968 - RNA, 22 nt, Escherichia coli CFT073
aguuugaucgcaaagguauggu

SEQ ID NO: 7969 - RNA, 22 nt, Escherichia coli CFT073
aguuugcuguugaccaggaaaa

SEQ ID NO: 7970 - RNA, 22 nt, Escherichia coli CFT073
uuccgguaccuggagcgcgaaa

SEQ ID NO: 7971 - RNA, 22 nt, Escherichia coli CFT073
uucgcgacuggacagcggucgg

SEQ ID NO: 7972 - RNA, 22 nt, Escherichia coli CFT073
uucgcgcauugaugauaucgau

SEQ ID NO: 7973 - RNA, 22 nt, Escherichia coli CFT073
uucgcguuguauaacaugguga

SEQ ID NO: 7974 - RNA, 22 nt, Escherichia coli CFT073
uucgcuauuaucggcguaauuu

SEQ ID NO: 7975 - RNA, 22 nt, Escherichia coli CFT073
uucgugauggucagguggugaa

SEQ ID NO: 7976 - RNA, 22 nt, Escherichia coli CFT073
uucguugaaauuauuggucaaa

SEQ ID NO: 7977 - RNA, 22 nt, Escherichia coli CFT073
uucguugcgugagguugcuggc

SEQ ID NO: 7978 - RNA, 22 nt, Escherichia coli CFT073
uucguugcugauagccgguggu

SEQ ID NO: 7979 - RNA, 22 nt, Escherichia coli CFT073
uucuacuguuagucgccuggca

SEQ ID NO: 7980 - RNA, 22 nt, Escherichia coli CFT073
uucuccgcgagaauguaaccag

SEQ ID NO: 7981 - RNA, 22 nt, Escherichia coli CFT073
uucucgaaaauaucgugcaugu

SEQ ID NO: 7982 - RNA, 22 nt, Escherichia coli CFT073
uucucucugccugccgaggcca

SEQ ID NO: 7983 - RNA, 22 nt, Escherichia coli CFT073
uucugaauucauccacuuugcc

SEQ ID NO: 7984 - RNA, 22 nt, Escherichia coli CFT073
uucugcgguaaaugcgauugaa

SEQ ID NO: 7985 - RNA, 22 nt, Escherichia coli CFT073
uucuguacagcacgcuucauag

SEQ ID NO: 7986 - RNA, 18 nt, Escherichia coli CFT073
uucuguagaaccgccgcc

SEQ ID NO: 7987 - RNA, 22 nt, Escherichia coli CFT073
uucuucaaucugacgcaucagg

SEQ ID NO: 7988 - RNA, 22 nt, Escherichia coli CFT073
uucuucauuuuguaaggcgaac

SEQ ID NO: 7989 - RNA, 22 nt, Escherichia coli CFT073
uucuuugcgcuuggcggucauu

SEQ ID NO: 7990 - RNA, 20 nt, Escherichia coli CFT073
uugaacagaacgcggaagcc

SEQ ID NO: 7991 - RNA, 22 nt, Escherichia coli CFT073
uugaagcgcuuagcagcaccgc

SEQ ID NO: 7992 - RNA, 22 nt, Escherichia coli CFT073
uugacgcgucuuauccggccua

SEQ ID NO: 7993 - RNA, 22 nt, Escherichia coli CFT073
uugaggaucgccaccaagucgu

SEQ ID NO: 7994 - RNA, 22 nt, Escherichia coli CFT073
uugagugugauggccugcuuau

SEQ ID NO: 7995 - RNA, 22 nt, Escherichia coli CFT073
uugaugaaccacucggugcgcu

SEQ ID NO: 7996 - RNA, 20 nt, Escherichia coli CFT073
uugaugaauuugcuguaaga

SEQ ID NO: 7997 - RNA, 22 nt, Escherichia coli CFT073
uugaugcucagucugcugauca

SEQ ID NO: 7998 - RNA, 22 nt, Escherichia coli CFT073
uugcacauuuuuguaggccgga

SEQ ID NO: 7999 - RNA, 22 nt, Escherichia coli CFT073
uugcacgauuuuguaggccgga

SEQ ID NO: 8000 - RNA, 22 nt, Escherichia coli CFT073
uugcacgauuuuguaggucgga

SEQ ID NO: 8001 - RNA, 22 nt, Escherichia coli CFT073
uugcagucacugcgugaugcac

SEQ ID NO: 8002 - RNA, 22 nt, Escherichia coli CFT073
uugccagccucgaguucaucac

SEQ ID NO: 8003 - RNA, 22 nt, Escherichia coli CFT073
uugccaguuuggcgacaguuga

SEQ ID NO: 8004 - RNA, 22 nt, Escherichia coli CFT073
uugccgccagugcgcuuggacu

SEQ ID NO: 8005 - RNA, 22 nt, Escherichia coli CFT073
uugccguugcaagggaagggcu

SEQ ID NO: 8006 - RNA, 22 nt, Escherichia coli CFT073
uugcggaaguuuaucuggcgau

SEQ ID NO: 8007 - RNA, 19 nt, Escherichia coli CFT073
uugcgggcaaggcguuaaa

SEQ ID NO: 8008 - RNA, 22 nt, Escherichia coli CFT073
uugcuaucaaagaagcaaacaa

SEQ ID NO: 8009 - RNA, 23 nt, Escherichia coli CFT073
uugcucucauuucgcacaucgcg

SEQ ID NO: 8010 - RNA, 22 nt, Escherichia coli CFT073
uugcucuucauucaggccuuua

SEQ ID NO: 8011 - RNA, 22 nt, Escherichia coli CFT073
uugcugacuaucggaacuuuuu

SEQ ID NO: 8012 - RNA, 22 nt, Escherichia coli CFT073
uugcugaugcgcugccaggcgu

SEQ ID NO: 8013 - RNA, 22 nt, Escherichia coli CFT073
uugcugucggaacaagguauca

SEQ ID NO: 8014 - RNA, 22 nt, Escherichia coli CFT073
uugcuguuuauagcagaugcca

SEQ ID NO: 8015 - RNA, 22 nt, Escherichia coli CFT073
augcagcacgucacggcgugga

SEQ ID NO: 8016 - RNA, 22 nt, Escherichia coli CFT073
augcaggcggccauguuacuug

SEQ ID NO: 8017 - RNA, 22 nt, Escherichia coli CFT073
augcauccgcuacccagguagg

SEQ ID NO: 8018 - RNA, 22 nt, Escherichia coli CFT073
augccgcuuacucaagaagaaa

SEQ ID NO: 8019 - RNA, 22 nt, Escherichia coli CFT073
augccuuauccggccuacaaag

SEQ ID NO: 8020 - RNA, 22 nt, Escherichia coli CFT073
augcgccgcugucgcgucuuau

SEQ ID NO: 8021 - RNA, 22 nt, Escherichia coli CFT073
augcgucgcugucgcgucuuau

SEQ ID NO: 8022 - RNA, 22 nt, Escherichia coli CFT073
augcgucugcugguggcggccu

SEQ ID NO: 8023 - RNA, 22 nt, Escherichia coli CFT073
augcucgccuguuggaucgugc

SEQ ID NO: 8024 - RNA, 22 nt, Escherichia coli CFT073
auggcaauugccgguucgcugg

SEQ ID NO: 8025 - RNA, 22 nt, Escherichia coli CFT073
auggcauuuggcaacauaugac

SEQ ID NO: 8026 - RNA, 22 nt, Escherichia coli CFT073
auggcgauauagucuuucacgc

SEQ ID NO: 8027 - RNA, 22 nt, Escherichia coli CFT073
auggcgcaauuuagcggguugg

SEQ ID NO: 8028 - RNA, 22 nt, Escherichia coli CFT073
auggcgcugguuuccgccugua

SEQ ID NO: 8029 - RNA, 22 nt, Escherichia coli CFT073
auggcgguauuuuuccuguugg

SEQ ID NO: 8030 - RNA, 22 nt, Escherichia coli CFT073
auggcguugguuaacaaccugg

SEQ ID NO: 8031 - RNA, 22 nt, Escherichia coli CFT073
auggcuuccugaaacaguuugg

SEQ ID NO: 8032 - RNA, 22 nt, Escherichia coli CFT073
auggcuuugacaguaucaguca

SEQ ID NO: 8033 - RNA, 22 nt, Escherichia coli CFT073
augggcggauucuugcgacagg

SEQ ID NO: 8034 - RNA, 22 nt, Escherichia coli CFT073
auggguuacauuaugaucaaau

SEQ ID NO: 8035 - RNA, 18 nt, Escherichia coli CFT073
auggugaugaucgauuuc

SEQ ID NO: 8036 - RNA, 22 nt, Escherichia coli CFT073
auggugugcugcucccgcugau

SEQ ID NO: 8037 - RNA, 22 nt, Escherichia coli CFT073
augguugaugacgaagagcugc

SEQ ID NO: 8038 - RNA, 22 nt, Escherichia coli CFT073
augucagacgcagacuaagcgg

SEQ ID NO: 8039 - RNA, 22 nt, Escherichia coli CFT073
augucguucggcgaggugguga

SEQ ID NO: 8040 - RNA, 22 nt, Escherichia coli CFT073
augugccuuauuccguauucau

SEQ ID NO: 8041 - RNA, 22 nt, Escherichia coli CFT073
auguguucugggaucugcagga

SEQ ID NO: 8042 - RNA, 22 nt, Escherichia coli CFT073
auguugaaauaaugaaagcggc

SEQ ID NO: 8043 - RNA, 22 nt, Escherichia coli CFT073
auguuucugacaucuguaagca

SEQ ID NO: 8044 - RNA, 22 nt, Escherichia coli CFT073
auuaauuugcuggaaauauuua

SEQ ID NO: 8045 - RNA, 22 nt, Escherichia coli CFT073
auuacagacugcccgcuugugg

SEQ ID NO: 8046 - RNA, 22 nt, Escherichia coli CFT073
auuaucaggucaugcguaccga

SEQ ID NO: 8047 - RNA, 22 nt, Escherichia coli CFT073
auuccgcaacgucagugacugc

SEQ ID NO: 8048 - RNA, 22 nt, Escherichia coli CFT073
auucucgcguuucagugauuug

SEQ ID NO: 8049 - RNA, 22 nt, Escherichia coli CFT073
auugagcauaacuuuaaugcgc

SEQ ID NO: 8050 - RNA, 22 nt, Escherichia coli CFT073
auugcaggaacguuaccaccgu

SEQ ID NO: 8051 - RNA, 22 nt, Escherichia coli CFT073
auuggccgccuguuuacuguuc

SEQ ID NO: 8052 - RNA, 22 nt, Escherichia coli CFT073
auugggauuaugccgcagcacg

SEQ ID NO: 8053 - RNA, 22 nt, Escherichia coli CFT073
auugucggugucagcgugucac

SEQ ID NO: 8054 - RNA, 22 nt, Escherichia coli CFT073
auuguucacgcuugauccacac

SEQ ID NO: 8055 - RNA, 22 nt, Escherichia coli CFT073
auuguugacuuccgucaugaag

SEQ ID NO: 8056 - RNA, 22 nt, Escherichia coli CFT073
auuuaauuacaguccagagcug

SEQ ID NO: 8057 - RNA, 22 nt, Escherichia coli CFT073
uuuggcgaugcaaucucgaagc

SEQ ID NO: 8058 - RNA, 22 nt, Escherichia coli CFT073
uuuguaacguugcaggaugucg

SEQ ID NO: 8059 - RNA, 22 nt, Escherichia coli CFT073
uuuuauauuagccaggaacuuu

SEQ ID NO: 8060 - RNA, 23 nt, Escherichia coli CFT073
uuuucggcaucaccauccgucgg

SEQ ID NO: 8061 - RNA, 22 nt, Escherichia coli CFT073
uuuucgugaagagguuuuguaa

SEQ ID NO: 8062 - RNA, 20 nt, Escherichia coli CFT073
uuuugaccaacagugcuggc

SEQ ID NO: 8063 - RNA, 22 nt, Escherichia coli CFT073
uuuuuacuggcauuugccugaa

SEQ ID NO: 8064 - RNA, 22 nt, Escherichia coli CFT073
uuuuucaaaucccacuacgaag

SEQ ID NO: 8065 - RNA, 22 nt, Escherichia coli CFT073
uuuuucagaaagaaugugauga

SEQ ID NO: 8066 - RNA, 22 nt, Escherichia coli CFT073
uuuuucugccuguaguaccuga

SEQ ID NO: 8067 - RNA, 22 nt, Escherichia coli CFT073
uuuuugauauguugaaaggcgg

SEQ ID NO: 8068 - RNA, 22 nt, Escherichia coli CFT073
uuuuuggauggucucauuaucc

SEQ ID NO: 8069 - RNA, 22 nt, Escherichia coli CFT073
uuuuuuaccacuggccuucugc

SEQ ID NO: 8070 - RNA, 22 nt, Escherichia coli CFT073
cugcuguacauggcugccgcug

SEQ ID NO: 8071 - RNA, 22 nt, Escherichia coli CFT073
cuggaagucaaagacagugaga

SEQ ID NO: 8072 - RNA, 22 nt, Escherichia coli CFT073
cuggauuggcagcgcguggguc

SEQ ID NO: 8073 - RNA, 22 nt, Escherichia coli CFT073
cuggcgcaacguuauccucccu

SEQ ID NO: 8074 - RNA, 22 nt, Escherichia coli CFT073
cuggcgucuugucguaauguuu

SEQ ID NO: 8075 - RNA, 22 nt, Escherichia coli CFT073
cuggcguugaaggggggaugac

SEQ ID NO: 8076 - RNA, 22 nt, Escherichia coli CFT073
cuggcuacucaggcgauacagu

SEQ ID NO: 8077 - RNA, 22 nt, Escherichia coli CFT073
cugggauacugguugcucauug

SEQ ID NO: 8078 - RNA, 22 nt, Escherichia coli CFT073
cugggcacgaccguucagcugc

SEQ ID NO: 8079 - RNA, 22 nt, Escherichia coli CFT073
cugggcagagcgcgacauggca

SEQ ID NO: 8080 - RNA, 22 nt, Escherichia coli CFT073
cugguaugacucaaauggguug

SEQ ID NO: 8081 - RNA, 22 nt, Escherichia coli CFT073
cuggucgaaaccgguggagaga

SEQ ID NO: 8082 - RNA, 22 nt, Escherichia coli CFT073
cugguguuuggucagccgagcg

SEQ ID NO: 8083 - RNA, 22 nt, Escherichia coli CFT073
cugguuacagaaagagauugau

SEQ ID NO: 8084 - RNA, 22 nt, Escherichia coli CFT073
cuguaauaucuuaaucucuggu

SEQ ID NO: 8085 - RNA, 18 nt, Escherichia coli CFT073
cugucguuuccuuucuuu

SEQ ID NO: 8086 - RNA, 22 nt, Escherichia coli CFT073
cugucuccggcugcgcugauga

SEQ ID NO: 8087 - RNA, 22 nt, Escherichia coli CFT073
cugugggaugcaaugccgaagc

SEQ ID NO: 8088 - RNA, 22 nt, Escherichia coli CFT073
cugugucauuuucgccgugucu

SEQ ID NO: 8089 - RNA, 22 nt, Escherichia coli CFT073
cuguucaucagggacuauggug

SEQ ID NO: 8090 - RNA, 19 nt, Escherichia coli CFT073
cuguuuauucuguuugccc

SEQ ID NO: 8091 - RNA, 19 nt, Escherichia coli CFT073
cuguuucgccaucgccaga

SEQ ID NO: 8092 - RNA, 22 nt, Escherichia coli CFT073
cuuaauaugggaucgucucaug

SEQ ID NO: 8093 - RNA, 22 nt, Escherichia coli CFT073
cuuacgccguauuuuguuauug

SEQ ID NO: 8094 - RNA, 20 nt, Escherichia coli CFT073
cuuagccgugugucucgcgu

SEQ ID NO: 8095 - RNA, 22 nt, Escherichia coli CFT073
cuucacaguauauuugaaaaag

SEQ ID NO: 8096 - RNA, 22 nt, Escherichia coli CFT073
cuucgaucucguaaccgucgca

SEQ ID NO: 8097 - RNA, 22 nt, Escherichia coli CFT073
cuucgcuggugggggcuacgcg

SEQ ID NO: 8098 - RNA, 22 nt, Escherichia coli CFT073
cuugagauuaaagaagaacggc

SEQ ID NO: 8099 - RNA, 19 nt, Escherichia coli CFT073
cuugcggugaagaagcggu

SEQ ID NO: 8100 - RNA, 22 nt, Escherichia coli CFT073
cuuuacuaucguuuaggugcgc

SEQ ID NO: 8101 - RNA, 22 nt, Escherichia coli CFT073
cuuugcuaucagucucaagggc

SEQ ID NO: 8102 - RNA, 22 nt, Escherichia coli CFT073
cauaccaacguacuggcucugc

SEQ ID NO: 8103 - RNA, 22 nt, Escherichia coli CFT073
caucacgcggucuacguaguca

SEQ ID NO: 8104 - RNA, 22 nt, Escherichia coli CFT073
caucgcuuuucuggauuauuug

SEQ ID NO: 8105 - RNA, 21 nt, Escherichia coli CFT073
caucuggaauaugcaucagcg

SEQ ID NO: 8106 - RNA, 18 nt, Escherichia coli CFT073
caugaaacgagagacuac

SEQ ID NO: 8107 - RNA, 22 nt, Escherichia coli CFT073
caugaugcugggugcggugcug

SEQ ID NO: 8108 - RNA, 22 nt, Escherichia coli CFT073
caugaugggcaugaaugucaua

SEQ ID NO: 8109 - RNA, 22 nt, Escherichia coli CFT073
caugauguuuucgauuauguga

SEQ ID NO: 8110 - RNA, 22 nt, Escherichia coli CFT073
caugccaaaagcugggagccga

SEQ ID NO: 8111 - RNA, 22 nt, Escherichia coli CFT073
caugcugcgcguuggcgaucug

SEQ ID NO: 8112 - RNA, 22 nt, Escherichia coli CFT073
caugguuucaccgguacccugg

SEQ ID NO: 8113 - RNA, 22 nt, Escherichia coli CFT073
cauuacaugcgcagaguggcgg

SEQ ID NO: 8114 - RNA, 22 nt, Escherichia coli CFT073
cauugcgcagguuuggagugau

SEQ ID NO: 8115 - RNA, 20 nt, Escherichia coli CFT073
cauuggcugguuguuggggc

SEQ ID NO: 8116 - RNA, 22 nt, Escherichia coli CFT073
ccaacugugaggcaagcuguuc

SEQ ID NO: 8117 - RNA, 22 nt, Escherichia coli CFT073
ccagaauucagguugcauccgu

SEQ ID NO: 8118 - RNA, 22 nt, Escherichia coli CFT073
ccagcaaacaagugcuccaggg

SEQ ID NO: 8119 - RNA, 22 nt, Escherichia coli CFT073
ccagcaguaugcaucagccgau

SEQ ID NO: 8120 - RNA, 22 nt, Escherichia coli CFT073
ccagccaggcuuucaucgccgc

SEQ ID NO: 8121 - RNA, 22 nt, Escherichia coli CFT073
ccaggaauugcaggguaaaauu

SEQ ID NO: 8122 - RNA, 21 nt, Escherichia coli CFT073
ccaggcggaaaaugaggcagc

SEQ ID NO: 8123 - RNA, 22 nt, Escherichia coli CFT073
ccaggcguuacuggauaaaauu

SEQ ID NO: 8124 - RNA, 19 nt, Escherichia coli CFT073
ccagguuggcguccagcug

SEQ ID NO: 8125 - RNA, 22 nt, Escherichia coli CFT073
ccaguacguugaauacaucacc

SEQ ID NO: 8126 - RNA, 22 nt, Escherichia coli CFT073
ccagugagaaaaugcuugauga

SEQ ID NO: 8127 - RNA, 22 nt, Escherichia coli CFT073
ccauucgcgcagacgaaaauuc

SEQ ID NO: 8128 - RNA, 22 nt, Escherichia coli CFT073
ccccccuauaguauauugcaug

SEQ ID NO: 8129 - RNA, 22 nt, Escherichia coli CFT073
cccgaugaugacagcagccgga

SEQ ID NO: 8130 - RNA, 22 nt, Escherichia coli CFT073
cccgcuguuuacgcuaacugcu

SEQ ID NO: 8131 - RNA, 21 nt, Escherichia coli CFT073
cccgugauguugucaggugca

SEQ ID NO: 8132 - RNA, 22 nt, Escherichia coli CFT073
ccgaaaaauugcagcaggcggu

SEQ ID NO: 8133 - RNA, 22 nt, Escherichia coli CFT073
ccgagcagcuuaaacgcaauau

SEQ ID NO: 8134 - RNA, 22 nt, Escherichia coli CFT073
ccgaucuucuucaugguaauac

SEQ ID NO: 8135 - RNA, 22 nt, Escherichia coli CFT073
ccgaugccgaugugaucauuga

SEQ ID NO: 8136 - RNA, 22 nt, Escherichia coli CFT073
ccgcaacuggcaacccgacugg

SEQ ID NO: 8137 - RNA, 22 nt, Escherichia coli CFT073
ccgcacacaacauuucaaaaga

SEQ ID NO: 8138 - RNA, 22 nt, Escherichia coli CFT073
ccgcaggagacggcauugguga

SEQ ID NO: 8139 - RNA, 22 nt, Escherichia coli CFT073
ccgcaggcucggugcugcgagu

SEQ ID NO: 8140 - RNA, 22 nt, Escherichia coli CFT073
ccgccgcuccguuaucgggugg

SEQ ID NO: 8141 - RNA, 22 nt, Escherichia coli CFT073
ccgccggacugauuuuguuguu

SEQ ID NO: 8142 - RNA, 22 nt, Escherichia coli CFT073
ccgcugauugaaaggaugcguu

SEQ ID NO: 8143 - RNA, 22 nt, Escherichia coli CFT073
ccgcuggcgagcuuguauuacu

SEQ ID NO: 8144 - RNA, 22 nt, Escherichia coli CFT073
ccgcuguacgucaaugcggcag

SEQ ID NO: 8145 - RNA, 22 nt, Escherichia coli CFT073
ccggaagguuaauugauggggu

SEQ ID NO: 8146 - RNA, 21 nt, Escherichia coli CFT073
ccggagaugugauugcccgga

SEQ ID NO: 8147 - RNA, 22 nt, Escherichia coli CFT073
ccggauugauuuuguccuuuuc

SEQ ID NO: 8148 - RNA, 22 nt, Escherichia coli CFT073
ccgguaaugacgccuguauugc

SEQ ID NO: 8149 - RNA, 22 nt, Escherichia coli CFT073
ccggugagucuuauuucacaag

SEQ ID NO: 8150 - RNA, 22 nt, Escherichia coli CFT073
ccggugccaucaagguuuguca

SEQ ID NO: 8151 - RNA, 22 nt, Escherichia coli CFT073
ccguaggucggauaaggcgcuc

SEQ ID NO: 8152 - RNA, 22 nt, Escherichia coli CFT073
ccgugcagcaacuugauccgau

SEQ ID NO: 8153 - RNA, 22 nt, Escherichia coli CFT073
ccgugcgucagcuggaagagug

SEQ ID NO: 8154 - RNA, 23 nt, Escherichia coli CFT073
ccguucguccaugucugaagcug

SEQ ID NO: 8155 - RNA, 22 nt, Escherichia coli CFT073
ccguuuucauggcaucgucaua

SEQ ID NO: 8156 - RNA, 22 nt, Escherichia coli CFT073
ccucaacaaaauccgccaguug

SEQ ID NO: 8157 - RNA, 22 nt, Escherichia coli CFT073
ccucccuugccacgcaguaguu

SEQ ID NO: 8158 - RNA, 22 nt, Escherichia coli CFT073
ccugacuauugccgcagcgauu

SEQ ID NO: 8159 - RNA, 22 nt, Escherichia coli CFT073
ccugauggaucagacugagauc

SEQ ID NO: 8160 - RNA, 22 nt, Escherichia coli CFT073
ccuggcugcaggaacaccaugu

SEQ ID NO: 8161 - RNA, 22 nt, Escherichia coli CFT073
ccuguaggccggauaaggcguu

SEQ ID NO: 8162 - RNA, 21 nt, Escherichia coli CFT073
ccugugguguauuuauuggcg

SEQ ID NO: 8163 - RNA, 22 nt, Escherichia coli CFT073
ccuugcugacacagcgcgcuca

SEQ ID NO: 8164 - RNA, 22 nt, Escherichia coli CFT073
ccuuuuuucugguaugccgcuc

SEQ ID NO: 8165 - RNA, 22 nt, Escherichia coli CFT073
cgaaaccguugagcgacagcaa

SEQ ID NO: 8166 - RNA, 22 nt, Escherichia coli CFT073
cgaaagacggcugguuauucac

SEQ ID NO: 8167 - RNA, 22 nt, Escherichia coli CFT073
cgaacuggaacgggcguugagu

SEQ ID NO: 8168 - RNA, 22 nt, Escherichia coli CFT073
cgaagccggauuccugcaagaa

SEQ ID NO: 8169 - RNA, 18 nt, Escherichia coli CFT073
cgaauuuuccugccguug

SEQ ID NO: 8170 - RNA, 22 nt, Escherichia coli CFT073
cgacauauaccggcgucagcaa

SEQ ID NO: 8171 - RNA, 22 nt, Escherichia coli CFT073
cgaccgauuucguaacgcggcu

SEQ ID NO: 8172 - RNA, 22 nt, Escherichia coli CFT073
cgacgaagcgauggcauccggu

SEQ ID NO: 8173 - RNA, 22 nt, Escherichia coli CFT073
cgagcaggacgauccgcucaau

SEQ ID NO: 8174 - RNA, 22 nt, Escherichia coli CFT073
cgagcgcaucgauccgacaugg

SEQ ID NO: 8175 - RNA, 22 nt, Escherichia coli CFT073
cgagcuggaaaccuuccugcug

SEQ ID NO: 8176 - RNA, 22 nt, Escherichia coli CFT073
cgagguuucaugggcgugauua

SEQ ID NO: 8177 - RNA, 22 nt, Escherichia coli CFT073
cgauggaagcgcguaacuaugg

SEQ ID NO: 8178 - RNA, 22 nt, Escherichia coli CFT073
cgauuaucaccuguugcccuuu

SEQ ID NO: 8179 - RNA, 22 nt, Escherichia coli CFT073
cgauuccgguaggcggucguua

SEQ ID NO: 8180 - RNA, 22 nt, Escherichia coli CFT073
cgcacaggauuauuacggugug

SEQ ID NO: 8181 - RNA, 22 nt, Escherichia coli CFT073
cgcaccgaccuggcuuggguua

SEQ ID NO: 8182 - RNA, 22 nt, Escherichia coli CFT073
cgcaggucaccuuuaucugccu

SEQ ID NO: 8183 - RNA, 22 nt, Escherichia coli CFT073
cgcauccgacaucuuuugccug

SEQ ID NO: 8184 - RNA, 22 nt, Escherichia coli CFT073
cgccagagugcuuauugcuucc

SEQ ID NO: 8185 - RNA, 22 nt, Escherichia coli CFT073
cgccagcaaaauggcgacggcg

SEQ ID NO: 8186 - RNA, 17 nt, Escherichia coli CFT073
cgccagcucgcuggcga

SEQ ID NO: 8187 - RNA, 22 nt, Escherichia coli CFT073
cgccauccacgccgagauggaa

SEQ ID NO: 8188 - RNA, 22 nt, Escherichia coli CFT073
uaaaguuccgcguauugcguuc

SEQ ID NO: 8189 - RNA, 16 nt, Escherichia coli CFT073
uaaaucagaggauuaa

SEQ ID NO: 8190 - RNA, 22 nt, Escherichia coli CFT073
uaaauuucccuuugccaaaggc

SEQ ID NO: 8191 - RNA, 22 nt, Escherichia coli CFT073
uaacaugcgcgcacgaucacuc

SEQ ID NO: 8192 - RNA, 22 nt, Escherichia coli CFT073
uaacugaggugauuaugggcuu

SEQ ID NO: 8193 - RNA, 22 nt, Escherichia coli CFT073
uaagcucaccacugcacgaaaa

SEQ ID NO: 8194 - RNA, 22 nt, Escherichia coli CFT073
uaaggcgaaauaugacgaguau

SEQ ID NO: 8195 - RNA, 22 nt, Escherichia coli CFT073
uaaggcgcuuuguugcgcaaca

SEQ ID NO: 8196 - RNA, 20 nt, Escherichia coli CFT073
uaagguuuuuguguggacug

SEQ ID NO: 8197 - RNA, 22 nt, Escherichia coli CFT073
uaauaucaaaaagugcuuaagg

SEQ ID NO: 8198 - RNA, 22 nt, Escherichia coli CFT073
uaaucccgauugaagagaaguu

SEQ ID NO: 8199 - RNA, 22 nt, Escherichia coli CFT073
uaaucgugauuuuuugugcgcg

SEQ ID NO: 8200 - RNA, 22 nt, Escherichia coli CFT073
uaaugaaacgacgcgcaguucc

SEQ ID NO: 8201 - RNA, 22 nt, Escherichia coli CFT073
uaauggaguauggcgucaguuu

SEQ ID NO: 8202 - RNA, 20 nt, Escherichia coli CFT073
uaauggcgauuacauuguug

SEQ ID NO: 8203 - RNA, 22 nt, Escherichia coli CFT073
uacaauguggcgcgaagaaugu

SEQ ID NO: 8204 - RNA, 22 nt, Escherichia coli CFT073
uaccagccuggugaacugguca

SEQ ID NO: 8205 - RNA, 21 nt, Escherichia coli CFT073
uaccggacaccugaauggcac

SEQ ID NO: 8206 - RNA, 22 nt, Escherichia coli CFT073
uacgcaccaaaacgagcggguc

SEQ ID NO: 8207 - RNA, 22 nt, Escherichia coli CFT073
uacgccgggccugcucggccca

SEQ ID NO: 8208 - RNA, 22 nt, Escherichia coli CFT073
uacgccuuguugcgccaguuuc

SEQ ID NO: 8209 - RNA, 22 nt, Escherichia coli CFT073
uacggcaaagauaccggucauu

SEQ ID NO: 8210 - RNA, 22 nt, Escherichia coli CFT073
uacggcuguuucugacgguaag

SEQ ID NO: 8211 - RNA, 22 nt, Escherichia coli CFT073
uacgguguuggguucgauuuua

SEQ ID NO: 8212 - RNA, 20 nt, Escherichia coli CFT073
uacgugcccaauaucggugc

SEQ ID NO: 8213 - RNA, 22 nt, Escherichia coli CFT073
uacugaaaacaaccgaugguaa

SEQ ID NO: 8214 - RNA, 22 nt, Escherichia coli CFT073
uacuggcgacagaaggcacuga

SEQ ID NO: 8215 - RNA, 22 nt, Escherichia coli CFT073
uacuggguguuugauuucguug

SEQ ID NO: 8216 - RNA, 22 nt, Escherichia coli CFT073
uagauacugacgauuacguaau

SEQ ID NO: 8217 - RNA, 22 nt, Escherichia coli CFT073
uagcaugugauucaauguaagc

SEQ ID NO: 8218 - RNA, 22 nt, Escherichia coli CFT073
uagcaugugcauggcggccugu

SEQ ID NO: 8219 - RNA, 22 nt, Escherichia coli CFT073
uagccgauagcggcgaugccgu

SEQ ID NO: 8220 - RNA, 22 nt, Escherichia coli CFT073
uagccgcaccacgucguuguua

SEQ ID NO: 8221 - RNA, 22 nt, Escherichia coli CFT073
uagcgcaacaaacguuggugug

SEQ ID NO: 8222 - RNA, 22 nt, Escherichia coli CFT073
uagcggacgucgacuacuggaa

SEQ ID NO: 8223 - RNA, 22 nt, Escherichia coli CFT073
uagcuggugacaauagcugguu

SEQ ID NO: 8224 - RNA, 22 nt, Escherichia coli CFT073
uaggccggauaaggcguuuaug

SEQ ID NO: 8225 - RNA, 22 nt, Escherichia coli CFT073
uaggcguuccguacaucaucgu

SEQ ID NO: 8226 - RNA, 22 nt, Escherichia coli CFT073
uaggugaguucgcugguguucc

SEQ ID NO: 8227 - RNA, 22 nt, Escherichia coli CFT073
uaguaucacuuuaucagccaag

SEQ ID NO: 8228 - RNA, 22 nt, Escherichia coli CFT073
uagugagcuauuaguguuuggu

SEQ ID NO: 8229 - RNA, 22 nt, Escherichia coli CFT073
uaguguggacugaugcucugcu

SEQ ID NO: 8230 - RNA, 22 nt, Escherichia coli CFT073
uauagcaaccgaccauauuggu

SEQ ID NO: 8231 - RNA, 22 nt, Escherichia coli CFT073
uaucagccugcaguucggcgau

SEQ ID NO: 8232 - RNA, 22 nt, Escherichia coli CFT073
uaucaggcauuguguagggcag

SEQ ID NO: 8233 - RNA, 22 nt, Escherichia coli CFT073
uaucaggccuacaugauuucug

SEQ ID NO: 8234 - RNA, 22 nt, Escherichia coli CFT073
uauccggccuacaaucauugca

SEQ ID NO: 8235 - RNA, 19 nt, Escherichia coli CFT073
uauccggccuccauaagag

SEQ ID NO: 8236 - RNA, 22 nt, Escherichia coli CFT073
uauccguuuauugaacuguuga

SEQ ID NO: 8237 - RNA, 22 nt, Escherichia coli CFT073
uaucgcuggcucccgcgccaau

SEQ ID NO: 8238 - RNA, 22 nt, Escherichia coli CFT073
uaucgucugauuaugaagagcg

SEQ ID NO: 8239 - RNA, 20 nt, Escherichia coli CFT073
uaucgugauuuguaaucgcc

SEQ ID NO: 8240 - RNA, 22 nt, Escherichia coli CFT073
uaucguuaauuggcgugacgau

SEQ ID NO: 8241 - RNA, 22 nt, Escherichia coli CFT073
uaucucaauuucucgcccuauc

SEQ ID NO: 8242 - RNA, 22 nt, Escherichia coli CFT073
uaucuccaguccaaaagagcug

SEQ ID NO: 8243 - RNA, 22 nt, Escherichia coli CFT073
uaucuggugugcccguaaaugu

SEQ ID NO: 8244 - RNA, 22 nt, Escherichia coli CFT073
uaugaugaugauggugggcaaa

SEQ ID NO: 8245 - RNA, 22 nt, Escherichia coli CFT073
uaugcaaaacugcggcgcauua

SEQ ID NO: 8246 - RNA, 22 nt, Escherichia coli CFT073
uaugcaguucuucuuccgacca

SEQ ID NO: 8247 - RNA, 22 nt, Escherichia coli CFT073
uauggcaaucaucgacaaacgu

SEQ ID NO: 8248 - RNA, 22 nt, Escherichia coli CFT073
uaugugggaagggaucggcgca

SEQ ID NO: 8249 - RNA, 21 nt, Escherichia coli CFT073
uauguguugugggaaacucgc

SEQ ID NO: 8250 - RNA, 22 nt, Escherichia coli CFT073
uauuaauggguugcguuguuga

SEQ ID NO: 8251 - RNA, 22 nt, Escherichia coli CFT073
uauuauguguuggguauacguc

SEQ ID NO: 8252 - RNA, 22 nt, Escherichia coli CFT073
uauucccauaaacucagaucua

SEQ ID NO: 8253 - RNA, 22 nt, Escherichia coli CFT073
uauugacuauacuuacgccauu

SEQ ID NO: 8254 - RNA, 22 nt, Escherichia coli CFT073
uauugcaaccguuuuugaggau

SEQ ID NO: 8255 - RNA, 22 nt, Escherichia coli CFT073
uauugcgcuuuaugucgcgugg

SEQ ID NO: 8256 - RNA, 22 nt, Escherichia coli CFT073
uauugcugggcaaucaggcgcu

SEQ ID NO: 8257 - RNA, 22 nt, Escherichia coli CFT073
uauuuauuuuuccugguucgcg

SEQ ID NO: 8258 - RNA, 19 nt, Escherichia coli CFT073
uauuucuccggauuuuuga

SEQ ID NO: 8259 - RNA, 22 nt, Escherichia coli CFT073
uauuucugccccgcaggucugg

SEQ ID NO: 8260 - RNA, 22 nt, Escherichia coli CFT073
uauuuuuacuuuguuccugcgc

SEQ ID NO: 8261 - RNA, 22 nt, Escherichia coli CFT073
ucaaacgguucaaucagaacag

SEQ ID NO: 8262 - RNA, 22 nt, Escherichia coli CFT073
ucaaccagaacauaucgccgcc

SEQ ID NO: 8263 - RNA, 22 nt, Escherichia coli CFT073
ucaacuucucgcuguuccaguc

SEQ ID NO: 8264 - RNA, 22 nt, Escherichia coli CFT073
ucaagcgaugcgccaaguuuua

SEQ ID NO: 8265 - RNA, 21 nt, Escherichia coli CFT073
ucaaugauggugccucgcugu

SEQ ID NO: 8266 - RNA, 20 nt, Escherichia coli CFT073
ucaccagcaucacggagcug

SEQ ID NO: 8267 - RNA, 22 nt, Escherichia coli CFT073
ucacccguguacgucugcaacu

SEQ ID NO: 8268 - RNA, 22 nt, Escherichia coli CFT073
ucaccguaugggucgcgguacc

SEQ ID NO: 8269 - RNA, 22 nt, Escherichia coli CFT073
ucaccuccacucccggccggau

SEQ ID NO: 8270 - RNA, 22 nt, Escherichia coli CFT073
ucaccugacgagcaaacugucg

SEQ ID NO: 8271 - RNA, 22 nt, Escherichia coli CFT073
ucaccugcauuuccgaacgcac

SEQ ID NO: 8272 - RNA, 20 nt, Escherichia coli CFT073
ucacgcggacggugguacgu

SEQ ID NO: 8273 - RNA, 22 nt, Escherichia coli CFT073
ucacugcaggacaacaguaaaa

SEQ ID NO: 8274 - RNA, 22 nt, Escherichia coli CFT073
ucacuggugagaagcaguauca

SEQ ID NO: 8275 - RNA, 22 nt, Escherichia coli CFT073
ucagaauauccggugaagugau

SEQ ID NO: 8276 - RNA, 22 nt, Escherichia coli CFT073
uuguuccagacaacaaucuguu

SEQ ID NO: 8277 - RNA, 22 nt, Escherichia coli CFT073
uuguugaugacgauauucaccu

SEQ ID NO: 8278 - RNA, 22 nt, Escherichia coli CFT073
uuguuucugcaauguuugaggg

SEQ ID NO: 8279 - RNA, 22 nt, Escherichia coli CFT073
uuuaaagauuccuuuguugcuc

SEQ ID NO: 8280 - RNA, 22 nt, Escherichia coli CFT073
uuuaccguggucgaugagcgca

SEQ ID NO: 8281 - RNA, 22 nt, Escherichia coli CFT073
uuuacgcauugcucaccucuca

SEQ ID NO: 8282 - RNA, 22 nt, Escherichia coli CFT073
uuuacuguuaaucugucaggga

SEQ ID NO: 8283 - RNA, 22 nt, Escherichia coli CFT073
uuuagcuuuugucguuggaaaa

SEQ ID NO: 8284 - RNA, 22 nt, Escherichia coli CFT073
uuuauaugaguguuguuauuac

SEQ ID NO: 8285 - RNA, 22 nt, Escherichia coli CFT073
uuuaucacccgcaugaugaugc

SEQ ID NO: 8286 - RNA, 22 nt, Escherichia coli CFT073
uuuaucgacaaaggccggauug

SEQ ID NO: 8287 - RNA, 22 nt, Escherichia coli CFT073
uuuaugcucauuuguaggucgg

SEQ ID NO: 8288 - RNA, 22 nt, Escherichia coli CFT073
uuuauggucaggaucgcucgcg

SEQ ID NO: 8289 - RNA, 22 nt, Escherichia coli CFT073
uuucaaaaugauaacuucgcaa

SEQ ID NO: 8290 - RNA, 22 nt, Escherichia coli CFT073
uuucacggucggccaguauuug

SEQ ID NO: 8291 - RNA, 22 nt, Escherichia coli CFT073
uuucaugagguguugauaucug

SEQ ID NO: 8292 - RNA, 22 nt, Escherichia coli CFT073
uuuccauauugucuuccagauc

SEQ ID NO: 8293 - RNA, 22 nt, Escherichia coli CFT073
uuucgcaucuuuguuaugcuau

SEQ ID NO: 8294 - RNA, 22 nt, Escherichia coli CFT073
uuucgcgacaaucuggcguuuu

SEQ ID NO: 8295 - RNA, 22 nt, Escherichia coli CFT073
uuucgucgugaaauggcuuaug

SEQ ID NO: 8296 - RNA, 22 nt, Escherichia coli CFT073
uuucuuguagauagucggcaaa

SEQ ID NO: 8297 - RNA, 22 nt, Escherichia coli CFT073
uuugaacgguuuguaggccgga

SEQ ID NO: 8298 - RNA, 22 nt, Escherichia coli CFT073
uuugaucuccuugccccacagc

SEQ ID NO: 8299 - RNA, 22 nt, Escherichia coli CFT073
uuugcaggccugauaagcguag

SEQ ID NO: 8300 - RNA, 22 nt, Escherichia coli CFT073
uuugccugauucgacgugcuca

SEQ ID NO: 8301 - RNA, 22 nt, Escherichia coli CFT073
uuuggcuucagcguuuugcagg

SEQ ID NO: 8302 - RNA, 22 nt, Escherichia coli CFT073
uuugguagcuaugucgcguuua

SEQ ID NO: 8303 - RNA, 17 nt, Escherichia coli CFT073
uuuguaggccggauaag

SEQ ID NO: 8304 - RNA, 22 nt, Escherichia coli CFT073
uuuguaggccggauaaggcguu

SEQ ID NO: 8305 - RNA, 22 nt, Escherichia coli CFT073
uuuguugaaagcaagaaagcuu

SEQ ID NO: 8306 - RNA, 22 nt, Escherichia coli CFT073
uuuuacgauauauccacagcca

SEQ ID NO: 8307 - RNA, 23 nt, Escherichia coli CFT073
uuuuacugaugucuggcggucgg

SEQ ID NO: 8308 - RNA, 22 nt, Escherichia coli CFT073
uuuuaucaguaauaccgugaau

SEQ ID NO: 8309 - RNA, 22 nt, Escherichia coli CFT073
uuuuccgguuaucaacuggccu

SEQ ID NO: 8310 - RNA, 22 nt, Escherichia coli CFT073
uuuuugacuuacucguaagccg

SEQ ID NO: 8311 - RNA, 22 nt, Escherichia coli CFT073
uuuuuggaucaugccagacacc

SEQ ID NO: 8312 - RNA, 22 nt, Escherichia coli CFT073
uuuuuuaucugaauguucugga

SEQ ID NO: 8313 - RNA, 22 nt, Haemophilus influenzae Rd
aaaaagccagcguuugaaacag

SEQ ID NO: 8314 - RNA, 22 nt, Haemophilus influenzae Rd
aaaaccuuucgaguguuuuauu

SEQ ID NO: 8315 - RNA, 22 nt, Haemophilus influenzae Rd
aaaaucacauuaaauaucgcug

SEQ ID NO: 8316 - RNA, 22 nt, Haemophilus influenzae Rd
aaacaucacaucagaaagauca

SEQ ID NO: 8317 - RNA, 22 nt, Haemophilus influenzae Rd
aaaccauuuggucauuucaauu

SEQ ID NO: 8318 - RNA, 19 nt, Haemophilus influenzae Rd
aaagauugaggaaagccaa

SEQ ID NO: 8319 - RNA, 22 nt, Haemophilus influenzae Rd
aaagggguggcugauaauugua

SEQ ID NO: 8320 - RNA, 22 nt, Haemophilus influenzae Rd
aaaguaaaaauagggcauugcg

SEQ ID NO: 8321 - RNA, 22 nt, Haemophilus influenzae Rd
aaagugauggcgacuguuggau

SEQ ID NO: 8322 - RNA, 21 nt, Haemophilus influenzae Rd
aaaucgcgauugguggcagug

SEQ ID NO: 8323 - RNA, 22 nt, Haemophilus influenzae Rd
aaauuagccguaguaucaacag

SEQ ID NO: 8324 - RNA, 22 nt, Haemophilus influenzae Rd
aacaaugccacugccauaacga

SEQ ID NO: 8325 - RNA, 20 nt, Haemophilus influenzae Rd
aacacggcauuguguuagga

SEQ ID NO: 8326 - RNA, 22 nt, Haemophilus influenzae Rd
aacagcuugaauuuauccgaac

SEQ ID NO: 8327 - RNA, 22 nt, Haemophilus influenzae Rd
aacccgaagaacuugauagagc

SEQ ID NO: 8328 - RNA, 22 nt, Haemophilus influenzae Rd
aacgcaauuacaggcacaauuu

SEQ ID NO: 8329 - RNA, 22 nt, Haemophilus influenzae Rd
aacuuaugauuucuauuuugaa

SEQ ID NO: 8330 - RNA, 22 nt, Haemophilus influenzae Rd
aacuugcacagauucuucaagc

SEQ ID NO: 8331 - RNA, 21 nt, Haemophilus influenzae Rd
aagaauagguuucaaacuugc

SEQ ID NO: 8332 - RNA, 22 nt, Haemophilus influenzae Rd
aagaauuacgcaacagcgguug

SEQ ID NO: 8333 - RNA, 22 nt, Haemophilus influenzae Rd
aagauugauaaccgaaaaccga

SEQ ID NO: 8334 - RNA, 22 nt, Haemophilus influenzae Rd
aagcaacugcugaacgcuuagg

SEQ ID NO: 8335 - RNA, 22 nt, Haemophilus influenzae Rd
aagccguacguuugcaaaaugc

SEQ ID NO: 8336 - RNA, 22 nt, Haemophilus influenzae Rd
aagccucaguuucuggaacagu

SEQ ID NO: 8337 - RNA, 16 nt, Haemophilus influenzae Rd
aagguuuuucagguaa

SEQ ID NO: 8338 - RNA, 19 nt, Haemophilus influenzae Rd
aagucuuaauaggugcuua

SEQ ID NO: 8339 - RNA, 22 nt, Haemophilus influenzae Rd
aagugcgguuaaaaaucucaca

SEQ ID NO: 8340 - RNA, 22 nt, Haemophilus influenzae Rd
aauauuguaagcucaucggguc

SEQ ID NO: 8341 - RNA, 22 nt, Haemophilus influenzae Rd
aaucaucgaccauuacgcguaa

SEQ ID NO: 8342 - RNA, 22 nt, Haemophilus influenzae Rd
aauccgcagauugaauugcaau

SEQ ID NO: 8343 - RNA, 22 nt, Haemophilus influenzae Rd
aauccguuuuuguagaaauaca

SEQ ID NO: 8344 - RNA, 19 nt, Haemophilus influenzae Rd
aaucuucuggacaacgagu

SEQ ID NO: 8345 - RNA, 22 nt, Haemophilus influenzae Rd
aaugaaagugcgguuaauuuga

SEQ ID NO: 8346 - RNA, 22 nt, Haemophilus influenzae Rd
aaugaguauucgcacccaugau

SEQ ID NO: 8347 - RNA, 22 nt, Haemophilus influenzae Rd
aaugccaacccguaacgcacgu

SEQ ID NO: 8348 - RNA, 22 nt, Haemophilus influenzae Rd
aauguuaaacauugaauugguu

SEQ ID NO: 8349 - RNA, 22 nt, Haemophilus influenzae Rd
aauuaaaacaucagguuuauua

SEQ ID NO: 8350 - RNA, 22 nt, Haemophilus influenzae Rd
aauucaacuugucgauaaaaug

SEQ ID NO: 8351 - RNA, 22 nt, Haemophilus influenzae Rd
aauucgugaacauacgcauuug

SEQ ID NO: 8352 - RNA, 22 nt, Haemophilus influenzae Rd
acacugaucgguaaucgacagc

SEQ ID NO: 8353 - RNA, 20 nt, Haemophilus influenzae Rd
accaaaugcaauuguagcaa

SEQ ID NO: 8354 - RNA, 22 nt, Haemophilus influenzae Rd
accacaagaaguaauggauaaa

SEQ ID NO: 8355 - RNA, 22 nt, Haemophilus influenzae Rd
accgaacuuucucacauuaaca

SEQ ID NO: 8356 - RNA, 22 nt, Haemophilus influenzae Rd
accgauuuuaaauucuccccga

SEQ ID NO: 8357 - RNA, 22 nt, Haemophilus influenzae Rd
accgcacuuuauucauuuuaga

SEQ ID NO: 8358 - RNA, 22 nt, Haemophilus influenzae Rd
acgagcgugguaucaacguuug

SEQ ID NO: 8359 - RNA, 22 nt, Haemophilus influenzae Rd
acgguagaagcggcagcgguaa

SEQ ID NO: 8360 - RNA, 22 nt, Haemophilus influenzae Rd
acggucggcaauauugguguua

SEQ ID NO: 8361 - RNA, 22 nt, Haemophilus influenzae Rd
acguauugaauguggcgauuuu

SEQ ID NO: 8362 - RNA, 22 nt, Haemophilus influenzae Rd
acuaaccuagaguauacuaccc

SEQ ID NO: 8363 - RNA, 22 nt, Haemophilus influenzae Rd
acuuuauaaguugcggguuuuu

SEQ ID NO: 8364 - RNA, 22 nt, Haemophilus influenzae Rd
agaaaucaaauuugcugauucc

SEQ ID NO: 8365 - RNA, 22 nt, Haemophilus influenzae Rd
agaaaugcaagcgauguguuuu

SEQ ID NO: 8366 - RNA, 22 nt, Haemophilus influenzae Rd
agaaauggguucguuauuggcu

SEQ ID NO: 8367 - RNA, 22 nt, Haemophilus influenzae Rd
agaaccaauggcagcugcaauu

SEQ ID NO: 8368 - RNA, 23 nt, Haemophilus influenzae Rd
agaacuucauccgcguaccuugg

SEQ ID NO: 8369 - RNA, 22 nt, Haemophilus influenzae Rd
agauaaauuuauuacuaaaagu

SEQ ID NO: 8370 - RNA, 22 nt, Haemophilus influenzae Rd
agcaacuuuuacuuuaaugagu

SEQ ID NO: 8371 - RNA, 22 nt, Haemophilus influenzae Rd
agcaguggaguuugcuggaauu

SEQ ID NO: 8372 - RNA, 22 nt, Haemophilus influenzae Rd
agccaaguagggcaaaagugcg

SEQ ID NO: 8373 - RNA, 22 nt, Haemophilus influenzae Rd
agccagaugcaaaaucaauggc

SEQ ID NO: 8374 - RNA, 22 nt, Haemophilus influenzae Rd
agcgaaacuuuaugcugaucca

SEQ ID NO: 8375 - RNA, 22 nt, Haemophilus influenzae Rd
agcugauauugccauuauccau

SEQ ID NO: 8376 - RNA, 21 nt, Haemophilus influenzae Rd
agcuuuuaccgugggcgacca

SEQ ID NO: 8377 - RNA, 22 nt, Haemophilus influenzae Rd
aggcaguaacucaaucucgauc

SEQ ID NO: 8378 - RNA, 22 nt, Haemophilus influenzae Rd
aggcguguuagaacuuguucgu

SEQ ID NO: 8379 - RNA, 21 nt, Haemophilus influenzae Rd
aggugcaguggaugcugcaau

SEQ ID NO: 8380 - RNA, 23 nt, Haemophilus influenzae Rd
agguggucuuuauuuucgaugaa

SEQ ID NO: 8381 - RNA, 22 nt, Haemophilus influenzae Rd
aguaaaauaggcuauuuugagc

SEQ ID NO: 8382 - RNA, 22 nt, Haemophilus influenzae Rd
aguacgaauauggucagacacg

SEQ ID NO: 8383 - RNA, 22 nt, Haemophilus influenzae Rd
agucguagccuaauucuguugc

SEQ ID NO: 8384 - RNA, 22 nt, Haemophilus influenzae Rd
agugggguauucugucagcggu

SEQ ID NO: 8385 - RNA, 21 nt, Haemophilus influenzae Rd
aguguauuucauuacauaagc

SEQ ID NO: 8386 - RNA, 22 nt, Haemophilus influenzae Rd
aguguugauaaauuucgucgug

SEQ ID NO: 8387 - RNA, 19 nt, Haemophilus influenzae Rd
auaagcagaauuuuggauu

SEQ ID NO: 8388 - RNA, 22 nt, Haemophilus influenzae Rd
auacaauauuggcuaugaugca

SEQ ID NO: 8389 - RNA, 22 nt, Haemophilus influenzae Rd
auagcuaauuaucuucgauuuu

SEQ ID NO: 8390 - RNA, 22 nt, Haemophilus influenzae Rd
auaugcuuaaagugaaacagaa

SEQ ID NO: 8391 - RNA, 22 nt, Haemophilus influenzae Rd
auauggucaagauacuuuggaa

SEQ ID NO: 8392 - RNA, 22 nt, Haemophilus influenzae Rd
auauugcguauuuuggaaucau

SEQ ID NO: 8393 - RNA, 22 nt, Haemophilus influenzae Rd
aucaacuugcuaaagauuuagu

SEQ ID NO: 8394 - RNA, 22 nt, Haemophilus influenzae Rd
aucaguggcaugguaauagcca

SEQ ID NO: 8395 - RNA, 22 nt, Haemophilus influenzae Rd
aucauuuaaccuaucuugcuga

SEQ ID NO: 8396 - RNA, 22 nt, Haemophilus influenzae Rd
auccgcuuaaggaucuugacca

SEQ ID NO: 8397 - RNA, 22 nt, Haemophilus influenzae Rd
aucgcgugcuuguuucagcgug

SEQ ID NO: 8398 - RNA, 22 nt, Haemophilus influenzae Rd
aucgugaagaaggucgcggaau

SEQ ID NO: 8399 - RNA, 22 nt, Haemophilus influenzae Rd
augaaauuugccacaacaaucu

SEQ ID NO: 8400 - RNA, 22 nt, Haemophilus influenzae Rd
augaacaaaguaaauucaaucg

SEQ ID NO: 8401 - RNA, 22 nt, Haemophilus influenzae Rd
augacuuaugccuucguaaaua

SEQ ID NO: 8402 - RNA, 22 nt, Haemophilus influenzae Rd
augaugaaagccguacgcauuu

SEQ ID NO: 8403 - RNA, 22 nt, Haemophilus influenzae Rd
augcucgccauuugcgugaugc

SEQ ID NO: 8404 - RNA, 22 nt, Haemophilus influenzae Rd
augcuuuaauugaagguguaga

SEQ ID NO: 8405 - RNA, 22 nt, Haemophilus influenzae Rd
auggcaagauauaauaaaccug

SEQ ID NO: 8406 - RNA, 22 nt, Haemophilus influenzae Rd
augguugguugccacucuuuga

SEQ ID NO: 8407 - RNA, 22 nt, Haemophilus influenzae Rd
auguauuccguucaagaacaaa

SEQ ID NO: 8408 - RNA, 22 nt, Haemophilus influenzae Rd
auguauuuaccgauuuugguug

SEQ ID NO: 8409 - RNA, 20 nt, Haemophilus influenzae Rd
auuaaagugcgguuauuuuu

SEQ ID NO: 8410 - RNA, 22 nt, Haemophilus influenzae Rd
auuacgccccauuuguguaaga

SEQ ID NO: 8411 - RNA, 22 nt, Haemophilus influenzae Rd
auuacguuuuagcaagguaauu

SEQ ID NO: 8412 - RNA, 22 nt, Haemophilus influenzae Rd
auucagaaauggcgaagccuau

SEQ ID NO: 8413 - RNA, 22 nt, Haemophilus influenzae Rd
auugcguggauuaaugaaucca

SEQ ID NO: 8414 - RNA, 22 nt, Haemophilus influenzae Rd
auuguagggugggcuuuagccc

SEQ ID NO: 8415 - RNA, 22 nt, Haemophilus influenzae Rd
auuguguuagcccgugaaauga

SEQ ID NO: 8416 - RNA, 22 nt, Haemophilus influenzae Rd
auuuaaaauggcaucggcuugu

SEQ ID NO: 8417 - RNA, 22 nt, Haemophilus influenzae Rd
auuuaacgccaagccguggcuu

SEQ ID NO: 8418 - RNA, 22 nt, Haemophilus influenzae Rd
auuuacguuaugggagcaaaug

SEQ ID NO: 8419 - RNA, 22 nt, Haemophilus influenzae Rd
auuuaguauucguucauuucga

SEQ ID NO: 8420 - RNA, 21 nt, Haemophilus influenzae Rd
auuuaucgauuucgaucuuaa

SEQ ID NO: 8421 - RNA, 22 nt, Haemophilus influenzae Rd
auuuauuugcaggcgaagugga

SEQ ID NO: 8422 - RNA, 22 nt, Haemophilus influenzae Rd
auuuuacgcguagcacgucacu

SEQ ID NO: 8423 - RNA, 22 nt, Haemophilus influenzae Rd
auuuuccagcucugcugcgaaa

SEQ ID NO: 8424 - RNA, 22 nt, Haemophilus influenzae Rd
caaaauuuagcugccuuguugc

SEQ ID NO: 8425 - RNA, 21 nt, Haemophilus influenzae Rd
caacaacgccauaaucuuacc

SEQ ID NO: 8426 - RNA, 22 nt, Haemophilus influenzae Rd
caaccugugaugguuucuuuua

SEQ ID NO: 8427 - RNA, 22 nt, Haemophilus influenzae Rd
caacuugcacauuuucaucgcc

SEQ ID NO: 8428 - RNA, 22 nt, Haemophilus influenzae Rd
caaggcuuucgcggguucuuuu

SEQ ID NO: 8429 - RNA, 22 nt, Haemophilus influenzae Rd
caccaaauuaacgcccauuuuu

SEQ ID NO: 8430 - RNA, 22 nt, Haemophilus influenzae Rd
cacguucaagaguuaccugugu

SEQ ID NO: 8431 - RNA, 22 nt, Haemophilus influenzae Rd
cacuagaacaguuuuagaaugc

SEQ ID NO: 8432 - RNA, 22 nt, Haemophilus influenzae Rd
cacuuuggcaaggaauuucaca

SEQ ID NO: 8433 - RNA, 22 nt, Haemophilus influenzae Rd
cagaagaaaacuacaaaggucg

SEQ ID NO: 8434 - RNA, 20 nt, Haemophilus influenzae Rd
cagaaggucgaauuucgcgg

SEQ ID NO: 8435 - RNA, 22 nt, Haemophilus influenzae Rd
cagcuauugcugacuuugauau

SEQ ID NO: 8436 - RNA, 22 nt, Haemophilus influenzae Rd
cagugauagaacagauccugaa

SEQ ID NO: 8437 - RNA, 22 nt, Haemophilus influenzae Rd
cauuaggcaauauugccgagcg

SEQ ID NO: 8438 - RNA, 22 nt, Haemophilus influenzae Rd
ccaucuuguaauuguagaaagu

SEQ ID NO: 8439 - RNA, 22 nt, Haemophilus influenzae Rd
ccccuucaaauauaacgacguu

SEQ ID NO: 8440 - RNA, 22 nt, Haemophilus influenzae Rd
ccccuuccgcccuucgggcacc

SEQ ID NO: 8441 - RNA, 22 nt, Haemophilus influenzae Rd
cgagaaaaagcggauaaacucg

SEQ ID NO: 8442 - RNA, 22 nt, Haemophilus influenzae Rd
cgcaaaaacuucuaugguaaau

SEQ ID NO: 8443 - RNA, 22 nt, Haemophilus influenzae Rd
cgccaaaucggcuuggauuacg

SEQ ID NO: 8444 - RNA, 20 nt, Haemophilus influenzae Rd
cgccacauauuucuaaagau

SEQ ID NO: 8445 - RNA, 22 nt, Haemophilus influenzae Rd
cgcguauugcugauguguuacu

SEQ ID NO: 8446 - RNA, 22 nt, Haemophilus influenzae Rd
cggcacagaacaauuagaagaa

SEQ ID NO: 8447 - RNA, 21 nt, Haemophilus influenzae Rd
cggcuuaucauccugaaucuc

SEQ ID NO: 8448 - RNA, 22 nt, Haemophilus influenzae Rd
cggguuuagguuuaaaucaagu

SEQ ID NO: 8449 - RNA, 22 nt, Haemophilus influenzae Rd
uaagagcguggcuaaagcccac

SEQ ID NO: 8450 - RNA, 22 nt, Haemophilus influenzae Rd
uaaggcauccauuaacauuaca

SEQ ID NO: 8451 - RNA, 22 nt, Haemophilus influenzae Rd
uaauauaacggacguagaugac

SEQ ID NO: 8452 - RNA, 22 nt, Haemophilus influenzae Rd
uaauguagggugggcuuuagcc

SEQ ID NO: 8453 - RNA, 22 nt, Haemophilus influenzae Rd
uacaaauaauagccaucggcaa

SEQ ID NO: 8454 - RNA, 22 nt, Haemophilus influenzae Rd
uacugcgauuccauuagccgcu

SEQ ID NO: 8455 - RNA, 22 nt, Haemophilus influenzae Rd
uagaauuuaaugauauuugcca

SEQ ID NO: 8456 - RNA, 22 nt, Haemophilus influenzae Rd
uagcggaaauugaucgcauuga

SEQ ID NO: 8457 - RNA, 22 nt, Haemophilus influenzae Rd
uagcuauuauugcgcauccauu

SEQ ID NO: 8458 - RNA, 22 nt, Haemophilus influenzae Rd
aaaaaaagaggcgugauuauag

SEQ ID NO: 8459 - RNA, 22 nt, Haemophilus influenzae Rd
aaaaaguuauguucgccuuucu

SEQ ID NO: 8460 - RNA, 22 nt, Haemophilus influenzae Rd
aaaaaugaccgcacuuuaguuu

SEQ ID NO: 8461 - RNA, 22 nt, Haemophilus influenzae Rd
aaaacgcauuccagugauucaa

SEQ ID NO: 8462 - RNA, 18 nt, Haemophilus influenzae Rd
aaaaucuuuggaauuggc

SEQ ID NO: 8463 - RNA, 22 nt, Haemophilus influenzae Rd
aaacccucuguuuaaguagcga

SEQ ID NO: 8464 - RNA, 23 nt, Haemophilus influenzae Rd
aaacgcaccgcacuuuuggagug

SEQ ID NO: 8465 - RNA, 22 nt, Haemophilus influenzae Rd
aaagucccucaauagaauccac

SEQ ID NO: 8466 - RNA, 22 nt, Haemophilus influenzae Rd
aaauauugugacaaaugauauu

SEQ ID NO: 8467 - RNA, 22 nt, Haemophilus influenzae Rd
aaauuguaauuguuccaaugaa

SEQ ID NO: 8468 - RNA, 22 nt, Haemophilus influenzae Rd
aacggcacgucauuguucccga

SEQ ID NO: 8469 - RNA, 22 nt, Haemophilus influenzae Rd
aacguuuugcugaagaugcggg

SEQ ID NO: 8470 - RNA, 22 nt, Haemophilus influenzae Rd
aagaaugucguacuagaaaaaa

SEQ ID NO: 8471 - RNA, 22 nt, Haemophilus influenzae Rd
aagcagaacaaaugagcgauuu

SEQ ID NO: 8472 - RNA, 22 nt, Haemophilus influenzae Rd
aagccagcaacagauuuacgag

SEQ ID NO: 8473 - RNA, 22 nt, Haemophilus influenzae Rd
aagcgaagaaaggcuuugccuu

SEQ ID NO: 8474 - RNA, 20 nt, Haemophilus influenzae Rd
aagcgugguuaauuuuuaua

SEQ ID NO: 8475 - RNA, 22 nt, Haemophilus influenzae Rd
aagcugauugugcguagggcaa

SEQ ID NO: 8476 - RNA, 22 nt, Haemophilus influenzae Rd
aaggaaugugaauuucgguuua

SEQ ID NO: 8477 - RNA, 22 nt, Haemophilus influenzae Rd
aaggaucgaaagcugaauguug

SEQ ID NO: 8478 - RNA, 22 nt, Haemophilus influenzae Rd
aaguacaaaagagcgguugaaa

SEQ ID NO: 8479 - RNA, 22 nt, Haemophilus influenzae Rd
aaguuugaaaacggcgauaaau

SEQ ID NO: 8480 - RNA, 22 nt, Haemophilus influenzae Rd
aaguuuuucauauaacguugac

SEQ ID NO: 8481 - RNA, 22 nt, Haemophilus influenzae Rd
aauaaauugaagcaauugguug

SEQ ID NO: 8482 - RNA, 22 nt, Haemophilus influenzae Rd
aauaacaugguacgagaugcgu

SEQ ID NO: 8483 - RNA, 22 nt, Haemophilus influenzae Rd
aauaugccuucuuccaagcuaa

SEQ ID NO: 8484 - RNA, 22 nt, Haemophilus influenzae Rd
aaucaaccaaugggcgaaaaug

SEQ ID NO: 8485 - RNA, 22 nt, Haemophilus influenzae Rd
aauccgugcuuauucuuuacaa

SEQ ID NO: 8486 - RNA, 22 nt, Haemophilus influenzae Rd
aaucugcgcaaucugcaacaag

SEQ ID NO: 8487 - RNA, 22 nt, Haemophilus influenzae Rd
aaucuuaauagucaugaagggc

SEQ ID NO: 8488 - RNA, 22 nt, Haemophilus influenzae Rd
aaugauaauguggccaacguuu

SEQ ID NO: 8489 - RNA, 22 nt, Haemophilus influenzae Rd
aaugauguggaauaugcagggc

SEQ ID NO: 8490 - RNA, 22 nt, Haemophilus influenzae Rd
aaugcuuuaccauaauuugcac

SEQ ID NO: 8491 - RNA, 22 nt, Haemophilus influenzae Rd
agguuuugucuagauaaagugc

SEQ ID NO: 8492 - RNA, 22 nt, Haemophilus influenzae Rd
aguaauaguaauauuagcgacu

SEQ ID NO: 8493 - RNA, 22 nt, Haemophilus influenzae Rd
aguuaaaguuguugguucaggu

SEQ ID NO: 8494 - RNA, 22 nt, Haemophilus influenzae Rd
aguuacugcauuagguucugug

SEQ ID NO: 8495 - RNA, 22 nt, Haemophilus influenzae Rd
aguucauucagcguagauugau

SEQ ID NO: 8496 - RNA, 22 nt, Haemophilus influenzae Rd
aguuggaaauauugaucaaggg

SEQ ID NO: 8497 - RNA, 22 nt, Haemophilus influenzae Rd
aguuguagauauuauuaaagaa

SEQ ID NO: 8498 - RNA, 22 nt, Haemophilus influenzae Rd
aguuuaccaaauaugguagaac

SEQ ID NO: 8499 - RNA, 22 nt, Haemophilus influenzae Rd
aguuuguaaucuuuacgacgcc

SEQ ID NO: 8500 - RNA, 22 nt, Haemophilus influenzae Rd
auacaaugaucguuuguacuug

SEQ ID NO: 8501 - RNA, 22 nt, Haemophilus influenzae Rd
auagccuuggguaauuaacauu

SEQ ID NO: 8502 - RNA, 22 nt, Haemophilus influenzae Rd
auaggauggguuucugcccacc

SEQ ID NO: 8503 - RNA, 22 nt, Haemophilus influenzae Rd
auagguuuuuucugcaucagga

SEQ ID NO: 8504 - RNA, 22 nt, Haemophilus influenzae Rd
auaugcguauuuagauaaggau

SEQ ID NO: 8505 - RNA, 22 nt, Haemophilus influenzae Rd
auauucuuauugcaacuuaugc

SEQ ID NO: 8506 - RNA, 22 nt, Haemophilus influenzae Rd
auauuucacaaugucagaagau

SEQ ID NO: 8507 - RNA, 22 nt, Haemophilus influenzae Rd
aucaacaacgcauucugaccca

SEQ ID NO: 8508 - RNA, 22 nt, Haemophilus influenzae Rd
aucaaguagcuggcgcauugac

SEQ ID NO: 8509 - RNA, 22 nt, Haemophilus influenzae Rd
aucgaccgaaaaaacuuuccuu

SEQ ID NO: 8510 - RNA, 22 nt, Haemophilus influenzae Rd
aucgcauugauaauaaguuguu

SEQ ID NO: 8511 - RNA, 22 nt, Haemophilus influenzae Rd
aucguuuuaaucauauuggaac

SEQ ID NO: 8512 - RNA, 19 nt, Haemophilus influenzae Rd
augaauggcaauuuagcuu

SEQ ID NO: 8513 - RNA, 22 nt, Haemophilus influenzae Rd
augacuuuagugggauugucgg

SEQ ID NO: 8514 - RNA, 22 nt, Haemophilus influenzae Rd
augauccuauucauaucguagg

SEQ ID NO: 8515 - RNA, 22 nt, Haemophilus influenzae Rd
augcgguugcaauacguuuuac

SEQ ID NO: 8516 - RNA, 22 nt, Haemophilus influenzae Rd
augguugguuacgugcagaaag

SEQ ID NO: 8517 - RNA, 22 nt, Haemophilus influenzae Rd
auguuguaaaguucgcaaacau

SEQ ID NO: 8518 - RNA, 22 nt, Haemophilus influenzae Rd
auuaaucauauuuugccuagcg

SEQ ID NO: 8519 - RNA, 22 nt, Haemophilus influenzae Rd
auuacagaaacaccuugauuga

SEQ ID NO: 8520 - RNA, 22 nt, Haemophilus influenzae Rd
auuacgucagagaaaucaauau

SEQ ID NO: 8521 - RNA, 22 nt, Haemophilus influenzae Rd
auuacuuauaugaucauagccu

SEQ ID NO: 8522 - RNA, 22 nt, Haemophilus influenzae Rd
auuagcaggguuaucucgcaaa

SEQ ID NO: 8523 - RNA, 22 nt, Haemophilus influenzae Rd
auuauuugaugaaccaacggcu

SEQ ID NO: 8524 - RNA, 22 nt, Haemophilus influenzae Rd
auucguauuaccuuaaacaaga

SEQ ID NO: 8525 - RNA, 22 nt, Haemophilus influenzae Rd
auugcagccaguguauuugugg

SEQ ID NO: 8526 - RNA, 22 nt, Haemophilus influenzae Rd
auugcucuauuuuuaauuguga

SEQ ID NO: 8527 - RNA, 22 nt, Haemophilus influenzae Rd
auuguucuaauaauugaugcgu

SEQ ID NO: 8528 - RNA, 22 nt, Haemophilus influenzae Rd
auuuacguauugauguuuaucg

SEQ ID NO: 8529 - RNA, 22 nt, Haemophilus influenzae Rd
auuucagcucguuuaggagaua

SEQ ID NO: 8530 - RNA, 19 nt, Haemophilus influenzae Rd
auuuucuaccaacauugca

SEQ ID NO: 8531 - RNA, 21 nt, Haemophilus influenzae Rd
auuuuugcauaauaccgacua

SEQ ID NO: 8532 - RNA, 22 nt, Haemophilus influenzae Rd
auuuuugugaaaucucaucagg

SEQ ID NO: 8533 - RNA, 22 nt, Haemophilus influenzae Rd
caaauuguguugaugaaauugg

SEQ ID NO: 8534 - RNA, 22 nt, Haemophilus influenzae Rd
caacaauuuuugacaauaaggg

SEQ ID NO: 8535 - RNA, 22 nt, Haemophilus influenzae Rd
caacggcuauuucuuggacaaa

SEQ ID NO: 8536 - RNA, 22 nt, Haemophilus influenzae Rd
caaggcaaaaaauuucgcugaa

SEQ ID NO: 8537 - RNA, 22 nt, Haemophilus influenzae Rd
caauaaagaagcucucugcguu

SEQ ID NO: 8538 - RNA, 22 nt, Haemophilus influenzae Rd
caauauucguuacugaaagagc

SEQ ID NO: 8539 - RNA, 22 nt, Haemophilus influenzae Rd
caaugccacauuuagacgauua

SEQ ID NO: 8540 - RNA, 22 nt, Haemophilus influenzae Rd
caauuuaucuugaucuagggcu

SEQ ID NO: 8541 - RNA, 22 nt, Haemophilus influenzae Rd
cacaagauaaagauauuaaaca

SEQ ID NO: 8542 - RNA, 22 nt, Haemophilus influenzae Rd
caccauauuuaauaaaguaaau

SEQ ID NO: 8543 - RNA, 22 nt, Haemophilus influenzae Rd
cacugaugcccaaaaauaacgu

SEQ ID NO: 8544 - RNA, 22 nt, Haemophilus influenzae Rd
cagcccugugccuuauaucucc

SEQ ID NO: 8545 - RNA, 22 nt, Haemophilus influenzae Rd
cagcgcaaugucuuuaccugau

SEQ ID NO: 8546 - RNA, 22 nt, Haemophilus influenzae Rd
caggugguuagagcgcaccccu

SEQ ID NO: 8547 - RNA, 22 nt, Haemophilus influenzae Rd
caguaacaauaguuuuaacauu

SEQ ID NO: 8548 - RNA, 22 nt, Haemophilus influenzae Rd
cauaucaaugcuaccauuguug

SEQ ID NO: 8549 - RNA, 22 nt, Haemophilus influenzae Rd
caucuuguuuuuaugccugaaa

SEQ ID NO: 8550 - RNA, 22 nt, Haemophilus influenzae Rd
cauggcauugaaggcauugaua

SEQ ID NO: 8551 - RNA, 20 nt, Haemophilus influenzae Rd
cauuaguggcauuaaaucag

SEQ ID NO: 8552 - RNA, 22 nt, Haemophilus influenzae Rd
cauugcugauuucgucagugag

SEQ ID NO: 8553 - RNA, 22 nt, Haemophilus influenzae Rd
ccacuuauuuugguucaguugc

SEQ ID NO: 8554 - RNA, 22 nt, Haemophilus influenzae Rd
ccauauugccccuaauguacua

SEQ ID NO: 8555 - RNA, 22 nt, Haemophilus influenzae Rd
ccgcacuuuuuguucauauucu

SEQ ID NO: 8556 - RNA, 22 nt, Haemophilus influenzae Rd
ccguuagaugcuggaaaugacg

SEQ ID NO: 8557 - RNA, 22 nt, Haemophilus influenzae Rd
cgaguuauuagugguaauacug

SEQ ID NO: 8558 - RNA, 22 nt, Haemophilus influenzae Rd
cgauauaaccuucagcagcuaa

SEQ ID NO: 8559 - RNA, 22 nt, Haemophilus influenzae Rd
cgccaauauuuaaugcaauuuu

SEQ ID NO: 8560 - RNA, 22 nt, Haemophilus influenzae Rd
cgccuuguuccguuaaaauuug

SEQ ID NO: 8561 - RNA, 23 nt, Haemophilus influenzae Rd
cgcuugucaucguuauuuuucag

SEQ ID NO: 8562 - RNA, 18 nt, Haemophilus influenzae Rd
cggcauuuuuucuuccua

SEQ ID NO: 8563 - RNA, 22 nt, Haemophilus influenzae Rd
cgguugauuuuguuugaauaau

SEQ ID NO: 8564 - RNA, 22 nt, Haemophilus influenzae Rd
cgucaaucaauuggaaauccgc

SEQ ID NO: 8565 - RNA, 22 nt, Haemophilus influenzae Rd
cguuauuauucaaguuuaaaua

SEQ ID NO: 8566 - RNA, 22 nt, Haemophilus influenzae Rd
cguuuauuccauugaugaaaga

SEQ ID NO: 8567 - RNA, 22 nt, Haemophilus influenzae Rd
cuauucuaaauucuuguucgau

SEQ ID NO: 8568 - RNA, 22 nt, Haemophilus influenzae Rd
cugaugugggucagcaucaaau

SEQ ID NO: 8569 - RNA, 22 nt, Haemophilus influenzae Rd
cuggguuagauaaaguccaguu

SEQ ID NO: 8570 - RNA, 22 nt, Haemophilus influenzae Rd
cuggguuugcuuuugagaaugc

SEQ ID NO: 8571 - RNA, 22 nt, Haemophilus influenzae Rd
cugguuuaggcucuagugcuug

SEQ ID NO: 8572 - RNA, 18 nt, Haemophilus influenzae Rd
cuguaccgaauucacgau

SEQ ID NO: 8573 - RNA, 22 nt, Haemophilus influenzae Rd
cuucaguuguuaguuuagucac

SEQ ID NO: 8574 - RNA, 19 nt, Haemophilus influenzae Rd
cuugauacaaugcuucauu

SEQ ID NO: 8575 - RNA, 22 nt, Haemophilus influenzae Rd
cuuggguucauuugaaaugagu

SEQ ID NO: 8576 - RNA, 22 nt, Haemophilus influenzae Rd
uugagauuuucgacaccuaaau

SEQ ID NO: 8577 - RNA, 22 nt, Haemophilus influenzae Rd
uugauuuacgguaacgguauca

SEQ ID NO: 8578 - RNA, 22 nt, Haemophilus influenzae Rd
uugauuucguccucacucgccc

SEQ ID NO: 8579 - RNA, 21 nt, Haemophilus influenzae Rd
uugcaaggcuugaaucauugc

SEQ ID NO: 8580 - RNA, 22 nt, Haemophilus influenzae Rd
uugcucuauuuuagcagaagau

SEQ ID NO: 8581 - RNA, 22 nt, Haemophilus influenzae Rd
uuggcuuaucaguaaauguacu

SEQ ID NO: 8582 - RNA, 22 nt, Haemophilus influenzae Rd
uugggcaaauguaauuugccua

SEQ ID NO: 8583 - RNA, 22 nt, Haemophilus influenzae Rd
uugggcaagagucgaugccaag

SEQ ID NO: 8584 - RNA, 22 nt, Haemophilus influenzae Rd
uugguaaaagaugggcgagauc

SEQ ID NO: 8585 - RNA, 21 nt, Haemophilus influenzae Rd
uugguagaguaaauucucggu

SEQ ID NO: 8586 - RNA, 22 nt, Haemophilus influenzae Rd
uugguuaagugaaagugaaaac

SEQ ID NO: 8587 - RNA, 20 nt, Haemophilus influenzae Rd
uugguucuggcgagcuaaag

SEQ ID NO: 8588 - RNA, 22 nt, Haemophilus influenzae Rd
uuguaacuggcuuuuaucugua

SEQ ID NO: 8589 - RNA, 22 nt, Haemophilus influenzae Rd
uuguaauguugaaaggguuugc

SEQ ID NO: 8590 - RNA, 22 nt, Haemophilus influenzae Rd
uuguaauuuaagcacuugaagc

SEQ ID NO: 8591 - RNA, 22 nt, Haemophilus influenzae Rd
uugugaaauuugcauuuggaau

SEQ ID NO: 8592 - RNA, 22 nt, Haemophilus influenzae Rd
uugugaaguaaugacuauucgc

SEQ ID NO: 8593 - RNA, 20 nt, Haemophilus influenzae Rd
uuguucuggcgugauuguuu

SEQ ID NO: 8594 - RNA, 22 nt, Haemophilus influenzae Rd
uuguugcguacuggaugaaccc

SEQ ID NO: 8595 - RNA, 22 nt, Haemophilus influenzae Rd
uuuaaccgcacuuggguuucaa

SEQ ID NO: 8596 - RNA, 22 nt, Haemophilus influenzae Rd
uuuagccaacggauuagaugaa

SEQ ID NO: 8597 - RNA, 22 nt, Haemophilus influenzae Rd
uuuaugaaggugcauuuggguu

SEQ ID NO: 8598 - RNA, 22 nt, Haemophilus influenzae Rd
uuuauggguugcuucuacugau

SEQ ID NO: 8599 - RNA, 22 nt, Haemophilus influenzae Rd
uuuauuaggaaguuacaucaug

SEQ ID NO: 8600 - RNA, 22 nt, Haemophilus influenzae Rd
uuucacuaagcguggauucaca

SEQ ID NO: 8601 - RNA, 22 nt, Haemophilus influenzae Rd
uuucagaaggugacaauguuuu

SEQ ID NO: 8602 - RNA, 22 nt, Haemophilus influenzae Rd
uuucuuccauugacucuucaga

SEQ ID NO: 8603 - RNA, 22 nt, Haemophilus influenzae Rd
uuugaagaauggcgguaacauu

SEQ ID NO: 8604 - RNA, 22 nt, Haemophilus influenzae Rd
uuugagcaaaguaaguugaauu

SEQ ID NO: 8605 - RNA, 19 nt, Haemophilus influenzae Rd
uuugaguaacggaauauug

SEQ ID NO: 8606 - RNA, 22 nt, Haemophilus influenzae Rd
uuugcagaaauuuaaauuagau

SEQ ID NO: 8607 - RNA, 22 nt, Haemophilus influenzae Rd
uuuguauuagcaaugccguugu

SEQ ID NO: 8608 - RNA, 22 nt, Haemophilus influenzae Rd
uuuuaaccgcacuuucaucuuc

SEQ ID NO: 8609 - RNA, 22 nt, Haemophilus influenzae Rd
uuuucguagauucugcauuugu

SEQ ID NO: 8610 - RNA, 22 nt, Haemophilus influenzae Rd
uuuugcaccaagcuguuguaau

SEQ ID NO: 8611 - RNA, 22 nt, Haemophilus influenzae Rd
uuuugcuucuucucgugauggu

SEQ ID NO: 8612 - RNA, 22 nt, Haemophilus influenzae Rd
uuuuguaguauccauucauuug

SEQ ID NO: 8613 - RNA, 22 nt, Haemophilus influenzae Rd
uuuuucuucccaaccuaaacga

SEQ ID NO: 8614 - RNA, 22 nt, Haemophilus influenzae Rd
uuuuugccgaucgacauuauau

SEQ ID NO: 8615 - RNA, 22 nt, Haemophilus influenzae Rd
uuagcgcaauaugcggauuuaa

SEQ ID NO: 8616 - RNA, 22 nt, Haemophilus influenzae Rd
uuagcuggugggguuuagcuuu

SEQ ID NO: 8617 - RNA, 22 nt, Haemophilus influenzae Rd
uuagcuuggaagaaggcauauu

SEQ ID NO: 8618 - RNA, 22 nt, Haemophilus influenzae Rd
uuauaguuccaaccuuuuuagu

SEQ ID NO: 8619 - RNA, 22 nt, Haemophilus influenzae Rd
uuauuagaacaauuggaaacgg

SEQ ID NO: 8620 - RNA, 22 nt, Haemophilus influenzae Rd
uucaauaucuacuaaacguggu

SEQ ID NO: 8621 - RNA, 22 nt, Haemophilus influenzae Rd
uucagcaaguuuuuccuguuga

SEQ ID NO: 8622 - RNA, 22 nt, Haemophilus influenzae Rd
uucaggcuguaguaaugaugau

SEQ ID NO: 8623 - RNA, 22 nt, Haemophilus influenzae Rd
uucaucgcuuuaauagcugaaa

SEQ ID NO: 8624 - RNA, 22 nt, Haemophilus influenzae Rd
uuccaucuggcaaugcggugcg

SEQ ID NO: 8625 - RNA, 22 nt, Haemophilus influenzae Rd
uucgauuagugaucaaugcugg

SEQ ID NO: 8626 - RNA, 22 nt, Haemophilus influenzae Rd
uucuccuugcugauuauaauaa

SEQ ID NO: 8627 - RNA, 22 nt, Haemophilus influenzae Rd
uucuguugcuuucgucuuguau

SEQ ID NO: 8628 - RNA, 21 nt, Haemophilus influenzae Rd
uucuuucguuuguccaggcaa

SEQ ID NO: 8629 - RNA, 22 nt, Haemophilus influenzae Rd
uugaaacuuuugaagaagguaa

SEQ ID NO: 8630 - RNA, 22 nt, Haemophilus influenzae Rd
uugauauugaagugaaugaaca

SEQ ID NO: 8631 - RNA, 22 nt, Haemophilus influenzae Rd
uugaugcggcaggauuaucagg

SEQ ID NO: 8632 - RNA, 21 nt, Haemophilus influenzae Rd
uugauugcaauguugugcuga

SEQ ID NO: 8633 - RNA, 19 nt, Haemophilus influenzae Rd
uugauuucuuccauggaaa

SEQ ID NO: 8634 - RNA, 22 nt, Haemophilus influenzae Rd
uugcaagaaucacuucguggaa

SEQ ID NO: 8635 - RNA, 19 nt, Haemophilus influenzae Rd
uugcagauugcgcagauuu

SEQ ID NO: 8636 - RNA, 22 nt, Haemophilus influenzae Rd
uugcccaaauuuccauuggguu

SEQ ID NO: 8637 - RNA, 22 nt, Haemophilus influenzae Rd
uugcuaauuuaauugcugauuu

SEQ ID NO: 8638 - RNA, 18 nt, Haemophilus influenzae Rd
uugcugauuauaaagcaa

SEQ ID NO: 8639 - RNA, 22 nt, Haemophilus influenzae Rd
uuggaaaccuucaauuugcuca

SEQ ID NO: 8640 - RNA, 19 nt, Haemophilus influenzae Rd
uuggacgcuuugguuaggu

SEQ ID NO: 8641 - RNA, 22 nt, Haemophilus influenzae Rd
uuggcaaacugguucugguaca

SEQ ID NO: 8642 - RNA, 22 nt, Haemophilus influenzae Rd
uuggcgauggggcaaaugacuu

SEQ ID NO: 8643 - RNA, 22 nt, Haemophilus influenzae Rd
uuggcggagauuaugcguuuuc

SEQ ID NO: 8644 - RNA, 22 nt, Haemophilus influenzae Rd
uuggcuugcucgguaaauucaa

SEQ ID NO: 8645 - RNA, 22 nt, Haemophilus influenzae Rd
uugguacaggaaauauucgaga

SEQ ID NO: 8646 - RNA, 22 nt, Haemophilus influenzae Rd
uugguggaaagaaucucaauua

SEQ ID NO: 8647 - RNA, 22 nt, Haemophilus influenzae Rd
uuguaggugggcuuuagcccac

SEQ ID NO: 8648 - RNA, 22 nt, Haemophilus influenzae Rd
uuguggaucuuugccugaauaa

SEQ ID NO: 8649 - RNA, 22 nt, Haemophilus influenzae Rd
uugugugcguucuauugcuuaa

SEQ ID NO: 8650 - RNA, 22 nt, Haemophilus influenzae Rd
uuguuaugggaucggugcuuuc

SEQ ID NO: 8651 - RNA, 17 nt, Haemophilus influenzae Rd
uuuaaaugcuaacucag

SEQ ID NO: 8652 - RNA, 22 nt, Haemophilus influenzae Rd
uuuacgcaauguuucggaaagu

SEQ ID NO: 8653 - RNA, 22 nt, Haemophilus influenzae Rd
uuuacgugaaaauaucgagcaa

SEQ ID NO: 8654 - RNA, 22 nt, Haemophilus influenzae Rd
uuuaggugcuaaaauauaacgg

SEQ ID NO: 8655 - RNA, 22 nt, Haemophilus influenzae Rd
uuucacaacgcauugaaagcga

SEQ ID NO: 8656 - RNA, 22 nt, Haemophilus influenzae Rd
uuuccuuggcaaggauuucaaa

SEQ ID NO: 8657 - RNA, 22 nt, Haemophilus influenzae Rd
uuugccaauggaaugugccaca

SEQ ID NO: 8658 - RNA, 22 nt, Haemophilus influenzae Rd
uuuguaauagaauggcgucacu

SEQ ID NO: 8659 - RNA, 22 nt, Haemophilus influenzae Rd
uuuguuauagauaaagugcggu

SEQ ID NO: 8660 - RNA, 22 nt, Haemophilus influenzae Rd
uuuuagcacuagguuuauugcu

SEQ ID NO: 8661 - RNA, 22 nt, Haemophilus influenzae Rd
uuuucaaugagaucaagauguu

SEQ ID NO: 8662 - RNA, 22 nt, Haemophilus influenzae Rd
uuuucguaaauguuuaccaagc

SEQ ID NO: 8663 - RNA, 21 nt, Haemophilus influenzae Rd
uuuuggcgauuggcuauguga

SEQ ID NO: 8664 - RNA, 22 nt, Haemophilus influenzae Rd
uuuuguuggaagccuguagggu

SEQ ID NO: 8665 - RNA, 22 nt, Haemophilus influenzae Rd
uuuuuaacacgcuuuugucuga

SEQ ID NO: 8666 - RNA, 22 nt, Haemophilus influenzae Rd
uuuuuccguugagcaaguugaa

SEQ ID NO: 8667 - RNA, 22 nt, Haemophilus influenzae Rd
uuuuucuugggcaaagcucgau

SEQ ID NO: 8668 - RNA, 22 nt, Haemophilus influenzae Rd
uuuuugaccgcugauugcugcu

SEQ ID NO: 8669 - RNA, 22 nt, Haemophilus influenzae Rd
uagucguguaagaaucgcucua

SEQ ID NO: 8670 - RNA, 22 nt, Haemophilus influenzae Rd
uaguggcuguacuugaaaacua

SEQ ID NO: 8671 - RNA, 22 nt, Haemophilus influenzae Rd
uaugcguaaagugucuguugcg

SEQ ID NO: 8672 - RNA, 22 nt, Haemophilus influenzae Rd
uaugggcgugaccgcacuuuua

SEQ ID NO: 8673 - RNA, 22 nt, Haemophilus influenzae Rd
uauguuuauuugaaauuguacg

SEQ ID NO: 8674 - RNA, 22 nt, Haemophilus influenzae Rd
uauuagauccuuuugcugguag

SEQ ID NO: 8675 - RNA, 22 nt, Haemophilus influenzae Rd
uauuagugucauuaguucguga

SEQ ID NO: 8676 - RNA, 22 nt, Haemophilus influenzae Rd
uauuauugaaugguucuuucaa

SEQ ID NO: 8677 - RNA, 22 nt, Haemophilus influenzae Rd
uauuguuaaagugaaaaauggu

SEQ ID NO: 8678 - RNA, 22 nt, Haemophilus influenzae Rd
uauuuaucauucuuaucguugc

SEQ ID NO: 8679 - RNA, 23 nt, Haemophilus influenzae Rd
ucaacucgacuauuuucaugcac

SEQ ID NO: 8680 - RNA, 22 nt, Haemophilus influenzae Rd
ucaaggugcugucgcaggccca

SEQ ID NO: 8681 - RNA, 22 nt, Haemophilus influenzae Rd
ucaauguguuuagauuuugcgg

SEQ ID NO: 8682 - RNA, 22 nt, Haemophilus influenzae Rd
ucacuugcacguuguugcaauu

SEQ ID NO: 8683 - RNA, 22 nt, Haemophilus influenzae Rd
ucagugauggacgaaauggaaa

SEQ ID NO: 8684 - RNA, 22 nt, Haemophilus influenzae Rd
ucaguggcgaauugcccaaaaa

SEQ ID NO: 8685 - RNA, 22 nt, Haemophilus influenzae Rd
ucaucuucuucuggguugcacg

SEQ ID NO: 8686 - RNA, 22 nt, Haemophilus influenzae Rd
ucaucuuuuacgaagugcaucg

SEQ ID NO: 8687 - RNA, 22 nt, Haemophilus influenzae Rd
ucccaauuuagcugccgugauu

SEQ ID NO: 8688 - RNA, 22 nt, Haemophilus influenzae Rd
ucgcaguacacaccgauuucac

SEQ ID NO: 8689 - RNA, 22 nt, Haemophilus influenzae Rd
ucgcccuuguuuacaacaugcu

SEQ ID NO: 8690 - RNA, 22 nt, Haemophilus influenzae Rd
ucgccguauucgugguaucacu

SEQ ID NO: 8691 - RNA, 22 nt, Haemophilus influenzae Rd
ucgcugcuaugaccugcaguua

SEQ ID NO: 8692 - RNA, 19 nt, Haemophilus influenzae Rd
ucguauuuggacgaggaug

SEQ ID NO: 8693 - RNA, 22 nt, Haemophilus influenzae Rd
ucgugguagauugugcaaaugg

SEQ ID NO: 8694 - RNA, 18 nt, Haemophilus influenzae Rd
ucuaccaacauucaaucc

SEQ ID NO: 8695 - RNA, 23 nt, Haemophilus influenzae Rd
ucucgguacuucugguaccuugu

SEQ ID NO: 8696 - RNA, 22 nt, Haemophilus influenzae Rd
ucugauauucagcuacucaaua

SEQ ID NO: 8697 - RNA, 22 nt, Haemophilus influenzae Rd
ucugcaauuuuuacaagguugg

SEQ ID NO: 8698 - RNA, 22 nt, Haemophilus influenzae Rd
ucuugauauuaaggcguguuag

SEQ ID NO: 8699 - RNA, 22 nt, Haemophilus influenzae Rd
ucuuggcuagucuugguaugga

SEQ ID NO: 8700 - RNA, 22 nt, Haemophilus influenzae Rd
ugaauguugguagagaguuucc

SEQ ID NO: 8701 - RNA, 22 nt, Haemophilus influenzae Rd
ugacguggaauuaucaaaaauu

SEQ ID NO: 8702 - RNA, 22 nt, Haemophilus influenzae Rd
ugagcaagguuuccaaugccgu

SEQ ID NO: 8703 - RNA, 23 nt, Haemophilus influenzae Rd
ugagcaugcucaucaaaaagugc

SEQ ID NO: 8704 - RNA, 22 nt, Haemophilus influenzae Rd
ugaucguuaaaugugguguuuu

SEQ ID NO: 8705 - RNA, 16 nt, Haemophilus influenzae Rd
ugaugcaacuuuagcu

SEQ ID NO: 8706 - RNA, 18 nt, Haemophilus influenzae Rd
ugauggugauacaaaaau

SEQ ID NO: 8707 - RNA, 22 nt, Haemophilus influenzae Rd
ugauuuuacccguuacuuuauc

SEQ ID NO: 8708 - RNA, 22 nt, Haemophilus influenzae Rd
ugcaauuugaaucauuuucuga

SEQ ID NO: 8709 - RNA, 22 nt, Haemophilus influenzae Rd
ugcacguuuggcauucgauagc

SEQ ID NO: 8710 - RNA, 19 nt, Haemophilus influenzae Rd
ugcaguuggaucuggguuu

SEQ ID NO: 8711 - RNA, 22 nt, Haemophilus influenzae Rd
ugccuguuaaaagcaugguuaa

SEQ ID NO: 8712 - RNA, 22 nt, Haemophilus influenzae Rd
ugcgauugaagcaguggucggu

SEQ ID NO: 8713 - RNA, 22 nt, Haemophilus influenzae Rd
ugcggaucguuugguacagcau

SEQ ID NO: 8714 - RNA, 18 nt, Haemophilus influenzae Rd
ugcggcuuuauugguaaa

SEQ ID NO: 8715 - RNA, 23 nt, Haemophilus influenzae Rd
ugcggguggcguuauuauggcag

SEQ ID NO: 8716 - RNA, 22 nt, Haemophilus influenzae Rd
ugcgguaguaaugcaaugauua

SEQ ID NO: 8717 - RNA, 22 nt, Haemophilus influenzae Rd
ugcguuuugaaggagauauuuu

SEQ ID NO: 8718 - RNA, 22 nt, Haemophilus influenzae Rd
ugcuacguucaauuuguugaau

SEQ ID NO: 8719 - RNA, 22 nt, Haemophilus influenzae Rd
ugcuuacagugcaucaauuggu

SEQ ID NO: 8720 - RNA, 20 nt, Haemophilus influenzae Rd
ugcuugauaaaccuguugau

SEQ ID NO: 8721 - RNA, 19 nt, Haemophilus influenzae Rd
ugcuuugcccaaugccgca

SEQ ID NO: 8722 - RNA, 22 nt, Haemophilus influenzae Rd
uggaaaauaaucaaacgcaagg

SEQ ID NO: 8723 - RNA, 21 nt, Haemophilus influenzae Rd
uggaaacgccauacauuagcu

SEQ ID NO: 8724 - RNA, 22 nt, Haemophilus influenzae Rd
uggauugugugagguagauuuu

SEQ ID NO: 8725 - RNA, 22 nt, Haemophilus influenzae Rd
uggcuuuauuugcucacugaaa

SEQ ID NO: 8726 - RNA, 21 nt, Haemophilus influenzae Rd
ugggcagaaacccauccuaua

SEQ ID NO: 8727 - RNA, 22 nt, Haemophilus influenzae Rd
uggggugugccgaugacguugu

SEQ ID NO: 8728 - RNA, 22 nt, Haemophilus influenzae Rd
uggguuaucaaaagcuuaucga

SEQ ID NO: 8729 - RNA, 19 nt, Haemophilus influenzae Rd
uggugcagccaguggcgug

SEQ ID NO: 8730 - RNA, 22 nt, Haemophilus influenzae Rd
ugguggaauugguugaucguga

SEQ ID NO: 8731 - RNA, 22 nt, Haemophilus influenzae Rd
uggugguuucacguugguuggu

SEQ ID NO: 8732 - RNA, 22 nt, Haemophilus influenzae Rd
ugguguuuaugugugagcauaa

SEQ ID NO: 8733 - RNA, 22 nt, Haemophilus influenzae Rd
ugguucaauuaccgugccagaa

SEQ ID NO: 8734 - RNA, 22 nt, Haemophilus influenzae Rd
ugucauaguugcguggcugcca

SEQ ID NO: 8735 - RNA, 22 nt, Haemophilus influenzae Rd
ugucuugccuguaccaguuuga

SEQ ID NO: 8736 - RNA, 22 nt, Haemophilus influenzae Rd
ugugaagauguauuuguuaaaa

SEQ ID NO: 8737 - RNA, 22 nt, Haemophilus influenzae Rd
uguguauaucaccgauguugca

SEQ ID NO: 8738 - RNA, 22 nt, Haemophilus influenzae Rd
uguugaugaaagcguacuucau

SEQ ID NO: 8739 - RNA, 22 nt, Haemophilus influenzae Rd
uguuugauaaaugaguaagcgu

SEQ ID NO: 8740 - RNA, 22 nt, Haemophilus influenzae Rd
uuaaacugauaggcaaggauaa

SEQ ID NO: 8741 - RNA, 22 nt, Haemophilus influenzae Rd
uuaauaaagguggugcgaccgu

SEQ ID NO: 8742 - RNA, 22 nt, Haemophilus influenzae Rd
uuaauguugcgcaucgcagagg

SEQ ID NO: 8743 - RNA, 22 nt, Haemophilus influenzae Rd
uuaccguuccuguuauuuguac

SEQ ID NO: 8744 - RNA, 18 nt, Haemophilus influenzae Rd
uuagaacuuuaucaugcu

SEQ ID NO: 8745 - RNA, 22 nt, Haemophilus influenzae Rd
uuagcauuuaugcuuuucagcg

SEQ ID NO: 8746 - RNA, 22 nt, Haemophilus influenzae Rd
guaaagcgauuaguauucgaac

SEQ ID NO: 8747 - RNA, 22 nt, Haemophilus influenzae Rd
guaacaaugauugcuucucucu

SEQ ID NO: 8748 - RNA, 22 nt, Haemophilus influenzae Rd
guaaccauuaccuuaaaugccg

SEQ ID NO: 8749 - RNA, 22 nt, Haemophilus influenzae Rd
guaagaguuuccuauuuagaau

SEQ ID NO: 8750 - RNA, 22 nt, Haemophilus influenzae Rd
guaaguauauccuagguucagu

SEQ ID NO: 8751 - RNA, 21 nt, Haemophilus influenzae Rd
guagaaaacgcgaaacguuuu

SEQ ID NO: 8752 - RNA, 22 nt, Haemophilus influenzae Rd
guaguggauuauaugguggcuc

SEQ ID NO: 8753 - RNA, 21 nt, Haemophilus influenzae Rd
guauaucggcaguuuugugcc

SEQ ID NO: 8754 - RNA, 19 nt, Haemophilus influenzae Rd
guaucgcucaauuuacgcc

SEQ ID NO: 8755 - RNA, 22 nt, Haemophilus influenzae Rd
guauuagugauuuuacuuugug

SEQ ID NO: 8756 - RNA, 22 nt, Haemophilus influenzae Rd
guauuucaucacgucuuacuuu

SEQ ID NO: 8757 - RNA, 22 nt, Haemophilus influenzae Rd
gucaauuucggguaaagguuuu

SEQ ID NO: 8758 - RNA, 22 nt, Haemophilus influenzae Rd
gucagcacaacugcauuugccg

SEQ ID NO: 8759 - RNA, 22 nt, Haemophilus influenzae Rd
gucagcgaaaugguacaaguga

SEQ ID NO: 8760 - RNA, 22 nt, Haemophilus influenzae Rd
gucgauuguuagauuuaccaac

SEQ ID NO: 8761 - RNA, 22 nt, Haemophilus influenzae Rd
gugaagaacgugaauuugaagg

SEQ ID NO: 8762 - RNA, 22 nt, Haemophilus influenzae Rd
gugauaaaaaugaagcggcuuu

SEQ ID NO: 8763 - RNA, 22 nt, Haemophilus influenzae Rd
gugauuuaucuuuaauuacauc

SEQ ID NO: 8764 - RNA, 22 nt, Haemophilus influenzae Rd
gugcauuaggcauccgugguug

SEQ ID NO: 8765 - RNA, 22 nt, Haemophilus influenzae Rd
gugcguuauuuuccauuugcgu

SEQ ID NO: 8766 - RNA, 22 nt, Haemophilus influenzae Rd
gugggcugaagcccacccuacg

SEQ ID NO: 8767 - RNA, 22 nt, Haemophilus influenzae Rd
guguuuuaauacuguguuaaug

SEQ ID NO: 8768 - RNA, 22 nt, Haemophilus influenzae Rd
guuaauccauucacgacugaaa

SEQ ID NO: 8769 - RNA, 22 nt, Haemophilus influenzae Rd
guuauuaccgcauuagaucaac

SEQ ID NO: 8770 - RNA, 22 nt, Haemophilus influenzae Rd
guuccagucuuauuaccagugu

SEQ ID NO: 8771 - RNA, 19 nt, Haemophilus influenzae Rd
guucuacauguuucacaau

SEQ ID NO: 8772 - RNA, 22 nt, Haemophilus influenzae Rd
guucugauuuagugccuaggua

SEQ ID NO: 8773 - RNA, 22 nt, Haemophilus influenzae Rd
guugagcaagguaaaguacgug

SEQ ID NO: 8774 - RNA, 22 nt, Haemophilus influenzae Rd
guuuaaccauugcaccagcauu

SEQ ID NO: 8775 - RNA, 22 nt, Haemophilus influenzae Rd
guuugguaaguaaaugcacuag

SEQ ID NO: 8776 - RNA, 22 nt, Haemophilus influenzae Rd
uaaagguauucaagaacaacuu

SEQ ID NO: 8777 - RNA, 22 nt, Haemophilus influenzae Rd
uaaagugguugcacauugguug

SEQ ID NO: 8778 - RNA, 22 nt, Haemophilus influenzae Rd
uaaauaugcaacagaauuaggc

SEQ ID NO: 8779 - RNA, 22 nt, Haemophilus influenzae Rd
uaaauauuacguaacugaaaug

SEQ ID NO: 8780 - RNA, 22 nt, Haemophilus influenzae Rd
uaagcuaucgcaccgugagguu

SEQ ID NO: 8781 - RNA, 22 nt, Haemophilus influenzae Rd
uaauggugcuuuguauuguauu

SEQ ID NO: 8782 - RNA, 22 nt, Haemophilus influenzae Rd
uacagacaauaaacauuuuaau

SEQ ID NO: 8783 - RNA, 22 nt, Haemophilus influenzae Rd
uacagccgagccuuugccuuag

SEQ ID NO: 8784 - RNA, 22 nt, Haemophilus influenzae Rd
uacggagauucuguuacauuag

SEQ ID NO: 8785 - RNA, 22 nt, Haemophilus influenzae Rd
uacguuauuaauugcugaccaa

SEQ ID NO: 8786 - RNA, 22 nt, Haemophilus influenzae Rd
uacucggcgcauuuggcauuau

SEQ ID NO: 8787 - RNA, 22 nt, Haemophilus influenzae Rd
uacuuaaugugauuaggcuuac

SEQ ID NO: 8788 - RNA, 22 nt, Haemophilus influenzae Rd
uagauucuuuuauugugaauca

SEQ ID NO: 8789 - RNA, 22 nt, Haemophilus influenzae Rd
uaggaaaauaaaaugccgucua

SEQ ID NO: 8790 - RNA, 22 nt, Haemophilus influenzae Rd
uagggugggcuucagcccaccg

SEQ ID NO: 8791 - RNA, 22 nt, Haemophilus influenzae Rd
uaguuuccuacgucaguauuaa

SEQ ID NO: 8792 - RNA, 22 nt, Haemophilus influenzae Rd
uaguuuguguuugcagagaucg

SEQ ID NO: 8793 - RNA, 23 nt, Haemophilus influenzae Rd
uaucauuauuaugaccgaugcug

SEQ ID NO: 8794 - RNA, 22 nt, Haemophilus influenzae Rd
uaucggaugucagcuuaucugu

SEQ ID NO: 8795 - RNA, 22 nt, Haemophilus influenzae Rd
uaucuguucgcugaauugguua

SEQ ID NO: 8796 - RNA, 22 nt, Haemophilus influenzae Rd
uaucuuuaggugcaagagaaug

SEQ ID NO: 8797 - RNA, 22 nt, Haemophilus influenzae Rd
uauuagcagcuaaagaauuaaa

SEQ ID NO: 8798 - RNA, 22 nt, Haemophilus influenzae Rd
uauuaguguuagucgcugcacc

SEQ ID NO: 8799 - RNA, 22 nt, Haemophilus influenzae Rd
uauuuuaacggugaugacaauc

SEQ ID NO: 8800 - RNA, 22 nt, Haemophilus influenzae Rd
uauuuugaaaucuuuacggauu

SEQ ID NO: 8801 - RNA, 22 nt, Haemophilus influenzae Rd
ucagccaaugcauucaccgaaa

SEQ ID NO: 8802 - RNA, 22 nt, Haemophilus influenzae Rd
ucaguuaagcguucuugaaccu

SEQ ID NO: 8803 - RNA, 22 nt, Haemophilus influenzae Rd
uccgugauuauuuagcgaaaaa

SEQ ID NO: 8804 - RNA, 22 nt, Haemophilus influenzae Rd
ucgaacaauuucguaguguagg

SEQ ID NO: 8805 - RNA, 20 nt, Haemophilus influenzae Rd
ucgccguuaauuuuuacuaa

SEQ ID NO: 8806 - RNA, 22 nt, Haemophilus influenzae Rd
ucgcuagaaugaggcguuuaau

SEQ ID NO: 8807 - RNA, 23 nt, Haemophilus influenzae Rd
ucugaauauaaggaaacucuuau

SEQ ID NO: 8808 - RNA, 22 nt, Haemophilus influenzae Rd
ucuguaauuauugguaaauucg

SEQ ID NO: 8809 - RNA, 22 nt, Haemophilus influenzae Rd
ucuguuguuauuaauguagaag

SEQ ID NO: 8810 - RNA, 22 nt, Haemophilus influenzae Rd
ucuugaauagcuuuguuacgua

SEQ ID NO: 8811 - RNA, 22 nt, Haemophilus influenzae Rd
ucuugggguuuaggcagcauug

SEQ ID NO: 8812 - RNA, 22 nt, Haemophilus influenzae Rd
ucuuuauaaagcacuaaagcaa

SEQ ID NO: 8813 - RNA, 22 nt, Haemophilus influenzae Rd
ugaaauugaccgcacuuuuuua

SEQ ID NO: 8814 - RNA, 22 nt, Haemophilus influenzae Rd
ugaguuuccacauuuagaugau

SEQ ID NO: 8815 - RNA, 22 nt, Haemophilus influenzae Rd
ugauagcaauaauagcguggcg

SEQ ID NO: 8816 - RNA, 22 nt, Haemophilus influenzae Rd
ugauccuuuuggcauucguccu

SEQ ID NO: 8817 - RNA, 22 nt, Haemophilus influenzae Rd
ugauuuuuuaauagaaaguagu

SEQ ID NO: 8818 - RNA, 22 nt, Haemophilus influenzae Rd
ugcaaugacguuagcgcguggu

SEQ ID NO: 8819 - RNA, 22 nt, Haemophilus influenzae Rd
ugcaggggacucaaucacaauu

SEQ ID NO: 8820 - RNA, 22 nt, Haemophilus influenzae Rd
ugccauuaauuuuauuugccgu

SEQ ID NO: 8821 - RNA, 19 nt, Haemophilus influenzae Rd
ugccggcguggcgauugca

SEQ ID NO: 8822 - RNA, 22 nt, Haemophilus influenzae Rd
ugccuacauaaccucaggcgga

SEQ ID NO: 8823 - RNA, 22 nt, Haemophilus influenzae Rd
ugcgguaaaaaauucgaggguu

SEQ ID NO: 8824 - RNA, 22 nt, Haemophilus influenzae Rd
ugcguuuaucuuacagcuauuu

SEQ ID NO: 8825 - RNA, 22 nt, Haemophilus influenzae Rd
ugcugacggaauguauuuaaug

SEQ ID NO: 8826 - RNA, 22 nt, Haemophilus influenzae Rd
ugcuuuauuguuuaucguuagc

SEQ ID NO: 8827 - RNA, 22 nt, Haemophilus influenzae Rd
ugcuuuugcaccauauucugca

SEQ ID NO: 8828 - RNA, 22 nt, Haemophilus influenzae Rd
uggcaauucauucucuuuuugc

SEQ ID NO: 8829 - RNA, 22 nt, Haemophilus influenzae Rd
uggcaggauugguuguguugau

SEQ ID NO: 8830 - RNA, 22 nt, Haemophilus influenzae Rd
uggcauuaaucaacaaaagcca

SEQ ID NO: 8831 - RNA, 22 nt, Haemophilus influenzae Rd
uggcuuuacgcaaaagcugcau

SEQ ID NO: 8832 - RNA, 22 nt, Haemophilus influenzae Rd
aaugggugcguaagcugauagu

SEQ ID NO: 8833 - RNA, 22 nt, Haemophilus influenzae Rd
aauguaggugaaauuacugaac

SEQ ID NO: 8834 - RNA, 22 nt, Haemophilus influenzae Rd
aauuaauuguagagcaucgcug

SEQ ID NO: 8835 - RNA, 21 nt, Haemophilus influenzae Rd
aauuaugagcaguaauaaaua

SEQ ID NO: 8836 - RNA, 22 nt, Haemophilus influenzae Rd
aauugagugauggcaaauuaga

SEQ ID NO: 8837 - RNA, 22 nt, Haemophilus influenzae Rd
aauuuauccucugauguagggc

SEQ ID NO: 8838 - RNA, 22 nt, Haemophilus influenzae Rd
accauuuacuaauaagcgauug

SEQ ID NO: 8839 - RNA, 22 nt, Haemophilus influenzae Rd
accauuuuaguucguucauuaa

SEQ ID NO: 8840 - RNA, 22 nt, Haemophilus influenzae Rd
accuugaguuucuugcugaauu

SEQ ID NO: 8841 - RNA, 22 nt, Haemophilus influenzae Rd
acgauuauuuagugauugccau

SEQ ID NO: 8842 - RNA, 22 nt, Haemophilus influenzae Rd
acgcaaauuugacaacgauaug

SEQ ID NO: 8843 - RNA, 22 nt, Haemophilus influenzae Rd
acggugaucauguaggcgguga

SEQ ID NO: 8844 - RNA, 22 nt, Haemophilus influenzae Rd
acguuuagauauggcauuugau

SEQ ID NO: 8845 - RNA, 22 nt, Haemophilus influenzae Rd
acugaaccuaggauauacuuac

SEQ ID NO: 8846 - RNA, 22 nt, Haemophilus influenzae Rd
acugaauuaagcaaagugaacg

SEQ ID NO: 8847 - RNA, 22 nt, Haemophilus influenzae Rd
acuguuuucuaacaucgcaaag

SEQ ID NO: 8848 - RNA, 22 nt, Haemophilus influenzae Rd
acuuguaugccaggcgauuugc

SEQ ID NO: 8849 - RNA, 23 nt, Haemophilus influenzae Rd
acuugugaacaucauuuugugac

SEQ ID NO: 8850 - RNA, 22 nt, Haemophilus influenzae Rd
acuuuaccacgugauucuagcc

SEQ ID NO: 8851 - RNA, 22 nt, Haemophilus influenzae Rd
acuuuuagauuauucuaaccgu

SEQ ID NO: 8852 - RNA, 22 nt, Haemophilus influenzae Rd
agaacuugcucaacuugguguu

SEQ ID NO: 8853 - RNA, 22 nt, Haemophilus influenzae Rd
agaaucugccauuguugcagca

SEQ ID NO: 8854 - RNA, 22 nt, Haemophilus influenzae Rd
agagaaagauuugauugguaua

SEQ ID NO: 8855 - RNA, 22 nt, Haemophilus influenzae Rd
agagcguauuaaucaacaagcg

SEQ ID NO: 8856 - RNA, 22 nt, Haemophilus influenzae Rd
agaugcaguggguauucaauau

SEQ ID NO: 8857 - RNA, 20 nt, Haemophilus influenzae Rd
agauuguuguggcaaauuuc

SEQ ID NO: 8858 - RNA, 22 nt, Haemophilus influenzae Rd
agcaaugaaagugcgguagauu

SEQ ID NO: 8859 - RNA, 22 nt, Haemophilus influenzae Rd
agcacuguaacgauuaaucauc

SEQ ID NO: 8860 - RNA, 22 nt, Haemophilus influenzae Rd
agcagacgaauaggcguuggcg

SEQ ID NO: 8861 - RNA, 22 nt, Haemophilus influenzae Rd
agcagcaaaucuugcagcagcu

SEQ ID NO: 8862 - RNA, 22 nt, Haemophilus influenzae Rd
agcagcugauuguauuggaaga

SEQ ID NO: 8863 - RNA, 22 nt, Haemophilus influenzae Rd
agcaucuugucaucccauuguu

SEQ ID NO: 8864 - RNA, 22 nt, Haemophilus influenzae Rd
agcccugugccguaaaacuccg

SEQ ID NO: 8865 - RNA, 22 nt, Haemophilus influenzae Rd
agccgauucucguuaucguacu

SEQ ID NO: 8866 - RNA, 18 nt, Haemophilus influenzae Rd
agcguauuauuucuggcg

SEQ ID NO: 8867 - RNA, 22 nt, Haemophilus influenzae Rd
agcuauugaagauaaacaaggu

SEQ ID NO: 8868 - RNA, 23 nt, Haemophilus influenzae Rd
aggaaaauggcaaaaccgauuau

SEQ ID NO: 8869 - RNA, 22 nt, Haemophilus influenzae Rd
agguuuaguuaaagaauauacg

SEQ ID NO: 8870 - RNA, 22 nt, Haemophilus influenzae Rd
cuuuauuugcaagagauugcaa

SEQ ID NO: 8871 - RNA, 22 nt, Haemophilus influenzae Rd
cuuuugcaaaauauagcacaga

SEQ ID NO: 8872 - RNA, 22 nt, Haemophilus influenzae Rd
gaaaaugugcggugcaaaacau

SEQ ID NO: 8873 - RNA, 22 nt, Haemophilus influenzae Rd
gaagaagugcgguugguuuuuu

SEQ ID NO: 8874 - RNA, 22 nt, Haemophilus influenzae Rd
gaagauucggugauuuuagucg

SEQ ID NO: 8875 - RNA, 22 nt, Haemophilus influenzae Rd
gaaguugugauccaguuggcgu

SEQ ID NO: 8876 - RNA, 22 nt, Haemophilus influenzae Rd
gaauuuauccauuacuucuugu

SEQ ID NO: 8877 - RNA, 22 nt, Haemophilus influenzae Rd
gacuaaaucaggcgaacgcaaa

SEQ ID NO: 8878 - RNA, 22 nt, Haemophilus influenzae Rd
gagcggauuauucagaugcaca

SEQ ID NO: 8879 - RNA, 22 nt, Haemophilus influenzae Rd
gauccaccauauucgcuaaugc

SEQ ID NO: 8880 - RNA, 22 nt, Haemophilus influenzae Rd
gaugaaugguaaaauugaugaa

SEQ ID NO: 8881 - RNA, 22 nt, Haemophilus influenzae Rd
gauuauuucugaugcaggaagc

SEQ ID NO: 8882 - RNA, 22 nt, Haemophilus influenzae Rd
gauugcgauugguucuggugga

SEQ ID NO: 8883 - RNA, 22 nt, Haemophilus influenzae Rd
gauuggugaaguaauaaccgau

SEQ ID NO: 8884 - RNA, 21 nt, Haemophilus influenzae Rd
gcaaaugugauuugccccuac

SEQ ID NO: 8885 - RNA, 22 nt, Haemophilus influenzae Rd
gcaauuugcaucacuuguucuu

SEQ ID NO: 8886 - RNA, 22 nt, Haemophilus influenzae Rd
gcacauaauguucauauuggca

SEQ ID NO: 8887 - RNA, 22 nt, Haemophilus influenzae Rd
gcaguagauucgauuauuguga

SEQ ID NO: 8888 - RNA, 22 nt, Haemophilus influenzae Rd
gcauucauucauuuugucguaa

SEQ ID NO: 8889 - RNA, 22 nt, Haemophilus influenzae Rd
gccuguuuuagagaguaucggc

SEQ ID NO: 8890 - RNA, 22 nt, Haemophilus influenzae Rd
gcggcagauauuuuaggugcau

SEQ ID NO: 8891 - RNA, 22 nt, Haemophilus influenzae Rd
gcggucaaauucuucucauuau

SEQ ID NO: 8892 - RNA, 22 nt, Haemophilus influenzae Rd
gcgguggaagucugcuacaagu

SEQ ID NO: 8893 - RNA, 22 nt, Haemophilus influenzae Rd
gcgucuauggcaaacagugcua

SEQ ID NO: 8894 - RNA, 22 nt, Haemophilus influenzae Rd
gcuggugcuauuugcuugcgca

SEQ ID NO: 8895 - RNA, 22 nt, Haemophilus influenzae Rd
gcuguugagaauacuugcgauu

SEQ ID NO: 8896 - RNA, 22 nt, Haemophilus influenzae Rd
gcuguuuugccacaaagcaaau

SEQ ID NO: 8897 - RNA, 22 nt, Haemophilus influenzae Rd
gcuucaauuuugccuucaaaca

SEQ ID NO: 8898 - RNA, 18 nt, Haemophilus influenzae Rd
gcuuucgcggaauucauc

SEQ ID NO: 8899 - RNA, 22 nt, Haemophilus influenzae Rd
ggaaaaacgccuuaaucgccga

SEQ ID NO: 8900 - RNA, 20 nt, Haemophilus influenzae Rd
ggacaaggucgauuuguugg

SEQ ID NO: 8901 - RNA, 22 nt, Haemophilus influenzae Rd
ggagaaaauaaagugcgguuga

SEQ ID NO: 8902 - RNA, 22 nt, Haemophilus influenzae Rd
ggaguuuuacggcacagggcug

SEQ ID NO: 8903 - RNA, 22 nt, Haemophilus influenzae Rd
ggaugauacgucuaaauccgcg

SEQ ID NO: 8904 - RNA, 22 nt, Haemophilus influenzae Rd
ggauuguuuaaucguaaaaauc

SEQ ID NO: 8905 - RNA, 20 nt, Haemophilus influenzae Rd
ggcaauguuuuacaaggcgu

SEQ ID NO: 8906 - RNA, 23 nt, Haemophilus influenzae Rd
ggcguagaaaaagauaaacgugc

SEQ ID NO: 8907 - RNA, 22 nt, Haemophilus influenzae Rd
ggcugcacacccugacauugaa

SEQ ID NO: 8908 - RNA, 18 nt, Haemophilus influenzae Rd
ggcuuaagcccacccuac

SEQ ID NO: 8909 - RNA, 22 nt, Haemophilus influenzae Rd
ggcuuggaauuauuugggcaga

SEQ ID NO: 8910 - RNA, 22 nt, Haemophilus influenzae Rd
ggggcaaauuuaucuuaauacu

SEQ ID NO: 8911 - RNA, 22 nt, Haemophilus influenzae Rd
ggggcguuuacguaaauuggcu

SEQ ID NO: 8912 - RNA, 22 nt, Haemophilus influenzae Rd
ggguaguauacucuagguuagu

SEQ ID NO: 8913 - RNA, 22 nt, Haemophilus influenzae Rd
gguaagauuacgguaaggguug

SEQ ID NO: 8914 - RNA, 22 nt, Haemophilus influenzae Rd
gguaagauuauggcguuguuga

SEQ ID NO: 8915 - RNA, 22 nt, Haemophilus influenzae Rd
gguaaugaaauuauucaaucaa

SEQ ID NO: 8916 - RNA, 22 nt, Haemophilus influenzae Rd
gguauuggucgugaugaauaua

SEQ ID NO: 8917 - RNA, 22 nt, Haemophilus influenzae Rd
gguguuuacgauaugaaaacug

SEQ ID NO: 8918 - RNA, 22 nt, Haemophilus influenzae Rd
gguuaaugugaaauguauucca

SEQ ID NO: 8919 - RNA, 22 nt, Haemophilus influenzae Rd
ugggcgaugguaauggccgagu

SEQ ID NO: 8920 - RNA, 22 nt, Haemophilus influenzae Rd
uggguauucguuuauuuaucac

SEQ ID NO: 8921 - RNA, 22 nt, Haemophilus influenzae Rd
ugguaagcaaaggaugaucugg

SEQ ID NO: 8922 - RNA, 22 nt, Haemophilus influenzae Rd
uggucguauuaaucgcuauugc

SEQ ID NO: 8923 - RNA, 22 nt, Haemophilus influenzae Rd
uggugggcuaaagcccaccuac

SEQ ID NO: 8924 - RNA, 18 nt, Haemophilus influenzae Rd
ugguguuggacgaacagu

SEQ ID NO: 8925 - RNA, 22 nt, Haemophilus influenzae Rd
uguggcauaggaccaucuguug

SEQ ID NO: 8926 - RNA, 18 nt, Haemophilus influenzae Rd
uguguauaugauuggcuu

SEQ ID NO: 8927 - RNA, 22 nt, Haemophilus influenzae Rd
ugugugguuuuacgcuuaucac

SEQ ID NO: 8928 - RNA, 22 nt, Haemophilus influenzae Rd
uguucuuucucaauaguuuuau

SEQ ID NO: 8929 - RNA, 22 nt, Haemophilus influenzae Rd
uguugggcaaucugguguuggu

SEQ ID NO: 8930 - RNA, 22 nt, Haemophilus influenzae Rd
uuaaauuuaggaguauagccaa

SEQ ID NO: 8931 - RNA, 22 nt, Haemophilus influenzae Rd
uuaauuugccgauugugccgcu

SEQ ID NO: 8932 - RNA, 22 nt, Haemophilus influenzae Rd
uuacggguaaaauucgcaaugu

SEQ ID NO: 8933 - RNA, 22 nt, Haemophilus influenzae Rd
uuacguccuuauggcuuaauua

SEQ ID NO: 8934 - RNA, 22 nt, Haemophilus influenzae Rd
uuagcgcgccaauuugaauuag

SEQ ID NO: 8935 - RNA, 23 nt, Haemophilus influenzae Rd
uuagcugcugaagguuauaucga

SEQ ID NO: 8936 - RNA, 22 nt, Haemophilus influenzae Rd
uuagcuuggcauggcguacacg

SEQ ID NO: 8937 - RNA, 22 nt, Haemophilus influenzae Rd
uuagugcaaaugcucggggugu

SEQ ID NO: 8938 - RNA, 22 nt, Haemophilus influenzae Rd
uuauaaauaucaguauagcaac

SEQ ID NO: 8939 - RNA, 22 nt, Haemophilus influenzae Rd
uuaucgugaaagaucuugaagc

SEQ ID NO: 8940 - RNA, 22 nt, Haemophilus influenzae Rd
uuauuuggcacagagguuuuac

SEQ ID NO: 8941 - RNA, 22 nt, Haemophilus influenzae Rd
uucaaaugcggcaaaagcgaua

SEQ ID NO: 8942 - RNA, 22 nt, Haemophilus influenzae Rd
uucaccgccuacaugaucaccg

SEQ ID NO: 8943 - RNA, 22 nt, Haemophilus influenzae Rd
uucacgcucaacaguuauaucu

SEQ ID NO: 8944 - RNA, 22 nt, Haemophilus influenzae Rd
uucaguuucaucauuaaaugua

SEQ ID NO: 8945 - RNA, 22 nt, Haemophilus influenzae Rd
uucaucagauaauucacggggu

SEQ ID NO: 8946 - RNA, 22 nt, Haemophilus influenzae Rd
uucgcuguauuagcuaauuuaa

SEQ ID NO: 8947 - RNA, 22 nt, Haemophilus influenzae Rd
uucguuauuuuccgccgaaauu

SEQ ID NO: 8948 - RNA, 22 nt, Haemophilus influenzae Rd
uucuauggcgaacaaaaaggcu

SEQ ID NO: 8949 - RNA, 17 nt, Haemophilus influenzae Rd
uucugacuuauaucaag

SEQ ID NO: 8950 - RNA, 22 nt, Haemophilus influenzae Rd
uugacaauggguuuugaugaug

SEQ ID NO: 8951 - RNA, 22 nt, Haemophilus influenzae Rd
cgguacauucuggguuaauuaa

SEQ ID NO: 8952 - RNA, 22 nt, Haemophilus influenzae Rd
cguaucaaucucaccauuuacc

SEQ ID NO: 8953 - RNA, 21 nt, Haemophilus influenzae Rd
cgucguaugcuuggcacagag

SEQ ID NO: 8954 - RNA, 22 nt, Haemophilus influenzae Rd
cgugcaacccagaagaagauga

SEQ ID NO: 8955 - RNA, 22 nt, Haemophilus influenzae Rd
cguuauaucaauuggacaggcu

SEQ ID NO: 8956 - RNA, 22 nt, Haemophilus influenzae Rd
cugaaaaggcucauaauuucac

SEQ ID NO: 8957 - RNA, 22 nt, Haemophilus influenzae Rd
cugguugggcgugguuaguauu

SEQ ID NO: 8958 - RNA, 22 nt, Haemophilus influenzae Rd
cuguuggauucguuuccauaca

SEQ ID NO: 8959 - RNA, 22 nt, Haemophilus influenzae Rd
cuuaaucgaugaagcgcguacg

SEQ ID NO: 8960 - RNA, 22 nt, Haemophilus influenzae Rd
cuucauuuucuacggugcaaug

SEQ ID NO: 8961 - RNA, 22 nt, Haemophilus influenzae Rd
cuugaagaaucugugcaaguug

SEQ ID NO: 8962 - RNA, 22 nt, Haemophilus influenzae Rd
cuugugugguuaagccuugcgc

SEQ ID NO: 8963 - RNA, 22 nt, Haemophilus influenzae Rd
cuuucuacgggugaagcuauug

SEQ ID NO: 8964 - RNA, 20 nt, Haemophilus influenzae Rd
cuuugcugaacuacucgcuc

SEQ ID NO: 8965 - RNA, 22 nt, Haemophilus influenzae Rd
gaaaauuguccaugucaaucua

SEQ ID NO: 8966 - RNA, 20 nt, Haemophilus influenzae Rd
gaaaguuuuguauugaugau

SEQ ID NO: 8967 - RNA, 22 nt, Haemophilus influenzae Rd
gaaucugcgcaccugcagcuuu

SEQ ID NO: 8968 - RNA, 22 nt, Haemophilus influenzae Rd
gaauggcauuuugcgcaccguu

SEQ ID NO: 8969 - RNA, 22 nt, Haemophilus influenzae Rd
gaauuucagcauauuguuguga

SEQ ID NO: 8970 - RNA, 22 nt, Haemophilus influenzae Rd
gaccgcacuuuggcacguggaa

SEQ ID NO: 8971 - RNA, 22 nt, Haemophilus influenzae Rd
gacuuuuaaugcaauuagugau

SEQ ID NO: 8972 - RNA, 22 nt, Haemophilus influenzae Rd
gagacaauuucaguuggaacgg

SEQ ID NO: 8973 - RNA, 22 nt, Haemophilus influenzae Rd
gagcagcauuauaaagcguugu

SEQ ID NO: 8974 - RNA, 22 nt, Haemophilus influenzae Rd
gaggagaaauaguacagcaagg

SEQ ID NO: 8975 - RNA, 19 nt, Haemophilus influenzae Rd
gauaauggauacuauaagg

SEQ ID NO: 8976 - RNA, 22 nt, Haemophilus influenzae Rd
gauacauuaaugguguuuugga

SEQ ID NO: 8977 - RNA, 22 nt, Haemophilus influenzae Rd
gaucacuuuagcauguguugaa

SEQ ID NO: 8978 - RNA, 22 nt, Haemophilus influenzae Rd
gauggugcggcgaaaagccauu

SEQ ID NO: 8979 - RNA, 22 nt, Haemophilus influenzae Rd
gauugcauuuuuagucaauggc

SEQ ID NO: 8980 - RNA, 22 nt, Haemophilus influenzae Rd
gauuuugcgucauauucaagaa

SEQ ID NO: 8981 - RNA, 22 nt, Haemophilus influenzae Rd
gcaaucaguugaguguauugug

SEQ ID NO: 8982 - RNA, 22 nt, Haemophilus influenzae Rd
gcaaucgguaauccauuugguu

SEQ ID NO: 8983 - RNA, 22 nt, Haemophilus influenzae Rd
gcaaugguuccuuuaguuaugg

SEQ ID NO: 8984 - RNA, 22 nt, Haemophilus influenzae Rd
gcaauugcaacaguaauuggua

SEQ ID NO: 8985 - RNA, 22 nt, Haemophilus influenzae Rd
gcacaaaauggccauuuauuua

SEQ ID NO: 8986 - RNA, 23 nt, Haemophilus influenzae Rd
gcacuuaauaauaaggugagcag

SEQ ID NO: 8987 - RNA, 22 nt, Haemophilus influenzae Rd
gcacuucuugguggcugguuaa

SEQ ID NO: 8988 - RNA, 22 nt, Haemophilus influenzae Rd
gcauaacagaacccaguuaaac

SEQ ID NO: 8989 - RNA, 22 nt, Haemophilus influenzae Rd
gcauuuugaugaacgcgguuua

SEQ ID NO: 8990 - RNA, 22 nt, Haemophilus influenzae Rd
gccauucuauuacaaauuuagc

SEQ ID NO: 8991 - RNA, 22 nt, Haemophilus influenzae Rd
gcccuuuuguuauuauagagca

SEQ ID NO: 8992 - RNA, 22 nt, Haemophilus influenzae Rd
gccguaacccaauguauuuaag

SEQ ID NO: 8993 - RNA, 22 nt, Haemophilus influenzae Rd
gcgaaggcgguucgggcggugc

SEQ ID NO: 8994 - RNA, 22 nt, Haemophilus influenzae Rd
gcgaugaaaaaugcgaauguug

SEQ ID NO: 8995 - RNA, 22 nt, Haemophilus influenzae Rd
gcgaugaaaaugugcaaguuga

SEQ ID NO: 8996 - RNA, 22 nt, Haemophilus influenzae Rd
gcggauuuccaauugauugacg

SEQ ID NO: 8997 - RNA, 22 nt, Haemophilus influenzae Rd
gcggcagaguuauuagauguuu

SEQ ID NO: 8998 - RNA, 22 nt, Haemophilus influenzae Rd
gcgguuuggcugugauguugcc

SEQ ID NO: 8999 - RNA, 22 nt, Haemophilus influenzae Rd
gcuaaauaggcuguuuuaugau

SEQ ID NO: 9000 - RNA, 22 nt, Haemophilus influenzae Rd
gcugcacucauccaguuggcag

SEQ ID NO: 9001 - RNA, 22 nt, Haemophilus influenzae Rd
gcuggugcuauuuguuugugca

SEQ ID NO: 9002 - RNA, 22 nt, Haemophilus influenzae Rd
gcuuuaacugcaggucauagca

SEQ ID NO: 9003 - RNA, 22 nt, Haemophilus influenzae Rd
gcuuuugggcgugggccuggua

SEQ ID NO: 9004 - RNA, 22 nt, Haemophilus influenzae Rd
ggagaacuaccugaaacuauuu

SEQ ID NO: 9005 - RNA, 22 nt, Haemophilus influenzae Rd
ggauaaaauuucugaugaacaa

SEQ ID NO: 9006 - RNA, 21 nt, Haemophilus influenzae Rd
ggcauugcucauuuaguugaa

SEQ ID NO: 9007 - RNA, 22 nt, Haemophilus influenzae Rd
ggcuaaagcccacccuacggaa

SEQ ID NO: 9008 - RNA, 22 nt, Haemophilus influenzae Rd
gggcaaaauugcauuaaauauu

SEQ ID NO: 9009 - RNA, 22 nt, Haemophilus influenzae Rd
gggcugaauggcaucaaauaaa

SEQ ID NO: 9010 - RNA, 22 nt, Haemophilus influenzae Rd
gguaaaagcacuuauaugcgcc

SEQ ID NO: 9011 - RNA, 22 nt, Haemophilus influenzae Rd
ggucaaaaugccauugacuggu

SEQ ID NO: 9012 - RNA, 22 nt, Haemophilus influenzae Rd
ggugcaauguugguagaaaaug

SEQ ID NO: 9013 - RNA, 22 nt, Haemophilus influenzae Rd
ggugcaguaaaugaauugggcg

SEQ ID NO: 9014 - RNA, 22 nt, Haemophilus influenzae Rd
ggugggcuuaaagcccaccuac

SEQ ID NO: 9015 - RNA, 22 nt, Haemophilus influenzae Rd
gguuucaucuuuaugaucuuaa

SEQ ID NO: 9016 - RNA, 22 nt, Haemophilus influenzae Rd
guaaaaccuaaugcauauagau

SEQ ID NO: 9017 - RNA, 22 nt, Haemophilus influenzae Rd
guaucagaaauagagcauaaug

SEQ ID NO: 9018 - RNA, 21 nt, Haemophilus influenzae Rd
gucuguaggaugauuagcuau

SEQ ID NO: 9019 - RNA, 22 nt, Haemophilus influenzae Rd
gugaauauuuaccgugaaccac

SEQ ID NO: 9020 - RNA, 20 nt, Haemophilus influenzae Rd
gugagaaaccgaaccaacag

SEQ ID NO: 9021 - RNA, 22 nt, Haemophilus influenzae Rd
gugagaaucgguaaaagucgcu

SEQ ID NO: 9022 - RNA, 22 nt, Haemophilus influenzae Rd
gugaugaucgcacugaugugau

SEQ ID NO: 9023 - RNA, 22 nt, Haemophilus influenzae Rd
gugcaguaaucgcaaucuucgg

SEQ ID NO: 9024 - RNA, 22 nt, Haemophilus influenzae Rd
guggauuucgagcauuggggaa

SEQ ID NO: 9025 - RNA, 22 nt, Haemophilus influenzae Rd
gugggauugcagauagucuuga

SEQ ID NO: 9026 - RNA, 22 nt, Haemophilus influenzae Rd
gugggcuuuagcccacaauuua

SEQ ID NO: 9027 - RNA, 22 nt, Haemophilus influenzae Rd
guguuauuuugacuuggggugu

SEQ ID NO: 9028 - RNA, 22 nt, Haemophilus influenzae Rd
guguuguucaaaaaauucgcag

SEQ ID NO: 9029 - RNA, 22 nt, Haemophilus influenzae Rd
guugccauuugcaaaauacgag

SEQ ID NO: 9030 - RNA, 22 nt, Haemophilus influenzae Rd
guugggaacccuggauguggug

SEQ ID NO: 9031 - RNA, 22 nt, Haemophilus influenzae Rd
guugggugagcaaauaacugaa

SEQ ID NO: 9032 - RNA, 22 nt, Haemophilus influenzae Rd
guuuaaccgcauuagcaaauga

SEQ ID NO: 9033 - RNA, 22 nt, Haemophilus influenzae Rd
guuugaugauuaucgaaaaugc

SEQ ID NO: 9034 - RNA, 22 nt, Haemophilus influenzae Rd
uaaaaaagaaguggaacgccgu

SEQ ID NO: 9035 - RNA, 22 nt, Haemophilus influenzae Rd
uaaauaguucucguggcagugc

SEQ ID NO: 9036 - RNA, 22 nt, Haemophilus influenzae Rd
uaacguugggaaauauugucgg

SEQ ID NO: 9037 - RNA, 22 nt, Human
agguggcguauguguucguguu

SEQ ID NO: 9038 - RNA, 22 nt, Human
aggugggaauaauaaucaaagc

SEQ ID NO: 9039 - RNA, 22 nt, Human
aggugggcuuagaaaucuguau

SEQ ID NO: 9040 - RNA, 22 nt, Human
agguggucccaauggcugggca

SEQ ID NO: 9041 - RNA, 22 nt, Human
agguggucuuguggaugccgca

SEQ ID NO: 9042 - RNA, 22 nt, Human
agguggugacgaugcuccguac

SEQ ID NO: 9043 - RNA, 21 nt, Human
aggugguuccaauaaguaggu

SEQ ID NO: 9044 - RNA, 22 nt, Human
aggugucauuauagaccagaua

SEQ ID NO: 9045 - RNA, 18 nt, Human
agguguguuucuaggagc

SEQ ID NO: 9046 - RNA, 22 nt, Human
agguuaaaagagugaguggaua

SEQ ID NO: 9047 - RNA, 22 nt, Human
agguuaaacuuccugcagggcu

SEQ ID NO: 9048 - RNA, 22 nt, Human
agguuaauaugaacagcagaag

SEQ ID NO: 9049 - RNA, 22 nt, Human
agguuaggaaugggagguaaug

SEQ ID NO: 9050 - RNA, 22 nt, Human
agguuaggaggggagugccaca

SEQ ID NO: 9051 - RNA, 22 nt, Human
agagaaauguacuagucuaacu

SEQ ID NO: 9052 - RNA, 20 nt, Human
agagaacaguuuggucacag

SEQ ID NO: 9053 - RNA, 22 nt, Human
agagacaagggaccucuggaga

SEQ ID NO: 9054 - RNA, 22 nt, Human
agagacaggguuuugucguguu

SEQ ID NO: 9055 - RNA, 22 nt, Human
agagacauagcacaguuuuucg

SEQ ID NO: 9056 - RNA, 21 nt, Human
agagaccuaagcugagauucc

SEQ ID NO: 9057 - RNA, 16 nt, Human
agagagaugguggugg

SEQ ID NO: 9058 - RNA, 22 nt, Human
agagaguacuuucaucagggaa

SEQ ID NO: 9059 - RNA, 22 nt, Human
agagauuagagaagaugauaaa

SEQ ID NO: 9060 - RNA, 22 nt, Human
agagauugagcucagaagaccu

SEQ ID NO: 9061 - RNA, 22 nt, Human
agagauuuacaacuugggcuuu

SEQ ID NO: 9062 - RNA, 19 nt, Human
agagauuuucuguuuuagu

SEQ ID NO: 9063 - RNA, 22 nt, Human
agagcaauggugcuuuaauucu

SEQ ID NO: 9064 - RNA, 22 nt, Human
agagcauagggcauuaggaagg

SEQ ID NO: 9065 - RNA, 22 nt, Human
agagcaucgguggaguccccac

SEQ ID NO: 9066 - RNA, 22 nt, Human
agagccaugcuugugcauauau

SEQ ID NO: 9067 - RNA, 22 nt, Human
agagcccagaucccacccugga

SEQ ID NO: 9068 - RNA, 22 nt, Human
agagcuagaaggaagcauuucu

SEQ ID NO: 9069 - RNA, 22 nt, Human
agagcuccaggguuuuguagug

SEQ ID NO: 9070 - RNA, 22 nt, Human
agagcucguggcucauugagga

SEQ ID NO: 9071 - RNA, 22 nt, Human
agagcuuagaggaccuucgugc

SEQ ID NO: 9072 - RNA, 22 nt, Human
agaggagaauguaaauuuguca

SEQ ID NO: 9073 - RNA, 22 nt, Human
agaggcagagcugggguuugac

SEQ ID NO: 9074 - RNA, 22 nt, Human
aggcaguguggagggcuguugc

SEQ ID NO: 9075 - RNA, 22 nt, Human
aggcauauaguguuuaaaaaaa

SEQ ID NO: 9076 - RNA, 22 nt, Human
aggcauguugcuucgggcuuug

SEQ ID NO: 9077 - RNA, 22 nt, Human
aggcauuuaucaggaaauguuc

SEQ ID NO: 9078 - RNA, 21 nt, Human
aggcauuuucuuggagauucu

SEQ ID NO: 9079 - RNA, 22 nt, Human
aggcauuuucuuguuauuuuua

SEQ ID NO: 9080 - RNA, 21 nt, Human
aggccaaguuggauuucuuca

SEQ ID NO: 9081 - RNA, 22 nt, Human
aggccaggcgccggcgcgagac

SEQ ID NO: 9082 - RNA, 22 nt, Human
aggccagggacaaugaggcaga

SEQ ID NO: 9083 - RNA, 22 nt, Human
aggccagugcagcuggaacaga

SEQ ID NO: 9084 - RNA, 22 nt, Human
aggcccugcugaggccucccuc

SEQ ID NO: 9085 - RNA, 22 nt, Human
aggccgagaugacagagccacu

SEQ ID NO: 9086 - RNA, 20 nt, Human
aggccgcccgcugccgcuuc

SEQ ID NO: 9087 - RNA, 22 nt, Human
aggccgcuggggcagcgcccga

SEQ ID NO: 9088 - RNA, 22 nt, Human
aggccugcuccucuucucaucc

SEQ ID NO: 9089 - RNA, 22 nt, Human
aggcgagcgcggccggugcccc

SEQ ID NO: 9090 - RNA, 22 nt, Human
aggcgguuggcuuugucugggu

SEQ ID NO: 9091 - RNA, 22 nt, Human
aggcguggcuucugcuggguug

SEQ ID NO: 9092 - RNA, 22 nt, Human
aggcucagcaucugauucauau

SEQ ID NO: 9093 - RNA, 22 nt, Human
aggcucucccacauucauuaca

SEQ ID NO: 9094 - RNA, 22 nt, Human
aggcugaagcacacucaugcag

SEQ ID NO: 9095 - RNA, 22 nt, Human
aggcugccuaugaaggcagaag

SEQ ID NO: 9096 - RNA, 19 nt, Human
aggcugccucacccucccu

SEQ ID NO: 9097 - RNA, 22 nt, Human
aggcugcucucgccggcggugu

SEQ ID NO: 9098 - RNA, 22 nt, Human
aggcugcuggcaggcguggacg

SEQ ID NO: 9099 - RNA, 22 nt, Human
aggcugggaaguguguccugag

SEQ ID NO: 9100 - RNA, 22 nt, Human
aggcuguagaucuagacaugua

SEQ ID NO: 9101 - RNA, 22 nt, Human
aggcuuaaaugcucauaucagu

SEQ ID NO: 9102 - RNA, 22 nt, Human
aggcuuagaugaguucccacau

SEQ ID NO: 9103 - RNA, 22 nt, Human
aggcuucaaggacagcagccac

SEQ ID NO: 9104 - RNA, 22 nt, Human
agggaaauaggagaagaaagga

SEQ ID NO: 9105 - RNA, 17 nt, Human
agggaaguagggugggc

SEQ ID NO: 9106 - RNA, 22 nt, Human
agggacuugugucuguguuuuu

SEQ ID NO: 9107 - RNA, 22 nt, Human
agggaggagggacagaaagagg

SEQ ID NO: 9108 - RNA, 19 nt, Human
agggaggcaagagaaaugu

SEQ ID NO: 9109 - RNA, 22 nt, Human
agggaguagggagccaugggug

SEQ ID NO: 9110 - RNA, 22 nt, Human
agggagucuggccgucggcugg

SEQ ID NO: 9111 - RNA, 22 nt, Human
agggaguuccgaucugugcacc

SEQ ID NO: 9112 - RNA, 22 nt, Human
agggaugcaguaaaaacuguag

SEQ ID NO: 9113 - RNA, 22 nt, Human
agggcacuuccucugggucccu

SEQ ID NO: 9114 - RNA, 22 nt, Human
agggcaggguuggugcuggugc

SEQ ID NO: 9115 - RNA, 22 nt, Human
agggcauacauuuuccugagau

SEQ ID NO: 9116 - RNA, 22 nt, Human
agggccggggagggcugugggg

SEQ ID NO: 9117 - RNA, 22 nt, Human
agggcggucccugagacucucc

SEQ ID NO: 9118 - RNA, 22 nt, Human
agggcguacuuucgccccuccu

SEQ ID NO: 9119 - RNA, 22 nt, Human
agggcucagccuccuccucagc

SEQ ID NO: 9120 - RNA, 22 nt, Human
agggcucuuucauuguuaagaa

SEQ ID NO: 9121 - RNA, 22 nt, Human
agggcuguuggugcccucgagg

SEQ ID NO: 9122 - RNA, 22 nt, Human
agggcuuaggcacacugugacu

SEQ ID NO: 9123 - RNA, 22 nt, Human
aggggaagagugagguuuuggu

SEQ ID NO: 9124 - RNA, 22 nt, Human
aggggagaagcacuccuugccu

SEQ ID NO: 9125 - RNA, 22 nt, Human
aggggagaguuaaugugaaugu

SEQ ID NO: 9126 - RNA, 22 nt, Human
aggggaggcugcgggcugccgu

SEQ ID NO: 9127 - RNA, 22 nt, Human
aggggaggcugggcuggggggc

SEQ ID NO: 9128 - RNA, 22 nt, Human
aggggaguuauuagacagggag

SEQ ID NO: 9129 - RNA, 22 nt, Human
aggggauggagcuggaaggcag

SEQ ID NO: 9130 - RNA, 22 nt, Human
aggggcaagucuggccauuucu

SEQ ID NO: 9131 - RNA, 22 nt, Human
aggggcagaggaugauggaaga

SEQ ID NO: 9132 - RNA, 22 nt, Human
aggggcagccucacaauccucu

SEQ ID NO: 9133 - RNA, 19 nt, Human
aggggccugcuuggccuug

SEQ ID NO: 9134 - RNA, 22 nt, Human
aggggcugagaguuugaugugg

SEQ ID NO: 9135 - RNA, 22 nt, Human
aggggcuuguggaguugcuggu

SEQ ID NO: 9136 - RNA, 22 nt, Human
agggggaaaauguggauuaugg

SEQ ID NO: 9137 - RNA, 22 nt, Human
agggggccggggcucaggagcc

SEQ ID NO: 9138 - RNA, 22 nt, Human
agggggccucucccgcggcgcc

SEQ ID NO: 9139 - RNA, 22 nt, Human
aggggguugcgcaggggcuccc

SEQ ID NO: 9140 - RNA, 22 nt, Human
agggguuugggaaggguuaggg

SEQ ID NO: 9141 - RNA, 22 nt, Human
aggguaauaacaguauggugau

SEQ ID NO: 9142 - RNA, 21 nt, Human
aggguccugaggaagugagau

SEQ ID NO: 9143 - RNA, 22 nt, Human
agggucgucuggguccgugggg

SEQ ID NO: 9144 - RNA, 22 nt, Human
aggguguacauuuguuggugaa

SEQ ID NO: 9145 - RNA, 22 nt, Human
aggguuacuuauuuuggauagu

SEQ ID NO: 9146 - RNA, 22 nt, Human
aggguuaggguggcauggggaa

SEQ ID NO: 9147 - RNA, 22 nt, Human
aggguugaagucugguccucau

SEQ ID NO: 9148 - RNA, 22 nt, Human
aggguuugugaagacuuggcca

SEQ ID NO: 9149 - RNA, 22 nt, Human
aggguuuucauauauuauuagu

SEQ ID NO: 9150 - RNA, 22 nt, Human
agguaguggaaccaaggcauca

SEQ ID NO: 9151 - RNA, 22 nt, Human
agguauuuuaugucgugugaug

SEQ ID NO: 9152 - RNA, 22 nt, Human
aggucagacagggugucuuucu

SEQ ID NO: 9153 - RNA, 22 nt, Human
agguccaucugaaucuuauucc

SEQ ID NO: 9154 - RNA, 22 nt, Human
agguccugucuuaucucuguaa

SEQ ID NO: 9155 - RNA, 22 nt, Human
aggucguauaguuaccuccuug

SEQ ID NO: 9156 - RNA, 22 nt, Human
aggucgugggugagagagagac

SEQ ID NO: 9157 - RNA, 19 nt, Human
aggucuaaucauaagacaa

SEQ ID NO: 9158 - RNA, 22 nt, Human
aggucuacaugcuuaauauauc

SEQ ID NO: 9159 - RNA, 22 nt, Human
aggucugcccaggaugcugcuu

SEQ ID NO: 9160 - RNA, 22 nt, Human
aggucuugcggaagauauggcu

SEQ ID NO: 9161 - RNA, 19 nt, Human
aggugaugugacucuagaa

SEQ ID NO: 9162 - RNA, 22 nt, Human
aggugcacugguacaggcuuca

SEQ ID NO: 9163 - RNA, 22 nt, Human
aggugcagcugguggagucugg

SEQ ID NO: 9164 - RNA, 22 nt, Human
aggugcccucucuggcuccucc

SEQ ID NO: 9165 - RNA, 22 nt, Human
aggugcucaguaauugauuguu

SEQ ID NO: 9166 - RNA, 22 nt, Human
aggugcuuaaagaauguguggu

SEQ ID NO: 9167 - RNA, 22 nt, Human
aggugcuugcauacugcuugac

SEQ ID NO: 9168 - RNA, 22 nt, Human
gccugagauuggacauuauuua

SEQ ID NO: 9169 - RNA, 22 nt, Human
gccugagucaagauguggcacc

SEQ ID NO: 9170 - RNA, 22 nt, Human
gccugcacucaaacacucucuu

SEQ ID NO: 9171 - RNA, 22 nt, Human
gccugcagccagggaguucucu

SEQ ID NO: 9172 - RNA, 22 nt, Human
gccugcaggaaggugugccugu

SEQ ID NO: 9173 - RNA, 21 nt, Human
gccugcuguucacccugccac

SEQ ID NO: 9174 - RNA, 22 nt, Human
gccuggcagggagauuguaaga

SEQ ID NO: 9175 - RNA, 20 nt, Human
gccugggagaagaucaggga

SEQ ID NO: 9176 - RNA, 22 nt, Human
gccugggauuggggauuuuuug

SEQ ID NO: 9177 - RNA, 22 nt, Human
gccugggccgggcgcggccccc

SEQ ID NO: 9178 - RNA, 22 nt, Human
gccuucccuccucugcucucag

SEQ ID NO: 9179 - RNA, 22 nt, Human
gccuucgauaugaggguuugcc

SEQ ID NO: 9180 - RNA, 22 nt, Human
gccuugagcucaugucccagcu

SEQ ID NO: 9181 - RNA, 22 nt, Human
gccuuuauauuacauuuggaag

SEQ ID NO: 9182 - RNA, 22 nt, Human
gccuuucuugguuugucaggca

SEQ ID NO: 9183 - RNA, 22 nt, Human
gccuuuugcaaugguguuggug

SEQ ID NO: 9184 - RNA, 22 nt, Human
gcgauugguuuggggccagagu

SEQ ID NO: 9185 - RNA, 22 nt, Human
gcgcacaaccccguggcgguga

SEQ ID NO: 9186 - RNA, 22 nt, Human
gcgccgacccucccugccggac

SEQ ID NO: 9187 - RNA, 22 nt, Human
gcgccuugccuguccucuaacc

SEQ ID NO: 9188 - RNA, 22 nt, Human
gcgcgccugccucccgcggugc

SEQ ID NO: 9189 - RNA, 22 nt, Human
gcgcgggugagucacgggcgga

SEQ ID NO: 9190 - RNA, 22 nt, Human
gcgcucuccugcagacagccuc

SEQ ID NO: 9191 - RNA, 20 nt, Human
gcgcuucccuacgcucugcu

SEQ ID NO: 9192 - RNA, 22 nt, Human
gcggacaauggaagaugucauu

SEQ ID NO: 9193 - RNA, 22 nt, Human
gcggagaggcagagacuccgcg

SEQ ID NO: 9194 - RNA, 22 nt, Human
gcggagcuaaagauuggcuccu

SEQ ID NO: 9195 - RNA, 22 nt, Human
gcggaucuccuugagugggcaa

SEQ ID NO: 9196 - RNA, 22 nt, Human
gcggcaguccuuccaguacagg

SEQ ID NO: 9197 - RNA, 22 nt, Human
gcggcggcggaggcgggggcag

SEQ ID NO: 9198 - RNA, 22 nt, Human
gcggcgucccagcuccgacggc

SEQ ID NO: 9199 - RNA, 22 nt, Human
gcggcuggcuguccaaacuggg

SEQ ID NO: 9200 - RNA, 22 nt, Human
gcgggccggcaggggaggaguu

SEQ ID NO: 9201 - RNA, 22 nt, Human
gcgggcuuggcuccagggccca

SEQ ID NO: 9202 - RNA, 22 nt, Human
gcggggcucuacuuggccugga

SEQ ID NO: 9203 - RNA, 22 nt, Human
gcggggggcucgggcagcucgg

SEQ ID NO: 9204 - RNA, 22 nt, Human
gcggguggaggagggacgggca

SEQ ID NO: 9205 - RNA, 22 nt, Human
gcgguuauggcagagauuacag

SEQ ID NO: 9206 - RNA, 22 nt, Human
gcgguuggacguucgccucggg

SEQ ID NO: 9207 - RNA, 22 nt, Human
gcgugcauggccguguguaugc

SEQ ID NO: 9208 - RNA, 22 nt, Human
gcguggaugauuuugagucggu

SEQ ID NO: 9209 - RNA, 22 nt, Human
gcgugugugauaugccucugca

SEQ ID NO: 9210 - RNA, 22 nt, Human
gcuaaccaaaccuguuguuugg

SEQ ID NO: 9211 - RNA, 22 nt, Human
gcuaagucaaaaaauucaaaau

SEQ ID NO: 9212 - RNA, 22 nt, Human
gcuacaggggucaguccuuugc

SEQ ID NO: 9213 - RNA, 22 nt, Human
gcuagaaacuguuuaaucucuu

SEQ ID NO: 9214 - RNA, 22 nt, Human
gcuagagaagagcccacaccgg

SEQ ID NO: 9215 - RNA, 22 nt, Human
gcuagagaccagaggccuugaa

SEQ ID NO: 9216 - RNA, 22 nt, Human
gcuagcugugcuuggaaguuug

SEQ ID NO: 9217 - RNA, 22 nt, Human
gcuaggagccucgacucuggag

SEQ ID NO: 9218 - RNA, 20 nt, Human
gcuaggggacuggagggagg

SEQ ID NO: 9219 - RNA, 22 nt, Human
gcuaguaagugauagagcugag

SEQ ID NO: 9220 - RNA, 22 nt, Human
gcuaguucugccuccccuagug

SEQ ID NO: 9221 - RNA, 22 nt, Human
gcuauuuagaaaggcuuggaga

SEQ ID NO: 9222 - RNA, 22 nt, Human
gcucaaggucacacagggguga

SEQ ID NO: 9223 - RNA, 22 nt, Human
gcucacuuguaaccccuuccuc

SEQ ID NO: 9224 - RNA, 22 nt, Human
gcucagagaugucugcugccuu

SEQ ID NO: 9225 - RNA, 22 nt, Human
gcucagcuggagagggacgggu

SEQ ID NO: 9226 - RNA, 20 nt, Human
gcucaguggagaaaugcacc

SEQ ID NO: 9227 - RNA, 22 nt, Human
gcucaugggcccagagcagccc

SEQ ID NO: 9228 - RNA, 22 nt, Human
gcuccacugccccugggcaccg

SEQ ID NO: 9229 - RNA, 22 nt, Human
gcuccagcuccauaaacauaag

SEQ ID NO: 9230 - RNA, 21 nt, Human
gcucccgaagugcucggcguu

SEQ ID NO: 9231 - RNA, 22 nt, Human
gcuccggggguuccagaucauc

SEQ ID NO: 9232 - RNA, 22 nt, Human
gcuccuuaugguccugacccua

SEQ ID NO: 9233 - RNA, 22 nt, Human
gcucggcuggcucaucucaugu

SEQ ID NO: 9234 - RNA, 23 nt, Human
gcucuccaucacaugguguggca

SEQ ID NO: 9235 - RNA, 22 nt, Human
gcucuccuugaugcccucuguu

SEQ ID NO: 9236 - RNA, 22 nt, Human
gcucuccuugcuagagguucua

SEQ ID NO: 9237 - RNA, 22 nt, Human
gcucugaacugucaugaauugg

SEQ ID NO: 9238 - RNA, 22 nt, Human
gcucuggcuacuguggcuaccg

SEQ ID NO: 9239 - RNA, 22 nt, Human
gcucuugcuuuuucuagaaaga

SEQ ID NO: 9240 - RNA, 22 nt, Human
gcugacucugcuuuuagccucc

SEQ ID NO: 9241 - RNA, 22 nt, Human
gcugacuguagcugggggaaga

SEQ ID NO: 9242 - RNA, 22 nt, Human
gcugagaguguaggauguuuac

SEQ ID NO: 9243 - RNA, 22 nt, Human
gcugagcaaugcacugccgcau

SEQ ID NO: 9244 - RNA, 22 nt, Human
gcugauucuucugcuuuuucuc

SEQ ID NO: 9245 - RNA, 22 nt, Human
gcugcagggagcuggaaggcuc

SEQ ID NO: 9246 - RNA, 22 nt, Human
gcugcccauugcucucccacuc

SEQ ID NO: 9247 - RNA, 23 nt, Human
gcugccguuucccaucgugguga

SEQ ID NO: 9248 - RNA, 22 nt, Human
gcugccuugaacuuggccuggg

SEQ ID NO: 9249 - RNA, 22 nt, Human
gcugcuacagagcuggaggggg

SEQ ID NO: 9250 - RNA, 22 nt, Human
gcugcuggcggagcuggcgcug

SEQ ID NO: 9251 - RNA, 22 nt, Human
gcugcuggcuuccugcuguuuu

SEQ ID NO: 9252 - RNA, 22 nt, Human
gcugcuuacuauaggguuaacu

SEQ ID NO: 9253 - RNA, 22 nt, Human
gcuggaugucugugccaggcac

SEQ ID NO: 9254 - RNA, 22 nt, Human
gcuggcgauggccgagucuccg

SEQ ID NO: 9255 - RNA, 22 nt, Human
gcuggcggguuggggaggcgga

SEQ ID NO: 9256 - RNA, 21 nt, Human
gcuggcugucucuuacacggu

SEQ ID NO: 9257 - RNA, 22 nt, Human
gcugggagucgcgucuguggcc

SEQ ID NO: 9258 - RNA, 22 nt, Human
gcuggggaucgaaggcagagcc

SEQ ID NO: 9259 - RNA, 22 nt, Human
gcugggucucucccugguccug

SEQ ID NO: 9260 - RNA, 22 nt, Human
gcuggguuguucuccuggucca

SEQ ID NO: 9261 - RNA, 22 nt, Human
gcuggucuggcaauccucaugg

SEQ ID NO: 9262 - RNA, 22 nt, Human
gcuggugugagauucucgaggg

SEQ ID NO: 9263 - RNA, 22 nt, Human
gcuuauugcuuauagauaggaa

SEQ ID NO: 9264 - RNA, 22 nt, Human
gcuucccacagcuggacugggg

SEQ ID NO: 9265 - RNA, 22 nt, Human
gcuucccagaccaggcucccuc

SEQ ID NO: 9266 - RNA, 22 nt, Human
gcuuccuccaucuggggcuugc

SEQ ID NO: 9267 - RNA, 22 nt, Human
gcuucucauguuuauuuuuaca

SEQ ID NO: 9268 - RNA, 22 nt, Human
gcuucugugagugcagaugcug

SEQ ID NO: 9269 - RNA, 22 nt, Human
gcuucuguuaggauguggcuua

SEQ ID NO: 9270 - RNA, 22 nt, Human
gcuugaggaacucagacuugag

SEQ ID NO: 9271 - RNA, 22 nt, Human
gcuugcugaacaggaaccuggc

SEQ ID NO: 9272 - RNA, 22 nt, Human
gcuugcuuuguaaauaucugug

SEQ ID NO: 9273 - RNA, 22 nt, Human
gcuuggagaacguuuucuagaa

SEQ ID NO: 9274 - RNA, 22 nt, Human
gcuugggcugaaggccuggguc

SEQ ID NO: 9275 - RNA, 22 nt, Human
gcuuguauguguauauauacau

SEQ ID NO: 9276 - RNA, 22 nt, Human
gcuuguuagcaaugcagaaucu

SEQ ID NO: 9277 - RNA, 22 nt, Human
gcuuguuuagcauaggucacug

SEQ ID NO: 9278 - RNA, 22 nt, Human
gcuuucacugcaauagaugaau

SEQ ID NO: 9279 - RNA, 22 nt, Human
gcuuucagggucacugucaaca

SEQ ID NO: 9280 - RNA, 22 nt, Human
gcuuucauuauguuguguuuuu

SEQ ID NO: 9281 - RNA, 22 nt, Human
gcuuuccuggcccugucccugc

SEQ ID NO: 9282 - RNA, 23 nt, Human
gcuuugaaaaugcuuucuuccag

SEQ ID NO: 9283 - RNA, 22 nt, Human
gcuuuguucauuuaguuuuuuu

SEQ ID NO: 9284 - RNA, 22 nt, Human
gcuuuguugauggugagucugu

SEQ ID NO: 9285 - RNA, 22 nt, Human
gcuuuucucccugcuuucuucc

SEQ ID NO: 9286 - RNA, 22 nt, Human
gcuuuugaauacuacaggaguu

SEQ ID NO: 9287 - RNA, 22 nt, Human
gcuuuuuaauuugcuucccugg

SEQ ID NO: 9288 - RNA, 22 nt, Human
ggaaaagaauuguuaguuagug

SEQ ID NO: 9289 - RNA, 22 nt, Human
ggaaaagccauauuauaggcaa

SEQ ID NO: 9290 - RNA, 22 nt, Human
ggaaaaucaaaccauuuacagu

SEQ ID NO: 9291 - RNA, 22 nt, Human
ggaaagaggacaucuuacuucu

SEQ ID NO: 9292 - RNA, 22 nt, Human
ggaaaggaagggaaggagaugc

SEQ ID NO: 9293 - RNA, 22 nt, Human
ggaaauauaagcaguuugugug

SEQ ID NO: 9294 - RNA, 22 nt, Human
ggaacaguacucggaggccaga

SEQ ID NO: 9295 - RNA, 19 nt, Human
ggaacgcugggcuccccuc

SEQ ID NO: 9296 - RNA, 22 nt, Human
ggaacuaagcacauuaucugau

SEQ ID NO: 9297 - RNA, 17 nt, Human
ggaagaaaaggaucauc

SEQ ID NO: 9298 - RNA, 22 nt, Human
ggaagaggaagaugaggcagca

SEQ ID NO: 9299 - RNA, 22 nt, Human
ggaagauagaaguucaaaaguu

SEQ ID NO: 9300 - RNA, 22 nt, Human
ggaagcucaauacuuuccucuu

SEQ ID NO: 9301 - RNA, 22 nt, Human
ggaagcugucugcccggcgcuc

SEQ ID NO: 9302 - RNA, 22 nt, Human
ggaagcuguugugagugcagca

SEQ ID NO: 9303 - RNA, 22 nt, Human
ggaaggggagcuggaaagggua

SEQ ID NO: 9304 - RNA, 22 nt, Human
ggaagguauuucuccuugagug

SEQ ID NO: 9305 - RNA, 22 nt, Human
ggaaggugagugcugugugauu

SEQ ID NO: 9306 - RNA, 18 nt, Human
ggaaggugcuggagugca

SEQ ID NO: 9307 - RNA, 22 nt, Human
ggaaguggauucagggcugcua

SEQ ID NO: 9308 - RNA, 22 nt, Human
ggaaguuugagcaucuguuucc

SEQ ID NO: 9309 - RNA, 22 nt, Human
ggaauaauauuacagauacagu

SEQ ID NO: 9310 - RNA, 18 nt, Human
ggaauagcuuguuuccca

SEQ ID NO: 9311 - RNA, 22 nt, Human
ggaauauaaaucagaugcuccg

SEQ ID NO: 9312 - RNA, 22 nt, Human
ggaaugcagugagcauuagaua

SEQ ID NO: 9313 - RNA, 22 nt, Human
ggaauugagcaagggguggggc

SEQ ID NO: 9314 - RNA, 23 nt, Human
ggaauuucagaugugaaauaaaa

SEQ ID NO: 9315 - RNA, 22 nt, Human
ggacagacuuuacagccccggg

SEQ ID NO: 9316 - RNA, 22 nt, Human
ggacagagcaacccuacgcagc

SEQ ID NO: 9317 - RNA, 22 nt, Human
ggacagggagcaaaaacguccc

SEQ ID NO: 9318 - RNA, 22 nt, Human
ggacauagaucuagacuuuaaa

SEQ ID NO: 9319 - RNA, 22 nt, Human
ggacauggaaagugugugauuu

SEQ ID NO: 9320 - RNA, 22 nt, Human
ggacauugaagcuggaaaggga

SEQ ID NO: 9321 - RNA, 21 nt, Human
ggacccucagauggcagugag

SEQ ID NO: 9322 - RNA, 20 nt, Human
ggacccuggguucuucugag

SEQ ID NO: 9323 - RNA, 22 nt, Human
ggaccucagccaucccucggag

SEQ ID NO: 9324 - RNA, 22 nt, Human
ggacggcuagcagcagaauuca

SEQ ID NO: 9325 - RNA, 23 nt, Human
ggacuaggcaacagaugggacag

SEQ ID NO: 9326 - RNA, 22 nt, Human
ggacuccuguguuuuggcugag

SEQ ID NO: 9327 - RNA, 21 nt, Human
ggacucguucgccgugccagc

SEQ ID NO: 9328 - RNA, 22 nt, Human
ggacugggagaauggaggcaag

SEQ ID NO: 9329 - RNA, 22 nt, Human
ggacuggugaagccuucggaga

SEQ ID NO: 9330 - RNA, 23 nt, Human
ggagaaggaugucaucaaaagac

SEQ ID NO: 9331 - RNA, 22 nt, Human
ggagagaacguaaucuaguauu

SEQ ID NO: 9332 - RNA, 22 nt, Human
ggagagagggaucuuuguggag

SEQ ID NO: 9333 - RNA, 22 nt, Human
ggagagcguggaugggcuucca

SEQ ID NO: 9334 - RNA, 22 nt, Human
ggagaggaggugagaggaagua

SEQ ID NO: 9335 - RNA, 20 nt, Human
ggagagggaaaggcuguacu

SEQ ID NO: 9336 - RNA, 22 nt, Human
ggagaugacaucccagcccggc

SEQ ID NO: 9337 - RNA, 22 nt, Human
ggagauggucacagguaaacau

SEQ ID NO: 9338 - RNA, 22 nt, Human
ggagcaagagugagcaagcaga

SEQ ID NO: 9339 - RNA, 22 nt, Human
ggagcagaggaaagaguagcau

SEQ ID NO: 9340 - RNA, 22 nt, Human
ggagcaguggaggggccagggu

SEQ ID NO: 9341 - RNA, 22 nt, Human
ggagcauggcuucuuggggcug

SEQ ID NO: 9342 - RNA, 22 nt, Human
ggagccucuaaacaguuaucaa

SEQ ID NO: 9343 - RNA, 22 nt, Human
ggagccuggaguuucugauggg

SEQ ID NO: 9344 - RNA, 22 nt, Human
ggagcuaagagaauggacaagg

SEQ ID NO: 9345 - RNA, 22 nt, Human
ggagcucaggaguugauuauuu

SEQ ID NO: 9346 - RNA, 22 nt, Human
ggagcugaacccuuaacuggcu

SEQ ID NO: 9347 - RNA, 22 nt, Human
ggaggaagagaccagggggcuu

SEQ ID NO: 9348 - RNA, 22 nt, Human
ggaggaggggcggggaggggag

SEQ ID NO: 9349 - RNA, 22 nt, Human
ggaggccagagaagagccaggc

SEQ ID NO: 9350 - RNA, 22 nt, Human
ggaggcccagaaggaagcccag

SEQ ID NO: 9351 - RNA, 22 nt, Human
ggaggcggaaguccaagcaggu

SEQ ID NO: 9352 - RNA, 22 nt, Human
ggagggagugcaggcaggcaga

SEQ ID NO: 9353 - RNA, 22 nt, Human
ggagggcuggacguacuagggc

SEQ ID NO: 9354 - RNA, 22 nt, Human
aauaacuuaaugacuguguaca

SEQ ID NO: 9355 - RNA, 22 nt, Human
aauaacuuacucuaugcuuagu

SEQ ID NO: 9356 - RNA, 22 nt, Human
aauaagagaauaaaaucuguua

SEQ ID NO: 9357 - RNA, 22 nt, Human
aauaagaguuaagaaguauauu

SEQ ID NO: 9358 - RNA, 22 nt, Human
aauaauacaauuggugucaugu

SEQ ID NO: 9359 - RNA, 22 nt, Human
aauaauacaugugaugagaauu

SEQ ID NO: 9360 - RNA, 22 nt, Human
aauaauuuuuuugugauuaugu

SEQ ID NO: 9361 - RNA, 22 nt, Human
aauacagauggcaugugaagau

SEQ ID NO: 9362 - RNA, 22 nt, Human
aauacagcacucacaccucccu

SEQ ID NO: 9363 - RNA, 22 nt, Human
aauagaguccuguacugaauga

SEQ ID NO: 9364 - RNA, 20 nt, Human
aauagcacagcucaaacauu

SEQ ID NO: 9365 - RNA, 22 nt, Human
aauagcacauguugguugagua

SEQ ID NO: 9366 - RNA, 22 nt, Human
aauagcuuuuuguuugguguau

SEQ ID NO: 9367 - RNA, 22 nt, Human
aauaggguccuuuguguuauau

SEQ ID NO: 9368 - RNA, 22 nt, Human
aauagguaaaugaguaagaaau

SEQ ID NO: 9369 - RNA, 22 nt, Human
aauaguggcuuggacuaaauau

SEQ ID NO: 9370 - RNA, 22 nt, Human
aauauagagcagaucuggcucu

SEQ ID NO: 9371 - RNA, 22 nt, Human
aauaucuagccuuuagcagcuu

SEQ ID NO: 9372 - RNA, 22 nt, Human
aauaugccaaauccugucacau

SEQ ID NO: 9373 - RNA, 22 nt, Human
aauaugucacacuccuuaauag

SEQ ID NO: 9374 - RNA, 22 nt, Human
aauauuuaccuaccugucaucu

SEQ ID NO: 9375 - RNA, 22 nt, Human
aaucaaagccugcaaguugacu

SEQ ID NO: 9376 - RNA, 22 nt, Human
aaucaaauuucuugugguuguu

SEQ ID NO: 9377 - RNA, 22 nt, Human
aaucaauuauccauuuguuagu

SEQ ID NO: 9378 - RNA, 19 nt, Human
aaucacaagcaauaggggu

SEQ ID NO: 9379 - RNA, 22 nt, Human
aaucacuggcuccucacggcaa

SEQ ID NO: 9380 - RNA, 22 nt, Human
aaucauaacaaaagcaauuaua

SEQ ID NO: 9381 - RNA, 22 nt, Human
aaucaucuguuguucccuugga

SEQ ID NO: 9382 - RNA, 22 nt, Human
aaucccaguugacagaacuguu

SEQ ID NO: 9383 - RNA, 22 nt, Human
aauccucguagugguuagaaag

SEQ ID NO: 9384 - RNA, 22 nt, Human
aaucgacuguagagacuuggcg

SEQ ID NO: 9385 - RNA, 22 nt, Human
aaucuacaaugaaaaaauguuu

SEQ ID NO: 9386 - RNA, 22 nt, Human
aaucuagagaacuguggggcag

SEQ ID NO: 9387 - RNA, 22 nt, Human
aaucucguuaugaagaugguug

SEQ ID NO: 9388 - RNA, 22 nt, Human
aaucuuguucaacauuaucugu

SEQ ID NO: 9389 - RNA, 22 nt, Human
aaucuuuuugaaggaggagaga

SEQ ID NO: 9390 - RNA, 22 nt, Human
aaugaaaaucugucaguucaag

SEQ ID NO: 9391 - RNA, 22 nt, Human
aaugaacuuucaguucagagag

SEQ ID NO: 9392 - RNA, 22 nt, Human
aaugaauaaauuuuaaagacag

SEQ ID NO: 9393 - RNA, 22 nt, Human
aaugaaugaaugaaugauuaug

SEQ ID NO: 9394 - RNA, 22 nt, Human
aaugacagccuauacugucugc

SEQ ID NO: 9395 - RNA, 22 nt, Human
aaugacaguggcacagucacuu

SEQ ID NO: 9396 - RNA, 22 nt, Human
aaugagacgagagaacccauuu

SEQ ID NO: 9397 - RNA, 22 nt, Human
aaugagauggaggacucuuaau

SEQ ID NO: 9398 - RNA, 22 nt, Human
aaugaguccuuuagugccauug

SEQ ID NO: 9399 - RNA, 23 nt, Human
aaugaguugggcagcauacaggc

SEQ ID NO: 9400 - RNA, 22 nt, Human
aaugaguuuguucuauuauuug

SEQ ID NO: 9401 - RNA, 22 nt, Human
aaugauuuucugcaaacaguga

SEQ ID NO: 9402 - RNA, 22 nt, Human
aaugcagaugugucuuuaauuu

SEQ ID NO: 9403 - RNA, 22 nt, Human
aaugcauaaugguuugugacaa

SEQ ID NO: 9404 - RNA, 22 nt, Human
aaugcauacguguuuguggcaa

SEQ ID NO: 9405 - RNA, 22 nt, Human
aaugcgcagaguggugugugca

SEQ ID NO: 9406 - RNA, 22 nt, Human
aaugcugaaugcauguuuccau

SEQ ID NO: 9407 - RNA, 22 nt, Human
aauggaaaaagaacuguuuaaa

SEQ ID NO: 9408 - RNA, 22 nt, Human
aauggaaaaauccacagggaac

SEQ ID NO: 9409 - RNA, 22 nt, Human
aauggaccuuaaauugcuucag

SEQ ID NO: 9410 - RNA, 22 nt, Human
aauggagaaaagacaauguuga

SEQ ID NO: 9411 - RNA, 22 nt, Human
aauggagugguucuugcccucu

SEQ ID NO: 9412 - RNA, 22 nt, Human
aauggcaaaaguuucggaaauu

SEQ ID NO: 9413 - RNA, 22 nt, Human
aauggcagauaauuuuccagau

SEQ ID NO: 9414 - RNA, 22 nt, Human
aauggcuagcauguaaaauauc

SEQ ID NO: 9415 - RNA, 22 nt, Human
aaugggauaggucuucaggaau

SEQ ID NO: 9416 - RNA, 22 nt, Human
aaugguaauauuucauaguugu

SEQ ID NO: 9417 - RNA, 22 nt, Human
aauggugaggagugcauugaga

SEQ ID NO: 9418 - RNA, 22 nt, Human
aaugguggaugucuguucugac

SEQ ID NO: 9419 - RNA, 22 nt, Human
aaugguuacuacccugggucuu

SEQ ID NO: 9420 - RNA, 23 nt, Human
aaugugaaauugaguuuuuguua

SEQ ID NO: 9421 - RNA, 22 nt, Human
aaugugcugguaacugcuuugc

SEQ ID NO: 9422 - RNA, 22 nt, Human
aaugugguauuuuggcauucuu

SEQ ID NO: 9423 - RNA, 22 nt, Human
aauguguauguguauauauaug

SEQ ID NO: 9424 - RNA, 22 nt, Human
aauguucauauggguagcagau

SEQ ID NO: 9425 - RNA, 22 nt, Human
aauguucucuaaucuuucucuu

SEQ ID NO: 9426 - RNA, 22 nt, Human
aauguugaaccuuuuuggccug

SEQ ID NO: 9427 - RNA, 22 nt, Human
aauguugacguuggccagggcc

SEQ ID NO: 9428 - RNA, 22 nt, Human
aauguuuaagcuuuuauuuaca

SEQ ID NO: 9429 - RNA, 22 nt, Human
aauuaaauguuugguuugagcu

SEQ ID NO: 9430 - RNA, 22 nt, Human
aauuaacuggguucucagaugc

SEQ ID NO: 9431 - RNA, 22 nt, Human
aauuacuuuaggaaaacuccuc

SEQ ID NO: 9432 - RNA, 22 nt, Human
aauuauguuugcuuuagaugga

SEQ ID NO: 9433 - RNA, 22 nt, Human
aauuauuaagcuuucuccagug

SEQ ID NO: 9434 - RNA, 22 nt, Human
aauuauucaugucugggcagcc

SEQ ID NO: 9435 - RNA, 22 nt, Human
aauuauucucucaacugagaug

SEQ ID NO: 9436 - RNA, 22 nt, Human
aauuauugucuuuuuuaaaagc

SEQ ID NO: 9437 - RNA, 22 nt, Human
aauucaacagucaguuaucuca

SEQ ID NO: 9438 - RNA, 21 nt, Human
aauucccagaaacagcacaag

SEQ ID NO: 9439 - RNA, 22 nt, Human
aauucuaaugaguucuuaucua

SEQ ID NO: 9440 - RNA, 22 nt, Human
aauucugaggccauuuauuucc

SEQ ID NO: 9441 - RNA, 22 nt, Human
aauucugcagucguacuauaau

SEQ ID NO: 9442 - RNA, 22 nt, Human
aauucuguugguuagaguugga

SEQ ID NO: 9443 - RNA, 22 nt, Human
aauucuuuguuccucugccaag

SEQ ID NO: 9444 - RNA, 22 nt, Human
aauugaggaaccuuagggcaaa

SEQ ID NO: 9445 - RNA, 22 nt, Human
aauugcauucauuuguauauuu

SEQ ID NO: 9446 - RNA, 21 nt, Human
aauugccuaauauaugggaag

SEQ ID NO: 9447 - RNA, 22 nt, Human
aauugcuuucacaaguguuaua

SEQ ID NO: 9448 - RNA, 22 nt, Human
aauugugagaguuagagagcau

SEQ ID NO: 9449 - RNA, 22 nt, Human
aauuuaauugguuuuuacuugu

SEQ ID NO: 9450 - RNA, 22 nt, Human
aauuuauccuuuugcuaaagca

SEQ ID NO: 9451 - RNA, 22 nt, Human
aauuucagaccaacgagucagg

SEQ ID NO: 9452 - RNA, 22 nt, Human
aauuucaucugagacugggagc

SEQ ID NO: 9453 - RNA, 22 nt, Human
aauuucuuuagagguacugauc

SEQ ID NO: 9454 - RNA, 22 nt, Human
aauuuuagcuaaagauccaugg

SEQ ID NO: 9455 - RNA, 22 nt, Human
aauuuuauuagacaggcauaau

SEQ ID NO: 9456 - RNA, 22 nt, Human
acaaaaauauuguagaagugcu

SEQ ID NO: 9457 - RNA, 21 nt, Human
acaaaaccuaacuuggcugcu

SEQ ID NO: 9458 - RNA, 22 nt, Human
acaaacugggauaggauccugu

SEQ ID NO: 9459 - RNA, 22 nt, Human
acaaagugaaaagcaucgaauu

SEQ ID NO: 9460 - RNA, 22 nt, Human
acaaauuuaaauguugucuguu

SEQ ID NO: 9461 - RNA, 22 nt, Human
acaacagaacuccugggauuuu

SEQ ID NO: 9462 - RNA, 22 nt, Human
acaagaaaggucugggaacaau

SEQ ID NO: 9463 - RNA, 22 nt, Human
acaagaccagcagggagggugc

SEQ ID NO: 9464 - RNA, 22 nt, Human
acaaggccaagcauucuagcaa

SEQ ID NO: 9465 - RNA, 22 nt, Human
acaaggccugagggugacagca

SEQ ID NO: 9466 - RNA, 17 nt, Human
acaaugggcaacaauau

SEQ ID NO: 9467 - RNA, 22 nt, Human
acaaugugcuuaugaaggcagu

SEQ ID NO: 9468 - RNA, 22 nt, Human
acacaagaaugugcacucagcc

SEQ ID NO: 9469 - RNA, 19 nt, Human
acacaccagugccugugac

SEQ ID NO: 9470 - RNA, 22 nt, Human
acacagaguauuuagaaggggu

SEQ ID NO: 9471 - RNA, 20 nt, Human
acacagccuagaguuuggcu

SEQ ID NO: 9472 - RNA, 22 nt, Human
acacaggacacaaaagucacca

SEQ ID NO: 9473 - RNA, 23 nt, Human
acacauguuuaugcuugggggca

SEQ ID NO: 9474 - RNA, 22 nt, Human
acacccuugcagacgguuccuu

SEQ ID NO: 9475 - RNA, 22 nt, Human
acacccuuuagcaauucuucaa

SEQ ID NO: 9476 - RNA, 22 nt, Human
acacgauguuuuaagccccuaa

SEQ ID NO: 9477 - RNA, 22 nt, Human
acacucaugcucagcuggugcu

SEQ ID NO: 9478 - RNA, 22 nt, Human
acacuuuugcgagagcaugcag

SEQ ID NO: 9479 - RNA, 14 nt, Human
acagaagucugcua

SEQ ID NO: 9480 - RNA, 22 nt, Human
acagacaucaucaacaucuucc

SEQ ID NO: 9481 - RNA, 22 nt, Human
acagacuuaguauccugcugcu

SEQ ID NO: 9482 - RNA, 22 nt, Human
acagacuugaccuuggagaggc

SEQ ID NO: 9483 - RNA, 20 nt, Human
acagagauccucucuuuauc

SEQ ID NO: 9484 - RNA, 22 nt, Human
acagagcucccagccaucuccu

SEQ ID NO: 9485 - RNA, 22 nt, Human
acagagggagugacggccaacc

SEQ ID NO: 9486 - RNA, 22 nt, Human
acagagguuaggauggguugua

SEQ ID NO: 9487 - RNA, 22 nt, Human
acagaugccagcuacaccaccg

SEQ ID NO: 9488 - RNA, 22 nt, Human
acagcagguuauuguuauggca

SEQ ID NO: 9489 - RNA, 22 nt, Human
acagccacccuggaacgguugu

SEQ ID NO: 9490 - RNA, 20 nt, Human
acagccguaaugguccuugg

SEQ ID NO: 9491 - RNA, 22 nt, Human
acagcucaggcccaucaacccc

SEQ ID NO: 9492 - RNA, 22 nt, Human
acagcugagaugcuacuugugg

SEQ ID NO: 9493 - RNA, 22 nt, Human
acagcugguugaaggggaccaa

SEQ ID NO: 9494 - RNA, 22 nt, Human
acaggacaaaaaucuggauggc

SEQ ID NO: 9495 - RNA, 22 nt, Human
acaggccuggguucaaauuugg

SEQ ID NO: 9496 - RNA, 22 nt, Human
acaggguauauaggcaaagcua

SEQ ID NO: 9497 - RNA, 22 nt, Human
acagguaucccuuucuaccuga

SEQ ID NO: 9498 - RNA, 22 nt, Human
acagguuucuccccugguuauu

SEQ ID NO: 9499 - RNA, 21 nt, Human
acaguaugaucaaaugugcca

SEQ ID NO: 9500 - RNA, 22 nt, Human
acagucuuggauuccaggaguc

SEQ ID NO: 9501 - RNA, 22 nt, Human
acagugguggagggcuguccug

SEQ ID NO: 9502 - RNA, 22 nt, Human
acaguuagguccuaaaauucug

SEQ ID NO: 9503 - RNA, 22 nt, Human
acaguuuucugagaaucacagg

SEQ ID NO: 9504 - RNA, 22 nt, Human
acauaaaccccccuuccccagg

SEQ ID NO: 9505 - RNA, 22 nt, Human
acauaaauagcacugugaauuu

SEQ ID NO: 9506 - RNA, 22 nt, Human
acauauaugugcauacaacuau

SEQ ID NO: 9507 - RNA, 22 nt, Human
acauauggcagguugaucaaug

SEQ ID NO: 9508 - RNA, 22 nt, Human
acaucacuugguuaaugugguc

SEQ ID NO: 9509 - RNA, 22 nt, Human
acauccagcagauuguccagag

SEQ ID NO: 9510 - RNA, 21 nt, Human
acauccaggguccucacugcc

SEQ ID NO: 9511 - RNA, 22 nt, Human
acauccaguaucagaagcauca

SEQ ID NO: 9512 - RNA, 22 nt, Human
acaucccccuacuuguguccug

SEQ ID NO: 9513 - RNA, 22 nt, Human
acaucuaugucugaggccuugg

SEQ ID NO: 9514 - RNA, 22 nt, Human
acaugacagugacuuuauaaga

SEQ ID NO: 9515 - RNA, 22 nt, Human
acaugaggaacucaggagucac

SEQ ID NO: 9516 - RNA, 22 nt, Human
acauggaaacacgcagccccaa

SEQ ID NO: 9517 - RNA, 22 nt, Human
acauggaauuucagaagagcau

SEQ ID NO: 9518 - RNA, 22 nt, Human
acauggacugguccauuaugac

SEQ ID NO: 9519 - RNA, 20 nt, Human
acauggagaagcgagguagg

SEQ ID NO: 9520 - RNA, 22 nt, Human
acauggcaugaauaauguguac

SEQ ID NO: 9521 - RNA, 22 nt, Human
acauggguuaaagaagauggaa

SEQ ID NO: 9522 - RNA, 22 nt, Human
acaugucagaaaauucagaggg

SEQ ID NO: 9523 - RNA, 23 nt, Human
acauuacacgcaguaauugcccc

SEQ ID NO: 9524 - RNA, 22 nt, Human
acauuagaugacucuuucuuuc

SEQ ID NO: 9525 - RNA, 22 nt, Human
acauuauuguguagugugggca

SEQ ID NO: 9526 - RNA, 22 nt, Human
acauuccugaagguaaugagaa

SEQ ID NO: 9527 - RNA, 22 nt, Human
acauucucuuuuagaaagcugu

SEQ ID NO: 9528 - RNA, 22 nt, Human
acauuguuuuugugacuucuau

SEQ ID NO: 9529 - RNA, 22 nt, Human
acauuuccaaagaugccaguca

SEQ ID NO: 9530 - RNA, 22 nt, Human
acauuugauauggaguugugua

SEQ ID NO: 9531 - RNA, 22 nt, Human
acauuuguuucucuagaguagg

SEQ ID NO: 9532 - RNA, 22 nt, Human
acauuuuguuuauggaaaagau

SEQ ID NO: 9533 - RNA, 22 nt, Human
accaacacgucugaguauuucc

SEQ ID NO: 9534 - RNA, 22 nt, Human
accaacuuuccaaagugccugg

SEQ ID NO: 9535 - RNA, 22 nt, Human
accaaucuccuauuuuguuuca

SEQ ID NO: 9536 - RNA, 22 nt, Human
accaaucugguauauuccagaa

SEQ ID NO: 9537 - RNA, 22 nt, Human
accaauguucaaccuugacugc

SEQ ID NO: 9538 - RNA, 22 nt, Human
accaccacugacaccagcucgg

SEQ ID NO: 9539 - RNA, 22 nt, Human
accacguccugguggcuguugg

SEQ ID NO: 9540 - RNA, 22 nt, Human
accagccacacacauuagucac

SEQ ID NO: 9541 - RNA, 22 nt, Human
accagcgcguuuucaguuucau

SEQ ID NO: 9542 - RNA, 22 nt, Human
accaggaguuuugaccaggggc

SEQ ID NO: 9543 - RNA, 22 nt, Human
acugaugacaaugugaguguuc

SEQ ID NO: 9544 - RNA, 22 nt, Human
acugauuccaagcuuguggagg

SEQ ID NO: 9545 - RNA, 22 nt, Human
acugauuuuauauauuaccccg

SEQ ID NO: 9546 - RNA, 20 nt, Human
acugcaagagacagaugaaa

SEQ ID NO: 9547 - RNA, 22 nt, Human
acugcacuccagcccgagcaac

SEQ ID NO: 9548 - RNA, 22 nt, Human
acugcagauccucugagaaacc

SEQ ID NO: 9549 - RNA, 22 nt, Human
acugcaggucccaucaccugcg

SEQ ID NO: 9550 - RNA, 22 nt, Human
acugcauuaucaccaagaugua

SEQ ID NO: 9551 - RNA, 22 nt, Human
acugcauuucauaaauuacaau

SEQ ID NO: 9552 - RNA, 22 nt, Human
acugccauauuaggagcuucag

SEQ ID NO: 9553 - RNA, 21 nt, Human
acugccaugcaggagccucca

SEQ ID NO: 9554 - RNA, 22 nt, Human
acugccuugcaccauggcuuuu

SEQ ID NO: 9555 - RNA, 23 nt, Human
acuggauuguucuugggcgcuga

SEQ ID NO: 9556 - RNA, 22 nt, Human
acuggcaugauagaccauaaca

SEQ ID NO: 9557 - RNA, 22 nt, Human
acuggcgucugucuccccugcc

SEQ ID NO: 9558 - RNA, 22 nt, Human
acuggcuuggaaauggguauuu

SEQ ID NO: 9559 - RNA, 19 nt, Human
acugggaugggcagugcca

SEQ ID NO: 9560 - RNA, 22 nt, Human
acugggcaaggauaugaugggu

SEQ ID NO: 9561 - RNA, 22 nt, Human
acuggggcaggaaaguaugcug

SEQ ID NO: 9562 - RNA, 19 nt, Human
acuggggcaggcugggcuu

SEQ ID NO: 9563 - RNA, 22 nt, Human
acuggguuguuugucucaugag

SEQ ID NO: 9564 - RNA, 22 nt, Human
acugguagcugauuaaguauag

SEQ ID NO: 9565 - RNA, 22 nt, Human
acugucaggauugagucucugg

SEQ ID NO: 9566 - RNA, 22 nt, Human
acugucauuaaugaauguaaua

SEQ ID NO: 9567 - RNA, 22 nt, Human
acugucuuguuguaugugagcu

SEQ ID NO: 9568 - RNA, 22 nt, Human
acugugacucuguuucuuggau

SEQ ID NO: 9569 - RNA, 22 nt, Human
acugugacugugucuucugggc

SEQ ID NO: 9570 - RNA, 22 nt, Human
acugugauguaaagaaauaggc

SEQ ID NO: 9571 - RNA, 22 nt, Human
acugugcccccucuacugcuga

SEQ ID NO: 9572 - RNA, 18 nt, Human
acuguggcucagaguugc

SEQ ID NO: 9573 - RNA, 22 nt, Human
acuguggcugcuacccuggcuc

SEQ ID NO: 9574 - RNA, 22 nt, Human
acuguuauugguguauguggca

SEQ ID NO: 9575 - RNA, 17 nt, Human
acuuaagacaguggaaa

SEQ ID NO: 9576 - RNA, 22 nt, Human
acuuaagcagaucuguggucca

SEQ ID NO: 9577 - RNA, 22 nt, Human
acuuacuuucuauucuuguagg

SEQ ID NO: 9578 - RNA, 22 nt, Human
acuuagacaucuuuagugguua

SEQ ID NO: 9579 - RNA, 22 nt, Human
acuuauaaauuuaguacacugu

SEQ ID NO: 9580 - RNA, 22 nt, Human
acuucaggacggcaguggaggg

SEQ ID NO: 9581 - RNA, 22 nt, Human
acuucaggagcagucucuggaa

SEQ ID NO: 9582 - RNA, 22 nt, Human
acuucagugugguauaaaacgu

SEQ ID NO: 9583 - RNA, 22 nt, Human
acuucauuugaaaugguugaau

SEQ ID NO: 9584 - RNA, 21 nt, Human
acuuccacaucacugaguaga

SEQ ID NO: 9585 - RNA, 22 nt, Human
acuuccuuccagcaaauggcau

SEQ ID NO: 9586 - RNA, 22 nt, Human
acuuccuuuuuuggggauagca

SEQ ID NO: 9587 - RNA, 22 nt, Human
acuucucuuuucauuaauuuug

SEQ ID NO: 9588 - RNA, 22 nt, Human
acuucugcccuggcgagggcgu

SEQ ID NO: 9589 - RNA, 22 nt, Human
acuucuuuugcaugauucuuua

SEQ ID NO: 9590 - RNA, 22 nt, Human
acuugaagcaugaaaauaagcc

SEQ ID NO: 9591 - RNA, 18 nt, Human
acuugacuuguuucucag

SEQ ID NO: 9592 - RNA, 22 nt, Human
acuugagcuugaaagguaugcu

SEQ ID NO: 9593 - RNA, 22 nt, Human
acuugaugcauauggaagagca

SEQ ID NO: 9594 - RNA, 22 nt, Human
acuugcaucuuagagacucacc

SEQ ID NO: 9595 - RNA, 22 nt, Human
acuuggcuaggguuuuuaucuu

SEQ ID NO: 9596 - RNA, 22 nt, Human
acuugggaaaugaaaauacaga

SEQ ID NO: 9597 - RNA, 22 nt, Human
acuugguccacaguaagugcuu

SEQ ID NO: 9598 - RNA, 22 nt, Human
acuuguaaaauagagauaggga

SEQ ID NO: 9599 - RNA, 22 nt, Human
acuuuaaauaucauuugguagg

SEQ ID NO: 9600 - RNA, 22 nt, Human
acuuuauacuagugauaguuug

SEQ ID NO: 9601 - RNA, 22 nt, Human
acuuuccuggcuuugcaaggua

SEQ ID NO: 9602 - RNA, 22 nt, Human
acuuugaauuagaauuuugcug

SEQ ID NO: 9603 - RNA, 22 nt, Human
acuuugagaauuuuacuugugu

SEQ ID NO: 9604 - RNA, 22 nt, Human
acuuugccagcucccugcuggc

SEQ ID NO: 9605 - RNA, 22 nt, Human
acuuugucuugaucaaaggugu

SEQ ID NO: 9606 - RNA, 22 nt, Human
acuuuuaauaguagauuuuuaa

SEQ ID NO: 9607 - RNA, 22 nt, Human
acuuuuccuggguagcuccugg

SEQ ID NO: 9608 - RNA, 22 nt, Human
agaaaagaggcuuucuaagcau

SEQ ID NO: 9609 - RNA, 22 nt, Human
agaaaaggaagcuuagacugua

SEQ ID NO: 9610 - RNA, 22 nt, Human
agaaaauagguaguagacgggc

SEQ ID NO: 9611 - RNA, 19 nt, Human
agaaacaacauucuggaga

SEQ ID NO: 9612 - RNA, 22 nt, Human
agaaacaagcccuagaaguccu

SEQ ID NO: 9613 - RNA, 22 nt, Human
agaaagcacccugcacuuucug

SEQ ID NO: 9614 - RNA, 22 nt, Human
agaaauggggugaagcaaaugg

SEQ ID NO: 9615 - RNA, 22 nt, Human
agaaauuguaauaaaucugguc

SEQ ID NO: 9616 - RNA, 22 nt, Human
agaacaagaaacccgaaaagug

SEQ ID NO: 9617 - RNA, 22 nt, Human
agaaccauccugguuccagcuu

SEQ ID NO: 9618 - RNA, 22 nt, Human
agaacccaaggcccagggaugu

SEQ ID NO: 9619 - RNA, 22 nt, Human
agaagcaaagcaaacacauucu

SEQ ID NO: 9620 - RNA, 22 nt, Human
agaagcagaaggaagcagggcc

SEQ ID NO: 9621 - RNA, 22 nt, Human
agaaggcagaaaagcuuuacaa

SEQ ID NO: 9622 - RNA, 22 nt, Human
agaaggcaucugcucgcuucca

SEQ ID NO: 9623 - RNA, 16 nt, Human
agaaggcuaguaacag

SEQ ID NO: 9624 - RNA, 22 nt, Human
agaagguagaugcaucaggagg

SEQ ID NO: 9625 - RNA, 22 nt, Human
agaaguguacuuagagaacaua

SEQ ID NO: 9626 - RNA, 21 nt, Human
agaaguuauuccauggguguu

SEQ ID NO: 9627 - RNA, 22 nt, Human
agaauaagucuaauauauuggu

SEQ ID NO: 9628 - RNA, 22 nt, Human
agaauacuaauaagggauuugc

SEQ ID NO: 9629 - RNA, 22 nt, Human
agaaucaggaagacagccuggc

SEQ ID NO: 9630 - RNA, 22 nt, Human
agaauccugagggaaauuuggc

SEQ ID NO: 9631 - RNA, 22 nt, Human
agaaucugcauuuuaacaagau

SEQ ID NO: 9632 - RNA, 21 nt, Human
agaaugaagaagaggucuuug

SEQ ID NO: 9633 - RNA, 22 nt, Human
agaaugucaagucaagaacaau

SEQ ID NO: 9634 - RNA, 22 nt, Human
agacaagagcugaggacauauu

SEQ ID NO: 9635 - RNA, 22 nt, Human
agacaaggggauuuuugauggu

SEQ ID NO: 9636 - RNA, 22 nt, Human
agacaauuccauccuacguggg

SEQ ID NO: 9637 - RNA, 22 nt, Human
agacacagcaauaacuacuguu

SEQ ID NO: 9638 - RNA, 22 nt, Human
agacacauuuucagcucugcca

SEQ ID NO: 9639 - RNA, 22 nt, Human
agacagaaaaguugucaaucau

SEQ ID NO: 9640 - RNA, 22 nt, Human
agaccauagugauguuuacguc

SEQ ID NO: 9641 - RNA, 19 nt, Human
agacccaguuuucuagugu

SEQ ID NO: 9642 - RNA, 22 nt, Human
agaccccugcuggggcugcugu

SEQ ID NO: 9643 - RNA, 22 nt, Human
agaccccuguggugaugguggu

SEQ ID NO: 9644 - RNA, 22 nt, Human
agacuagccaaaggacuuuaua

SEQ ID NO: 9645 - RNA, 22 nt, Human
agacuagguauagguaauaacu

SEQ ID NO: 9646 - RNA, 22 nt, Human
agacuccuucuaagaccucauu

SEQ ID NO: 9647 - RNA, 22 nt, Human
agacucuggcaugcuaacuagu

SEQ ID NO: 9648 - RNA, 21 nt, Human
agacugaugggaagacucugu

SEQ ID NO: 9649 - RNA, 22 nt, Human
agacuggagucuccuuuggagc

SEQ ID NO: 9650 - RNA, 22 nt, Human
agacuguuccgucagacucagu

SEQ ID NO: 9651 - RNA, 21 nt, Human
agacuucuacuaucuuaugac

SEQ ID NO: 9652 - RNA, 22 nt, Human
agacuucucuaacuugaggacc

SEQ ID NO: 9653 - RNA, 22 nt, Human
agacuuuggcagggccaguggu

SEQ ID NO: 9654 - RNA, 22 nt, Human
accaggcagcaccaaagccggu

SEQ ID NO: 9655 - RNA, 22 nt, Human
accagguugagacuucggcuuu

SEQ ID NO: 9656 - RNA, 22 nt, Human
accaguuaaagaauaugaggcc

SEQ ID NO: 9657 - RNA, 22 nt, Human
accaguuuuuugaccaugggug

SEQ ID NO: 9658 - RNA, 22 nt, Human
accauaugaagaucacacuauc

SEQ ID NO: 9659 - RNA, 22 nt, Human
accauccaggugagggagaccu

SEQ ID NO: 9660 - RNA, 22 nt, Human
accauuauagaggacauuaugu

SEQ ID NO: 9661 - RNA, 22 nt, Human
accauuuaucagaagagacacc

SEQ ID NO: 9662 - RNA, 20 nt, Human
acccagaguccuccccgcgc

SEQ ID NO: 9663 - RNA, 22 nt, Human
acccaucauuagucuuucagga

SEQ ID NO: 9664 - RNA, 22 nt, Human
acccauggcucucugggaugcu

SEQ ID NO: 9665 - RNA, 18 nt, Human
acccauuauauuuguagc

SEQ ID NO: 9666 - RNA, 22 nt, Human
accccuauugcuugugauuaug

SEQ ID NO: 9667 - RNA, 20 nt, Human
accccuccccacuccucgcc

SEQ ID NO: 9668 - RNA, 22 nt, Human
accccuuaaauuuguuguuuaa

SEQ ID NO: 9669 - RNA, 22 nt, Human
acccuacggacuugacugggcg

SEQ ID NO: 9670 - RNA, 22 nt, Human
acccugcacagagggcuuuaua

SEQ ID NO: 9671 - RNA, 22 nt, Human
acccuucugugaccugccuguc

SEQ ID NO: 9672 - RNA, 22 nt, Human
accgagcaggguguuugcgcac

SEQ ID NO: 9673 - RNA, 22 nt, Human
accgcuggcacuggggacgggg

SEQ ID NO: 9674 - RNA, 22 nt, Human
accgggcagcucugccccugcc

SEQ ID NO: 9675 - RNA, 22 nt, Human
accggucucaccaaacgcccca

SEQ ID NO: 9676 - RNA, 21 nt, Human
accgucaguacuaguauugac

SEQ ID NO: 9677 - RNA, 22 nt, Human
accgugcccauucauuuacaaa

SEQ ID NO: 9678 - RNA, 22 nt, Human
accucaguacugcaguuugguu

SEQ ID NO: 9679 - RNA, 22 nt, Human
accucauucugcauagaacuuu

SEQ ID NO: 9680 - RNA, 22 nt, Human
accuccauggcccacaucuagu

SEQ ID NO: 9681 - RNA, 22 nt, Human
accuccauggcucagguuccaa

SEQ ID NO: 9682 - RNA, 22 nt, Human
accucccugaaaaagacagugc

SEQ ID NO: 9683 - RNA, 22 nt, Human
accucuuucuauggauuuuuug

SEQ ID NO: 9684 - RNA, 22 nt, Human
accugaccagguggcuucccaa

SEQ ID NO: 9685 - RNA, 22 nt, Human
accugagauuuuuacucaguaa

SEQ ID NO: 9686 - RNA, 22 nt, Human
accugcagguguuuccacacuu

SEQ ID NO: 9687 - RNA, 22 nt, Human
accugcucucccucucgcaguc

SEQ ID NO: 9688 - RNA, 22 nt, Human
accuggacucugaucacuuuug

SEQ ID NO: 9689 - RNA, 22 nt, Human
accuggcccugggucuccugac

SEQ ID NO: 9690 - RNA, 22 nt, Human
accugguaaccugccugacuaa

SEQ ID NO: 9691 - RNA, 23 nt, Human
accuggucccaugggugggccug

SEQ ID NO: 9692 - RNA, 21 nt, Human
accuggugaugaaugggaggc

SEQ ID NO: 9693 - RNA, 22 nt, Human
accuguagcccaaucauggcag

SEQ ID NO: 9694 - RNA, 19 nt, Human
accuguucaaccucgugcu

SEQ ID NO: 9695 - RNA, 22 nt, Human
accuuaaacagauggcggcugg

SEQ ID NO: 9696 - RNA, 22 nt, Human
accuuagcuguuaaaacuaagu

SEQ ID NO: 9697 - RNA, 22 nt, Human
accuucguuuaguacucauuuu

SEQ ID NO: 9698 - RNA, 22 nt, Human
accuucugaccucucggacuuc

SEQ ID NO: 9699 - RNA, 20 nt, Human
accuucuuugguagacggaa

SEQ ID NO: 9700 - RNA, 22 nt, Human
accuuuggaggacuagggucau

SEQ ID NO: 9701 - RNA, 22 nt, Human
accuuuuauuuucaugcuugcu

SEQ ID NO: 9702 - RNA, 22 nt, Human
acgaaauaaaauuaaagcccua

SEQ ID NO: 9703 - RNA, 23 nt, Human
acgaccuugcccucauuccaaag

SEQ ID NO: 9704 - RNA, 22 nt, Human
acgaggauuuccuuagaugaaa

SEQ ID NO: 9705 - RNA, 22 nt, Human
acgauaacaauaguagcaugua

SEQ ID NO: 9706 - RNA, 22 nt, Human
acgcaacacugcuauuuuuuuc

SEQ ID NO: 9707 - RNA, 22 nt, Human
acgcacuuuaugcuuuuaacaa

SEQ ID NO: 9708 - RNA, 20 nt, Human
acgccgcgaggugagcuggu

SEQ ID NO: 9709 - RNA, 22 nt, Human
acgccggguaaggucauucugc

SEQ ID NO: 9710 - RNA, 22 nt, Human
acgcgcuccagcaggugcuuca

SEQ ID NO: 9711 - RNA, 22 nt, Human
acgcggagccagaggguguggg

SEQ ID NO: 9712 - RNA, 22 nt, Human
acggagggagagagggaggaga

SEQ ID NO: 9713 - RNA, 21 nt, Human
acggaucucgcaccucuccug

SEQ ID NO: 9714 - RNA, 22 nt, Human
acgggggagucuuuuacaucau

SEQ ID NO: 9715 - RNA, 22 nt, Human
acgggugcuuguucccgcugcu

SEQ ID NO: 9716 - RNA, 22 nt, Human
acguaaacagcaaagacaugau

SEQ ID NO: 9717 - RNA, 22 nt, Human
acguagggauuccucgucucau

SEQ ID NO: 9718 - RNA, 22 nt, Human
acgucaucguugucaucgucau

SEQ ID NO: 9719 - RNA, 22 nt, Human
acguccgcugauucuuuggaag

SEQ ID NO: 9720 - RNA, 22 nt, Human
acgugguaaaagaucuguaaaa

SEQ ID NO: 9721 - RNA, 22 nt, Human
acguuuuagccauguaguuucu

SEQ ID NO: 9722 - RNA, 22 nt, Human
acuaaacauaucacugcuuuac

SEQ ID NO: 9723 - RNA, 22 nt, Human
acuaaccacuuuacaccuggug

SEQ ID NO: 9724 - RNA, 22 nt, Human
acuaagcugugugguucacuca

SEQ ID NO: 9725 - RNA, 22 nt, Human
acuaaguagaggagugaugauu

SEQ ID NO: 9726 - RNA, 22 nt, Human
acuaauuguuuaaggauaggaa

SEQ ID NO: 9727 - RNA, 20 nt, Human
acuaccaugcaauuccgcuu

SEQ ID NO: 9728 - RNA, 22 nt, Human
acuacccugaccaaguauuuua

SEQ ID NO: 9729 - RNA, 20 nt, Human
acuagaaagucacugggggg

SEQ ID NO: 9730 - RNA, 22 nt, Human
acuagagguuccagugaaggua

SEQ ID NO: 9731 - RNA, 22 nt, Human
acuagccucauaaaguuugucu

SEQ ID NO: 9732 - RNA, 22 nt, Human
acuaggaaguaaauaugucauc

SEQ ID NO: 9733 - RNA, 22 nt, Human
acuaggagcccgaugccugggu

SEQ ID NO: 9734 - RNA, 22 nt, Human
acuaggugggugucacugacuc

SEQ ID NO: 9735 - RNA, 22 nt, Human
acuauacaguauguacgugcac

SEQ ID NO: 9736 - RNA, 22 nt, Human
acuauauaaugcacacaguaua

SEQ ID NO: 9737 - RNA, 22 nt, Human
acucaaccaucugcauuuuuga

SEQ ID NO: 9738 - RNA, 22 nt, Human
acucacuguuuugaaauugaac

SEQ ID NO: 9739 - RNA, 22 nt, Human
acucaugugacuaaaacauuaa

SEQ ID NO: 9740 - RNA, 22 nt, Human
acucauucgccuugcccaaggc

SEQ ID NO: 9741 - RNA, 22 nt, Human
acucauuuggauuuuggaguuu

SEQ ID NO: 9742 - RNA, 21 nt, Human
acuccagccacugacugucuc

SEQ ID NO: 9743 - RNA, 22 nt, Human
acuccuucauauuuuaauugaa

SEQ ID NO: 9744 - RNA, 22 nt, Human
acucggaggccaaggccaacgg

SEQ ID NO: 9745 - RNA, 22 nt, Human
acucucaauuaucuggacugaa

SEQ ID NO: 9746 - RNA, 22 nt, Human
acucucugcugcugagcuuggg

SEQ ID NO: 9747 - RNA, 23 nt, Human
acucucuguuuggaggcacuggu

SEQ ID NO: 9748 - RNA, 22 nt, Human
acucugaaaggcuacaaaugcu

SEQ ID NO: 9749 - RNA, 18 nt, Human
acucugaagcuaagucac

SEQ ID NO: 9750 - RNA, 22 nt, Human
acucugagguuuuccaaguaca

SEQ ID NO: 9751 - RNA, 22 nt, Human
acucugcaguaaggaauuguuu

SEQ ID NO: 9752 - RNA, 22 nt, Human
acucuuauuuugaaguaauaau

SEQ ID NO: 9753 - RNA, 18 nt, Human
acucuuccuuauguucuu

SEQ ID NO: 9754 - RNA, 22 nt, Human
acucuugacuaaugcuaauguc

SEQ ID NO: 9755 - RNA, 22 nt, Human
acugaaaguugaugagucacug

SEQ ID NO: 9756 - RNA, 22 nt, Human
acugaaauuuauauuuugggca

SEQ ID NO: 9757 - RNA, 22 nt, Human
acugaacuaaagaaaugggcaa

SEQ ID NO: 9758 - RNA, 22 nt, Human
acugaaggcuggaccaugcauc

SEQ ID NO: 9759 - RNA, 22 nt, Human
acugacuacauguccugucauu

SEQ ID NO: 9760 - RNA, 22 nt, Human
acugacucacauuuugguuugc

SEQ ID NO: 9761 - RNA, 22 nt, Human
acugacuucugguauuuuuagu

SEQ ID NO: 9762 - RNA, 22 nt, Human
acugagcaaaacugauccuguu

SEQ ID NO: 9763 - RNA, 22 nt, Human
acugaggaagccugucaucauc

SEQ ID NO: 9764 - RNA, 22 nt, Human
acugaucuguguaauauguuac

SEQ ID NO: 9765 - RNA, 22 nt, Human
ggaugcagcagagaccuggagu

SEQ ID NO: 9766 - RNA, 22 nt, Human
ggaugcguuugaauguguuugu

SEQ ID NO: 9767 - RNA, 22 nt, Human
ggaugcugcuccacaucccaca

SEQ ID NO: 9768 - RNA, 23 nt, Human
ggauggacauacguaugcacagg

SEQ ID NO: 9769 - RNA, 22 nt, Human
ggaugggcuuggggaggucuag

SEQ ID NO: 9770 - RNA, 22 nt, Human
ggauggugauguacccagucau

SEQ ID NO: 9771 - RNA, 20 nt, Human
ggauugaacuauuucucagc

SEQ ID NO: 9772 - RNA, 22 nt, Human
ggauuguaugcagcaguaggca

SEQ ID NO: 9773 - RNA, 22 nt, Human
ggauuugaugagacuaucuacu

SEQ ID NO: 9774 - RNA, 22 nt, Human
ggcaagcacugggugucuuagc

SEQ ID NO: 9775 - RNA, 22 nt, Human
ggcaaggaagaaagcagaaguu

SEQ ID NO: 9776 - RNA, 22 nt, Human
ggcaauuacguauuagucaugu

SEQ ID NO: 9777 - RNA, 22 nt, Human
ggcacagcgacuaccaucgaaa

SEQ ID NO: 9778 - RNA, 19 nt, Human
ggcacccagagucccccug

SEQ ID NO: 9779 - RNA, 22 nt, Human
ggcacgagccaguguguguguu

SEQ ID NO: 9780 - RNA, 21 nt, Human
ggcagagaagcuggaaguugg

SEQ ID NO: 9781 - RNA, 22 nt, Human
ggcagagcugugcgcccaccca

SEQ ID NO: 9782 - RNA, 22 nt, Human
ggcagaggaagcuggaaguggg

SEQ ID NO: 9783 - RNA, 22 nt, Human
ggcagaggagcuggaaacaugg

SEQ ID NO: 9784 - RNA, 22 nt, Human
ggcagagguagcuggaaccagg

SEQ ID NO: 9785 - RNA, 22 nt, Human
ggcagggaauucagagggaagg

SEQ ID NO: 9786 - RNA, 22 nt, Human
ggcagggacugggauauggaga

SEQ ID NO: 9787 - RNA, 22 nt, Human
ggcagguccugaguccugaggc

SEQ ID NO: 9788 - RNA, 22 nt, Human
ggcaguagucagaggguuuuac

SEQ ID NO: 9789 - RNA, 22 nt, Human
ggcagugguaggagcccaggag

SEQ ID NO: 9790 - RNA, 22 nt, Human
ggcaguguggauccuggagaag

SEQ ID NO: 9791 - RNA, 20 nt, Human
ggcaucugacaacuaguugc

SEQ ID NO: 9792 - RNA, 22 nt, Human
ggcaugcaaaugugggugaccu

SEQ ID NO: 9793 - RNA, 22 nt, Human
ggcauggugggggaggacuugg

SEQ ID NO: 9794 - RNA, 21 nt, Human
ggcauguagccagcaaaggua

SEQ ID NO: 9795 - RNA, 22 nt, Human
ggcauuccgggguccccuucuc

SEQ ID NO: 9796 - RNA, 22 nt, Human
ggcauuccucucuguucaugga

SEQ ID NO: 9797 - RNA, 22 nt, Human
ggcauugauggggucuugggga

SEQ ID NO: 9798 - RNA, 20 nt, Human
ggcauuuuuuaguugagcuu

SEQ ID NO: 9799 - RNA, 22 nt, Human
ggccaauuuccuagacauuagu

SEQ ID NO: 9800 - RNA, 22 nt, Human
ggccacauuccagagggcugaa

SEQ ID NO: 9801 - RNA, 21 nt, Human
ggccagauucucccauagcug

SEQ ID NO: 9802 - RNA, 22 nt, Human
ggccagcuuugagcugcaggaa

SEQ ID NO: 9803 - RNA, 22 nt, Human
ggccaguauacaaacuuccggu

SEQ ID NO: 9804 - RNA, 22 nt, Human
ggccccagggauuaggccaacc

SEQ ID NO: 9805 - RNA, 22 nt, Human
ggcccugcuuccccaguguaca

SEQ ID NO: 9806 - RNA, 22 nt, Human
ggccgccacacagauucccccg

SEQ ID NO: 9807 - RNA, 22 nt, Human
ggccgcuuucuggggagugagg

SEQ ID NO: 9808 - RNA, 22 nt, Human
ggccgggcaugcgagcugagcg

SEQ ID NO: 9809 - RNA, 18 nt, Human
ggccucagccuggccgga

SEQ ID NO: 9810 - RNA, 22 nt, Human
ggccugagaagcaaggacacaa

SEQ ID NO: 9811 - RNA, 22 nt, Human
ggccuggccuccugcuuuucca

SEQ ID NO: 9812 - RNA, 22 nt, Human
ggccuugauuccggucauugaa

SEQ ID NO: 9813 - RNA, 22 nt, Human
ggccuugggauguggcugcagc

SEQ ID NO: 9814 - RNA, 22 nt, Human
ggccuugguggcuuugcugaug

SEQ ID NO: 9815 - RNA, 23 nt, Human
ggccuuuuuaaccgcgagcgaca

SEQ ID NO: 9816 - RNA, 22 nt, Human
ggcgacuacugaaugcuugaaa

SEQ ID NO: 9817 - RNA, 22 nt, Human
ggcgaggcgggccgcggggucu

SEQ ID NO: 9818 - RNA, 22 nt, Human
ggcgaugaggucuuagaaucua

SEQ ID NO: 9819 - RNA, 22 nt, Human
ggcgauuggccgggaggaggca

SEQ ID NO: 9820 - RNA, 22 nt, Human
ggcgcaguguucgcccucucgc

SEQ ID NO: 9821 - RNA, 22 nt, Human
ggcgccauuuuugccuucggag

SEQ ID NO: 9822 - RNA, 22 nt, Human
ggcgccuuguggaaugagagcu

SEQ ID NO: 9823 - RNA, 22 nt, Human
ggcgcuccccgccugcgucgcg

SEQ ID NO: 9824 - RNA, 22 nt, Human
ggcggagggcuguguccccggc

SEQ ID NO: 9825 - RNA, 22 nt, Human
ggcggaggucacgcacccgcca

SEQ ID NO: 9826 - RNA, 22 nt, Human
ggcggcaagggaauggagaaga

SEQ ID NO: 9827 - RNA, 22 nt, Human
ggcgggggagccaggaacccag

SEQ ID NO: 9828 - RNA, 22 nt, Human
ggcgucuugcgggcgguagcgc

SEQ ID NO: 9829 - RNA, 23 nt, Human
ggcgugcugggcugacccuuggc

SEQ ID NO: 9830 - RNA, 22 nt, Human
ggcuagggaucuagaccaggac

SEQ ID NO: 9831 - RNA, 22 nt, Human
ggcuauuguuuuaaaaaaugag

SEQ ID NO: 9832 - RNA, 22 nt, Human
ggcucagaggagcuggaacggu

SEQ ID NO: 9833 - RNA, 22 nt, Human
ggcuccaggguaccccuggaug

SEQ ID NO: 9834 - RNA, 22 nt, Human
ggcuccccagagcuccuuacuc

SEQ ID NO: 9835 - RNA, 22 nt, Human
ggcucccccauggcugacagac

SEQ ID NO: 9836 - RNA, 22 nt, Human
ggcucccgugggaugguggagc

SEQ ID NO: 9837 - RNA, 22 nt, Human
ggcuccucaggcugggguaagg

SEQ ID NO: 9838 - RNA, 22 nt, Human
ggcuccuuguaugauauuuugu

SEQ ID NO: 9839 - RNA, 22 nt, Human
ggcucuccacuauggaugagaa

SEQ ID NO: 9840 - RNA, 22 nt, Human
ggcugaggccucuggggaggga

SEQ ID NO: 9841 - RNA, 22 nt, Human
ggcugaugacgccugagucuga

SEQ ID NO: 9842 - RNA, 22 nt, Human
ggcugcuauuggucuggcuugg

SEQ ID NO: 9843 - RNA, 21 nt, Human
ggcugcucgugaugaacuuca

SEQ ID NO: 9844 - RNA, 22 nt, Human
ggcuggagcaggcugcacagug

SEQ ID NO: 9845 - RNA, 22 nt, Human
ggcugguggcgggcagcacaga

SEQ ID NO: 9846 - RNA, 22 nt, Human
ggcuguggcagcuggaaguggu

SEQ ID NO: 9847 - RNA, 22 nt, Human
ggcugugggguccuguggugug

SEQ ID NO: 9848 - RNA, 22 nt, Human
ggcugugguggacgcgggaaac

SEQ ID NO: 9849 - RNA, 22 nt, Human
ggcuuacgcgcuaacagugaau

SEQ ID NO: 9850 - RNA, 22 nt, Human
ggcuuaguagggacagaugcac

SEQ ID NO: 9851 - RNA, 22 nt, Human
ggcuuaugaucugacccaucga

SEQ ID NO: 9852 - RNA, 22 nt, Human
ggcuuccuggugcagaguuaua

SEQ ID NO: 9853 - RNA, 22 nt, Human
ggcuucuuaacauuuggacacc

SEQ ID NO: 9854 - RNA, 22 nt, Human
guggagaaagcuggaaucugag

SEQ ID NO: 9855 - RNA, 22 nt, Human
guggagaaauauguucagcuuc

SEQ ID NO: 9856 - RNA, 22 nt, Human
guggagaagggaccgggaagga

SEQ ID NO: 9857 - RNA, 22 nt, Human
guggagauauuugugauagggg

SEQ ID NO: 9858 - RNA, 22 nt, Human
guggagaucuggugcccccugg

SEQ ID NO: 9859 - RNA, 22 nt, Human
guggaggaagaucuuugaugau

SEQ ID NO: 9860 - RNA, 22 nt, Human
guggaggguuugcaaugugcag

SEQ ID NO: 9861 - RNA, 22 nt, Human
guggauaaguuguuugaccuac

SEQ ID NO: 9862 - RNA, 22 nt, Human
guggauggagcuggaagccauu

SEQ ID NO: 9863 - RNA, 22 nt, Human
guggauuguaccacgaaaagug

SEQ ID NO: 9864 - RNA, 22 nt, Human
guggcaaguuuucugacaagga

SEQ ID NO: 9865 - RNA, 22 nt, Human
guggcagagccuugcggcuuug

SEQ ID NO: 9866 - RNA, 22 nt, Human
guggccuuccuguuccuuugaa

SEQ ID NO: 9867 - RNA, 22 nt, Human
guggcuugguauuaaggugcca

SEQ ID NO: 9868 - RNA, 22 nt, Human
gugggauaaccugagauaacau

SEQ ID NO: 9869 - RNA, 22 nt, Human
gugggcagauuaauuucucaau

SEQ ID NO: 9870 - RNA, 22 nt, Human
gugggcuuuuuugaaaccugaa

SEQ ID NO: 9871 - RNA, 22 nt, Human
guggggcgggucccccgccugg

SEQ ID NO: 9872 - RNA, 22 nt, Human
gugggggauggcgugugggucu

SEQ ID NO: 9873 - RNA, 22 nt, Human
gugggggcuaaauugaggggug

SEQ ID NO: 9874 - RNA, 22 nt, Human
gugggggugaggaauguucuau

SEQ ID NO: 9875 - RNA, 22 nt, Human
guggguauauauaugugugcug

SEQ ID NO: 9876 - RNA, 22 nt, Human
gugggugaguggggccgccuga

SEQ ID NO: 9877 - RNA, 22 nt, Human
gugggugucaguaucuuuaacg

SEQ ID NO: 9878 - RNA, 22 nt, Human
gugguaaagugugccugugguc

SEQ ID NO: 9879 - RNA, 22 nt, Human
gugguaagugcuccuauuggcg

SEQ ID NO: 9880 - RNA, 22 nt, Human
gugguaccaguaggucagccau

SEQ ID NO: 9881 - RNA, 22 nt, Human
guggugaacauuugcaucugcu

SEQ ID NO: 9882 - RNA, 22 nt, Human
guggugauuugggucuagcuuu

SEQ ID NO: 9883 - RNA, 22 nt, Human
guggugggcgugguguaugccu

SEQ ID NO: 9884 - RNA, 22 nt, Human
gugguggggaguuggauggaag

SEQ ID NO: 9885 - RNA, 22 nt, Human
guggugguguuggugacaaguu

SEQ ID NO: 9886 - RNA, 22 nt, Human
gugguuugacccuucagguaaa

SEQ ID NO: 9887 - RNA, 22 nt, Human
gugguuugcugguguacguuua

SEQ ID NO: 9888 - RNA, 22 nt, Human
guguauuucuagaagaaaugaa

SEQ ID NO: 9889 - RNA, 22 nt, Human
gugucacuuucaggagcucuaa

SEQ ID NO: 9890 - RNA, 22 nt, Human
guguccaaagguaggaggaggg

SEQ ID NO: 9891 - RNA, 22 nt, Human
gugucccaaagauuagaaauca

SEQ ID NO: 9892 - RNA, 22 nt, Human
guguccuguagaaacuguucca

SEQ ID NO: 9893 - RNA, 22 nt, Human
gugucuuggaacuggaauugag

SEQ ID NO: 9894 - RNA, 22 nt, Human
guguggcgacucagagcugccu

SEQ ID NO: 9895 - RNA, 22 nt, Human
gugugguguuaagcaaauuaau

SEQ ID NO: 9896 - RNA, 22 nt, Human
guguguauguagguauauaugu

SEQ ID NO: 9897 - RNA, 22 nt, Human
guguuaaucauuuuugauuuug

SEQ ID NO: 9898 - RNA, 22 nt, Human
guguuagagucuugugcucauu

SEQ ID NO: 9899 - RNA, 22 nt, Human
guguuagcauggaacagaacgc

SEQ ID NO: 9900 - RNA, 22 nt, Human
guguuaggugcauuaaacgugg

SEQ ID NO: 9901 - RNA, 22 nt, Human
guguucccauccacaccaagcc

SEQ ID NO: 9902 - RNA, 22 nt, Human
guguucucagcacccacuucau

SEQ ID NO: 9903 - RNA, 19 nt, Human
guguucuguuauacaguug

SEQ ID NO: 9904 - RNA, 22 nt, Human
guguugaaaaguagcacugcuu

SEQ ID NO: 9905 - RNA, 22 nt, Human
guguugacacagccaucuuguc

SEQ ID NO: 9906 - RNA, 22 nt, Human
guguuggugagcucauuuccac

SEQ ID NO: 9907 - RNA, 23 nt, Human
guguuguugauuuucgaaucuuu

SEQ ID NO: 9908 - RNA, 22 nt, Human
guguuuauguuuuugcuaggga

SEQ ID NO: 9909 - RNA, 22 nt, Human
guuaaaaugauuugugauuuau

SEQ ID NO: 9910 - RNA, 22 nt, Human
guuaaaggaagccauauguucg

SEQ ID NO: 9911 - RNA, 22 nt, Human
guuacagagcugcuaugugugc

SEQ ID NO: 9912 - RNA, 22 nt, Human
guuagacuugcguggaucauga

SEQ ID NO: 9913 - RNA, 22 nt, Human
guuaggcagugugguauagcag

SEQ ID NO: 9914 - RNA, 22 nt, Human
guuagggcaagggguuccucug

SEQ ID NO: 9915 - RNA, 22 nt, Human
guuauacuuaugugcaaaaaua

SEQ ID NO: 9916 - RNA, 22 nt, Human
guuauugggagagggaauggga

SEQ ID NO: 9917 - RNA, 22 nt, Human
guuauuguuauugcguugucga

SEQ ID NO: 9918 - RNA, 22 nt, Human
guucaaggagcagcuugcuaca

SEQ ID NO: 9919 - RNA, 22 nt, Human
guucagauucuuucucuuucac

SEQ ID NO: 9920 - RNA, 22 nt, Human
guucccuugccuuuaguuugau

SEQ ID NO: 9921 - RNA, 22 nt, Human
guuccgcugcaaggccaggaaa

SEQ ID NO: 9922 - RNA, 22 nt, Human
guuccucugaaggauuuucaga

SEQ ID NO: 9923 - RNA, 22 nt, Human
guucggcuuccuaugucaugag

SEQ ID NO: 9924 - RNA, 22 nt, Human
guucgucuguggugugaggugc

SEQ ID NO: 9925 - RNA, 21 nt, Human
guucucacagcugaggugguu

SEQ ID NO: 9926 - RNA, 22 nt, Human
guucuccaggggcuguucaucu

SEQ ID NO: 9927 - RNA, 22 nt, Human
guucucuccugcuggugaugga

SEQ ID NO: 9928 - RNA, 22 nt, Human
guucucuuaauccuaguuggua

SEQ ID NO: 9929 - RNA, 22 nt, Human
guucugcccaggccuccccaac

SEQ ID NO: 9930 - RNA, 22 nt, Human
guucuggaggagagccuggugu

SEQ ID NO: 9931 - RNA, 22 nt, Human
guucuguauauauccuagcaaa

SEQ ID NO: 9932 - RNA, 22 nt, Human
guucuguuguugaucuuuggag

SEQ ID NO: 9933 - RNA, 22 nt, Human
guucuuagguacucauauuuaa

SEQ ID NO: 9934 - RNA, 21 nt, Human
guucuuaguuauauucucaau

SEQ ID NO: 9935 - RNA, 22 nt, Human
guucuucagauuccauuucagu

SEQ ID NO: 9936 - RNA, 22 nt, Human
guucuucagcccucagguccua

SEQ ID NO: 9937 - RNA, 22 nt, Human
guucuuuacuucgcaucugcua

SEQ ID NO: 9938 - RNA, 22 nt, Human
guugaacagucacccugggagu

SEQ ID NO: 9939 - RNA, 22 nt, Human
guugagaagaccauuuuguuca

SEQ ID NO: 9940 - RNA, 22 nt, Human
guugagacugaaguucugaaag

SEQ ID NO: 9941 - RNA, 22 nt, Human
guugagaggccuggcucuuuuc

SEQ ID NO: 9942 - RNA, 22 nt, Human
guugauaauuaauagcuuuuga

SEQ ID NO: 9943 - RNA, 22 nt, Human
guugauuuaaccucaccuuuga

SEQ ID NO: 9944 - RNA, 22 nt, Human
guugauuuaggguuuugguuuu

SEQ ID NO: 9945 - RNA, 22 nt, Human
guugcaaaugggaagaugguua

SEQ ID NO: 9946 - RNA, 22 nt, Human
guugccugguuucaaaaggaau

SEQ ID NO: 9947 - RNA, 23 nt, Human
guugccuuugcaucuucauccau

SEQ ID NO: 9948 - RNA, 22 nt, Human
guugcggaguguagcgaugcuu

SEQ ID NO: 9949 - RNA, 22 nt, Human
guugcuggggcugaguccccag

SEQ ID NO: 9950 - RNA, 22 nt, Human
guuggaaauaucagucacguga

SEQ ID NO: 9951 - RNA, 22 nt, Human
guuggaggaaggacaggaacag

SEQ ID NO: 9952 - RNA, 22 nt, Human
guuggcgaaggaccuggaggag

SEQ ID NO: 9953 - RNA, 22 nt, Human
guugggaauucggagagaaaua

SEQ ID NO: 9954 - RNA, 22 nt, Human
guugggauugaaggugccucua

SEQ ID NO: 9955 - RNA, 22 nt, Human
guugggugccagaggcuucacg

SEQ ID NO: 9956 - RNA, 22 nt, Human
guuggugagaguuagggauuua

SEQ ID NO: 9957 - RNA, 22 nt, Human
guugguggaggcgagagaagaa

SEQ ID NO: 9958 - RNA, 22 nt, Human
guugucguucccccugcuuaaa

SEQ ID NO: 9959 - RNA, 21 nt, Human
guugugaccaugggaguugcu

SEQ ID NO: 9960 - RNA, 22 nt, Human
guuguugcuauguuauuguuau

SEQ ID NO: 9961 - RNA, 22 nt, Human
guuguugucauuagcuguuuaa

SEQ ID NO: 9962 - RNA, 22 nt, Human
guuuaagcagauugcuguggug

SEQ ID NO: 9963 - RNA, 22 nt, Human
guuuaucagagagcagaggugg

SEQ ID NO: 9964 - RNA, 22 nt, Human
guuuccaagucucucaacaccc

SEQ ID NO: 9965 - RNA, 22 nt, Human
guuucucuuugguggguugaga

SEQ ID NO: 9966 - RNA, 22 nt, Human
guuucuguggacucugcuuagg

SEQ ID NO: 9967 - RNA, 22 nt, Human
guuucuguguugauugugcccu

SEQ ID NO: 9968 - RNA, 22 nt, Human
guuugaacagaaggguugauca

SEQ ID NO: 9969 - RNA, 22 nt, Human
guuugggauucuagacaaaaau

SEQ ID NO: 9970 - RNA, 22 nt, Human
guuuggguugcucauucuacau

SEQ ID NO: 9971 - RNA, 22 nt, Human
guuugguucucauuguuuuucu

SEQ ID NO: 9972 - RNA, 22 nt, Human
guuuguguauauguguauuuuu

SEQ ID NO: 9973 - RNA, 22 nt, Human
guuuuaucuauguaauuauaaa

SEQ ID NO: 9974 - RNA, 22 nt, Human
guuuucuaaaacacauauaagu

SEQ ID NO: 9975 - RNA, 22 nt, Human
guuuucuccugcuauacagugc

SEQ ID NO: 9976 - RNA, 22 nt, Human
guuuucuuguuaauuuugaacg

SEQ ID NO: 9977 - RNA, 22 nt, Human
guuuugauggaguguguuaaau

SEQ ID NO: 9978 - RNA, 22 nt, Human
guuuuguucaugaacauugggu

SEQ ID NO: 9979 - RNA, 22 nt, Human
guuuuuaguuuaaguuuuugca

SEQ ID NO: 9980 - RNA, 23 nt, Human
guuuuugcugcagcugaagaagg

SEQ ID NO: 9981 - RNA, 22 nt, Human
uaaaaauuagauauguauuuag

SEQ ID NO: 9982 - RNA, 22 nt, Human
uaaaaccauucauugaccuaug

SEQ ID NO: 9983 - RNA, 21 nt, Human
uaaaagaugacaagacagcuc

SEQ ID NO: 9984 - RNA, 22 nt, Human
uaaaauaccacauauggugcuc

SEQ ID NO: 9985 - RNA, 22 nt, Human
uaaaaucaugacagauugacau

SEQ ID NO: 9986 - RNA, 22 nt, Human
uaaaaugcucagauaaauauau

SEQ ID NO: 9987 - RNA, 22 nt, Human
uaaacugacagugagggagagu

SEQ ID NO: 9988 - RNA, 22 nt, Human
uaaagaagaaaaggcuucaggc

SEQ ID NO: 9989 - RNA, 22 nt, Human
uaaagaggagaauuaagucagc

SEQ ID NO: 9990 - RNA, 22 nt, Human
uaaagcacucaaaauuguagcu

SEQ ID NO: 9991 - RNA, 22 nt, Human
uaaaggaguguauaauuguagu

SEQ ID NO: 9992 - RNA, 22 nt, Human
uaaaggcaaacucuccaaggau

SEQ ID NO: 9993 - RNA, 22 nt, Human
uaaaguauucaaguagcuuucu

SEQ ID NO: 9994 - RNA, 22 nt, Human
uaaagugaaguucagaauggcu

SEQ ID NO: 9995 - RNA, 22 nt, Human
uaaaugagcaccucuaguuuug

SEQ ID NO: 9996 - RNA, 22 nt, Human
uaaaugcucuuuaaaagugcuu

SEQ ID NO: 9997 - RNA, 22 nt, Human
uaaauuccuagucacaaacuuc

SEQ ID NO: 9998 - RNA, 22 nt, Human
uaaauuggaauaaugagaagug

SEQ ID NO: 9999 - RNA, 22 nt, Human
uaaauuugugaauuagcuauca

SEQ ID NO: 10000 - RNA, 23 nt, Human
uaaauuuuauucugauaacacag

SEQ ID NO: 10001 - RNA, 23 nt, Human
uaacacaguccuggucuuuggcc

SEQ ID NO: 10002 - RNA, 22 nt, Human
uaacaguauacuacaucauauu

SEQ ID NO: 10003 - RNA, 22 nt, Human
uaacauuagcuuugcucaugca

SEQ ID NO: 10004 - RNA, 22 nt, Human
uaacauuucggugacaguggga

SEQ ID NO: 10005 - RNA, 22 nt, Human
uaaccaggaaaaagauaugcau

SEQ ID NO: 10006 - RNA, 22 nt, Human
uaaccuugaagacugagcugac

SEQ ID NO: 10007 - RNA, 22 nt, Human
uaacgcaucuggaaacaggaca

SEQ ID NO: 10008 - RNA, 22 nt, Human
uaacucuagggacucgcccaga

SEQ ID NO: 10009 - RNA, 22 nt, Human
uaacucugcuguggaaauggga

SEQ ID NO: 10010 - RNA, 18 nt, Human
uaacugguuucuucccau

SEQ ID NO: 10011 - RNA, 22 nt, Human
uaacuguuuugaauauuguggu

SEQ ID NO: 10012 - RNA, 22 nt, Human
uaacuugaauacauucuuuuca

SEQ ID NO: 10013 - RNA, 22 nt, Human
uaacuuuucuguucaauuuucc

SEQ ID NO: 10014 - RNA, 22 nt, Human
uaagaaaggggaaguuccucuu

SEQ ID NO: 10015 - RNA, 21 nt, Human
uaagaacauuaucuucuuccu

SEQ ID NO: 10016 - RNA, 19 nt, Human
uaagaaucaccaggggugu

SEQ ID NO: 10017 - RNA, 22 nt, Human
uaagaauguuuguugaguaaau

SEQ ID NO: 10018 - RNA, 22 nt, Human
uaagaccuuuuugaaaucacug

SEQ ID NO: 10019 - RNA, 22 nt, Human
uaagacuuuaccaggcucaaau

SEQ ID NO: 10020 - RNA, 22 nt, Human
uaagagauuuauugaggacuuc

SEQ ID NO: 10021 - RNA, 22 nt, Human
uaagaggucugaaacgguggga

SEQ ID NO: 10022 - RNA, 22 nt, Human
uaagauauugagugguaauuug

SEQ ID NO: 10023 - RNA, 22 nt, Human
uaagauuuuuacaaauagagug

SEQ ID NO: 10024 - RNA, 22 nt, Human
uaagcacuuuauaugcuuuauc

SEQ ID NO: 10025 - RNA, 21 nt, Human
uaagccaccaugugaaaccag

SEQ ID NO: 10026 - RNA, 23 nt, Human
uaagccugugccugcuaccugcu

SEQ ID NO: 10027 - RNA, 22 nt, Human
uaaggagagaauuuagagguuu

SEQ ID NO: 10028 - RNA, 22 nt, Human
uaaggcuuuggucaccauggag

SEQ ID NO: 10029 - RNA, 22 nt, Human
uaagggaagucuucaggagaca

SEQ ID NO: 10030 - RNA, 19 nt, Human
uaaguagaugacugaugcu

SEQ ID NO: 10031 - RNA, 22 nt, Human
uaagucaagagcuagaaaaagc

SEQ ID NO: 10032 - RNA, 22 nt, Human
uaagugcuagaauuccagguuu

SEQ ID NO: 10033 - RNA, 22 nt, Human
uaaguuguagaacguuuucuua

SEQ ID NO: 10034 - RNA, 22 nt, Human
uaauaacuacacucagaggacc

SEQ ID NO: 10035 - RNA, 22 nt, Human
uaauaauuaacagugauggguc

SEQ ID NO: 10036 - RNA, 22 nt, Human
uaauagauagggagaguugcug

SEQ ID NO: 10037 - RNA, 22 nt, Human
uaauaguugaaggucaucacua

SEQ ID NO: 10038 - RNA, 22 nt, Human
uaauauauuuuuuaagggaugu

SEQ ID NO: 10039 - RNA, 22 nt, Human
uaauccaaaacugaaucugugg

SEQ ID NO: 10040 - RNA, 22 nt, Human
uaaugaugaacacuuggaagaa

SEQ ID NO: 10041 - RNA, 22 nt, Human
uaaugcucauuuggcucugcaa

SEQ ID NO: 10042 - RNA, 22 nt, Human
uaauuauuaauuuuagguugcu

SEQ ID NO: 10043 - RNA, 22 nt, Human
uaauucuacagggaacucugga

SEQ ID NO: 10044 - RNA, 22 nt, Human
uaauucuagauugacauuuuga

SEQ ID NO: 10045 - RNA, 22 nt, Human
uaauugaacguucauuuuuaau

SEQ ID NO: 10046 - RNA, 22 nt, Human
uaauuuagugcauuuccuagua

SEQ ID NO: 10047 - RNA, 22 nt, Human
uaauuucauuuugcaaugaucu

SEQ ID NO: 10048 - RNA, 22 nt, Human
uaauuuugucacagugacaugc

SEQ ID NO: 10049 - RNA, 22 nt, Human
uacaaaauucaaauaauguuug

SEQ ID NO: 10050 - RNA, 22 nt, Human
uacaaagugauuuuggaauuga

SEQ ID NO: 10051 - RNA, 22 nt, Human
uacaaauguuucuucuccuuuu

SEQ ID NO: 10052 - RNA, 22 nt, Human
uacaaauugccugacggcaggu

SEQ ID NO: 10053 - RNA, 22 nt, Human
uacaaauuguuuugccacaaag

SEQ ID NO: 10054 - RNA, 22 nt, Human
uacaacuuacuugaauggcuuu

SEQ ID NO: 10055 - RNA, 21 nt, Human
uacaagaccggauucgggccc

SEQ ID NO: 10056 - RNA, 20 nt, Human
uacaaggauguucaucagag

SEQ ID NO: 10057 - RNA, 20 nt, Human
uacaauauucccacuuugcu

SEQ ID NO: 10058 - RNA, 22 nt, Human
uacaaucacccaaagagccaga

SEQ ID NO: 10059 - RNA, 22 nt, Human
uacaaucaggcucuagcuucuc

SEQ ID NO: 10060 - RNA, 22 nt, Human
uacaauguucgcauucucucug

SEQ ID NO: 10061 - RNA, 22 nt, Human
uacacacacaugcauguacgug

SEQ ID NO: 10062 - RNA, 22 nt, Human
uacaccaugcuccagcaggaca

SEQ ID NO: 10063 - RNA, 22 nt, Human
uacagaccaguaguucucagcg

SEQ ID NO: 10064 - RNA, 18 nt, Human
uacagauguaugucuaca

SEQ ID NO: 10065 - RNA, 21 nt, Human
uacagcucaucaauuacugcu

SEQ ID NO: 10066 - RNA, 22 nt, Human
uacagcuuccucuaugguggcc

SEQ ID NO: 10067 - RNA, 22 nt, Human
uacaggaggaugugcagccagg

SEQ ID NO: 10068 - RNA, 22 nt, Human
uacagugaggcgagauucacca

SEQ ID NO: 10069 - RNA, 22 nt, Human
uacauagaauauauaaaugucg

SEQ ID NO: 10070 - RNA, 22 nt, Human
uacauccuuuugaaaucccaga

SEQ ID NO: 10071 - RNA, 22 nt, Human
uacaugggcguguucaguuagu

SEQ ID NO: 10072 - RNA, 22 nt, Human
uacauuccagaaaguuucugua

SEQ ID NO: 10073 - RNA, 22 nt, Human
uacauuguguuaaaacagaaga

SEQ ID NO: 10074 - RNA, 22 nt, Human
uaccaauuaaauagccaaucua

SEQ ID NO: 10075 - RNA, 20 nt, Human
uaccagggguuugggacagc

SEQ ID NO: 10076 - RNA, 22 nt, Human
uaccauaaagcaggcaaaugag

SEQ ID NO: 10077 - RNA, 22 nt, Human
uaccaugggucaguuggguuug

SEQ ID NO: 10078 - RNA, 23 nt, Human
uaccauugauuuuaugguuuucu

SEQ ID NO: 10079 - RNA, 22 nt, Human
uacccauuuugguucuugaugc

SEQ ID NO: 10080 - RNA, 22 nt, Human
uaccgaagcugcuuuugcaugu

SEQ ID NO: 10081 - RNA, 22 nt, Human
uaccuaacauugugcagagguu

SEQ ID NO: 10082 - RNA, 22 nt, Human
uaccucauguucaggaggauca

SEQ ID NO: 10083 - RNA, 20 nt, Human
uaccuccccagcagucauga

SEQ ID NO: 10084 - RNA, 22 nt, Human
uaccuggauaaauguacaaccg

SEQ ID NO: 10085 - RNA, 22 nt, Human
uaccugguuucuuaaacccaaa

SEQ ID NO: 10086 - RNA, 22 nt, Human
uacguaauagcuuuauuuuggg

SEQ ID NO: 10087 - RNA, 20 nt, Human
uacguguccgaugaucacag

SEQ ID NO: 10088 - RNA, 22 nt, Human
uacuaaagaaugaguuaaguuu

SEQ ID NO: 10089 - RNA, 22 nt, Human
uacuaccugcaggaacaauuag

SEQ ID NO: 10090 - RNA, 22 nt, Human
uacuagaggaauugcuauaacu

SEQ ID NO: 10091 - RNA, 22 nt, Human
uacucgaaaucagagagaauaa

SEQ ID NO: 10092 - RNA, 22 nt, Human
uacucucuuccauacaaucugu

SEQ ID NO: 10093 - RNA, 22 nt, Human
uacugaaagagugguggacucu

SEQ ID NO: 10094 - RNA, 22 nt, Human
uacugacguaguagaguugcuu

SEQ ID NO: 10095 - RNA, 22 nt, Human
uacugaguuucacugucugugc

SEQ ID NO: 10096 - RNA, 22 nt, Human
uacugauggagauaggcuauca

SEQ ID NO: 10097 - RNA, 22 nt, Human
uacugcaguuccugcugucucc

SEQ ID NO: 10098 - RNA, 22 nt, Human
uacuggaugcaacaaagcccag

SEQ ID NO: 10099 - RNA, 22 nt, Human
uacugggugagcugggcuggga

SEQ ID NO: 10100 - RNA, 22 nt, Human
uacuggguguucugagaaaaua

SEQ ID NO: 10101 - RNA, 22 nt, Human
uacugguguauuucuucuuauu

SEQ ID NO: 10102 - RNA, 22 nt, Human
uacugucuuuuccuaaaugggu

SEQ ID NO: 10103 - RNA, 21 nt, Human
uacugugccagggcagcucug

SEQ ID NO: 10104 - RNA, 22 nt, Human
uacuuaauuuuaaaagcuagau

SEQ ID NO: 10105 - RNA, 22 nt, Human
uacuucaguuacaugaagguau

SEQ ID NO: 10106 - RNA, 22 nt, Human
uacuucauucaaguucgcuaua

SEQ ID NO: 10107 - RNA, 22 nt, Human
uacuuccuucugcccccucuga

SEQ ID NO: 10108 - RNA, 22 nt, Human
uacuugaaaugggcaucaagag

SEQ ID NO: 10109 - RNA, 22 nt, Human
uacuugaacaucacuaagagaa

SEQ ID NO: 10110 - RNA, 22 nt, Human
uacuugucuuuauuuuaaugcu

SEQ ID NO: 10111 - RNA, 22 nt, Human
uacuuuaauugcaaaaauaaau

SEQ ID NO: 10112 - RNA, 23 nt, Human
uacuuuggcuagaguugucucuu

SEQ ID NO: 10113 - RNA, 22 nt, Human
uacuuuggugaaauuggaaaua

SEQ ID NO: 10114 - RNA, 22 nt, Human
uagaaauaaacacugcuaccuu

SEQ ID NO: 10115 - RNA, 22 nt, Human
uagaacaaacagcauguuugau

SEQ ID NO: 10116 - RNA, 22 nt, Human
uagaacugcucucauacuugcu

SEQ ID NO: 10117 - RNA, 22 nt, Human
uagaacuguaaauuaucucucc

SEQ ID NO: 10118 - RNA, 21 nt, Human
uagaagagggaauuugucuuu

SEQ ID NO: 10119 - RNA, 22 nt, Human
uagaaguagaaucauuagggcu

SEQ ID NO: 10120 - RNA, 22 nt, Human
uagaaguuaaaggaauacagaa

SEQ ID NO: 10121 - RNA, 19 nt, Human
uagacagauuuguguuacu

SEQ ID NO: 10122 - RNA, 23 nt, Human
uagacugcaggcuccuugagggc

SEQ ID NO: 10123 - RNA, 22 nt, Human
uagacugugagcuccuugaggg

SEQ ID NO: 10124 - RNA, 22 nt, Human
uagacuuggaagagacauugga

SEQ ID NO: 10125 - RNA, 22 nt, Human
uagagauagccaaguccuucaa

SEQ ID NO: 10126 - RNA, 22 nt, Human
uagaggaccacagggugcagag

SEQ ID NO: 10127 - RNA, 22 nt, Human
uagaggccagggugucuugagu

SEQ ID NO: 10128 - RNA, 22 nt, Human
uagaggguccaggagggcaaga

SEQ ID NO: 10129 - RNA, 22 nt, Human
uagagugcugucaaagacuugu

SEQ ID NO: 10130 - RNA, 22 nt, Human
uagaguguaagcuccuugaggg

SEQ ID NO: 10131 - RNA, 22 nt, Human
uagauccaagguuggauugggg

SEQ ID NO: 10132 - RNA, 23 nt, Human
uagauccuuccaacuacucuuac

SEQ ID NO: 10133 - RNA, 22 nt, Human
uagaucucugccuuguucagag

SEQ ID NO: 10134 - RNA, 22 nt, Human
uagaugaacagaaagccacugu

SEQ ID NO: 10135 - RNA, 22 nt, Human
uagauuuaaaaagggugggaug

SEQ ID NO: 10136 - RNA, 22 nt, Human
uagcaaucugugaugugugugu

SEQ ID NO: 10137 - RNA, 20 nt, Human
uagcacagacuuuugcuuac

SEQ ID NO: 10138 - RNA, 22 nt, Human
uagcagaacaauagucaaugau

SEQ ID NO: 10139 - RNA, 22 nt, Human
uagcaggagagaaguuuuaagu

SEQ ID NO: 10140 - RNA, 22 nt, Human
uagcauacagauauuuaacucu

SEQ ID NO: 10141 - RNA, 22 nt, Human
uagcauuuauugggcuagcaaa

SEQ ID NO: 10142 - RNA, 22 nt, Human
uagcauuucacugaucuucacu

SEQ ID NO: 10143 - RNA, 22 nt, Human
uagccaaguguuuuucaugacc

SEQ ID NO: 10144 - RNA, 22 nt, Human
uagccaaguuuucuuugaaagu

SEQ ID NO: 10145 - RNA, 22 nt, Human
uagccacuccgcagcaccgggu

SEQ ID NO: 10146 - RNA, 22 nt, Human
uagccaguuuauaaaguggaag

SEQ ID NO: 10147 - RNA, 22 nt, Human
uagccaucaugaguaagggcuu

SEQ ID NO: 10148 - RNA, 22 nt, Human
uagccucauuauuuacucauga

SEQ ID NO: 10149 - RNA, 22 nt, Human
uagccucuggaauccuuucucu

SEQ ID NO: 10150 - RNA, 22 nt, Human
uagccuguuuuuaugagaauuu

SEQ ID NO: 10151 - RNA, 23 nt, Human
uagcggccaugacgggggucaca

SEQ ID NO: 10152 - RNA, 22 nt, Human
uagcgggucacccugcugugaa

SEQ ID NO: 10153 - RNA, 22 nt, Human
uagcuaccucugcaaggugaua

SEQ ID NO: 10154 - RNA, 22 nt, Human
uagcucuaaggagaaucccucu

SEQ ID NO: 10155 - RNA, 22 nt, Human
uagcucuuaccagugaaguuug

SEQ ID NO: 10156 - RNA, 22 nt, Human
uagcuggaggggcaggaugcug

SEQ ID NO: 10157 - RNA, 19 nt, Human
uagcuguucuugaguguga

SEQ ID NO: 10158 - RNA, 22 nt, Human
uagcuucacuuuuguugaugcg

SEQ ID NO: 10159 - RNA, 22 nt, Human
uaggacuugaauucagccucca

SEQ ID NO: 10160 - RNA, 22 nt, Human
uaggacuuguccauccaggaca

SEQ ID NO: 10161 - RNA, 22 nt, Human
uaggagccagaauugcauuagu

SEQ ID NO: 10162 - RNA, 22 nt, Human
uaggauauuuuagaaugguaca

SEQ ID NO: 10163 - RNA, 22 nt, Human
uaggaucaugaugguaaggcaa

SEQ ID NO: 10164 - RNA, 22 nt, Human
uaggcaauauuagacuuugucu

SEQ ID NO: 10165 - RNA, 22 nt, Human
uaggcagauuccauauuuuggc

SEQ ID NO: 10166 - RNA, 22 nt, Human
uaggcagggauuaggguugauu

SEQ ID NO: 10167 - RNA, 22 nt, Human
uaggcaguagcuuuggauguca

SEQ ID NO: 10168 - RNA, 22 nt, Human
uaggcauguaaaagugaguucg

SEQ ID NO: 10169 - RNA, 22 nt, Human
uaggcuuuguuacuuucccuuu

SEQ ID NO: 10170 - RNA, 22 nt, Human
uagggaggguuugggguggagg

SEQ ID NO: 10171 - RNA, 22 nt, Human
uaggggaagcauagguuuagaa

SEQ ID NO: 10172 - RNA, 22 nt, Human
uaggggcccgugggauggacag

SEQ ID NO: 10173 - RNA, 22 nt, Human
uaggggggugaaggaggucccu

SEQ ID NO: 10174 - RNA, 22 nt, Human
uaggggguuuuucuagagauug

SEQ ID NO: 10175 - RNA, 22 nt, Human
uaggguagugggaaacuggacg

SEQ ID NO: 10176 - RNA, 22 nt, Human
uaggguuucaugcugguuucca

SEQ ID NO: 10177 - RNA, 22 nt, Human
uagguaauacuuagaccugauu

SEQ ID NO: 10178 - RNA, 22 nt, Human
uaggucaaggccacuucuugga

SEQ ID NO: 10179 - RNA, 22 nt, Human
uaggucuuggagguggggcugg

SEQ ID NO: 10180 - RNA, 22 nt, Human
uagguggaaccauaugaaauuu

SEQ ID NO: 10181 - RNA, 22 nt, Human
uagguuuugugucagaguagaa

SEQ ID NO: 10182 - RNA, 22 nt, Human
uaguaauagcuguaaagugugu

SEQ ID NO: 10183 - RNA, 22 nt, Human
uaguacguuccaaaucacugga

SEQ ID NO: 10184 - RNA, 20 nt, Human
uaguaugggagaagaucucc

SEQ ID NO: 10185 - RNA, 22 nt, Human
uaguaugugccuguugucucug

SEQ ID NO: 10186 - RNA, 22 nt, Human
uaguauuuguaauuaucaaagc

SEQ ID NO: 10187 - RNA, 22 nt, Human
uagucaauuagaaagaggccuu

SEQ ID NO: 10188 - RNA, 22 nt, Human
uagucauaauucuugcugccuu

SEQ ID NO: 10189 - RNA, 22 nt, Human
uagucggcuaggagggccuucu

SEQ ID NO: 10190 - RNA, 22 nt, Human
uagucuaguggaaccaucacug

SEQ ID NO: 10191 - RNA, 20 nt, Human
uagugaccaagagggcugcu

SEQ ID NO: 10192 - RNA, 22 nt, Human
uagugcauaccuaacauuuuug

SEQ ID NO: 10193 - RNA, 22 nt, Human
uagugcuagaagcaaagacaaa

SEQ ID NO: 10194 - RNA, 22 nt, Human
uagugcuuaaaacagaauuuuc

SEQ ID NO: 10195 - RNA, 22 nt, Human
uagugcuucauucuauugguuu

SEQ ID NO: 10196 - RNA, 22 nt, Human
uaguggaaccuucuaaaugacg

SEQ ID NO: 10197 - RNA, 20 nt, Human
uaguggaccuugaaggccuc

SEQ ID NO: 10198 - RNA, 22 nt, Human
uaguggcccagcauuucucaau

SEQ ID NO: 10199 - RNA, 22 nt, Human
uagugggauuuugaacaaaacc

SEQ ID NO: 10200 - RNA, 18 nt, Human
uaguggguccaagcacau

SEQ ID NO: 10201 - RNA, 22 nt, Human
uaguuaaugauagggagagggg

SEQ ID NO: 10202 - RNA, 22 nt, Human
uaguuagaucuccaguuugguu

SEQ ID NO: 10203 - RNA, 22 nt, Human
uaguucauucucucuauuccug

SEQ ID NO: 10204 - RNA, 23 nt, Human
uaguuucaucuccacccugcccu

SEQ ID NO: 10205 - RNA, 22 nt, Human
uaguuucuaauguugaaauuau

SEQ ID NO: 10206 - RNA, 22 nt, Human
uaguuucuucaacugucccagc

SEQ ID NO: 10207 - RNA, 22 nt, Human
uaguuuuaagcugacauuguuc

SEQ ID NO: 10208 - RNA, 22 nt, Human
uaguuuucaagugaguuggaag

SEQ ID NO: 10209 - RNA, 18 nt, Human
uauaaacacacuuagguu

SEQ ID NO: 10210 - RNA, 22 nt, Human
uauaaagaccuuauccuucaua

SEQ ID NO: 10211 - RNA, 22 nt, Human
uauaagaaaagucauuaucaaa

SEQ ID NO: 10212 - RNA, 22 nt, Human
uauaagggaaaagcagguuggu

SEQ ID NO: 10213 - RNA, 22 nt, Human
uauaaucuugcccauaguauuu

SEQ ID NO: 10214 - RNA, 22 nt, Human
uauacauauacaaaugcacaua

SEQ ID NO: 10215 - RNA, 22 nt, Human
uauacucaauaaauauuuggag

SEQ ID NO: 10216 - RNA, 22 nt, Human
uauagcaagagaaccauuacca

SEQ ID NO: 10217 - RNA, 22 nt, Human
uauagccuuacaagauauuaua

SEQ ID NO: 10218 - RNA, 22 nt, Human
uauaggaugaugucauguugcu

SEQ ID NO: 10219 - RNA, 22 nt, Human
uauaggugagugaagcucagga

SEQ ID NO: 10220 - RNA, 22 nt, Human
uauagucuuaaguaguagacuc

SEQ ID NO: 10221 - RNA, 22 nt, Human
uauaguucuuagcuggcaccag

SEQ ID NO: 10222 - RNA, 22 nt, Human
uauauaauacacaaauauguac

SEQ ID NO: 10223 - RNA, 22 nt, Human
uauauacacgcacauauacaua

SEQ ID NO: 10224 - RNA, 22 nt, Human
uauauacacugauuaggauuuu

SEQ ID NO: 10225 - RNA, 22 nt, Human
uauauauacauauagaauaugu

SEQ ID NO: 10226 - RNA, 22 nt, Human
uauaugcacucagguguaugug

SEQ ID NO: 10227 - RNA, 22 nt, Human
uauauguagcucaaaaauuccc

SEQ ID NO: 10228 - RNA, 22 nt, Human
uauauuaaagugcuuugcagug

SEQ ID NO: 10229 - RNA, 22 nt, Human
uaucauuaggagugcugcucgg

SEQ ID NO: 10230 - RNA, 22 nt, Human
uaucauuuuacugugacauuuu

SEQ ID NO: 10231 - RNA, 21 nt, Human
uaucauuuuuuccccugagau

SEQ ID NO: 10232 - RNA, 22 nt, Human
uauccuaaaggguaguguggga

SEQ ID NO: 10233 - RNA, 22 nt, Human
uaucuccauucuagccccuugu

SEQ ID NO: 10234 - RNA, 22 nt, Human
uaucuguagucucaugguuccu

SEQ ID NO: 10235 - RNA, 22 nt, Human
uaucuuagaagaaaugggucca

SEQ ID NO: 10236 - RNA, 22 nt, Human
uaugaaagguuuuuucuugaaa

SEQ ID NO: 10237 - RNA, 19 nt, Human
uaugaaguugauaaaaguu

SEQ ID NO: 10238 - RNA, 22 nt, Human
uaugacccccugcacaugugac

SEQ ID NO: 10239 - RNA, 22 nt, Human
uaugacugcucagugaauggaa

SEQ ID NO: 10240 - RNA, 22 nt, Human
uaugagguuaucuaugucguau

SEQ ID NO: 10241 - RNA, 22 nt, Human
uaugaguauagugcaccauggu

SEQ ID NO: 10242 - RNA, 22 nt, Human
uaugccaaaaauaaguuuuaug

SEQ ID NO: 10243 - RNA, 22 nt, Human
uaugcuagauggaaaaauauug

SEQ ID NO: 10244 - RNA, 22 nt, Human
uauggacagcuuucuuuguguu

SEQ ID NO: 10245 - RNA, 22 nt, Human
uaugggcaagagauaggugguc

SEQ ID NO: 10246 - RNA, 22 nt, Human
uaugguuagugcuguagauuau

SEQ ID NO: 10247 - RNA, 22 nt, Human
uauguacauauauguguauaua

SEQ ID NO: 10248 - RNA, 22 nt, Human
uauguauaacuugauaggauga

SEQ ID NO: 10249 - RNA, 22 nt, Human
uauguauauaaaugugugugug

SEQ ID NO: 10250 - RNA, 22 nt, Human
uauguauauccagguaagggcu

SEQ ID NO: 10251 - RNA, 22 nt, Human
uaugucuauugacuuaggauuu

SEQ ID NO: 10252 - RNA, 22 nt, Human
uaugugaaauggaauauagaaa

SEQ ID NO: 10253 - RNA, 22 nt, Human
uaugugaguaccugucaugugc

SEQ ID NO: 10254 - RNA, 20 nt, Human
uaugugcaguuugguuuauc

SEQ ID NO: 10255 - RNA, 18 nt, Human
uaugugucuguuacaacu

SEQ ID NO: 10256 - RNA, 22 nt, Human
uaugugugaguauauaugcaca

SEQ ID NO: 10257 - RNA, 22 nt, Human
uaugugugugcguguguuuugc

SEQ ID NO: 10258 - RNA, 22 nt, Human
uauguuaauuaccagcacugau

SEQ ID NO: 10259 - RNA, 22 nt, Human
uauguucaauaccagguucuuu

SEQ ID NO: 10260 - RNA, 22 nt, Human
uauguuugcaguucuaggucuu

SEQ ID NO: 10261 - RNA, 22 nt, Human
uauguuuugcaaauaucaaaca

SEQ ID NO: 10262 - RNA, 19 nt, Human
uauuagccucaucccagcc

SEQ ID NO: 10263 - RNA, 22 nt, Human
uauuagggaacugcaagacuaa

SEQ ID NO: 10264 - RNA, 22 nt, Human
uauuauggguuuuuguguaaau

SEQ ID NO: 10265 - RNA, 22 nt, Human
uauuaugguuguagguuaacaa

SEQ ID NO: 10266 - RNA, 22 nt, Human
uauucagugcugguucuuuuuc

SEQ ID NO: 10267 - RNA, 22 nt, Human
uauucauuuuuauuugugacug

SEQ ID NO: 10268 - RNA, 22 nt, Human
uauucccacuccucagcaauuu

SEQ ID NO: 10269 - RNA, 21 nt, Human
uauucgcauuucugucuuuac

SEQ ID NO: 10270 - RNA, 22 nt, Human
uauucuucaacuuuucuccucu

SEQ ID NO: 10271 - RNA, 22 nt, Human
uauucuucagcauaaaaauucu

SEQ ID NO: 10272 - RNA, 22 nt, Human
uauugaucuuugaaaccuuggu

SEQ ID NO: 10273 - RNA, 22 nt, Human
uauuggcucagucagaaguuuu

SEQ ID NO: 10274 - RNA, 22 nt, Human
uauuguuuuaagguguauuaau

SEQ ID NO: 10275 - RNA, 22 nt, Human
uauuuaaagucagcaacuuuuc

SEQ ID NO: 10276 - RNA, 22 nt, Human
uauuuacgcaaacaauugugca

SEQ ID NO: 10277 - RNA, 22 nt, Human
uauuuacuguguucaucccucu

SEQ ID NO: 10278 - RNA, 22 nt, Human
uauuuaggcagaaagugauauu

SEQ ID NO: 10279 - RNA, 22 nt, Human
uauuuaugcaucacuuuuuucc

SEQ ID NO: 10280 - RNA, 20 nt, Human
uauuucaaugugccaaguuu

SEQ ID NO: 10281 - RNA, 22 nt, Human
uauuucaucugaacuucccaac

SEQ ID NO: 10282 - RNA, 22 nt, Human
uauuucaugagugaauaucuag

SEQ ID NO: 10283 - RNA, 22 nt, Human
uauuugauggaacucuugcuuu

SEQ ID NO: 10284 - RNA, 22 nt, Human
uauuuguuucuaguggcagcaa

SEQ ID NO: 10285 - RNA, 22 nt, Human
uauuuuagaagauuuggagaaa

SEQ ID NO: 10286 - RNA, 22 nt, Human
uauuuuagccaacagaaugaug

SEQ ID NO: 10287 - RNA, 23 nt, Human
uauuuuccccuguaauauguauu

SEQ ID NO: 10288 - RNA, 22 nt, Human
uauuuugaggugaaagaguuug

SEQ ID NO: 10289 - RNA, 22 nt, Human
uauuuuuacuguuugaugauuc

SEQ ID NO: 10290 - RNA, 22 nt, Human
uauuuuuguuuaccaguuaaca

SEQ ID NO: 10291 - RNA, 22 nt, Human
uauuuuuuuaacauuuauugua

SEQ ID NO: 10292 - RNA, 22 nt, Human
uccacagugguggaauuguuca

SEQ ID NO: 10293 - RNA, 22 nt, Human
uccaccaccaucacagucagac

SEQ ID NO: 10294 - RNA, 22 nt, Human
uccaccacgaaacugcagcugc

SEQ ID NO: 10295 - RNA, 19 nt, Human
uccaccgcgugcaccucua

SEQ ID NO: 10296 - RNA, 22 nt, Human
uccacgcucuuucuacuuuuca

SEQ ID NO: 10297 - RNA, 22 nt, Human
uccacgggagcgucggucucgg

SEQ ID NO: 10298 - RNA, 22 nt, Human
uccacuaucugagcuuaguugc

SEQ ID NO: 10299 - RNA, 20 nt, Human
uccacugagcgucacggcag

SEQ ID NO: 10300 - RNA, 22 nt, Human
uccacuuaauagguauggagcc

SEQ ID NO: 10301 - RNA, 22 nt, Human
uccagacucaaaaaccagaugg

SEQ ID NO: 10302 - RNA, 22 nt, Human
uccagagcuguccuacugugag

SEQ ID NO: 10303 - RNA, 22 nt, Human
uccagcacacagguggcucuca

SEQ ID NO: 10304 - RNA, 22 nt, Human
uccagccugaacuuuguccaga

SEQ ID NO: 10305 - RNA, 22 nt, Human
uccagcuccugaguucacugcu

SEQ ID NO: 10306 - RNA, 22 nt, Human
uccagcuucugccugcugcugc

SEQ ID NO: 10307 - RNA, 22 nt, Human
uccaggacgccgacgugucggc

SEQ ID NO: 10308 - RNA, 21 nt, Human
uccaggagcacgggacuagga

SEQ ID NO: 10309 - RNA, 22 nt, Human
uccaggaggacugagggggcug

SEQ ID NO: 10310 - RNA, 22 nt, Human
uccagguaaggguaaguaggcu

SEQ ID NO: 10311 - RNA, 22 nt, Human
uccagguaggagaccaggcugu

SEQ ID NO: 10312 - RNA, 22 nt, Human
uccagguccuacuggcccauag

SEQ ID NO: 10313 - RNA, 22 nt, Human
uccagguucaguucaucaucua

SEQ ID NO: 10314 - RNA, 22 nt, Human
uccagguuuggcuuuauaacuu

SEQ ID NO: 10315 - RNA, 22 nt, Human
uccagugaacaucauggcucca

SEQ ID NO: 10316 - RNA, 16 nt, Human
uccaguguuccuggau

SEQ ID NO: 10317 - RNA, 22 nt, Human
uccauacuggccucuuucccag

SEQ ID NO: 10318 - RNA, 22 nt, Human
uccaucaccacagaggacagag

SEQ ID NO: 10319 - RNA, 22 nt, Human
uccaugcaguagaggcgcuggg

SEQ ID NO: 10320 - RNA, 22 nt, Human
uccaugcgcgauggccuggcuu

SEQ ID NO: 10321 - RNA, 22 nt, Human
uccauggucgauggcugcuggg

SEQ ID NO: 10322 - RNA, 22 nt, Human
uccauguagggagggcuuucaa

SEQ ID NO: 10323 - RNA, 22 nt, Human
uccauguugauaaucuugugaa

SEQ ID NO: 10324 - RNA, 22 nt, Human
uccauuagagaugcuaaaggac

SEQ ID NO: 10325 - RNA, 22 nt, Human
uccauucccugacagccucuuu

SEQ ID NO: 10326 - RNA, 17 nt, Human
uccauugagacaagaag

SEQ ID NO: 10327 - RNA, 22 nt, Human
uccuucagaggacggcagccag

SEQ ID NO: 10328 - RNA, 22 nt, Human
uccuuccucuuucaaauuuguu

SEQ ID NO: 10329 - RNA, 22 nt, Human
uccuucucagggagacuugaua

SEQ ID NO: 10330 - RNA, 22 nt, Human
uccuugaccuccugacaguaac

SEQ ID NO: 10331 - RNA, 22 nt, Human
uccuuguaccauuugcucacag

SEQ ID NO: 10332 - RNA, 22 nt, Human
uccuuguucugauuuuucuggg

SEQ ID NO: 10333 - RNA, 18 nt, Human
uccuuucaccccuucucu

SEQ ID NO: 10334 - RNA, 22 nt, Human
uccuuuggaaacuggaugucuu

SEQ ID NO: 10335 - RNA, 22 nt, Human
uccuuuuuagguuauuguacau

SEQ ID NO: 10336 - RNA, 22 nt, Human
ucgaaugccaacaccgaaguuu

SEQ ID NO: 10337 - RNA, 22 nt, Human
ucgacuccauuuuucuugguuc

SEQ ID NO: 10338 - RNA, 22 nt, Human
ucgagcucagcagggaggugcg

SEQ ID NO: 10339 - RNA, 22 nt, Human
ucgaggagagucgccagcugcu

SEQ ID NO: 10340 - RNA, 22 nt, Human
ucgauccaggaaggcugguuua

SEQ ID NO: 10341 - RNA, 22 nt, Human
ucgcccagguuggagugcagug

SEQ ID NO: 10342 - RNA, 22 nt, Human
ucgcggccgcuccacaugcaca

SEQ ID NO: 10343 - RNA, 22 nt, Human
ucgcuauuauuuuagguucuca

SEQ ID NO: 10344 - RNA, 20 nt, Human
ucgcugcaagggaaauggag

SEQ ID NO: 10345 - RNA, 22 nt, Human
ucgcuugaacccaggaagugga

SEQ ID NO: 10346 - RNA, 22 nt, Human
ucgcuuuaauggucuucacagc

SEQ ID NO: 10347 - RNA, 22 nt, Human
ucggccggagggggcgggcgca

SEQ ID NO: 10348 - RNA, 22 nt, Human
ucggccuuuucuuauacccaca

SEQ ID NO: 10349 - RNA, 22 nt, Human
ucggcuccucccuggaaagggg

SEQ ID NO: 10350 - RNA, 22 nt, Human
ucgggacccccgcccgggcccg

SEQ ID NO: 10351 - RNA, 22 nt, Human
ucgggaggaggcggagcucguu

SEQ ID NO: 10352 - RNA, 22 nt, Human
ucgggccacauccacacaucca

SEQ ID NO: 10353 - RNA, 22 nt, Human
ucgggcgaauguuguuuuucuc

SEQ ID NO: 10354 - RNA, 22 nt, Human
ucgggggaaccggcccgggccu

SEQ ID NO: 10355 - RNA, 22 nt, Human
ucgggggucgggcggcggucca

SEQ ID NO: 10356 - RNA, 22 nt, Human
ucguauaguugcugcagauggu

SEQ ID NO: 10357 - RNA, 22 nt, Human
ucguauucagugcaagucaacg

SEQ ID NO: 10358 - RNA, 22 nt, Human
ucgucaaaguaaugucauagca

SEQ ID NO: 10359 - RNA, 22 nt, Human
ucguccaauaaccugccagcgc

SEQ ID NO: 10360 - RNA, 22 nt, Human
ucgugaagaaauguggacuuca

SEQ ID NO: 10361 - RNA, 22 nt, Human
ucgugagugcugucaccugcug

SEQ ID NO: 10362 - RNA, 22 nt, Human
ucguggaugaagaauagaggcc

SEQ ID NO: 10363 - RNA, 22 nt, Human
ucguguuggaacugcuuuguaa

SEQ ID NO: 10364 - RNA, 22 nt, Human
ucguuucuuuuucuucccugga

SEQ ID NO: 10365 - RNA, 22 nt, Human
ucuaaaaauuagaaauuagguc

SEQ ID NO: 10366 - RNA, 22 nt, Human
ucuaaaugaccuccuugcccag

SEQ ID NO: 10367 - RNA, 22 nt, Human
ucuaacuaagcuuuaaaagguc

SEQ ID NO: 10368 - RNA, 22 nt, Human
ucuaagcuugaucacuugcuuu

SEQ ID NO: 10369 - RNA, 22 nt, Human
ucuaaucuacaaaaggaaauuc

SEQ ID NO: 10370 - RNA, 22 nt, Human
ucuacgugggaguucaggauuc

SEQ ID NO: 10371 - RNA, 22 nt, Human
ucuacuccaucugccagggcuu

SEQ ID NO: 10372 - RNA, 21 nt, Human
ucuagaccuugggcagucacu

SEQ ID NO: 10373 - RNA, 22 nt, Human
ucuagcccucauggcugaaggc

SEQ ID NO: 10374 - RNA, 22 nt, Human
ucuaggaguugauaaaagggcu

SEQ ID NO: 10375 - RNA, 22 nt, Human
ucuaggcugugugugggcaggg

SEQ ID NO: 10376 - RNA, 22 nt, Human
ucuaguguuaaggcaaaguaaa

SEQ ID NO: 10377 - RNA, 22 nt, Human
ucuauauucuauguucuucuuu

SEQ ID NO: 10378 - RNA, 22 nt, Human
ucuaugaagucuuccuuuccuc

SEQ ID NO: 10379 - RNA, 23 nt, Human
ucucaccaggauaugacugucac

SEQ ID NO: 10380 - RNA, 23 nt, Human
ucucacucauucuccucugucca

SEQ ID NO: 10381 - RNA, 22 nt, Human
ucucagaaaugacaggagguac

SEQ ID NO: 10382 - RNA, 22 nt, Human
ucucagaagaaacaucugcugg

SEQ ID NO: 10383 - RNA, 22 nt, Human
ucucagggaugggaggccccag

SEQ ID NO: 10384 - RNA, 22 nt, Human
ucucauaauuguuucccagcua

SEQ ID NO: 10385 - RNA, 22 nt, Human
ucucauacguuuccagguguca

SEQ ID NO: 10386 - RNA, 22 nt, Human
ucucauaucuguacacccuugu

SEQ ID NO: 10387 - RNA, 22 nt, Human
ucucauugugcuuuuuguacug

SEQ ID NO: 10388 - RNA, 21 nt, Human
ucucauuuuaacacagaguug

SEQ ID NO: 10389 - RNA, 20 nt, Human
ucucauuuugauuucgcauu

SEQ ID NO: 10390 - RNA, 22 nt, Human
ucuccagcugaggccuucuucc

SEQ ID NO: 10391 - RNA, 22 nt, Human
ucuccaggggcagggucuggag

SEQ ID NO: 10392 - RNA, 22 nt, Human
ucucccaaaucuuucuagcaca

SEQ ID NO: 10393 - RNA, 22 nt, Human
ucucccauuuuacaggugagga

SEQ ID NO: 10394 - RNA, 22 nt, Human
ucuccccagcucgcucucuccc

SEQ ID NO: 10395 - RNA, 22 nt, Human
ucuccccucuggucugggcucu

SEQ ID NO: 10396 - RNA, 22 nt, Human
ucucccgcuuccugcuggcugc

SEQ ID NO: 10397 - RNA, 22 nt, Human
ucucccuggccagcccuuuccc

SEQ ID NO: 10398 - RNA, 22 nt, Human
ucucccuuuggauuuguuuugg

SEQ ID NO: 10399 - RNA, 22 nt, Human
ucuccucuauuucuguauguau

SEQ ID NO: 10400 - RNA, 22 nt, Human
ucuccugacaccucuugugggg

SEQ ID NO: 10401 - RNA, 22 nt, Human
ucuccuuuacuggcuccuuuug

SEQ ID NO: 10402 - RNA, 22 nt, Human
ucuccuuugaaaguuaggacug

SEQ ID NO: 10403 - RNA, 22 nt, Human
ucucuacuuggcuuguguucac

SEQ ID NO: 10404 - RNA, 22 nt, Human
ucucuagaggaauuguucuagg

SEQ ID NO: 10405 - RNA, 22 nt, Human
ucucuagcuuccuuaggaacac

SEQ ID NO: 10406 - RNA, 21 nt, Human
ucucuaucguauaccagccgg

SEQ ID NO: 10407 - RNA, 22 nt, Human
ucucuccauguuuucuguccag

SEQ ID NO: 10408 - RNA, 22 nt, Human
ucucuccuccacaccgggugcu

SEQ ID NO: 10409 - RNA, 22 nt, Human
ucucucguuuuuugcagauaaa

SEQ ID NO: 10410 - RNA, 22 nt, Human
ucucugaccuccaccccaggag

SEQ ID NO: 10411 - RNA, 22 nt, Human
ucucugaggaagcgaucuuuag

SEQ ID NO: 10412 - RNA, 22 nt, Human
ucucugaggacagaaaguuugu

SEQ ID NO: 10413 - RNA, 22 nt, Human
ucucugguagcucugugcucug

SEQ ID NO: 10414 - RNA, 19 nt, Human
ucucugguggcuccaucag

SEQ ID NO: 10415 - RNA, 22 nt, Human
ucucugguggcuccaucaguag

SEQ ID NO: 10416 - RNA, 22 nt, Human
ucucuguacauagugaagcccg

SEQ ID NO: 10417 - RNA, 22 nt, Human
ucucugugaauggcgucaccug

SEQ ID NO: 10418 - RNA, 20 nt, Human
ucucuuuuucuucuuuucuc

SEQ ID NO: 10419 - RNA, 22 nt, Human
ucugaaaggagaguagggcaga

SEQ ID NO: 10420 - RNA, 22 nt, Human
ucugaagagaacucuuaguguu

SEQ ID NO: 10421 - RNA, 22 nt, Human
ucugaauauguuuaucaucucu

SEQ ID NO: 10422 - RNA, 22 nt, Human
ucugaccaggcucuuguagccu

SEQ ID NO: 10423 - RNA, 17 nt, Human
ucugaccuuuacuccug

SEQ ID NO: 10424 - RNA, 22 nt, Human
ucugaggacagugcugugccug

SEQ ID NO: 10425 - RNA, 22 nt, Human
ucugagugacguccugacagga

SEQ ID NO: 10426 - RNA, 22 nt, Human
ucugaucagaagacaaaugagg

SEQ ID NO: 10427 - RNA, 22 nt, Human
ucugaucuuucauccuaaaugg

SEQ ID NO: 10428 - RNA, 22 nt, Human
ucugaugaccacaugugggacu

SEQ ID NO: 10429 - RNA, 22 nt, Human
ucugauucauucugguaaaugg

SEQ ID NO: 10430 - RNA, 22 nt, Human
ucugauucucuuguugaccuag

SEQ ID NO: 10431 - RNA, 22 nt, Human
ucugcacagcucaccucccugg

SEQ ID NO: 10432 - RNA, 17 nt, Human
ucugcagaggcaaaccu

SEQ ID NO: 10433 - RNA, 22 nt, Human
ucugcagggcccuuggcuccug

SEQ ID NO: 10434 - RNA, 22 nt, Human
ucugcaugccucaggaggccug

SEQ ID NO: 10435 - RNA, 17 nt, Human
ucugccaguuuuagaau

SEQ ID NO: 10436 - RNA, 22 nt, Human
ucugcccguucaaauccuuguu

SEQ ID NO: 10437 - RNA, 22 nt, Human
ucugcggccuagcgcccggcgc

SEQ ID NO: 10438 - RNA, 22 nt, Human
ucugcgggccuggcucccagcg

SEQ ID NO: 10439 - RNA, 22 nt, Human
ucugcguggcgugguucugugc

SEQ ID NO: 10440 - RNA, 22 nt, Human
ucugcuuaguuuucuugaacag

SEQ ID NO: 10441 - RNA, 20 nt, Human
ucugcuugucuucagguucc

SEQ ID NO: 10442 - RNA, 22 nt, Human
ucuggaggucucagggcgggaa

SEQ ID NO: 10443 - RNA, 22 nt, Human
ucuggcaguugccgcuucaguc

SEQ ID NO: 10444 - RNA, 21 nt, Human
ucuggccuauaaaguagucgc

SEQ ID NO: 10445 - RNA, 22 nt, Human
ucuggcucaggagcuguguuca

SEQ ID NO: 10446 - RNA, 22 nt, Human
ucuggcucuccagugcucuuag

SEQ ID NO: 10447 - RNA, 22 nt, Human
ucugggagaguagauaaaggaa

SEQ ID NO: 10448 - RNA, 22 nt, Human
ucugggccacccgccuccaggg

SEQ ID NO: 10449 - RNA, 21 nt, Human
ucuggggacaagguccaggaa

SEQ ID NO: 10450 - RNA, 22 nt, Human
ucugggucuaucccaugccuuu

SEQ ID NO: 10451 - RNA, 22 nt, Human
ucuggguuuccuucacaagcac

SEQ ID NO: 10452 - RNA, 17 nt, Human
ucuggguuucugauuua

SEQ ID NO: 10453 - RNA, 22 nt, Human
ucuggucugccgagauccauuu

SEQ ID NO: 10454 - RNA, 22 nt, Human
ucuggugcacucugauauuuga

SEQ ID NO: 10455 - RNA, 22 nt, Human
ucugguuccugcauucauucaa

SEQ ID NO: 10456 - RNA, 22 nt, Human
ucugguuuggguugcuauggcu

SEQ ID NO: 10457 - RNA, 22 nt, Human
ucuguaaaugcaaguuuuccuc

SEQ ID NO: 10458 - RNA, 22 nt, Human
ucuguagcuaauucucuuuaaa

SEQ ID NO: 10459 - RNA, 22 nt, Human
ucuguaguaugguacuuauuua

SEQ ID NO: 10460 - RNA, 22 nt, Human
ucuguauuuuuuacacacaugc

SEQ ID NO: 10461 - RNA, 22 nt, Human
ucugucuaaccauauuuuccua

SEQ ID NO: 10462 - RNA, 22 nt, Human
ucugucucugucaggcugcugc

SEQ ID NO: 10463 - RNA, 22 nt, Human
ucugugcuccuuccuugucauc

SEQ ID NO: 10464 - RNA, 22 nt, Human
ucuguggcaaacacagugacca

SEQ ID NO: 10465 - RNA, 22 nt, Human
ucugugugugugcauaugcaug

SEQ ID NO: 10466 - RNA, 22 nt, Human
ucuguuauaaaucacacugcau

SEQ ID NO: 10467 - RNA, 22 nt, Human
ucuguucagaagaggugaaagu

SEQ ID NO: 10468 - RNA, 22 nt, Human
ucuguuguauggcugucuaauu

SEQ ID NO: 10469 - RNA, 21 nt, Human
ucuguuguguguugaggacuu

SEQ ID NO: 10470 - RNA, 22 nt, Human
ucuguuucaggggucuggaaug

SEQ ID NO: 10471 - RNA, 22 nt, Human
ucuguuuuccaggaaucucaua

SEQ ID NO: 10472 - RNA, 22 nt, Human
ucuguuuugugcuuuguuuucu

SEQ ID NO: 10473 - RNA, 22 nt, Human
ucuuaaguuccaggugugcuca

SEQ ID NO: 10474 - RNA, 22 nt, Human
ucuuaaucauucuucacuuccu

SEQ ID NO: 10475 - RNA, 22 nt, Human
ucuuacuguccucuguuuuucu

SEQ ID NO: 10476 - RNA, 21 nt, Human
ucuuauacagcaauagaucug

SEQ ID NO: 10477 - RNA, 22 nt, Human
ucuuauucuuuuaaacaacgca

SEQ ID NO: 10478 - RNA, 22 nt, Human
ucuucacugaagcuuugcaucu

SEQ ID NO: 10479 - RNA, 22 nt, Human
ucuucagacuguuguucuuuug

SEQ ID NO: 10480 - RNA, 20 nt, Human
ucuucagcuccaagucuggc

SEQ ID NO: 10481 - RNA, 22 nt, Human
ucuucaggaaaaccaaaguugu

SEQ ID NO: 10482 - RNA, 22 nt, Human
ucuucaucucuaaaaugggaac

SEQ ID NO: 10483 - RNA, 22 nt, Human
ucuuccaaacaaaaaucugugu

SEQ ID NO: 10484 - RNA, 21 nt, Human
ucuuccaacacugacaccaug

SEQ ID NO: 10485 - RNA, 22 nt, Human
ucuuccagauacuuccugacuu

SEQ ID NO: 10486 - RNA, 22 nt, Human
ucuuccauuccccuccuacgcc

SEQ ID NO: 10487 - RNA, 21 nt, Human
ucuucccaggccuuaaagggc

SEQ ID NO: 10488 - RNA, 22 nt, Human
ucuuccuuacucuggauguuau

SEQ ID NO: 10489 - RNA, 22 nt, Human
ucuuccuuguaagggcuuuaga

SEQ ID NO: 10490 - RNA, 22 nt, Human
ucuucuauaucuacauaugcaa

SEQ ID NO: 10491 - RNA, 22 nt, Human
ucuucuguguguagugguugug

SEQ ID NO: 10492 - RNA, 22 nt, Human
ucuucuuauuuuaugaucgcuu

SEQ ID NO: 10493 - RNA, 22 nt, Human
ucuucuuuccuuuugugcauuu

SEQ ID NO: 10494 - RNA, 22 nt, Human
ucuugauggugauguuguguca

SEQ ID NO: 10495 - RNA, 22 nt, Human
ucuugccccugcuuuggaacaa

SEQ ID NO: 10496 - RNA, 22 nt, Human
ucuugcucuguucuaaaggauu

SEQ ID NO: 10497 - RNA, 22 nt, Human
ucuugcuggagucaaggcuaca

SEQ ID NO: 10498 - RNA, 22 nt, Human
ucuuggcaguucuugugcuuuu

SEQ ID NO: 10499 - RNA, 22 nt, Human
ucuuggggagacuaguguuugg

SEQ ID NO: 10500 - RNA, 22 nt, Human
ucuugucacagcuugacuccua

SEQ ID NO: 10501 - RNA, 20 nt, Human
ucuugucuggcagccuggag

SEQ ID NO: 10502 - RNA, 22 nt, Human
ucuugugagcugagauaaagcc

SEQ ID NO: 10503 - RNA, 22 nt, Human
ucuuuaaauucuuaugagugaa

SEQ ID NO: 10504 - RNA, 22 nt, Human
ucuuucucauccaaacuaguug

SEQ ID NO: 10505 - RNA, 22 nt, Human
ucuuucucuccagccuggaccu

SEQ ID NO: 10506 - RNA, 22 nt, Human
ucuuugcauggacauguguuuu

SEQ ID NO: 10507 - RNA, 22 nt, Human
ucuuugcugacacuuacacugu

SEQ ID NO: 10508 - RNA, 19 nt, Human
ucuuugcuuuucuaagagg

SEQ ID NO: 10509 - RNA, 22 nt, Human
ucuuuguuagucagaauugauc

SEQ ID NO: 10510 - RNA, 22 nt, Human
ucuuuucagccagcugguagga

SEQ ID NO: 10511 - RNA, 22 nt, Human
ucuuuugaacauccaggauguc

SEQ ID NO: 10512 - RNA, 22 nt, Human
ucuuuugugauuuucugaagca

SEQ ID NO: 10513 - RNA, 22 nt, Human
ucuuuuuaugucaaaaucgaug

SEQ ID NO: 10514 - RNA, 22 nt, Human
ugaaaaauauuuuuagaaauaa

SEQ ID NO: 10515 - RNA, 22 nt, Human
ugaaaaaugcuuuaaugcaugu

SEQ ID NO: 10516 - RNA, 22 nt, Human
ugaaaggaauuuaaauguuguu

SEQ ID NO: 10517 - RNA, 22 nt, Human
ugaaaugccucuuugguucuaa

SEQ ID NO: 10518 - RNA, 22 nt, Human
ugaaauguggagaugguaagua

SEQ ID NO: 10519 - RNA, 22 nt, Human
ugaaauuuuuuggagauaauuu

SEQ ID NO: 10520 - RNA, 21 nt, Human
ugaacaccaggagaaaucggu

SEQ ID NO: 10521 - RNA, 22 nt, Human
ugaaccgacaggggaagauugu

SEQ ID NO: 10522 - RNA, 22 nt, Human
ugaaccuaacauuucuggcagu

SEQ ID NO: 10523 - RNA, 22 nt, Human
ugaaccugagggcaaagggaca

SEQ ID NO: 10524 - RNA, 22 nt, Human
ugaacuuacauugaggaauucu

SEQ ID NO: 10525 - RNA, 22 nt, Human
ugaacuucccauguacagacug

SEQ ID NO: 10526 - RNA, 22 nt, Human
ugaagccacacuagcuuguccu

SEQ ID NO: 10527 - RNA, 22 nt, Human
ugaagccaugcuaaauguuaca

SEQ ID NO: 10528 - RNA, 21 nt, Human
ugaagcccugugaggugcuua

SEQ ID NO: 10529 - RNA, 22 nt, Human
ugaagcuaguauuaacucagau

SEQ ID NO: 10530 - RNA, 22 nt, Human
ugaaggaggugaauccaugcau

SEQ ID NO: 10531 - RNA, 22 nt, Human
ugaaggagucgaggugggugag

SEQ ID NO: 10532 - RNA, 22 nt, Human
ugaaggccagggauuugcagcc

SEQ ID NO: 10533 - RNA, 22 nt, Human
ugaaggggaaagucuugcuaua

SEQ ID NO: 10534 - RNA, 22 nt, Human
ugaagguggcuugcagcuaguc

SEQ ID NO: 10535 - RNA, 22 nt, Human
ugaauaaucuuggguauuaaua

SEQ ID NO: 10536 - RNA, 22 nt, Human
ugaaucaaugaauugcacuuca

SEQ ID NO: 10537 - RNA, 22 nt, Human
ugaaucuuguuuacugauuccu

SEQ ID NO: 10538 - RNA, 22 nt, Human
ugaaugaacugaugaacuuaac

SEQ ID NO: 10539 - RNA, 22 nt, Human
ugaaugaagcacuguaauucuc

SEQ ID NO: 10540 - RNA, 22 nt, Human
ugaaugaguucaccgcucaguu

SEQ ID NO: 10541 - RNA, 22 nt, Human
ugaauggugcccuagagggaug

SEQ ID NO: 10542 - RNA, 22 nt, Human
ugaauguguacacgauuguuug

SEQ ID NO: 10543 - RNA, 22 nt, Human
ugaauuagagugaaggaaagcu

SEQ ID NO: 10544 - RNA, 22 nt, Human
ugaauuucuuuuuaaaauauua

SEQ ID NO: 10545 - RNA, 22 nt, Human
ugaauuuuggcaauuuucugug

SEQ ID NO: 10546 - RNA, 22 nt, Human
ugacacagaccaaguggugcug

SEQ ID NO: 10547 - RNA, 22 nt, Human
ugacagaggagcuggaaugauu

SEQ ID NO: 10548 - RNA, 23 nt, Human
ugacagguucuaugguuuccaac

SEQ ID NO: 10549 - RNA, 22 nt, Human
ugacaguuugacugcaaccuuu

SEQ ID NO: 10550 - RNA, 22 nt, Human
uggaaaggaguucuguuuauuu

SEQ ID NO: 10551 - RNA, 22 nt, Human
uggaaaggcccauaaaaggaua

SEQ ID NO: 10552 - RNA, 22 nt, Human
uggaaauaguugugagucaggc

SEQ ID NO: 10553 - RNA, 22 nt, Human
uggaaccuggcuucaaagggag

SEQ ID NO: 10554 - RNA, 22 nt, Human
uggaagaaaacuuggaaggcau

SEQ ID NO: 10555 - RNA, 23 nt, Human
uggaagaaaaugguuuggcugug

SEQ ID NO: 10556 - RNA, 22 nt, Human
uggaagcuagggguuucuguug

SEQ ID NO: 10557 - RNA, 22 nt, Human
uggaagcuggcugaucugacuu

SEQ ID NO: 10558 - RNA, 21 nt, Human
uggaagggaagucuugguugu

SEQ ID NO: 10559 - RNA, 22 nt, Human
uggaagggguuacgcagcagga

SEQ ID NO: 10560 - RNA, 22 nt, Human
uggaaggugauucucugguuaa

SEQ ID NO: 10561 - RNA, 22 nt, Human
uggaagucuucucucccaugga

SEQ ID NO: 10562 - RNA, 22 nt, Human
uggaaguggcaggggagacgua

SEQ ID NO: 10563 - RNA, 22 nt, Human
uggaagugucagcaggcugguu

SEQ ID NO: 10564 - RNA, 22 nt, Human
uggaaugaaagaaaaauuguag

SEQ ID NO: 10565 - RNA, 21 nt, Human
uggaauuggaaaccauucuau

SEQ ID NO: 10566 - RNA, 22 nt, Human
uggacagguacuucacauuauu

SEQ ID NO: 10567 - RNA, 22 nt, Human
uggacagugguggggaggagga

SEQ ID NO: 10568 - RNA, 22 nt, Human
uggacuguaaauuggggacucu

SEQ ID NO: 10569 - RNA, 22 nt, Human
uggacuguaauguguguggacc

SEQ ID NO: 10570 - RNA, 22 nt, Human
uggacuguucauugauacugga

SEQ ID NO: 10571 - RNA, 22 nt, Human
uggagaaauaacauuuggauuc

SEQ ID NO: 10572 - RNA, 22 nt, Human
uggagagaaguucuauaaauca

SEQ ID NO: 10573 - RNA, 22 nt, Human
uggagagauagucauucuagag

SEQ ID NO: 10574 - RNA, 22 nt, Human
uggagagcaaugaggggcaggc

SEQ ID NO: 10575 - RNA, 22 nt, Human
uggagauauucuauauuuuaua

SEQ ID NO: 10576 - RNA, 22 nt, Human
uggagaugcacgagcaggugga

SEQ ID NO: 10577 - RNA, 22 nt, Human
uggagcaagaagggaggcagaa

SEQ ID NO: 10578 - RNA, 21 nt, Human
uggagcagggaggauuugggg

SEQ ID NO: 10579 - RNA, 22 nt, Human
uggagccugauggauaggaacg

SEQ ID NO: 10580 - RNA, 22 nt, Human
uggagcugaaguacucucacua

SEQ ID NO: 10581 - RNA, 22 nt, Human
uggagcuggcuuguggaaguug

SEQ ID NO: 10582 - RNA, 22 nt, Human
uggagcugguucuggggaagcu

SEQ ID NO: 10583 - RNA, 22 nt, Human
uggaggagaacugauuuggcuu

SEQ ID NO: 10584 - RNA, 22 nt, Human
uggaggaggaugcauuuguugu

SEQ ID NO: 10585 - RNA, 22 nt, Human
uggaggauaacacaagaaguga

SEQ ID NO: 10586 - RNA, 22 nt, Human
uggaggaugacagagaugggcu

SEQ ID NO: 10587 - RNA, 22 nt, Human
uggaggcccagcugggggccgg

SEQ ID NO: 10588 - RNA, 22 nt, Human
ugggauauagaauuggcagagu

SEQ ID NO: 10589 - RNA, 22 nt, Human
ugggaugagcuauauagaaagu

SEQ ID NO: 10590 - RNA, 20 nt, Human
ugggauggaaucaccugcac

SEQ ID NO: 10591 - RNA, 22 nt, Human
ugggauucugaaaauggauuac

SEQ ID NO: 10592 - RNA, 22 nt, Human
ugggcaaaugcuuuuuagucaa

SEQ ID NO: 10593 - RNA, 22 nt, Human
ugggcagggagcuggaaccaca

SEQ ID NO: 10594 - RNA, 22 nt, Human
ugggcagggauuuggggaaacu

SEQ ID NO: 10595 - RNA, 22 nt, Human
ugggcaguccagcuggaaacgg

SEQ ID NO: 10596 - RNA, 22 nt, Human
ugggcccaucauugcugugggc

SEQ ID NO: 10597 - RNA, 22 nt, Human
ugggccgugagacgucucuggg

SEQ ID NO: 10598 - RNA, 23 nt, Human
ugggccucuccacccuuuucugu

SEQ ID NO: 10599 - RNA, 22 nt, Human
ugggcuguuucuuaaggauaug

SEQ ID NO: 10600 - RNA, 22 nt, Human
uggggaagaacuugccauuuca

SEQ ID NO: 10601 - RNA, 22 nt, Human
uggggaauguaauucuuuggcu

SEQ ID NO: 10602 - RNA, 22 nt, Human
uggggacucacugacuaucuug

SEQ ID NO: 10603 - RNA, 22 nt, Human
uggggaguaggaggggaacaga

SEQ ID NO: 10604 - RNA, 22 nt, Human
uggggagucccaacgguggaag

SEQ ID NO: 10605 - RNA, 21 nt, Human
uggggaugcauugcagaggca

SEQ ID NO: 10606 - RNA, 22 nt, Human
uggggcauacgugaaauaauuu

SEQ ID NO: 10607 - RNA, 22 nt, Human
uggggccaggcuguuggcuucc

SEQ ID NO: 10608 - RNA, 22 nt, Human
uggggcgccuggcugaggcugc

SEQ ID NO: 10609 - RNA, 22 nt, Human
uggggcuccaguagagaaggca

SEQ ID NO: 10610 - RNA, 22 nt, Human
uggggcuccuccuggcaggagg

SEQ ID NO: 10611 - RNA, 18 nt, Human
ugggggacgcuuuuuuuc

SEQ ID NO: 10612 - RNA, 22 nt, Human
ugggggaggaggagacagacug

SEQ ID NO: 10613 - RNA, 22 nt, Human
ugggggagggagaguugauggg

SEQ ID NO: 10614 - RNA, 22 nt, Human
ugggggauauggcuccauacuu

SEQ ID NO: 10615 - RNA, 22 nt, Human
ugggggaugacuugcucuuuca

SEQ ID NO: 10616 - RNA, 22 nt, Human
uggggggacagauggagaggac

SEQ ID NO: 10617 - RNA, 22 nt, Human
ugggggguuuagaaucugcccu

SEQ ID NO: 10618 - RNA, 23 nt, Human
uggggucaaggcugccuuggggu

SEQ ID NO: 10619 - RNA, 22 nt, Human
uggggucuggcauaugguagau

SEQ ID NO: 10620 - RNA, 20 nt, Human
ugggguucccuuuagggcuu

SEQ ID NO: 10621 - RNA, 22 nt, Human
ugggguuuuagagcaggcagag

SEQ ID NO: 10622 - RNA, 22 nt, Human
ugggucacuggccaagcucgac

SEQ ID NO: 10623 - RNA, 22 nt, Human
ugggucagauacaguguuuggu

SEQ ID NO: 10624 - RNA, 22 nt, Human
ugggucagauugagccccuggu

SEQ ID NO: 10625 - RNA, 22 nt, Human
ugggucaguagccuugcagaac

SEQ ID NO: 10626 - RNA, 22 nt, Human
uggguccaggauucuguguuuc

SEQ ID NO: 10627 - RNA, 22 nt, Human
ugggugaugagguccccagccc

SEQ ID NO: 10628 - RNA, 22 nt, Human
uguguguucauccccucaacau

SEQ ID NO: 10629 - RNA, 22 nt, Human
uguguguuguuuugccagaaua

SEQ ID NO: 10630 - RNA, 22 nt, Human
uguguuacaauaauggcaagua

SEQ ID NO: 10631 - RNA, 22 nt, Human
uguguuagguuuugggauggcu

SEQ ID NO: 10632 - RNA, 22 nt, Human
uguguucagaagaggcugccgg

SEQ ID NO: 10633 - RNA, 22 nt, Human
uguguuuaaacuauaugccugc

SEQ ID NO: 10634 - RNA, 21 nt, Human
uguguuuauauguguuuauau

SEQ ID NO: 10635 - RNA, 22 nt, Human
uguuaacugccaggacagaucg

SEQ ID NO: 10636 - RNA, 22 nt, Human
uguuaacuuagcugaccuuaaa

SEQ ID NO: 10637 - RNA, 22 nt, Human
uguuacaucucugcccagccua

SEQ ID NO: 10638 - RNA, 22 nt, Human
uguuacugaaugucucugcuuu

SEQ ID NO: 10639 - RNA, 22 nt, Human
uguuaguauuggcaaauuuguu

SEQ ID NO: 10640 - RNA, 23 nt, Human
uguuaucacauguuccuuuaaau

SEQ ID NO: 10641 - RNA, 22 nt, Human
uguuauugccucaugagacucc

SEQ ID NO: 10642 - RNA, 22 nt, Human
uguuccacgcguaguuccugcu

SEQ ID NO: 10643 - RNA, 22 nt, Human
uguuccggucuaucgugucaau

SEQ ID NO: 10644 - RNA, 22 nt, Human
uguuccucuuagucuuaugugu

SEQ ID NO: 10645 - RNA, 22 nt, Human
uguuccuggggaccugccuucc

SEQ ID NO: 10646 - RNA, 22 nt, Human
uguuccuuuuguuguuuuguuu

SEQ ID NO: 10647 - RNA, 22 nt, Human
uguucggaaaagggcaagcuau

SEQ ID NO: 10648 - RNA, 19 nt, Human
uguucuacuugcuaguauu

SEQ ID NO: 10649 - RNA, 22 nt, Human
uguucugaggaggguuucaagg

SEQ ID NO: 10650 - RNA, 22 nt, Human
uguucuuaacuuuuguguauau

SEQ ID NO: 10651 - RNA, 22 nt, Human
uguugagaacaucucggggaca

SEQ ID NO: 10652 - RNA, 22 nt, Human
uguugaugaccacaauuuaugc

SEQ ID NO: 10653 - RNA, 19 nt, Human
uguugcagcuugaucggua

SEQ ID NO: 10654 - RNA, 22 nt, Human
uguugccaucuaaaauguuacu

SEQ ID NO: 10655 - RNA, 22 nt, Human
uguuggaaucuucuagucuucc

SEQ ID NO: 10656 - RNA, 22 nt, Human
uguuggauuuugugaaauauga

SEQ ID NO: 10657 - RNA, 22 nt, Human
uguuguaaacagaggagccauu

SEQ ID NO: 10658 - RNA, 22 nt, Human
uguuguagaaaggaaaguggcc

SEQ ID NO: 10659 - RNA, 22 nt, Human
uguugucaugcagucaguggua

SEQ ID NO: 10660 - RNA, 23 nt, Human
uguuguccaacugaucuccaggc

SEQ ID NO: 10661 - RNA, 19 nt, Human
uguugugggccacuaacua

SEQ ID NO: 10662 - RNA, 22 nt, Human
uguuguucuuuuucuucuuguu

SEQ ID NO: 10663 - RNA, 22 nt, Human
uguuuaguuuugcaccaauaaa

SEQ ID NO: 10664 - RNA, 22 nt, Human
uguuuaucaguagacucaaguu

SEQ ID NO: 10665 - RNA, 22 nt, Human
uguuucaguaugauuuucccuc

SEQ ID NO: 10666 - RNA, 20 nt, Human
uguuucccaacaccccaaag

SEQ ID NO: 10667 - RNA, 22 nt, Human
uguuuccuguaccacagguuuu

SEQ ID NO: 10668 - RNA, 22 nt, Human
uguuucguugguggagagcuac

SEQ ID NO: 10669 - RNA, 22 nt, Human
uguuugaugugcacgugugugu

SEQ ID NO: 10670 - RNA, 21 nt, Human
uguuugcuuuuggagcaacug

SEQ ID NO: 10671 - RNA, 22 nt, Human
uucaggaaacaaauuugcaguu

SEQ ID NO: 10672 - RNA, 18 nt, Human
uucaggcucuugcaugaa

SEQ ID NO: 10673 - RNA, 19 nt, Human
uucaggcuuuucauuuuuc

SEQ ID NO: 10674 - RNA, 22 nt, Human
uucagguacuaagugcugauuc

SEQ ID NO: 10675 - RNA, 22 nt, Human
uucaggugguuuaagaauugga

SEQ ID NO: 10676 - RNA, 22 nt, Human
uucaguguuagaauuccaagaa

SEQ ID NO: 10677 - RNA, 22 nt, Human
uucauacucuucccugggcaaa

SEQ ID NO: 10678 - RNA, 22 nt, Human
uucauagggagcaucuaccuau

SEQ ID NO: 10679 - RNA, 22 nt, Human
uucauauuguggucuugcauuc

SEQ ID NO: 10680 - RNA, 22 nt, Human
uucauccucuaguacugaagug

SEQ ID NO: 10681 - RNA, 22 nt, Human
uucaucuucaaaccccagugcc

SEQ ID NO: 10682 - RNA, 22 nt, Human
uucaugcaagagugugaggucc

SEQ ID NO: 10683 - RNA, 20 nt, Human
uucaugcagugguugcugug

SEQ ID NO: 10684 - RNA, 22 nt, Human
uucaugucuuugauucugauaa

SEQ ID NO: 10685 - RNA, 22 nt, Human
uucauuagcacauuuccuuggu

SEQ ID NO: 10686 - RNA, 22 nt, Human
uucauuagcguaggauguguac

SEQ ID NO: 10687 - RNA, 22 nt, Human
uucauugcuacuuaaaauacca

SEQ ID NO: 10688 - RNA, 22 nt, Human
uucauuuccauuuuauagauaa

SEQ ID NO: 10689 - RNA, 22 nt, Human
uucauuuuauauuagagcuguu

SEQ ID NO: 10690 - RNA, 22 nt, Human
uuccaaaugacaaugggcugua

SEQ ID NO: 10691 - RNA, 22 nt, Human
uuccaaggagagcucgaccuca

SEQ ID NO: 10692 - RNA, 22 nt, Human
uuccacauucggaauuuucuga

SEQ ID NO: 10693 - RNA, 22 nt, Human
uuccaggacuggguguuugaag

SEQ ID NO: 10694 - RNA, 22 nt, Human
uuccagguggcuuuccuggggg

SEQ ID NO: 10695 - RNA, 22 nt, Human
uuccaugccccucuuuggguac

SEQ ID NO: 10696 - RNA, 22 nt, Human
uuccaugccuaagagccugaag

SEQ ID NO: 10697 - RNA, 22 nt, Human
uuccauggggcuguugcgcaga

SEQ ID NO: 10698 - RNA, 22 nt, Human
uuccauuacuaaugccugcaau

SEQ ID NO: 10699 - RNA, 18 nt, Human
uuccauuuuucagucuuc

SEQ ID NO: 10700 - RNA, 22 nt, Human
uucccagggaucucuaguauuu

SEQ ID NO: 10701 - RNA, 22 nt, Human
uucccaggugugagugagguga

SEQ ID NO: 10702 - RNA, 22 nt, Human
uuccccaccagagacagagcug

SEQ ID NO: 10703 - RNA, 20 nt, Human
uuccccauaaaaauguucca

SEQ ID NO: 10704 - RNA, 22 nt, Human
uucccccuuuuuuguguugucu

SEQ ID NO: 10705 - RNA, 22 nt, Human
uuccccgagccuggggaagcug

SEQ ID NO: 10706 - RNA, 22 nt, Human
uuccccuuaagagacaguugga

SEQ ID NO: 10707 - RNA, 22 nt, Human
uucccgcugcuggaguuggggc

SEQ ID NO: 10708 - RNA, 22 nt, Human
uucccuauaauauggcucuucu

SEQ ID NO: 10709 - RNA, 22 nt, Human
uucccugggggggccgcuuucc

SEQ ID NO: 10710 - RNA, 22 nt, Human
uucccugugcaguauguuccaa

SEQ ID NO: 10711 - RNA, 22 nt, Human
uuccgcuuucaauggcuuggcu

SEQ ID NO: 10712 - RNA, 22 nt, Human
uuccuaagugcugguaugaggc

SEQ ID NO: 10713 - RNA, 22 nt, Human
uuccuaauugccaugaaguuau

SEQ ID NO: 10714 - RNA, 20 nt, Human
uuccucaaaagucugaugcu

SEQ ID NO: 10715 - RNA, 19 nt, Human
uuccucaggugugaguuag

SEQ ID NO: 10716 - RNA, 22 nt, Human
uuccucauucuggggcauguug

SEQ ID NO: 10717 - RNA, 22 nt, Human
uuccucauuuuguuaauuuuac

SEQ ID NO: 10718 - RNA, 22 nt, Human
uuccucuugaaucugucugacu

SEQ ID NO: 10719 - RNA, 22 nt, Human
uuccugcuggucaaaguugccu

SEQ ID NO: 10720 - RNA, 21 nt, Human
uuccuggaggcagaaacguga

SEQ ID NO: 10721 - RNA, 22 nt, Human
uuccuggaguggagggagguga

SEQ ID NO: 10722 - RNA, 22 nt, Human
uuccuucccccuucuuugccuu

SEQ ID NO: 10723 - RNA, 22 nt, Human
uuccuuuuuaauuaaucuaauu

SEQ ID NO: 10724 - RNA, 22 nt, Human
uucgcggccaggcggggaggcc

SEQ ID NO: 10725 - RNA, 22 nt, Human
uucggcagaaagucauuugucu

SEQ ID NO: 10726 - RNA, 22 nt, Human
uucggugagcugcgggcgagga

SEQ ID NO: 10727 - RNA, 18 nt, Human
uucgucauggggaucgua

SEQ ID NO: 10728 - RNA, 22 nt, Human
uucgucauuaugcagccuguga

SEQ ID NO: 10729 - RNA, 22 nt, Human
uucguucagcgcuugcgcaugc

SEQ ID NO: 10730 - RNA, 20 nt, Human
uucguuucaguguuggauca

SEQ ID NO: 10731 - RNA, 18 nt, Human
uucuaaauucuguuuuua

SEQ ID NO: 10732 - RNA, 22 nt, Human
uucuaauauuaugauuucuaag

SEQ ID NO: 10733 - RNA, 22 nt, Human
uucuacauugugaaguucuuua

SEQ ID NO: 10734 - RNA, 22 nt, Human
uucuacuagugguugauggccu

SEQ ID NO: 10735 - RNA, 22 nt, Human
uucuagacaauugaaaacuguu

SEQ ID NO: 10736 - RNA, 18 nt, Human
uucuagaggucucaucca

SEQ ID NO: 10737 - RNA, 22 nt, Human
uucuagccauagaaauuagauu

SEQ ID NO: 10738 - RNA, 22 nt, Human
uuggaaguggcaaaggcuaaag

SEQ ID NO: 10739 - RNA, 22 nt, Human
uuggaagugucuaauacaggua

SEQ ID NO: 10740 - RNA, 22 nt, Human
uuggaauuugagaccaagaaaa

SEQ ID NO: 10741 - RNA, 19 nt, Human
uuggacuaugaaaaaucag

SEQ ID NO: 10742 - RNA, 22 nt, Human
uuggacugggauggccgaggcu

SEQ ID NO: 10743 - RNA, 22 nt, Human
uuggacuucauuuaccucucuc

SEQ ID NO: 10744 - RNA, 22 nt, Human
uuggagaaagcugcaggcucug

SEQ ID NO: 10745 - RNA, 22 nt, Human
uuggaggaagcucaugggggau

SEQ ID NO: 10746 - RNA, 22 nt, Human
uuggaggccacagucaucuuua

SEQ ID NO: 10747 - RNA, 22 nt, Human
uuggaggucucugugguggugg

SEQ ID NO: 10748 - RNA, 22 nt, Human
uuggauagaauuuaaauugucu

SEQ ID NO: 10749 - RNA, 22 nt, Human
uuggauguccucuguggaguau

SEQ ID NO: 10750 - RNA, 22 nt, Human
uuggauguggggauggaguggg

SEQ ID NO: 10751 - RNA, 22 nt, Human
uuggauugugaaaguauucucu

SEQ ID NO: 10752 - RNA, 22 nt, Human
uuggcaaaaauacuguaggccu

SEQ ID NO: 10753 - RNA, 22 nt, Human
uuggcaaaagauuggguacuua

SEQ ID NO: 10754 - RNA, 22 nt, Human
uuggcacagagcugcagccugg

SEQ ID NO: 10755 - RNA, 22 nt, Human
uuggcaggcugcauguuuaugu

SEQ ID NO: 10756 - RNA, 22 nt, Human
uuggcauuccagaugcuuuucu

SEQ ID NO: 10757 - RNA, 22 nt, Human
uuggccguuucacugggcaguu

SEQ ID NO: 10758 - RNA, 22 nt, Human
uuggccuaggcacaggcaggug

SEQ ID NO: 10759 - RNA, 22 nt, Human
uuggccugcuccagaacaaggg

SEQ ID NO: 10760 - RNA, 22 nt, Human
uuggccuuacgcauggucggca

SEQ ID NO: 10761 - RNA, 22 nt, Human
uuggcguuuccuguucugggug

SEQ ID NO: 10762 - RNA, 21 nt, Human
uuggcuacugcuucagaggga

SEQ ID NO: 10763 - RNA, 22 nt, Human
uuggcuucuugcuaggaagcug

SEQ ID NO: 10764 - RNA, 22 nt, Human
uuggcuuuucaguuuuaaguua

SEQ ID NO: 10765 - RNA, 22 nt, Human
uugggacuguugucuaaaccau

SEQ ID NO: 10766 - RNA, 22 nt, Human
uugggagaaauaguugauccgc

SEQ ID NO: 10767 - RNA, 22 nt, Human
uugggagaggcagcagagucau

SEQ ID NO: 10768 - RNA, 22 nt, Human
uugggaguaauacugaagagag

SEQ ID NO: 10769 - RNA, 22 nt, Human
uugggauucugucagugugugu

SEQ ID NO: 10770 - RNA, 22 nt, Human
uugggauuggugggguggguuu

SEQ ID NO: 10771 - RNA, 22 nt, Human
uugggcuagaaacaacgugggu

SEQ ID NO: 10772 - RNA, 22 nt, Human
uuggggaauuuggggccguccg

SEQ ID NO: 10773 - RNA, 22 nt, Human
uuggggagaagagcuggucagg

SEQ ID NO: 10774 - RNA, 22 nt, Human
uuggggaggaagauagggugaa

SEQ ID NO: 10775 - RNA, 22 nt, Human
uuggggauugggugcaagggac

SEQ ID NO: 10776 - RNA, 22 nt, Human
uugggggccuccuguuccccca

SEQ ID NO: 10777 - RNA, 22 nt, Human
uuggggggucagacuugauaca

SEQ ID NO: 10778 - RNA, 22 nt, Human
uuggguagguccuucacggaua

SEQ ID NO: 10779 - RNA, 22 nt, Human
uugggucaugggaucccagcau

SEQ ID NO: 10780 - RNA, 22 nt, Human
uugggugcugcacccuucaaca

SEQ ID NO: 10781 - RNA, 22 nt, Human
uugguaccaagcaaacuuucug

SEQ ID NO: 10782 - RNA, 22 nt, Human
uuggucaagacugauaucaaga

SEQ ID NO: 10783 - RNA, 22 nt, Human
uuggucagaugugucuccuccu

SEQ ID NO: 10784 - RNA, 19 nt, Human
uuggugaagguucacugac

SEQ ID NO: 10785 - RNA, 22 nt, Human
uuggugaugcuaggaauguagu

SEQ ID NO: 10786 - RNA, 22 nt, Human
uuggugauguagcagcaauugu

SEQ ID NO: 10787 - RNA, 22 nt, Human
uugguguuucacuuccuugucg

SEQ ID NO: 10788 - RNA, 22 nt, Human
aguucucaagguuaggaaaagu

SEQ ID NO: 10789 - RNA, 22 nt, Human
aguucugggaggugcacgucca

SEQ ID NO: 10790 - RNA, 22 nt, Human
aguucuguucccccaguuacau

SEQ ID NO: 10791 - RNA, 22 nt, Human
aguugaggguuaguaaauagcu

SEQ ID NO: 10792 - RNA, 22 nt, Human
aguugcuaauacaaaaaguccc

SEQ ID NO: 10793 - RNA, 22 nt, Human
aguugcuucccuauucuuagca

SEQ ID NO: 10794 - RNA, 22 nt, Human
aguuggaagacacccugaaauc

SEQ ID NO: 10795 - RNA, 22 nt, Human
aguuggcauuuuauuuaaguau

SEQ ID NO: 10796 - RNA, 22 nt, Human
aguugguggaagcuaagcuucu

SEQ ID NO: 10797 - RNA, 22 nt, Human
aguugguguuagaguuuuucag

SEQ ID NO: 10798 - RNA, 21 nt, Human
aguuguacuguauagcagaug

SEQ ID NO: 10799 - RNA, 22 nt, Human
aucauguuauguacaaauauga

SEQ ID NO: 10800 - RNA, 22 nt, Human
aucauuaacagugcagggguag

SEQ ID NO: 10801 - RNA, 22 nt, Human
aucauugcuaguaaggaucuug

SEQ ID NO: 10802 - RNA, 22 nt, Human
aucauuugaacagaauuuguuu

SEQ ID NO: 10803 - RNA, 22 nt, Human
aucauuuggaaauuuggccuaa

SEQ ID NO: 10804 - RNA, 22 nt, Human
aucauuuuuauuagcugggguu

SEQ ID NO: 10805 - RNA, 22 nt, Human
auccacccugcaggccaacucu

SEQ ID NO: 10806 - RNA, 22 nt, Human
auccacggucaauuccccaucc

SEQ ID NO: 10807 - RNA, 22 nt, Human
auccacuagagggugaacucug

SEQ ID NO: 10808 - RNA, 22 nt, Human
auccagaaguauuuuggguacu

SEQ ID NO: 10809 - RNA, 18 nt, Human
auccccagucccuggaau

SEQ ID NO: 10810 - RNA, 22 nt, Human
aucccuggccacgaagcugccc

SEQ ID NO: 10811 - RNA, 22 nt, Human
auccucaaggaauuaaauaggg

SEQ ID NO: 10812 - RNA, 22 nt, Human
auccuccuggggcagucuuccc

SEQ ID NO: 10813 - RNA, 22 nt, Human
auccucucugugacagggaacg

SEQ ID NO: 10814 - RNA, 22 nt, Human
auccucugcucaugagaaaugu

SEQ ID NO: 10815 - RNA, 22 nt, Human
auccugauggaaacugguauga

SEQ ID NO: 10816 - RNA, 22 nt, Human
auccuggcuuuccugauuuacu

SEQ ID NO: 10817 - RNA, 20 nt, Human
auccuggucuuuggaagcuu

SEQ ID NO: 10818 - RNA, 18 nt, Human
auccuucggccuagugga

SEQ ID NO: 10819 - RNA, 23 nt, Human
aucgcccggguccagucccggcu

SEQ ID NO: 10820 - RNA, 22 nt, Human
aucuaauguggcaaguugcuga

SEQ ID NO: 10821 - RNA, 22 nt, Human
aucuacuuugggaguuucucuu

SEQ ID NO: 10822 - RNA, 22 nt, Human
aucuagguuuggaagauagagu

SEQ ID NO: 10823 - RNA, 22 nt, Human
aucuagucccugcccuugaaga

SEQ ID NO: 10824 - RNA, 22 nt, Human
aucuauguaucucagaagcuag

SEQ ID NO: 10825 - RNA, 22 nt, Human
aucucacuucugucauguggca

SEQ ID NO: 10826 - RNA, 21 nt, Human
aucucaguccugggaaugauu

SEQ ID NO: 10827 - RNA, 22 nt, Human
aucuccagcagugcuuuugagc

SEQ ID NO: 10828 - RNA, 22 nt, Human
aucucuguaaaccauaaauuga

SEQ ID NO: 10829 - RNA, 22 nt, Human
aucugcauguggcagguggauu

SEQ ID NO: 10830 - RNA, 22 nt, Human
aucugcugcuccuucuucuugc

SEQ ID NO: 10831 - RNA, 22 nt, Human
aucugcuguaguuggugccagu

SEQ ID NO: 10832 - RNA, 22 nt, Human
aucugggaaggggaaaaugcug

SEQ ID NO: 10833 - RNA, 20 nt, Human
aucugguggggaauaacuuc

SEQ ID NO: 10834 - RNA, 22 nt, Human
aucugucagaccuuggucacag

SEQ ID NO: 10835 - RNA, 20 nt, Human
aucugugaugagaacgguuu

SEQ ID NO: 10836 - RNA, 22 nt, Human
aucugugauuuuggcaagauuu

SEQ ID NO: 10837 - RNA, 22 nt, Human
aucuguggguaaggauaagcau

SEQ ID NO: 10838 - RNA, 21 nt, Human
aucugugucauuagguggcag

SEQ ID NO: 10839 - RNA, 22 nt, Human
aucuuagagagucguguuuugu

SEQ ID NO: 10840 - RNA, 22 nt, Human
aucuuagcucaacucucaccaa

SEQ ID NO: 10841 - RNA, 22 nt, Human
aucuucaggggcaauggagaua

SEQ ID NO: 10842 - RNA, 22 nt, Human
aucuucuauguguaggcauuuu

SEQ ID NO: 10843 - RNA, 22 nt, Human
aucuugaaacauauaugcauuu

SEQ ID NO: 10844 - RNA, 22 nt, Human
aucuuggccuucuccuggagug

SEQ ID NO: 10845 - RNA, 22 nt, Human
aucuuguuagaaggcaguaggu

SEQ ID NO: 10846 - RNA, 22 nt, Human
aucuuugauuuuggcuuuuagg

SEQ ID NO: 10847 - RNA, 22 nt, Human
augaaaacggaccagagcuauu

SEQ ID NO: 10848 - RNA, 22 nt, Human
augaaaacgugugugugugugu

SEQ ID NO: 10849 - RNA, 22 nt, Human
augaaacucuagcuuucagcac

SEQ ID NO: 10850 - RNA, 22 nt, Human
augaaggauagggcaaaauuuu

SEQ ID NO: 10851 - RNA, 22 nt, Human
augaagguggacagauuuuuuu

SEQ ID NO: 10852 - RNA, 22 nt, Human
augaagugcccugggggccaga

SEQ ID NO: 10853 - RNA, 22 nt, Human
augaauuugaacaccagguugg

SEQ ID NO: 10854 - RNA, 22 nt, Human
augaccauccagaaguccagcu

SEQ ID NO: 10855 - RNA, 22 nt, Human
augacuauaaauaggagauugu

SEQ ID NO: 10856 - RNA, 22 nt, Human
augacugaugcugacucauggg

SEQ ID NO: 10857 - RNA, 22 nt, Human
augacuguuaugaggugggugg

SEQ ID NO: 10858 - RNA, 22 nt, Human
augagcuaagcagaaagcacac

SEQ ID NO: 10859 - RNA, 22 nt, Human
augagcucuaaguacaugccca

SEQ ID NO: 10860 - RNA, 22 nt, Human
augaggaacagcaagaauauuu

SEQ ID NO: 10861 - RNA, 22 nt, Human
augaggguggggaaugggccau

SEQ ID NO: 10862 - RNA, 22 nt, Human
augaguaaguucugauuagauu

SEQ ID NO: 10863 - RNA, 18 nt, Human
augauaauguuugcauca

SEQ ID NO: 10864 - RNA, 22 nt, Human
augauaccacucaauagggcau

SEQ ID NO: 10865 - RNA, 22 nt, Human
augaucaagaauuuuguauucc

SEQ ID NO: 10866 - RNA, 22 nt, Human
augaugaugguuuaacuucagg

SEQ ID NO: 10867 - RNA, 22 nt, Human
augauggagaacaaagaaaauc

SEQ ID NO: 10868 - RNA, 22 nt, Human
augauuaagguacgucauuucu

SEQ ID NO: 10869 - RNA, 22 nt, Human
augcaaaaucuuauuuuuucua

SEQ ID NO: 10870 - RNA, 23 nt, Human
augcaacauugccaguaugggca

SEQ ID NO: 10871 - RNA, 22 nt, Human
augcacuaugaugagcuagucu

SEQ ID NO: 10872 - RNA, 22 nt, Human
augcacuccucagcuguucugg

SEQ ID NO: 10873 - RNA, 22 nt, Human
augcacuugacucuauuccaca

SEQ ID NO: 10874 - RNA, 22 nt, Human
augcagagacugugggaaagca

SEQ ID NO: 10875 - RNA, 22 nt, Human
augcaggcuaagaguaaagacg

SEQ ID NO: 10876 - RNA, 22 nt, Human
augcaguuagguaauagucuca

SEQ ID NO: 10877 - RNA, 22 nt, Human
augcauaugugugcaagugugu

SEQ ID NO: 10878 - RNA, 17 nt, Human
augcccagggcucccug

SEQ ID NO: 10879 - RNA, 22 nt, Human
augccccucucucucccaauca

SEQ ID NO: 10880 - RNA, 22 nt, Human
augccccuuuauauguuaaguc

SEQ ID NO: 10881 - RNA, 22 nt, Human
augcccugggagugcuguacca

SEQ ID NO: 10882 - RNA, 22 nt, Human
augccugcugucaggaacucuu

SEQ ID NO: 10883 - RNA, 22 nt, Human
augccugggcuuuaggguucuc

SEQ ID NO: 10884 - RNA, 21 nt, Human
augcgcgguggagugagcgaa

SEQ ID NO: 10885 - RNA, 22 nt, Human
augcggcugugggggaauggga

SEQ ID NO: 10886 - RNA, 22 nt, Human
augcuacuugugaaaacccagg

SEQ ID NO: 10887 - RNA, 22 nt, Human
augcuagaaaauuucauauuau

SEQ ID NO: 10888 - RNA, 22 nt, Human
augcucggcuuucuuucuuucu

SEQ ID NO: 10889 - RNA, 22 nt, Human
augcucuuaauugcuagauaag

SEQ ID NO: 10890 - RNA, 22 nt, Human
augcugacaacaaagaaggaag

SEQ ID NO: 10891 - RNA, 22 nt, Human
augcugcuuguccauuuauuug

SEQ ID NO: 10892 - RNA, 22 nt, Human
augcugugccuggaaagcggcu

SEQ ID NO: 10893 - RNA, 22 nt, Human
augcuucuguugcuuaggaggu

SEQ ID NO: 10894 - RNA, 22 nt, Human
augcuuuauuggagacagucau

SEQ ID NO: 10895 - RNA, 22 nt, Human
augcuuucucuucuauuucuca

SEQ ID NO: 10896 - RNA, 20 nt, Human
auggaaacacgcagccccaa

SEQ ID NO: 10897 - RNA, 22 nt, Human
auggaacauuaaucuucaaaug

SEQ ID NO: 10898 - RNA, 22 nt, Human
auggaacccgggcgucugcucu

SEQ ID NO: 10899 - RNA, 22 nt, Human
auggaagagacaaugcuaucug

SEQ ID NO: 10900 - RNA, 22 nt, Human
auggagcagagcugaugggccu

SEQ ID NO: 10901 - RNA, 22 nt, Human
auggagcgggaggauggaggag

SEQ ID NO: 10902 - RNA, 22 nt, Human
aaagaagugucuuacucccucu

SEQ ID NO: 10903 - RNA, 21 nt, Human
aaagaaguuaguucagugguu

SEQ ID NO: 10904 - RNA, 22 nt, Human
aaagacaauaauucucucuagc

SEQ ID NO: 10905 - RNA, 22 nt, Human
aaagaccaagagccccaaguuu

SEQ ID NO: 10906 - RNA, 23 nt, Human
aaagacuagaagccguggcugca

SEQ ID NO: 10907 - RNA, 22 nt, Human
aaagacucaauuguucccuaau

SEQ ID NO: 10908 - RNA, 22 nt, Human
auggagguuugucugguuuugu

SEQ ID NO: 10909 - RNA, 22 nt, Human
auggaguguggccaggcaguaa

SEQ ID NO: 10910 - RNA, 22 nt, Human
auggauggaagcagccugaacu

SEQ ID NO: 10911 - RNA, 22 nt, Human
auggauuggguugauggcauac

SEQ ID NO: 10912 - RNA, 22 nt, Human
auggcagcggagcuggaaauga

SEQ ID NO: 10913 - RNA, 22 nt, Human
auggccuguuuccucugaaaga

SEQ ID NO: 10914 - RNA, 22 nt, Human
auggccuuucucaguggugcuu

SEQ ID NO: 10915 - RNA, 18 nt, Human
auggcuccagugucuucc

SEQ ID NO: 10916 - RNA, 22 nt, Human
auggcuucugucuuggaaauuu

SEQ ID NO: 10917 - RNA, 22 nt, Human
augggaggguagagugaacaga

SEQ ID NO: 10918 - RNA, 22 nt, Human
augggagugacagggccacugg

SEQ ID NO: 10919 - RNA, 22 nt, Human
augggauuugaaaaguggaaau

SEQ ID NO: 10920 - RNA, 22 nt, Human
augggcauacaaaugcuacccu

SEQ ID NO: 10921 - RNA, 22 nt, Human
augggcauggauggccgagucu

SEQ ID NO: 10922 - RNA, 22 nt, Human
auggggaauugaccguggaucu

SEQ ID NO: 10923 - RNA, 22 nt, Human
auggggaggcggauggagugcu

SEQ ID NO: 10924 - RNA, 22 nt, Human
auggggaucugcaguguugauc

SEQ ID NO: 10925 - RNA, 22 nt, Human
auggggucagagaauggugggu

SEQ ID NO: 10926 - RNA, 22 nt, Human
augggucccuggccgcccucgg

SEQ ID NO: 10927 - RNA, 22 nt, Human
augguaaguuuuuaaaaagcgu

SEQ ID NO: 10928 - RNA, 19 nt, Human
augguauugcuggguuuuu

SEQ ID NO: 10929 - RNA, 22 nt, Human
auggugugugugugugugugug

SEQ ID NO: 10930 - RNA, 22 nt, Human
augguuacgcccucacccuacc

SEQ ID NO: 10931 - RNA, 22 nt, Human
augguuagauggaugagaugug

SEQ ID NO: 10932 - RNA, 22 nt, Human
augguugccugagauaagacug

SEQ ID NO: 10933 - RNA, 22 nt, Human
augguugggggaugucagcagg

SEQ ID NO: 10934 - RNA, 22 nt, Human
augguuuugugaaaaugcuuug

SEQ ID NO: 10935 - RNA, 22 nt, Human
auguaacauaugugaucgcauu

SEQ ID NO: 10936 - RNA, 22 nt, Human
auguaccgccuuggagaaaugc

SEQ ID NO: 10937 - RNA, 22 nt, Human
auguacugacuguacuuuuaaa

SEQ ID NO: 10938 - RNA, 23 nt, Human
auguagcugcucccgaugcccuc

SEQ ID NO: 10939 - RNA, 22 nt, Human
auguaugagagauucuuuuauu

SEQ ID NO: 10940 - RNA, 22 nt, Human
auguauuuauguauguguuaua

SEQ ID NO: 10941 - RNA, 22 nt, Human
auguccugguccacagaaggga

SEQ ID NO: 10942 - RNA, 22 nt, Human
augugaaagagguguucagugg

SEQ ID NO: 10943 - RNA, 22 nt, Human
augugaaauuugggcucuggga

SEQ ID NO: 10944 - RNA, 22 nt, Human
augugagcuggaugaauuuaua

SEQ ID NO: 10945 - RNA, 22 nt, Human
augugauacuccuucuagugga

SEQ ID NO: 10946 - RNA, 22 nt, Human
augugccugagggcuccuugug

SEQ ID NO: 10947 - RNA, 20 nt, Human
augugcuaauauuaauaugu

SEQ ID NO: 10948 - RNA, 22 nt, Human
auguggaaagcuugucuuagag

SEQ ID NO: 10949 - RNA, 22 nt, Human
augugggguaggaggggggaau

SEQ ID NO: 10950 - RNA, 22 nt, Human
augugggugaggaggccauugu

SEQ ID NO: 10951 - RNA, 22 nt, Human
augugucauuauccagaauaac

SEQ ID NO: 10952 - RNA, 22 nt, Human
auguguguaugacugaaucuau

SEQ ID NO: 10953 - RNA, 22 nt, Human
auguguguaugugugcauguau

SEQ ID NO: 10954 - RNA, 22 nt, Human
augugugugcgagcgugugugu

SEQ ID NO: 10955 - RNA, 22 nt, Human
auguguuuccaacagagaggga

SEQ ID NO: 10956 - RNA, 22 nt, Human
auguuccaugacuaugcaugaa

SEQ ID NO: 10957 - RNA, 22 nt, Human
auguucccaaaaucccuguaga

SEQ ID NO: 10958 - RNA, 18 nt, Human
auguuccugcaguuauuu

SEQ ID NO: 10959 - RNA, 22 nt, Human
auguuccuuuaaaauauagauu

SEQ ID NO: 10960 - RNA, 19 nt, Human
auguucugaauuacuguaa

SEQ ID NO: 10961 - RNA, 22 nt, Human
auguugaguggaugaacaaaca

SEQ ID NO: 10962 - RNA, 22 nt, Human
auguuuaaguguuuugccccaa

SEQ ID NO: 10963 - RNA, 22 nt, Human
auguuuaauuugaaauuuuauu

SEQ ID NO: 10964 - RNA, 19 nt, Human
auguuuccauuucuggaua

SEQ ID NO: 10965 - RNA, 22 nt, Human
auguuuucuugucuggagaagu

SEQ ID NO: 10966 - RNA, 22 nt, Human
auuaaaaaaagauaaugaguua

SEQ ID NO: 10967 - RNA, 22 nt, Human
auuaaacuaaauuaugaauugg

SEQ ID NO: 10968 - RNA, 22 nt, Human
auuaaagcaugaauaauaugua

SEQ ID NO: 10969 - RNA, 22 nt, Human
auuaagucugacuggauuguau

SEQ ID NO: 10970 - RNA, 22 nt, Human
auuaaguuauuaagcuaaauau

SEQ ID NO: 10971 - RNA, 22 nt, Human
auuaauaucaauauauuauaug

SEQ ID NO: 10972 - RNA, 22 nt, Human
auuaauguguaugauauaaauu

SEQ ID NO: 10973 - RNA, 22 nt, Human
auuacagauuauaaauuugagc

SEQ ID NO: 10974 - RNA, 22 nt, Human
auuacugaggcaaaguaguuuu

SEQ ID NO: 10975 - RNA, 22 nt, Human
auuagaaaugacaugugggaau

SEQ ID NO: 10976 - RNA, 22 nt, Human
auuagaagagcuuuuuacucuu

SEQ ID NO: 10977 - RNA, 22 nt, Human
auuaguagcacacagagaucag

SEQ ID NO: 10978 - RNA, 22 nt, Human
auuagugguguauuuggcacua

SEQ ID NO: 10979 - RNA, 22 nt, Human
auuauacauuaggagauugauu

SEQ ID NO: 10980 - RNA, 22 nt, Human
auuauaguuuugcccuuaagaa

SEQ ID NO: 10981 - RNA, 23 nt, Human
auuaugaagaagacucgccuguu

SEQ ID NO: 10982 - RNA, 22 nt, Human
auuaugaauuguguuacgaaga

SEQ ID NO: 10983 - RNA, 22 nt, Human
auuaugugagggacuuaaucau

SEQ ID NO: 10984 - RNA, 22 nt, Human
auuauucaaggugaggguaaaa

SEQ ID NO: 10985 - RNA, 23 nt, Human
auuauuucaggguuuugacuugc

SEQ ID NO: 10986 - RNA, 22 nt, Human
auucaagagcccauguuuccug

SEQ ID NO: 10987 - RNA, 22 nt, Human
auucaagauaagggucugggag

SEQ ID NO: 10988 - RNA, 22 nt, Human
auucaagauagaaggauuuuca

SEQ ID NO: 10989 - RNA, 22 nt, Human
auucaggacucuuccuugaaga

SEQ ID NO: 10990 - RNA, 22 nt, Human
auucaguucuaaggucagugcc

SEQ ID NO: 10991 - RNA, 22 nt, Human
auucauauagcgcuuacagccu

SEQ ID NO: 10992 - RNA, 22 nt, Human
auucauuuuuacaucaccaaua

SEQ ID NO: 10993 - RNA, 22 nt, Human
auuccaccccauccucccaggu

SEQ ID NO: 10994 - RNA, 22 nt, Human
auuccauccuggcuuuuuccug

SEQ ID NO: 10995 - RNA, 22 nt, Human
auucccagucccucccaccccu

SEQ ID NO: 10996 - RNA, 22 nt, Human
auucccuuugacgaucccuagg

SEQ ID NO: 10997 - RNA, 22 nt, Human
auuccguuuuaaaaccuuaagc

SEQ ID NO: 10998 - RNA, 22 nt, Human
auucgcggcuugaucugcuugc

SEQ ID NO: 10999 - RNA, 22 nt, Human
auucuaauaagcguuuugucgc

SEQ ID NO: 11000 - RNA, 22 nt, Human
auucuacucuuuaaauaugaaa

SEQ ID NO: 11001 - RNA, 17 nt, Human
auucuaguuggcuuuuu

SEQ ID NO: 11002 - RNA, 22 nt, Human
auucuaugaaugacuguuagau

SEQ ID NO: 11003 - RNA, 22 nt, Human
auucucauguuuuaaaaaaguu

SEQ ID NO: 11004 - RNA, 22 nt, Human
auucucuguacagaagguaccg

SEQ ID NO: 11005 - RNA, 22 nt, Human
auucugagaucucuucuaggcc

SEQ ID NO: 11006 - RNA, 21 nt, Human
auucugaguugucagucuuca

SEQ ID NO: 11007 - RNA, 22 nt, Human
auucugcaauaaucaguccuua

SEQ ID NO: 11008 - RNA, 22 nt, Human
auucuguuuaauacacgaaagg

SEQ ID NO: 11009 - RNA, 22 nt, Human
auucuguuuuaccauuuucuuu

SEQ ID NO: 11010 - RNA, 22 nt, Human
auucuuacaaagcagagucugu

SEQ ID NO: 11011 - RNA, 17 nt, Human
auucuuauacucuguga

SEQ ID NO: 11012 - RNA, 22 nt, Human
auucuucauguugaagcuguca

SEQ ID NO: 11013 - RNA, 19 nt, Human
auucuucucuuccugcugu

SEQ ID NO: 11014 - RNA, 22 nt, Human
auucuuuucucuaaaugaugaa

SEQ ID NO: 11015 - RNA, 22 nt, Human
aacugaaguuuucagauuuugc

SEQ ID NO: 11016 - RNA, 22 nt, Human
aacugagugcuacauugugauu

SEQ ID NO: 11017 - RNA, 22 nt, Human
auugaaauuaauuucugcuuuc

SEQ ID NO: 11018 - RNA, 22 nt, Human
auugacagagguguaguugaga

SEQ ID NO: 11019 - RNA, 22 nt, Human
auugagaugcuuaaaucuucac

SEQ ID NO: 11020 - RNA, 18 nt, Human
auugagcaugacagaccu

SEQ ID NO: 11021 - RNA, 22 nt, Human
auugaguucaccucuuucagaa

SEQ ID NO: 11022 - RNA, 22 nt, Human
auugaugccugaaaaauaugua

SEQ ID NO: 11023 - RNA, 19 nt, Human
auugcaguguaaaacuauu

SEQ ID NO: 11024 - RNA, 22 nt, Human
auugccauaauagagccaugua

SEQ ID NO: 11025 - RNA, 22 nt, Human
auuggaagacgcuggaggcacu

SEQ ID NO: 11026 - RNA, 22 nt, Human
auuggagacauuaagucuaaga

SEQ ID NO: 11027 - RNA, 22 nt, Human
auuggccaguggacagcgccgu

SEQ ID NO: 11028 - RNA, 22 nt, Human
auugguuucuuguggguuaucc

SEQ ID NO: 11029 - RNA, 19 nt, Human
auugguuugcucgggaaug

SEQ ID NO: 11030 - RNA, 22 nt, Human
auuguagucuggacuuuuggga

SEQ ID NO: 11031 - RNA, 22 nt, Human
auuguucuagaauuuuuuuucc

SEQ ID NO: 11032 - RNA, 22 nt, Human
auuuaaaaacugguacaacagg

SEQ ID NO: 11033 - RNA, 22 nt, Human
auuuaaagaguaauacaaucca

SEQ ID NO: 11034 - RNA, 22 nt, Human
auuuaaaggaagugggugauaa

SEQ ID NO: 11035 - RNA, 22 nt, Human
auuuaagacuguggugcaguuu

SEQ ID NO: 11036 - RNA, 22 nt, Human
auuuaaguuacuucucuuuccu

SEQ ID NO: 11037 - RNA, 22 nt, Human
auuuagacaacaagccuucucc

SEQ ID NO: 11038 - RNA, 22 nt, Human
auuucaacagaguuugaaggca

SEQ ID NO: 11039 - RNA, 22 nt, Human
auuucagaguagaucguuauuu

SEQ ID NO: 11040 - RNA, 22 nt, Human
auuucagcagcccauguuugga

SEQ ID NO: 11041 - RNA, 22 nt, Human
auuucauuuuagaaauaagugu

SEQ ID NO: 11042 - RNA, 22 nt, Human
auuuccacaaauuaagauugca

SEQ ID NO: 11043 - RNA, 23 nt, Human
auuuccuaaaagauaaucauuac

SEQ ID NO: 11044 - RNA, 22 nt, Human
auuuccugugaacuuuucugau

SEQ ID NO: 11045 - RNA, 22 nt, Human
auuugaaguauaaguaauugcu

SEQ ID NO: 11046 - RNA, 22 nt, Human
auuugacuugguaagacuuaag

SEQ ID NO: 11047 - RNA, 22 nt, Human
auuugcaucagugagcgaugug

SEQ ID NO: 11048 - RNA, 23 nt, Human
auuugcugaucguagaugacuag

SEQ ID NO: 11049 - RNA, 22 nt, Human
auuuggaaggcguuucucugua

SEQ ID NO: 11050 - RNA, 22 nt, Human
auuuggggacagagugggggua

SEQ ID NO: 11051 - RNA, 22 nt, Human
auuuuagagaaacaaacguagg

SEQ ID NO: 11052 - RNA, 22 nt, Human
auuuucgcaccucgcgaguugc

SEQ ID NO: 11053 - RNA, 22 nt, Human
auuuucuugucucuguuguagg

SEQ ID NO: 11054 - RNA, 22 nt, Human
auuuuggguguuaacaaugaaa

SEQ ID NO: 11055 - RNA, 19 nt, Human
auuuugguucuuuccauuc

SEQ ID NO: 11056 - RNA, 22 nt, Human
auuuuuagagugaaagaauuaa

SEQ ID NO: 11057 - RNA, 22 nt, Human
auuuuuauuugccuaugauaua

SEQ ID NO: 11058 - RNA, 22 nt, Human
auuuuucacauuuugggggaca

SEQ ID NO: 11059 - RNA, 23 nt, Human
auuuuuccacacacagacucagu

SEQ ID NO: 11060 - RNA, 22 nt, Human
auuuuucucucaugugcaacua

SEQ ID NO: 11061 - RNA, 22 nt, Human
auuuuugguuucaccugcacgc

SEQ ID NO: 11062 - RNA, 22 nt, Human
caaaaaauccauagaaagaggu

SEQ ID NO: 11063 - RNA, 22 nt, Human
caaaaauacuugccuguaucug

SEQ ID NO: 11064 - RNA, 22 nt, Human
caaaauuguugaugcugcuuug

SEQ ID NO: 11065 - RNA, 22 nt, Human
caaacauuuguuggaaccccug

SEQ ID NO: 11066 - RNA, 22 nt, Human
caaagaagagauuuacagagcu

SEQ ID NO: 11067 - RNA, 22 nt, Human
caaagagaugcaccauauuucu

SEQ ID NO: 11068 - RNA, 22 nt, Human
caaagaugccaaaaggaagaca

SEQ ID NO: 11069 - RNA, 22 nt, Human
caaagccuggggagaguaagga

SEQ ID NO: 11070 - RNA, 22 nt, Human
caaagcuucaucuguuguuuug

SEQ ID NO: 11071 - RNA, 22 nt, Human
caaaggaauuacauguuucgga

SEQ ID NO: 11072 - RNA, 22 nt, Human
caaaguauuuagcugacucgcu

SEQ ID NO: 11073 - RNA, 22 nt, Human
caaaucuguuaauuucaaguug

SEQ ID NO: 11074 - RNA, 22 nt, Human
caaaugaugcauggcuagugag

SEQ ID NO: 11075 - RNA, 22 nt, Human
caacaagcgcucagagcaaagc

SEQ ID NO: 11076 - RNA, 20 nt, Human
caacacugcccauuguuugc

SEQ ID NO: 11077 - RNA, 17 nt, Human
caaccaggaaaggaggg

SEQ ID NO: 11078 - RNA, 22 nt, Human
caaccaguagcugaguucaaaa

SEQ ID NO: 11079 - RNA, 22 nt, Human
caacguggauucuuccaggggc

SEQ ID NO: 11080 - RNA, 22 nt, Human
caagaaccuagcgaucagguaa

SEQ ID NO: 11081 - RNA, 22 nt, Human
caagaaguugacagccagguga

SEQ ID NO: 11082 - RNA, 19 nt, Human
caagagcaaagucuuauga

SEQ ID NO: 11083 - RNA, 22 nt, Human
caagagcgugugcagggcaagu

SEQ ID NO: 11084 - RNA, 22 nt, Human
caagaugcaagaccagucaggc

SEQ ID NO: 11085 - RNA, 22 nt, Human
caagccacugggagcugcacac

SEQ ID NO: 11086 - RNA, 22 nt, Human
caagcgcgccgcuuccuuccgc

SEQ ID NO: 11087 - RNA, 22 nt, Human
caaggaaaugucagaaaggcaa

SEQ ID NO: 11088 - RNA, 22 nt, Human
caaggaagguugguugaaggua

SEQ ID NO: 11089 - RNA, 22 nt, Human
caaggaguuuggggaccaagga

SEQ ID NO: 11090 - RNA, 22 nt, Human
caaggcuaagcuuuggcuuucu

SEQ ID NO: 11091 - RNA, 22 nt, Human
caagggcagaggcagggccccg

SEQ ID NO: 11092 - RNA, 22 nt, Human
caaggggagcugguauggaugg

SEQ ID NO: 11093 - RNA, 22 nt, Human
caagguuucgaguucccaacca

SEQ ID NO: 11094 - RNA, 22 nt, Human
caagugaguauguauuguguag

SEQ ID NO: 11095 - RNA, 22 nt, Human
caauaauugcuuuccagaguua

SEQ ID NO: 11096 - RNA, 22 nt, Human
caauaguaaucaaugcaguuag

SEQ ID NO: 11097 - RNA, 22 nt, Human
caaugaaaauuuaaguugcagc

SEQ ID NO: 11098 - RNA, 22 nt, Human
caauggaguccucuuccucuuu

SEQ ID NO: 11099 - RNA, 22 nt, Human
caaugggagaugcagaacagcu

SEQ ID NO: 11100 - RNA, 22 nt, Human
caauggguuuucuauagagugc

SEQ ID NO: 11101 - RNA, 22 nt, Human
caauugcuuccuucuguaagua

SEQ ID NO: 11102 - RNA, 22 nt, Human
cacacacacacacacucucaca

SEQ ID NO: 11103 - RNA, 22 nt, Human
cacacaccagaaagccugggac

SEQ ID NO: 11104 - RNA, 22 nt, Human
cacacagguaagccucuuucaa

SEQ ID NO: 11105 - RNA, 22 nt, Human
cacacguuucuacugcugccaa

SEQ ID NO: 11106 - RNA, 22 nt, Human
cacagaggaugcccaagcgauc

SEQ ID NO: 11107 - RNA, 22 nt, Human
cacagcagcaucauuuaucugg

SEQ ID NO: 11108 - RNA, 22 nt, Human
cacagcaggcagaacgugggca

SEQ ID NO: 11109 - RNA, 22 nt, Human
cacagccaagacuuggccccau

SEQ ID NO: 11110 - RNA, 22 nt, Human
cacagcuggggaagcugaggcc

SEQ ID NO: 11111 - RNA, 22 nt, Human
cacagucugagcccagccuugu

SEQ ID NO: 11112 - RNA, 22 nt, Human
cacagugugguauauuucccaa

SEQ ID NO: 11113 - RNA, 22 nt, Human
cacaguuuuaucuuauacugau

SEQ ID NO: 11114 - RNA, 22 nt, Human
cacauaaggacauuauugaaag

SEQ ID NO: 11115 - RNA, 22 nt, Human
cacauaguuuaucuucauuuuc

SEQ ID NO: 11116 - RNA, 22 nt, Human
cacaucucagggcuacaggcag

SEQ ID NO: 11117 - RNA, 17 nt, Human
cacauggagcuuguugc

SEQ ID NO: 11118 - RNA, 22 nt, Human
cacaugugggcacagggcugca

SEQ ID NO: 11119 - RNA, 22 nt, Human
cacauuaagcccaagcauagaa

SEQ ID NO: 11120 - RNA, 22 nt, Human
caccacauguccgaaauucagc

SEQ ID NO: 11121 - RNA, 22 nt, Human
caccacuuggcccugagguccu

SEQ ID NO: 11122 - RNA, 22 nt, Human
caccagcgacugugaccagcaa

SEQ ID NO: 11123 - RNA, 22 nt, Human
caccaucagacuucugggcagg

SEQ ID NO: 11124 - RNA, 23 nt, Human
caccaugacaugccuauagggga

SEQ ID NO: 11125 - RNA, 22 nt, Human
cacccccaggcuccccuucugg

SEQ ID NO: 11126 - RNA, 22 nt, Human
caggguaagagagagugacauu

SEQ ID NO: 11127 - RNA, 22 nt, Human
caggguaccaagcuucgcccuc

SEQ ID NO: 11128 - RNA, 22 nt, Human
caggguugaugaauugucugua

SEQ ID NO: 11129 - RNA, 22 nt, Human
caggguuuuauuuggcuuuaaa

SEQ ID NO: 11130 - RNA, 22 nt, Human
aagugagaugggagucagagga

SEQ ID NO: 11131 - RNA, 22 nt, Human
aagugaggagaccucuucuuca

SEQ ID NO: 11132 - RNA, 22 nt, Human
aagugauuuucccaccaucuac

SEQ ID NO: 11133 - RNA, 22 nt, Human
aagugauuuuccuacuugcuaa

SEQ ID NO: 11134 - RNA, 22 nt, Human
aagugcuggccuacucaaucga

SEQ ID NO: 11135 - RNA, 22 nt, Human
aaguguggguaagcauuucuug

SEQ ID NO: 11136 - RNA, 22 nt, Human
aagugugugagaaggggucgca

SEQ ID NO: 11137 - RNA, 22 nt, Human
aaguuaaaaaagcuggguaaaa

SEQ ID NO: 11138 - RNA, 22 nt, Human
aaguuaauugcuucuaguuaau

SEQ ID NO: 11139 - RNA, 22 nt, Human
aaguuaugauuggcguggacaa

SEQ ID NO: 11140 - RNA, 22 nt, Human
aaguuccacuagugacccagaa

SEQ ID NO: 11141 - RNA, 22 nt, Human
aaguucuuauguucugaugugc

SEQ ID NO: 11142 - RNA, 20 nt, Human
aaguugaaguuacuucaugg

SEQ ID NO: 11143 - RNA, 22 nt, Human
aaguugaaugucuugcugaaug

SEQ ID NO: 11144 - RNA, 22 nt, Human
aaguugacuguuuuacuuaugu

SEQ ID NO: 11145 - RNA, 22 nt, Human
aaguuuaagguagugaugauga

SEQ ID NO: 11146 - RNA, 16 nt, Human
aaguuuuaucuucuca

SEQ ID NO: 11147 - RNA, 21 nt, Human
aaguuuuggcuguacaguugu

SEQ ID NO: 11148 - RNA, 22 nt, Human
aauaaagcuugaaagcagggaa

SEQ ID NO: 11149 - RNA, 22 nt, Human
aauaagacugucauggaguaaa

SEQ ID NO: 11150 - RNA, 22 nt, Human
aauaaggacaugaaggguccug

SEQ ID NO: 11151 - RNA, 22 nt, Human
aauaaugguuugauucucacau

SEQ ID NO: 11152 - RNA, 22 nt, Human
aauacaaucagauuaugguagu

SEQ ID NO: 11153 - RNA, 22 nt, Human
aauagagacaguuuaacaauau

SEQ ID NO: 11154 - RNA, 22 nt, Human
aauagcaauuacccuucaacuc

SEQ ID NO: 11155 - RNA, 22 nt, Human
aauaggaaggaaauguuuaccu

SEQ ID NO: 11156 - RNA, 22 nt, Human
aauauauaugggugcaugucug

SEQ ID NO: 11157 - RNA, 22 nt, Human
aauaucuugaguuauaaauuca

SEQ ID NO: 11158 - RNA, 22 nt, Human
aauaugaugccaaauugcuaca

SEQ ID NO: 11159 - RNA, 22 nt, Human
aauaugcaaagcguguuaucug

SEQ ID NO: 11160 - RNA, 22 nt, Human
aauauuuaaauagaauuacauc

SEQ ID NO: 11161 - RNA, 22 nt, Human
aauauuuugggacugaggaauu

SEQ ID NO: 11162 - RNA, 22 nt, Human
aaucaagcugcuguuuguucua

SEQ ID NO: 11163 - RNA, 23 nt, Human
aaucacuggauuugagcaugagg

SEQ ID NO: 11164 - RNA, 22 nt, Human
aaucacuuagaacccaggaagu

SEQ ID NO: 11165 - RNA, 22 nt, Human
aaucacuucuuugucuucuuca

SEQ ID NO: 11166 - RNA, 22 nt, Human
aaucaugagguguuucuuugca

SEQ ID NO: 11167 - RNA, 22 nt, Human
aaucaugguacaaguaagcacg

SEQ ID NO: 11168 - RNA, 22 nt, Human
aaucauguguaaugggcagacc

SEQ ID NO: 11169 - RNA, 22 nt, Human
aauccaaacaggauuaccuauc

SEQ ID NO: 11170 - RNA, 22 nt, Human
aaucccaguccuccugggggau

SEQ ID NO: 11171 - RNA, 22 nt, Human
aaucgguugaacccaggaagug

SEQ ID NO: 11172 - RNA, 22 nt, Human
aaucucuugggaagagugagug

SEQ ID NO: 11173 - RNA, 22 nt, Human
aaucugacaaaauauuuccagu

SEQ ID NO: 11174 - RNA, 22 nt, Human
aaucugaccguggagaucucca

SEQ ID NO: 11175 - RNA, 22 nt, Human
aaucugugaggaauaaugaguu

SEQ ID NO: 11176 - RNA, 22 nt, Human
aaucugugugugagaaauggca

SEQ ID NO: 11177 - RNA, 22 nt, Human
aaucuguugucaggaauccaca

SEQ ID NO: 11178 - RNA, 22 nt, Human
aaucuugggacagggacacuau

SEQ ID NO: 11179 - RNA, 22 nt, Human
aaugaaacuaguagaaucuuug

SEQ ID NO: 11180 - RNA, 22 nt, Human
aaugaacuuugaagauggugaa

SEQ ID NO: 11181 - RNA, 22 nt, Human
aaugagaauguaagugaagaga

SEQ ID NO: 11182 - RNA, 22 nt, Human
aaugagauaagaaaaccuuugc

SEQ ID NO: 11183 - RNA, 22 nt, Human
aaugaguucaucugaauucugg

SEQ ID NO: 11184 - RNA, 22 nt, Human
aaugccuucauuggcgaagugc

SEQ ID NO: 11185 - RNA, 22 nt, Human
aaugcuaaagaagaaggaguag

SEQ ID NO: 11186 - RNA, 22 nt, Human
aaugcugugauuuauuaaguau

SEQ ID NO: 11187 - RNA, 22 nt, Human
aaugcugugggauagggcuccu

SEQ ID NO: 11188 - RNA, 22 nt, Human
aaugcuuuuugcgaaaugugca

SEQ ID NO: 11189 - RNA, 22 nt, Human
aauggaaaggagccugacuaua

SEQ ID NO: 11190 - RNA, 22 nt, Human
aauggacuucucugagccuguu

SEQ ID NO: 11191 - RNA, 22 nt, Human
aauggauaacaccgguucuguc

SEQ ID NO: 11192 - RNA, 22 nt, Human
aauggaugauuaaauggaugaa

SEQ ID NO: 11193 - RNA, 22 nt, Human
aauggcaagccacaugcuuuuc

SEQ ID NO: 11194 - RNA, 22 nt, Human
aauggcaauagugcauuaugua

SEQ ID NO: 11195 - RNA, 22 nt, Human
aaugggauuaagaaagaucuug

SEQ ID NO: 11196 - RNA, 23 nt, Human
aaugggcggaaguguuaaguugc

SEQ ID NO: 11197 - RNA, 22 nt, Human
aaugguagaguauuuuaauccu

SEQ ID NO: 11198 - RNA, 22 nt, Human
aaugguccagaaucuuuuggac

SEQ ID NO: 11199 - RNA, 22 nt, Human
aauguaaauaauuguaaaauuu

SEQ ID NO: 11200 - RNA, 22 nt, Human
aauguacucgaaugauguuaag

SEQ ID NO: 11201 - RNA, 22 nt, Human
aauguacucuguguuucucaug

SEQ ID NO: 11202 - RNA, 22 nt, Human
aauguaguuuacugugagugca

SEQ ID NO: 11203 - RNA, 22 nt, Human
aauguauuuuuaggcagaauau

SEQ ID NO: 11204 - RNA, 22 nt, Human
aaugugcauaacuuuauaaauu

SEQ ID NO: 11205 - RNA, 22 nt, Human
aauguggaguugguuuccuucc

SEQ ID NO: 11206 - RNA, 22 nt, Human
aaugugugggagaacagucuuu

SEQ ID NO: 11207 - RNA, 22 nt, Human
aauguuaguauuuaagagcuug

SEQ ID NO: 11208 - RNA, 23 nt, Human
aauguugaggguggguuuuuaac

SEQ ID NO: 11209 - RNA, 22 nt, Human
aauguuguaaauauucuuugag

SEQ ID NO: 11210 - RNA, 22 nt, Human
aauguuuaacuguggucagcag

SEQ ID NO: 11211 - RNA, 22 nt, Human
aauguuuaguuuuauuuuagua

SEQ ID NO: 11212 - RNA, 22 nt, Human
aauguuugaacuuugcauauuu

SEQ ID NO: 11213 - RNA, 22 nt, Human
aauguuuuucaaguguggagca

SEQ ID NO: 11214 - RNA, 22 nt, Human
aauuaaggccuuuaaaugucuu

SEQ ID NO: 11215 - RNA, 22 nt, Human
aauuagaagcuguuagcaaaau

SEQ ID NO: 11216 - RNA, 22 nt, Human
aauuauguugaaauaugagaac

SEQ ID NO: 11217 - RNA, 22 nt, Human
aauuauuaucauuaucuuccug

SEQ ID NO: 11218 - RNA, 22 nt, Human
aauuauuauguggaagacgacg

SEQ ID NO: 11219 - RNA, 22 nt, Human
aauuauucuugccuagguuuaa

SEQ ID NO: 11220 - RNA, 21 nt, Human
aauuauuugcauuuuucuugu

SEQ ID NO: 11221 - RNA, 22 nt, Human
aauucaggacaaauguuuucaa

SEQ ID NO: 11222 - RNA, 22 nt, Human
aauucagguuauauuugcaacu

SEQ ID NO: 11223 - RNA, 22 nt, Human
aauucgcugcauuccaucuagg

SEQ ID NO: 11224 - RNA, 22 nt, Human
aauugauauuagauuugucuca

SEQ ID NO: 11225 - RNA, 22 nt, Human
aauugccaagaauuagugauac

SEQ ID NO: 11226 - RNA, 22 nt, Human
aauuggagaguugugaaaggau

SEQ ID NO: 11227 - RNA, 22 nt, Human
aauugguuugaauaaauaaaga

SEQ ID NO: 11228 - RNA, 22 nt, Human
aauuguuagaaaugacuguuuu

SEQ ID NO: 11229 - RNA, 22 nt, Human
aauuuaaguuauugcuaaugug

SEQ ID NO: 11230 - RNA, 20 nt, Human
aauuuagaguuuuaccaagg

SEQ ID NO: 11231 - RNA, 22 nt, Human
aauuucuccuuuucaguuagau

SEQ ID NO: 11232 - RNA, 22 nt, Human
aauuucuuucagcugcuuuaag

SEQ ID NO: 11233 - RNA, 22 nt, Human
aauuugcuccaaugucaguucu

SEQ ID NO: 11234 - RNA, 22 nt, Human
aauuuuauuuuuuccccuagau

SEQ ID NO: 11235 - RNA, 22 nt, Human
cauuuucugcaagucugcucaa

SEQ ID NO: 11236 - RNA, 22 nt, Human
cauuuugguccucauguguagc

SEQ ID NO: 11237 - RNA, 22 nt, Human
ccaaaauauuagugcuuaagua

SEQ ID NO: 11238 - RNA, 22 nt, Human
ccaaagaauuuggaaaaucuga

SEQ ID NO: 11239 - RNA, 22 nt, Human
ccaaaguauuaaaucuuagcaa

SEQ ID NO: 11240 - RNA, 22 nt, Human
ccaaauuaccuucuuggauuca

SEQ ID NO: 11241 - RNA, 19 nt, Human
ccaacaguacugaagcacu

SEQ ID NO: 11242 - RNA, 22 nt, Human
ccaaccaguuucuuggcuuuag

SEQ ID NO: 11243 - RNA, 22 nt, Human
acaacuuuaauggguuucagcu

SEQ ID NO: 11244 - RNA, 22 nt, Human
acaaggaagaaaacauuacuuu

SEQ ID NO: 11245 - RNA, 22 nt, Human
acaagguugauucuggcaucug

SEQ ID NO: 11246 - RNA, 23 nt, Human
acaaguguuuccaauauggcugg

SEQ ID NO: 11247 - RNA, 22 nt, Human
acaaguuucauuguuuagaacc

SEQ ID NO: 11248 - RNA, 22 nt, Human
acaauaauguuuuuagguuauu

SEQ ID NO: 11249 - RNA, 22 nt, Human
acaaucagcacugaguuuaucu

SEQ ID NO: 11250 - RNA, 22 nt, Human
acaaucauuuuuccccuucagu

SEQ ID NO: 11251 - RNA, 22 nt, Human
acaaucuuauuaguaguauaga

SEQ ID NO: 11252 - RNA, 21 nt, Human
acaaugaguuugaggcaucag

SEQ ID NO: 11253 - RNA, 22 nt, Human
acacaacuuuauuaauuuauac

SEQ ID NO: 11254 - RNA, 22 nt, Human
acacacagaaggaagccccacu

SEQ ID NO: 11255 - RNA, 22 nt, Human
acacacaugccuuuccuaagua

SEQ ID NO: 11256 - RNA, 20 nt, Human
acacaccugcucagacugag

SEQ ID NO: 11257 - RNA, 21 nt, Human
acacagcuggagcaucccggu

SEQ ID NO: 11258 - RNA, 22 nt, Human
acacagugaccuacauuccaaa

SEQ ID NO: 11259 - RNA, 22 nt, Human
acacgcacaccugugcacucgu

SEQ ID NO: 11260 - RNA, 22 nt, Human
acacgguggccagcaguaggug

SEQ ID NO: 11261 - RNA, 22 nt, Human
acacgugcaggagaauguagug

SEQ ID NO: 11262 - RNA, 22 nt, Human
acacuagcgcaaauacgcccau

SEQ ID NO: 11263 - RNA, 22 nt, Human
acacucagaaaggcagagguuc

SEQ ID NO: 11264 - RNA, 22 nt, Human
acacugguucucuuaacccuau

SEQ ID NO: 11265 - RNA, 22 nt, Human
acacuuacugcauuuuucuaua

SEQ ID NO: 11266 - RNA, 21 nt, Human
acagaaguggcuuggucucag

SEQ ID NO: 11267 - RNA, 22 nt, Human
acagaauugggguucuugggga

SEQ ID NO: 11268 - RNA, 22 nt, Human
acagacuuuuagacuuaugagu

SEQ ID NO: 11269 - RNA, 23 nt, Human
acagaggcaucagagcagcaggc

SEQ ID NO: 11270 - RNA, 22 nt, Human
acagaucuauauuauauauaca

SEQ ID NO: 11271 - RNA, 22 nt, Human
acagaucugcacagugaacaau

SEQ ID NO: 11272 - RNA, 23 nt, Human
acagcaagaggaccagaugugag

SEQ ID NO: 11273 - RNA, 22 nt, Human
acagcaauccuggcagaggguu

SEQ ID NO: 11274 - RNA, 22 nt, Human
acagcauagaggaaauguggaa

SEQ ID NO: 11275 - RNA, 22 nt, Human
acagccaacgucuuucuuacuu

SEQ ID NO: 11276 - RNA, 22 nt, Human
acagccacuaugacagauuuag

SEQ ID NO: 11277 - RNA, 19 nt, Human
acagccuguugguggggcu

SEQ ID NO: 11278 - RNA, 22 nt, Human
acagcuauuuaaaggcuuuagg

SEQ ID NO: 11279 - RNA, 22 nt, Human
acagcuggaggucugugagcac

SEQ ID NO: 11280 - RNA, 22 nt, Human
acaggaaaugaaaugguaucua

SEQ ID NO: 11281 - RNA, 19 nt, Human
acaggaaggaaaauuucaa

SEQ ID NO: 11282 - RNA, 22 nt, Human
acaggaaugaagaugagagagu

SEQ ID NO: 11283 - RNA, 22 nt, Human
acaggacgugugugcgcaugug

SEQ ID NO: 11284 - RNA, 22 nt, Human
acaggauuuucagggaagguga

SEQ ID NO: 11285 - RNA, 22 nt, Human
acaggcgucgccugcucuugcc

SEQ ID NO: 11286 - RNA, 22 nt, Human
acaggcugcccgcuccccaccu

SEQ ID NO: 11287 - RNA, 22 nt, Human
acaggggauaggcaggaaggca

SEQ ID NO: 11288 - RNA, 22 nt, Human
acaggguaagggagggugagug

SEQ ID NO: 11289 - RNA, 22 nt, Human
acagguauuaugaagccuauuu

SEQ ID NO: 11290 - RNA, 22 nt, Human
acagguuggagguguggaguca

SEQ ID NO: 11291 - RNA, 21 nt, Human
acaguacuugagaucuuuuga

SEQ ID NO: 11292 - RNA, 22 nt, Human
acagucucucaagcauauccug

SEQ ID NO: 11293 - RNA, 22 nt, Human
acagugugcaagaaauggggga

SEQ ID NO: 11294 - RNA, 22 nt, Human
acaguguuacuugauaguguau

SEQ ID NO: 11295 - RNA, 19 nt, Human
acaguucuguggccuguuc

SEQ ID NO: 11296 - RNA, 22 nt, Human
acaguuuuccuugguauagaac

SEQ ID NO: 11297 - RNA, 22 nt, Human
acauaaacaugcagccugccaa

SEQ ID NO: 11298 - RNA, 22 nt, Human
acauagcuuaaaugagaagaua

SEQ ID NO: 11299 - RNA, 20 nt, Human
acauccacugagugggauga

SEQ ID NO: 11300 - RNA, 22 nt, Human
acaucucacuucuuugaaggcu

SEQ ID NO: 11301 - RNA, 22 nt, Human
acaucuucuauggagguucgga

SEQ ID NO: 11302 - RNA, 22 nt, Human
acaugaguuacuuccgauuccc

SEQ ID NO: 11303 - RNA, 22 nt, Human
acaugcacagcaagggugagag

SEQ ID NO: 11304 - RNA, 22 nt, Human
acaugcuucauauuauaaccaa

SEQ ID NO: 11305 - RNA, 22 nt, Human
acaugcuuucuagguccuucug

SEQ ID NO: 11306 - RNA, 22 nt, Human
acauggaccucagauccuggcc

SEQ ID NO: 11307 - RNA, 16 nt, Human
acauggcacacaguuu

SEQ ID NO: 11308 - RNA, 22 nt, Human
acaugggcaaucgcuuuauuca

SEQ ID NO: 11309 - RNA, 22 nt, Human
acauggggaaaaaggccugcuc

SEQ ID NO: 11310 - RNA, 22 nt, Human
acaugggggugggacggcagag

SEQ ID NO: 11311 - RNA, 22 nt, Human
acaugguguggcacuaggggcu

SEQ ID NO: 11312 - RNA, 21 nt, Human
acauguacacauguaugcaca

SEQ ID NO: 11313 - RNA, 22 nt, Human
acauguggaggaggcgagggua

SEQ ID NO: 11314 - RNA, 22 nt, Human
acaugugugucugugugugugu

SEQ ID NO: 11315 - RNA, 22 nt, Human
acauguuuacaaaccucaagcc

SEQ ID NO: 11316 - RNA, 22 nt, Human
acauugcagcuccuaccuuguc

SEQ ID NO: 11317 - RNA, 22 nt, Human
acauugguauuaguguggcuga

SEQ ID NO: 11318 - RNA, 22 nt, Human
acauuguuauuccucaggaguu

SEQ ID NO: 11319 - RNA, 22 nt, Human
acauuucuccuacuuguuauuu

SEQ ID NO: 11320 - RNA, 22 nt, Human
acauuuuaaaaacaguaccugg

SEQ ID NO: 11321 - RNA, 22 nt, Human
acauuuuaccaucuguggauga

SEQ ID NO: 11322 - RNA, 22 nt, Human
acauuuugggagaaaguuguua

SEQ ID NO: 11323 - RNA, 22 nt, Human
acauuuuuggguugaugucuga

SEQ ID NO: 11324 - RNA, 19 nt, Human
accaaacaguggacggagc

SEQ ID NO: 11325 - RNA, 22 nt, Human
accaagaguccaagugagguug

SEQ ID NO: 11326 - RNA, 22 nt, Human
accaauaaaagcaauucacagu

SEQ ID NO: 11327 - RNA, 22 nt, Human
accaauguuuuauagaaaugcc

SEQ ID NO: 11328 - RNA, 22 nt, Human
accaccacauaguaggcacuua

SEQ ID NO: 11329 - RNA, 20 nt, Human
accagacagcuguuggggug

SEQ ID NO: 11330 - RNA, 22 nt, Human
accagccacccugccgcguccg

SEQ ID NO: 11331 - RNA, 17 nt, Human
accaggggcagcacugc

SEQ ID NO: 11332 - RNA, 22 nt, Human
accaggguacuucuaggugggg

SEQ ID NO: 11333 - RNA, 22 nt, Human
accaguucuauguagauaauga

SEQ ID NO: 11334 - RNA, 22 nt, Human
accauaguuauaacaaaguguu

SEQ ID NO: 11335 - RNA, 22 nt, Human
accauaugaaguugcccauauu

SEQ ID NO: 11336 - RNA, 22 nt, Human
accauccaaaagcuuuucauca

SEQ ID NO: 11337 - RNA, 22 nt, Human
accaugacugucacauuauuau

SEQ ID NO: 11338 - RNA, 19 nt, Human
accauggguguguuaagaa

SEQ ID NO: 11339 - RNA, 20 nt, Human
acccaaagcucagcgugucc

SEQ ID NO: 11340 - RNA, 21 nt, Human
acccagaauggagccaagccu

SEQ ID NO: 11341 - RNA, 22 nt, Human
acccagauauccaggccucugc

SEQ ID NO: 11342 - RNA, 19 nt, Human
acccaugcucuguggacuu

SEQ ID NO: 11343 - RNA, 22 nt, Human
accccacucccuuucuuuugcu

SEQ ID NO: 11344 - RNA, 22 nt, Human
ccccauuugaagauugggggua

SEQ ID NO: 11345 - RNA, 22 nt, Human
cccccauccccugaaggagcug

SEQ ID NO: 11346 - RNA, 22 nt, Human
ccccccaaauguuacagugacc

SEQ ID NO: 11347 - RNA, 22 nt, Human
cccccucugcugaugcccccau

SEQ ID NO: 11348 - RNA, 22 nt, Human
cccccucuuccccucauugcuu

SEQ ID NO: 11349 - RNA, 18 nt, Human
ccccucuuccagacagag

SEQ ID NO: 11350 - RNA, 23 nt, Human
ccccugcauggcaccacauuccc

SEQ ID NO: 11351 - RNA, 22 nt, Human
ccccugcucagggaggagaccg

SEQ ID NO: 11352 - RNA, 21 nt, Human
ccccuguggagcacauguggc

SEQ ID NO: 11353 - RNA, 22 nt, Human
ccccuuguuuuauucaaauugg

SEQ ID NO: 11354 - RNA, 22 nt, Human
ccccuuucucccgcgucuggcc

SEQ ID NO: 11355 - RNA, 19 nt, Human
cccgauggagacuuagcag

SEQ ID NO: 11356 - RNA, 22 nt, Human
cccgccggccacaccggccgcc

SEQ ID NO: 11357 - RNA, 22 nt, Human
cccgcuaaaucaguucugaguc

SEQ ID NO: 11358 - RNA, 22 nt, Human
accgaauucuauucccaauacc

SEQ ID NO: 11359 - RNA, 22 nt, Human
accgauguggaaaauuucauuu

SEQ ID NO: 11360 - RNA, 22 nt, Human
accgauuucaaauggugcuaga

SEQ ID NO: 11361 - RNA, 23 nt, Human
accgccgcugccgccgcccccgc

SEQ ID NO: 11362 - RNA, 22 nt, Human
accgguucccaucuggagaguu

SEQ ID NO: 11363 - RNA, 22 nt, Human
accgucagguuagaaugagcac

SEQ ID NO: 11364 - RNA, 22 nt, Human
accuagcacggugagguaggcc

SEQ ID NO: 11365 - RNA, 22 nt, Human
accuaucugcuggauuuguugu

SEQ ID NO: 11366 - RNA, 22 nt, Human
accuauuguccagagccaggcc

SEQ ID NO: 11367 - RNA, 22 nt, Human
accuauuuauacaacugcacca

SEQ ID NO: 11368 - RNA, 22 nt, Human
accucagauuguggcuccgcug

SEQ ID NO: 11369 - RNA, 22 nt, Human
accucaguucaagggaguuuca

SEQ ID NO: 11370 - RNA, 22 nt, Human
accucccgacggcgcgggagaa

SEQ ID NO: 11371 - RNA, 22 nt, Human
accuccuaccuaacuuuugcuu

SEQ ID NO: 11372 - RNA, 23 nt, Human
accuccuuguugaguggggguga

SEQ ID NO: 11373 - RNA, 22 nt, Human
accucuuuuugaauauagcauu

SEQ ID NO: 11374 - RNA, 22 nt, Human
accugaucugagaaguggaggg

SEQ ID NO: 11375 - RNA, 22 nt, Human
accugauuuuauggauuuugag

SEQ ID NO: 11376 - RNA, 22 nt, Human
accuggaccugccaccuaugag

SEQ ID NO: 11377 - RNA, 22 nt, Human
accuggauauuuucaguugcau

SEQ ID NO: 11378 - RNA, 21 nt, Human
accugguuuacugaucccagg

SEQ ID NO: 11379 - RNA, 22 nt, Human
accugguuucuuacccaagaga

SEQ ID NO: 11380 - RNA, 22 nt, Human
accuuaagugauuaugacauau

SEQ ID NO: 11381 - RNA, 22 nt, Human
accuuagugauuuaaaaucaga

SEQ ID NO: 11382 - RNA, 22 nt, Human
accuugauggagugaugaauga

SEQ ID NO: 11383 - RNA, 22 nt, Human
accuuggauauucuuacucggu

SEQ ID NO: 11384 - RNA, 22 nt, Human
accuugggcccagaccggcacg

SEQ ID NO: 11385 - RNA, 22 nt, Human
accuuguuguagguacaaaaga

SEQ ID NO: 11386 - RNA, 20 nt, Human
acgaacauauugcaggguuu

SEQ ID NO: 11387 - RNA, 22 nt, Human
acgaagggggcauggugagagu

SEQ ID NO: 11388 - RNA, 22 nt, Human
acgaaugacaugugauuugaaa

SEQ ID NO: 11389 - RNA, 22 nt, Human
acgagguaaucaauuggucuug

SEQ ID NO: 11390 - RNA, 22 nt, Human
acgauacaaucauauaguaccu

SEQ ID NO: 11391 - RNA, 22 nt, Human
acgauuugguucagugaagaca

SEQ ID NO: 11392 - RNA, 23 nt, Human
acgcagacacauguaugggccuc

SEQ ID NO: 11393 - RNA, 22 nt, Human
acgcauguacuuguaugcaaug

SEQ ID NO: 11394 - RNA, 20 nt, Human
acgcauguauaugcaucacc

SEQ ID NO: 11395 - RNA, 22 nt, Human
acgccaggagcuucuccguuca

SEQ ID NO: 11396 - RNA, 22 nt, Human
acgccugccuguacuugugggg

SEQ ID NO: 11397 - RNA, 22 nt, Human
acgccuugagccuugccugaau

SEQ ID NO: 11398 - RNA, 22 nt, Human
acgcugagcucauggagaugca

SEQ ID NO: 11399 - RNA, 22 nt, Human
acgcuucacaggugcgcauugu

SEQ ID NO: 11400 - RNA, 22 nt, Human
acggccgaugacuccagcaugg

SEQ ID NO: 11401 - RNA, 22 nt, Human
acggcggguuccgggccagccc

SEQ ID NO: 11402 - RNA, 22 nt, Human
acggcuugaacgcgccuguggg

SEQ ID NO: 11403 - RNA, 23 nt, Human
acgggaggcggggcagggcugag

SEQ ID NO: 11404 - RNA, 22 nt, Human
acgggaggcguggucuuguagu

SEQ ID NO: 11405 - RNA, 22 nt, Human
acggggagcgucggccucuccc

SEQ ID NO: 11406 - RNA, 22 nt, Human
acgggugugauuccuuuugugu

SEQ ID NO: 11407 - RNA, 22 nt, Human
acggguuccuugagggcaggau

SEQ ID NO: 11408 - RNA, 22 nt, Human
acggugagacuggcgaaggaaa

SEQ ID NO: 11409 - RNA, 22 nt, Human
acgguguuucucguucaggguu

SEQ ID NO: 11410 - RNA, 22 nt, Human
acgguuuggggaggaggauccc

SEQ ID NO: 11411 - RNA, 22 nt, Human
acgguuuugugagguaguacuu

SEQ ID NO: 11412 - RNA, 22 nt, Human
acguccaccccguaccagauca

SEQ ID NO: 11413 - RNA, 22 nt, Human
acgucuacaugcaauucuuaua

SEQ ID NO: 11414 - RNA, 22 nt, Human
acgugaccuuauuugaaaaaug

SEQ ID NO: 11415 - RNA, 22 nt, Human
acgugcauuacucaaaucucaa

SEQ ID NO: 11416 - RNA, 22 nt, Human
acgugugugugcacguguguau

SEQ ID NO: 11417 - RNA, 22 nt, Human
acguuauagaugcuucaugaaa

SEQ ID NO: 11418 - RNA, 22 nt, Human
acguugaaaugggcauuuuccg

SEQ ID NO: 11419 - RNA, 22 nt, Human
acuaaagcagcucagacgagaa

SEQ ID NO: 11420 - RNA, 22 nt, Human
acuaagucugcaaaaguacuga

SEQ ID NO: 11421 - RNA, 22 nt, Human
acuaauuuacagaaauuucuua

SEQ ID NO: 11422 - RNA, 22 nt, Human
acuacucagcaaacauuugcug

SEQ ID NO: 11423 - RNA, 22 nt, Human
acuacuguaauuuauuguuaca

SEQ ID NO: 11424 - RNA, 22 nt, Human
acuagcacgccuuaccguaaga

SEQ ID NO: 11425 - RNA, 22 nt, Human
acuaucaacagcaucagggugu

SEQ ID NO: 11426 - RNA, 22 nt, Human
acuaucuauugucuucuucaug

SEQ ID NO: 11427 - RNA, 22 nt, Human
acuauggaguucagaucuugag

SEQ ID NO: 11428 - RNA, 22 nt, Human
acuaugugucuguaucuggugc

SEQ ID NO: 11429 - RNA, 22 nt, Human
acuauugcuuuagggggaaacc

SEQ ID NO: 11430 - RNA, 22 nt, Human
acuauuguccgauuucuuuacu

SEQ ID NO: 11431 - RNA, 22 nt, Human
acucaaacuuuuuguggacauu

SEQ ID NO: 11432 - RNA, 22 nt, Human
acucagaguuugcguuccauac

SEQ ID NO: 11433 - RNA, 22 nt, Human
acucagcaccuagaaagugugc

SEQ ID NO: 11434 - RNA, 22 nt, Human
acucaguaacuguuugcugaau

SEQ ID NO: 11435 - RNA, 22 nt, Human
acucagucauuuggggaacagu

SEQ ID NO: 11436 - RNA, 22 nt, Human
acucaguuuugaucguucuuau

SEQ ID NO: 11437 - RNA, 22 nt, Human
acucaucauuuuacggagcagc

SEQ ID NO: 11438 - RNA, 21 nt, Human
acucaucuuuuuggagaccag

SEQ ID NO: 11439 - RNA, 22 nt, Human
acuccuauuugguagauggaag

SEQ ID NO: 11440 - RNA, 22 nt, Human
acuccuuuuaugugugcuaaaa

SEQ ID NO: 11441 - RNA, 22 nt, Human
acucggcggccucgagugcugg

SEQ ID NO: 11442 - RNA, 22 nt, Human
acucgggggccgcugcagggag

SEQ ID NO: 11443 - RNA, 22 nt, Human
acucugagaugugucuugauuc

SEQ ID NO: 11444 - RNA, 22 nt, Human
acucugaggauuucaguuuuac

SEQ ID NO: 11445 - RNA, 22 nt, Human
acucuguaauucugaagcaccu

SEQ ID NO: 11446 - RNA, 22 nt, Human
acugaaauggggacaguccuua

SEQ ID NO: 11447 - RNA, 22 nt, Human
acugaauguucucaaaggggag

SEQ ID NO: 11448 - RNA, 22 nt, Human
acugagaacuuggggacagagg

SEQ ID NO: 11449 - RNA, 18 nt, Human
acugagcccaggacacac

SEQ ID NO: 11450 - RNA, 22 nt, Human
acugcguuucuaaaguagcaua

SEQ ID NO: 11451 - RNA, 22 nt, Human
acugcucugugguuggaagccu

SEQ ID NO: 11452 - RNA, 22 nt, Human
acugcugauuauugaaguagag

SEQ ID NO: 11453 - RNA, 22 nt, Human
acugcuguugugauggguauuu

SEQ ID NO: 11454 - RNA, 22 nt, Human
acuggagcccguggaggcgcag

SEQ ID NO: 11455 - RNA, 22 nt, Human
acuggauucucuuacacagaug

SEQ ID NO: 11456 - RNA, 22 nt, Human
acuggauuuugugguguaucuu

SEQ ID NO: 11457 - RNA, 22 nt, Human
acuggcauuccuaggggagggg

SEQ ID NO: 11458 - RNA, 22 nt, Human
acuggcuuauuguuguggagcu

SEQ ID NO: 11459 - RNA, 15 nt, Human
acugggaaggaguau

SEQ ID NO: 11460 - RNA, 22 nt, Human
acugggacuguaugugcuggac

SEQ ID NO: 11461 - RNA, 21 nt, Human
acugggcuagccugacuucug

SEQ ID NO: 11462 - RNA, 22 nt, Human
acuggggaggucuggauggauc

SEQ ID NO: 11463 - RNA, 22 nt, Human
acuggggauugguucuucaaca

SEQ ID NO: 11464 - RNA, 22 nt, Human
acuggugcucuggccaccgcug

SEQ ID NO: 11465 - RNA, 22 nt, Human
acugguuucaaguuggacugaa

SEQ ID NO: 11466 - RNA, 18 nt, Human
acuguccucaggacguug

SEQ ID NO: 11467 - RNA, 22 nt, Human
acuguccucgaaguaccugugc

SEQ ID NO: 11468 - RNA, 22 nt, Human
acugugaagagcauucuggcug

SEQ ID NO: 11469 - RNA, 23 nt, Human
cccgggaagugcugcuuaucugg

SEQ ID NO: 11470 - RNA, 22 nt, Human
cccgggccgagucuuccagcga

SEQ ID NO: 11471 - RNA, 22 nt, Human
cccgggcucuggcagaggcggu

SEQ ID NO: 11472 - RNA, 22 nt, Human
cccgggucugugugaaauucca

SEQ ID NO: 11473 - RNA, 22 nt, Human
cccgguggagaugugggacagg

SEQ ID NO: 11474 - RNA, 22 nt, Human
cccguggugggaugacaccaug

SEQ ID NO: 11475 - RNA, 22 nt, Human
cccuaaucuuggaaaugccauu

SEQ ID NO: 11476 - RNA, 22 nt, Human
cccuaguuuauuugccuucuuu

SEQ ID NO: 11477 - RNA, 22 nt, Human
cccuccaaauuauaguauuguc

SEQ ID NO: 11478 - RNA, 22 nt, Human
cccuccagugucccagugggga

SEQ ID NO: 11479 - RNA, 22 nt, Human
cccuccgccagugcccgccccg

SEQ ID NO: 11480 - RNA, 22 nt, Human
cccuccuuggccccagacccgc

SEQ ID NO: 11481 - RNA, 23 nt, Human
cccucgcuccucgguuccccugu

SEQ ID NO: 11482 - RNA, 22 nt, Human
cccucucaaucuuuaaaauaca

SEQ ID NO: 11483 - RNA, 22 nt, Human
cccugaggcccacaagucccag

SEQ ID NO: 11484 - RNA, 22 nt, Human
cccugauaaaucagcaccucag

SEQ ID NO: 11485 - RNA, 17 nt, Human
cccugcauugauccuca

SEQ ID NO: 11486 - RNA, 22 nt, Human
cccugcuuccucuucuguuugu

SEQ ID NO: 11487 - RNA, 22 nt, Human
cccuggacuccauuuucccgua

SEQ ID NO: 11488 - RNA, 20 nt, Human
cccuggcuggcaucuggacu

SEQ ID NO: 11489 - RNA, 22 nt, Human
cccuggucucugacuugauccu

SEQ ID NO: 11490 - RNA, 22 nt, Human
cccuguccuucccuccaucuga

SEQ ID NO: 11491 - RNA, 22 nt, Human
cccuucauguagcugugugucc

SEQ ID NO: 11492 - RNA, 22 nt, Human
cccuucuguaucuucugaguuu

SEQ ID NO: 11493 - RNA, 22 nt, Human
cccuugagccuggaggagcucu

SEQ ID NO: 11494 - RNA, 21 nt, Human
cccuugccugcacuccucggc

SEQ ID NO: 11495 - RNA, 22 nt, Human
cccuuugucaguagucuuagug

SEQ ID NO: 11496 - RNA, 22 nt, Human
cccuuuuuugccauuccuuccu

SEQ ID NO: 11497 - RNA, 22 nt, Human
ccgaaccacacgacagugcuca

SEQ ID NO: 11498 - RNA, 22 nt, Human
ccgagaucagaguaggauuugg

SEQ ID NO: 11499 - RNA, 19 nt, Human
ccgagcagauugauguuuc

SEQ ID NO: 11500 - RNA, 22 nt, Human
ccgagguccugaagcaagggcc

SEQ ID NO: 11501 - RNA, 22 nt, Human
ccgauuuaugucucugacuuga

SEQ ID NO: 11502 - RNA, 22 nt, Human
ccgcagucugcaaucucccugg

SEQ ID NO: 11503 - RNA, 22 nt, Human
ccgccacggggcaugggaggca

SEQ ID NO: 11504 - RNA, 22 nt, Human
ccgccccaggcccugagccaag

SEQ ID NO: 11505 - RNA, 22 nt, Human
ccgccucucgcucccagcuugc

SEQ ID NO: 11506 - RNA, 22 nt, Human
ccgcgcccccggcugugccccc

SEQ ID NO: 11507 - RNA, 22 nt, Human
ccgcggauggggagucaccacc

SEQ ID NO: 11508 - RNA, 22 nt, Human
ccgcggcagaggcgggggcgcc

SEQ ID NO: 11509 - RNA, 22 nt, Human
ccgcggcugcgcggugccccuc

SEQ ID NO: 11510 - RNA, 22 nt, Human
ccgcucgggugcagagggcaga

SEQ ID NO: 11511 - RNA, 22 nt, Human
ccgcuggaagcgaguggugggc

SEQ ID NO: 11512 - RNA, 22 nt, Human
ccggaggaaauugcauugguug

SEQ ID NO: 11513 - RNA, 22 nt, Human
ccggcggguggagcaugcgcgg

SEQ ID NO: 11514 - RNA, 22 nt, Human
ccgggcuuccuuagagcaagau

SEQ ID NO: 11515 - RNA, 22 nt, Human
ccgguguggguuucucgguagu

SEQ ID NO: 11516 - RNA, 22 nt, Human
ccguccgcuccuccagccgcug

SEQ ID NO: 11517 - RNA, 22 nt, Human
ccgugccuuuaguuucuucugu

SEQ ID NO: 11518 - RNA, 22 nt, Human
ccgugggugggguacgggcugg

SEQ ID NO: 11519 - RNA, 21 nt, Human
ccguuauucuucccaccccca

SEQ ID NO: 11520 - RNA, 22 nt, Human
ccuaacagauugggugacaaua

SEQ ID NO: 11521 - RNA, 22 nt, Human
ccuaacaugguuauuguuaauu

SEQ ID NO: 11522 - RNA, 22 nt, Human
ccuacccaccccuccucaucac

SEQ ID NO: 11523 - RNA, 20 nt, Human
ccuagacacagggagggccg

SEQ ID NO: 11524 - RNA, 22 nt, Human
ccuagcauagcuuuugccuccc

SEQ ID NO: 11525 - RNA, 22 nt, Human
ccuaggauuaaaauaauaauua

SEQ ID NO: 11526 - RNA, 22 nt, Human
ccuauauaaaugacauauagga

SEQ ID NO: 11527 - RNA, 22 nt, Human
ccuauauuacaggcuugcucua

SEQ ID NO: 11528 - RNA, 21 nt, Human
ccuaugucucaaagguucucc

SEQ ID NO: 11529 - RNA, 20 nt, Human
ccucaaccuccuuucucucc

SEQ ID NO: 11530 - RNA, 22 nt, Human
ccucacuucuuucucuucacuu

SEQ ID NO: 11531 - RNA, 22 nt, Human
ccucagcuguuucucucaucag

SEQ ID NO: 11532 - RNA, 22 nt, Human
ccucaggaauuuauucuucugu

SEQ ID NO: 11533 - RNA, 22 nt, Human
ccucaucagaaagcagaaagca

SEQ ID NO: 11534 - RNA, 22 nt, Human
ccuccacgaggggucuucucuu

SEQ ID NO: 11535 - RNA, 21 nt, Human
ccuccagccagagggucugga

SEQ ID NO: 11536 - RNA, 22 nt, Human
ccucccaccguaucucaguggc

SEQ ID NO: 11537 - RNA, 22 nt, Human
ccucccagccuggagaggagcc

SEQ ID NO: 11538 - RNA, 18 nt, Human
ccuccccuguggaggucc

SEQ ID NO: 11539 - RNA, 22 nt, Human
ccucccuucccggcauggcucu

SEQ ID NO: 11540 - RNA, 22 nt, Human
ccuccgguucucagggcuccac

SEQ ID NO: 11541 - RNA, 22 nt, Human
ccuccuggaguuacuuccaaaa

SEQ ID NO: 11542 - RNA, 22 nt, Human
ccuccuuuccuguuuuccugag

SEQ ID NO: 11543 - RNA, 22 nt, Human
ccucggacuugggugggcuccu

SEQ ID NO: 11544 - RNA, 19 nt, Human
ccucggggucugaagucag

SEQ ID NO: 11545 - RNA, 22 nt, Human
ccucuagaauuaucacuuuuaa

SEQ ID NO: 11546 - RNA, 22 nt, Human
ccucucacucccucauggguuc

SEQ ID NO: 11547 - RNA, 22 nt, Human
ccucucccugcagggcccaggg

SEQ ID NO: 11548 - RNA, 22 nt, Human
ccucuccucugugcagacugcc

SEQ ID NO: 11549 - RNA, 20 nt, Human
ccucucugcaugcucccuga

SEQ ID NO: 11550 - RNA, 22 nt, Human
ccucuggacuugggacagugag

SEQ ID NO: 11551 - RNA, 22 nt, Human
ccucuuugcccucuuuccuucc

SEQ ID NO: 11552 - RNA, 22 nt, Human
ccucuuuugaaccaguucuuca

SEQ ID NO: 11553 - RNA, 22 nt, Human
ccugaaaugaguucugcucacu

SEQ ID NO: 11554 - RNA, 22 nt, Human
ccugacagcgugucccuggccc

SEQ ID NO: 11555 - RNA, 22 nt, Human
ccugaccauuugccacaugggu

SEQ ID NO: 11556 - RNA, 22 nt, Human
ccugacgcugauauauaguuaa

SEQ ID NO: 11557 - RNA, 22 nt, Human
ccugacucugauuucgcugcau

SEQ ID NO: 11558 - RNA, 22 nt, Human
ccugauauggugucauuuaaac

SEQ ID NO: 11559 - RNA, 22 nt, Human
ccugcacuaccuggggcugcug

SEQ ID NO: 11560 - RNA, 22 nt, Human
ccugcaguagagguugguaggg

SEQ ID NO: 11561 - RNA, 22 nt, Human
ccugccagaaaagagggaguuc

SEQ ID NO: 11562 - RNA, 22 nt, Human
agagacugauggaucaccaaau

SEQ ID NO: 11563 - RNA, 22 nt, Human
agagacuguaaugagagguaca

SEQ ID NO: 11564 - RNA, 22 nt, Human
agagagggaugguguccagaga

SEQ ID NO: 11565 - RNA, 22 nt, Human
agagaguagaagggacaguauu

SEQ ID NO: 11566 - RNA, 22 nt, Human
agagauacugcaggccauaaau

SEQ ID NO: 11567 - RNA, 22 nt, Human
agagauggugaugaggaaaaau

SEQ ID NO: 11568 - RNA, 22 nt, Human
agagcacaggguuuugugccgg

SEQ ID NO: 11569 - RNA, 22 nt, Human
agagcagaggcauggccguggg

SEQ ID NO: 11570 - RNA, 22 nt, Human
agagcagauggagcuggaagag

SEQ ID NO: 11571 - RNA, 22 nt, Human
agagcagcaaucuuugaaauua

SEQ ID NO: 11572 - RNA, 22 nt, Human
agagcagcuuuucggaaccacu

SEQ ID NO: 11573 - RNA, 22 nt, Human
agagccauuuaaauaguuguca

SEQ ID NO: 11574 - RNA, 22 nt, Human
agagccggagucuucuuguuug

SEQ ID NO: 11575 - RNA, 23 nt, Human
agagccuaauaucuaaucuuugu

SEQ ID NO: 11576 - RNA, 22 nt, Human
agagccuaguauggacucuuag

SEQ ID NO: 11577 - RNA, 22 nt, Human
agagcuauuucuuaaaagcugu

SEQ ID NO: 11578 - RNA, 22 nt, Human
agagcugggacuuggacucaau

SEQ ID NO: 11579 - RNA, 22 nt, Human
agagcuuuggaguaaguuuuga

SEQ ID NO: 11580 - RNA, 22 nt, Human
agaggaauuauugaguuagauu

SEQ ID NO: 11581 - RNA, 21 nt, Human
agaggacuuuuuugauguuuu

SEQ ID NO: 11582 - RNA, 22 nt, Human
ccuuagaaaaucauggaauauu

SEQ ID NO: 11583 - RNA, 22 nt, Human
ccuucaguguuacuagaaagcg

SEQ ID NO: 11584 - RNA, 22 nt, Human
ccuuccaguucuugguuguaau

SEQ ID NO: 11585 - RNA, 22 nt, Human
ccuucccagacggcucagcugu

SEQ ID NO: 11586 - RNA, 22 nt, Human
ccuucucuucuuggaaggaacu

SEQ ID NO: 11587 - RNA, 22 nt, Human
ccuucuguaccaaggccucaug

SEQ ID NO: 11588 - RNA, 22 nt, Human
ccuugagacacagccaaagaug

SEQ ID NO: 11589 - RNA, 22 nt, Human
ccuugagugcaucguggguguc

SEQ ID NO: 11590 - RNA, 21 nt, Human
ccuugcacucaucccaugccc

SEQ ID NO: 11591 - RNA, 22 nt, Human
ccuuggaucugcauaucagcua

SEQ ID NO: 11592 - RNA, 22 nt, Human
ccuuggcuuaccuucugugugg

SEQ ID NO: 11593 - RNA, 22 nt, Human
ccuugggagcgcccuguccggg

SEQ ID NO: 11594 - RNA, 22 nt, Human
ccuugguuuagcaauuuuucuu

SEQ ID NO: 11595 - RNA, 22 nt, Human
ccuugugauugaucuaaguugc

SEQ ID NO: 11596 - RNA, 20 nt, Human
ccuuguggaugucuuuuuug

SEQ ID NO: 11597 - RNA, 23 nt, Human
ccuuguguaucuccagccacucc

SEQ ID NO: 11598 - RNA, 22 nt, Human
ccuuuccucuucaugacuuucu

SEQ ID NO: 11599 - RNA, 17 nt, Human
ccuuucugaucaucuga

SEQ ID NO: 11600 - RNA, 22 nt, Human
ccuuugcccugagaaauguucc

SEQ ID NO: 11601 - RNA, 22 nt, Human
ccuuuggaugucauucuuggca

SEQ ID NO: 11602 - RNA, 22 nt, Human
ccuuuuagagaagugcauccag

SEQ ID NO: 11603 - RNA, 22 nt, Human
ccuuuuaucgcgaagaacucca

SEQ ID NO: 11604 - RNA, 22 nt, Human
cgaaaaagaagugcaccauguu

SEQ ID NO: 11605 - RNA, 22 nt, Human
cgacaagagaaaugcuuuguuu

SEQ ID NO: 11606 - RNA, 19 nt, Human
cgacauggguaaugggaga

SEQ ID NO: 11607 - RNA, 22 nt, Human
cgaccccugaaaauggcagcca

SEQ ID NO: 11608 - RNA, 22 nt, Human
cgacgacaggcgcccgaggagg

SEQ ID NO: 11609 - RNA, 22 nt, Human
cgacuacuaacuacuguagaaa

SEQ ID NO: 11610 - RNA, 22 nt, Human
cgagaccaggcuuuuuuuagga

SEQ ID NO: 11611 - RNA, 22 nt, Human
cgagcccaacccucccguccuc

SEQ ID NO: 11612 - RNA, 22 nt, Human
cgaggcuugcaaggacgaggag

SEQ ID NO: 11613 - RNA, 22 nt, Human
cgagguacuuacccuggucugu

SEQ ID NO: 11614 - RNA, 22 nt, Human
cgagguuuaugaguuuguguuc

SEQ ID NO: 11615 - RNA, 22 nt, Human
cgaguaauuggaaauuugcuau

SEQ ID NO: 11616 - RNA, 22 nt, Human
cgaguagagaugugguuucuga

SEQ ID NO: 11617 - RNA, 22 nt, Human
cgauuccugauaagugaauaag

SEQ ID NO: 11618 - RNA, 22 nt, Human
cgcacaggcacagacacuggga

SEQ ID NO: 11619 - RNA, 22 nt, Human
cgcagcuucagggccaggaggg

SEQ ID NO: 11620 - RNA, 22 nt, Human
cgcaucggguagaggagcugga

SEQ ID NO: 11621 - RNA, 22 nt, Human
cgcccccgaucggggccgccgc

SEQ ID NO: 11622 - RNA, 21 nt, Human
cgcccggccggaaaccccuuc

SEQ ID NO: 11623 - RNA, 22 nt, Human
cgccugucugcauggccacugg

SEQ ID NO: 11624 - RNA, 22 nt, Human
cgcgcgguguuccgcauucugc

SEQ ID NO: 11625 - RNA, 22 nt, Human
cgcgcuuugggcaguguggcug

SEQ ID NO: 11626 - RNA, 22 nt, Human
cgcgggcuugggcaccugcgga

SEQ ID NO: 11627 - RNA, 22 nt, Human
cgcucggcuuucccuccgccgg

SEQ ID NO: 11628 - RNA, 22 nt, Human
cgcugcugucaucgucuacggu

SEQ ID NO: 11629 - RNA, 22 nt, Human
cgcuuugacuuuagaaggccaa

SEQ ID NO: 11630 - RNA, 22 nt, Human
cgcuuugguaauagggcagccu

SEQ ID NO: 11631 - RNA, 22 nt, Human
cggaagcacuagacacugacac

SEQ ID NO: 11632 - RNA, 22 nt, Human
cggacugaccugcucggggaga

SEQ ID NO: 11633 - RNA, 22 nt, Human
cggagagacaagucugcuuugg

SEQ ID NO: 11634 - RNA, 22 nt, Human
cggagcauacugccuggagaug

SEQ ID NO: 11635 - RNA, 22 nt, Human
cggagcgagaaggggaaagccc

SEQ ID NO: 11636 - RNA, 22 nt, Human
cggaggagcugcgcggaggggg

SEQ ID NO: 11637 - RNA, 22 nt, Human
cggagguccagucacaaguaac

SEQ ID NO: 11638 - RNA, 22 nt, Human
cggccgcgggauggcgggcagc

SEQ ID NO: 11639 - RNA, 22 nt, Human
cggccuuugcccgucauucugg

SEQ ID NO: 11640 - RNA, 22 nt, Human
cggcuacccaugucauauucgu

SEQ ID NO: 11641 - RNA, 22 nt, Human
cggcugcagcggagcaggcugg

SEQ ID NO: 11642 - RNA, 22 nt, Human
cggcugcgguucaccuagggca

SEQ ID NO: 11643 - RNA, 22 nt, Human
cggcuucucgggucggauuccg

SEQ ID NO: 11644 - RNA, 22 nt, Human
cgggaaguaaacauuauuucag

SEQ ID NO: 11645 - RNA, 22 nt, Human
cgggacaauagcagugcugaug

SEQ ID NO: 11646 - RNA, 22 nt, Human
cgggagcagcucuggggcuggg

SEQ ID NO: 11647 - RNA, 22 nt, Human
cgggcacucagggucgaggugg

SEQ ID NO: 11648 - RNA, 22 nt, Human
cggggaggagccagcggaggau

SEQ ID NO: 11649 - RNA, 22 nt, Human
cggggcuccgaagagcucgguu

SEQ ID NO: 11650 - RNA, 22 nt, Human
cggggcuggcguuagggaggca

SEQ ID NO: 11651 - RNA, 22 nt, Human
cggggggguuggaaaagggaga

SEQ ID NO: 11652 - RNA, 22 nt, Human
cggggugugacggugcgggccu

SEQ ID NO: 11653 - RNA, 22 nt, Human
cgggguguggggcgguagugug

SEQ ID NO: 11654 - RNA, 22 nt, Human
cgggucgagugcuguaguucga

SEQ ID NO: 11655 - RNA, 22 nt, Human
cgggucgcacaggagaaaggcg

SEQ ID NO: 11656 - RNA, 22 nt, Human
cgguccugcucuuccucccguu

SEQ ID NO: 11657 - RNA, 19 nt, Human
cggugaagagaguuuagau

SEQ ID NO: 11658 - RNA, 22 nt, Human
cgguggcccauuguacgcagcu

SEQ ID NO: 11659 - RNA, 22 nt, Human
cgucagccacagcugccccggg

SEQ ID NO: 11660 - RNA, 22 nt, Human
cgucauacagaugaacaaucuc

SEQ ID NO: 11661 - RNA, 22 nt, Human
cgucauguuauggcucauucua

SEQ ID NO: 11662 - RNA, 22 nt, Human
cgucauuuguaaaugaucaaga

SEQ ID NO: 11663 - RNA, 22 nt, Human
cgugaaaugcagaaaguugugg

SEQ ID NO: 11664 - RNA, 22 nt, Human
cgugaucuguuauauagugagc

SEQ ID NO: 11665 - RNA, 22 nt, Human
cgugccugguggagagcgaggg

SEQ ID NO: 11666 - RNA, 22 nt, Human
cgugcuaccugagcugacagcu

SEQ ID NO: 11667 - RNA, 22 nt, Human
cguggccacaguggagcugagc

SEQ ID NO: 11668 - RNA, 20 nt, Human
cguguacauuuaugccccug

SEQ ID NO: 11669 - RNA, 22 nt, Human
cgugucauggcggcgcaggugg

SEQ ID NO: 11670 - RNA, 22 nt, Human
cgugugcguauguguuuguaug

SEQ ID NO: 11671 - RNA, 22 nt, Human
cucugucuggggaggggagagg

SEQ ID NO: 11672 - RNA, 22 nt, Human
cucugugucugauucugggaag

SEQ ID NO: 11673 - RNA, 22 nt, Human
cucuucauguuggugcagaagc

SEQ ID NO: 11674 - RNA, 19 nt, Human
cucuucauuggaggguuga

SEQ ID NO: 11675 - RNA, 22 nt, Human
cucuucugugggugcuauguca

SEQ ID NO: 11676 - RNA, 22 nt, Human
cucuugacagcuuuaguaucau

SEQ ID NO: 11677 - RNA, 22 nt, Human
cucuugggggcaggagggacag

SEQ ID NO: 11678 - RNA, 22 nt, Human
cucuuucauucuuagguugccg

SEQ ID NO: 11679 - RNA, 20 nt, Human
cucuuucugcuuuaugccuc

SEQ ID NO: 11680 - RNA, 22 nt, Human
cucuuuguauucuagaagcucu

SEQ ID NO: 11681 - RNA, 22 nt, Human
cucuuuuuccuaugaaaucuau

SEQ ID NO: 11682 - RNA, 22 nt, Human
cugaaacucaagauaggaggaa

SEQ ID NO: 11683 - RNA, 22 nt, Human
cugaaagacagccaggcaaagc

SEQ ID NO: 11684 - RNA, 22 nt, Human
cugaaagacgaggggaagucgg

SEQ ID NO: 11685 - RNA, 20 nt, Human
cugaaaggaaagaaauuuuu

SEQ ID NO: 11686 - RNA, 23 nt, Human
cugaaauucagaugcuaaagaua

SEQ ID NO: 11687 - RNA, 22 nt, Human
cugaagaaagaaaauggccauc

SEQ ID NO: 11688 - RNA, 22 nt, Human
cugaagcugggcacuuccuuuu

SEQ ID NO: 11689 - RNA, 22 nt, Human
cugaauucuuguugucggagca

SEQ ID NO: 11690 - RNA, 22 nt, Human
cugacacagccauuguccuugu

SEQ ID NO: 11691 - RNA, 20 nt, Human
cugaccagcagccugucucc

SEQ ID NO: 11692 - RNA, 19 nt, Human
cugacccaacauuaguuca

SEQ ID NO: 11693 - RNA, 22 nt, Human
cugaccgugccgcgguacugcu

SEQ ID NO: 11694 - RNA, 22 nt, Human
cugaccugugagcuaugccggc

SEQ ID NO: 11695 - RNA, 22 nt, Human
agaggaguagcugagcucugca

SEQ ID NO: 11696 - RNA, 22 nt, Human
agaggcacccaguuaagcugca

SEQ ID NO: 11697 - RNA, 23 nt, Human
agaggccaacuucuugccccucc

SEQ ID NO: 11698 - RNA, 22 nt, Human
agaggcuuuccuaagauugguu

SEQ ID NO: 11699 - RNA, 23 nt, Human
agagggaagagcuuagaugggga

SEQ ID NO: 11700 - RNA, 22 nt, Human
agagggagagaccuccgugccu

SEQ ID NO: 11701 - RNA, 22 nt, Human
agagggagagauuggcaaucag

SEQ ID NO: 11702 - RNA, 22 nt, Human
agagggagccugcacagcuuuc

SEQ ID NO: 11703 - RNA, 22 nt, Human
agagggagcuccaagaucaagg

SEQ ID NO: 11704 - RNA, 22 nt, Human
agagggcaggcugguugggguc

SEQ ID NO: 11705 - RNA, 22 nt, Human
agagggcugugcuaaauuucag

SEQ ID NO: 11706 - RNA, 22 nt, Human
agaggggaaggaugugauguga

SEQ ID NO: 11707 - RNA, 21 nt, Human
agaguaacucagugaaaaaua

SEQ ID NO: 11708 - RNA, 22 nt, Human
agagugucaggaggguggaugu

SEQ ID NO: 11709 - RNA, 22 nt, Human
agaguguggaaauguucagagu

SEQ ID NO: 11710 - RNA, 21 nt, Human
agagugugugcaucauauuug

SEQ ID NO: 11711 - RNA, 22 nt, Human
agaguuaaugcaggccaagccu

SEQ ID NO: 11712 - RNA, 22 nt, Human
agauaaaucauuuauuaagcgg

SEQ ID NO: 11713 - RNA, 22 nt, Human
agauaacauguugcagauucug

SEQ ID NO: 11714 - RNA, 22 nt, Human
agauaaucacaaucuagacuuu

SEQ ID NO: 11715 - RNA, 22 nt, Human
agauacaaaagauaagauuuag

SEQ ID NO: 11716 - RNA, 22 nt, Human
agauacuaagccucaagagacg

SEQ ID NO: 11717 - RNA, 22 nt, Human
agauagaaggauugugacacau

SEQ ID NO: 11718 - RNA, 22 nt, Human
agauaucuuguuggcauaaaug

SEQ ID NO: 11719 - RNA, 22 nt, Human
agauauucugccuaacagguuu

SEQ ID NO: 11720 - RNA, 19 nt, Human
agaucaggauguauuuuug

SEQ ID NO: 11721 - RNA, 22 nt, Human
agaucauuaaccaccuguucug

SEQ ID NO: 11722 - RNA, 22 nt, Human
agaucugucaccauccuggagc

SEQ ID NO: 11723 - RNA, 22 nt, Human
agaugaacuuuuuuaaacugga

SEQ ID NO: 11724 - RNA, 21 nt, Human
agaugaggauacugaggccua

SEQ ID NO: 11725 - RNA, 22 nt, Human
agaugaguaaauggagucuucc

SEQ ID NO: 11726 - RNA, 22 nt, Human
agaugaugugugucuucagcua

SEQ ID NO: 11727 - RNA, 19 nt, Human
agauggcaaaaugcaaaga

SEQ ID NO: 11728 - RNA, 22 nt, Human
agauggcuccaguguccagagg

SEQ ID NO: 11729 - RNA, 22 nt, Human
agauggggccugaggacacugu

SEQ ID NO: 11730 - RNA, 22 nt, Human
agaugucauguguugcuccaag

SEQ ID NO: 11731 - RNA, 22 nt, Human
agauguuaauaaccuuagggca

SEQ ID NO: 11732 - RNA, 22 nt, Human
agauguugucucuuacguuuga

SEQ ID NO: 11733 - RNA, 22 nt, Human
agauuaagcauuauaauuauaa

SEQ ID NO: 11734 - RNA, 22 nt, Human
agauucgucuuuaauucaccau

SEQ ID NO: 11735 - RNA, 22 nt, Human
agauucucccuccuggcgcugu

SEQ ID NO: 11736 - RNA, 22 nt, Human
agauugaacgagcuggcaugga

SEQ ID NO: 11737 - RNA, 22 nt, Human
agauuguaugaggacuccauga

SEQ ID NO: 11738 - RNA, 22 nt, Human
agauuuguauagaugugguuga

SEQ ID NO: 11739 - RNA, 22 nt, Human
agcaaaacuaaagacacagaca

SEQ ID NO: 11740 - RNA, 22 nt, Human
agcaaauaauugucuuugaggg

SEQ ID NO: 11741 - RNA, 22 nt, Human
agcaaggguugguuuucugaca

SEQ ID NO: 11742 - RNA, 20 nt, Human
agcacaggcagucauucagu

SEQ ID NO: 11743 - RNA, 22 nt, Human
agcacagugccugacauauaug

SEQ ID NO: 11744 - RNA, 22 nt, Human
agcacauguuucuuuugcaauu

SEQ ID NO: 11745 - RNA, 19 nt, Human
agcaccuaucuggauaagg

SEQ ID NO: 11746 - RNA, 22 nt, Human
agcacggugguuaagagagugg

SEQ ID NO: 11747 - RNA, 22 nt, Human
agcacuaccggucacggccaug

SEQ ID NO: 11748 - RNA, 22 nt, Human
agcacuuuagaauuuagaguug

SEQ ID NO: 11749 - RNA, 22 nt, Human
agcagauaaagguugcauuucu

SEQ ID NO: 11750 - RNA, 22 nt, Human
agcagcaggcugggaugagucu

SEQ ID NO: 11751 - RNA, 16 nt, Human
agcagcgugggggugg

SEQ ID NO: 11752 - RNA, 17 nt, Human
agcagcuggguugaucu

SEQ ID NO: 11753 - RNA, 22 nt, Human
agcaggaaggcuagaagcagga

SEQ ID NO: 11754 - RNA, 22 nt, Human
agcaggagaaagaguaugggcu

SEQ ID NO: 11755 - RNA, 22 nt, Human
agcaggagagacuggcccaaaa

SEQ ID NO: 11756 - RNA, 22 nt, Human
agcaggaggagagccuggcggu

SEQ ID NO: 11757 - RNA, 22 nt, Human
agcaggauggaguaacgugaaa

SEQ ID NO: 11758 - RNA, 22 nt, Human
agcaggggcaggguuuugugcu

SEQ ID NO: 11759 - RNA, 22 nt, Human
agcagguucaagggcaaagcug

SEQ ID NO: 11760 - RNA, 21 nt, Human
agcagucugcggccggugcgg

SEQ ID NO: 11761 - RNA, 19 nt, Human
agcagugaaaucuggugag

SEQ ID NO: 11762 - RNA, 18 nt, Human
agcagugcggaucauuuu

SEQ ID NO: 11763 - RNA, 19 nt, Human
agcaguggagccaugccug

SEQ ID NO: 11764 - RNA, 22 nt, Human
agcaguucucugucuagcuaga

SEQ ID NO: 11765 - RNA, 22 nt, Human
agcaguugcuuuguauauuaaa

SEQ ID NO: 11766 - RNA, 22 nt, Human
agcauaacaaagggcauaauug

SEQ ID NO: 11767 - RNA, 22 nt, Human
agcauacuaggauguuuucugg

SEQ ID NO: 11768 - RNA, 22 nt, Human
agcauauaugcaugagugugca

SEQ ID NO: 11769 - RNA, 22 nt, Human
agcaucggacggagcaccugcu

SEQ ID NO: 11770 - RNA, 21 nt, Human
agcaucugaggcaguuuccua

SEQ ID NO: 11771 - RNA, 20 nt, Human
agcauucaacuuucuauguu

SEQ ID NO: 11772 - RNA, 22 nt, Human
agcauucccuuugcagugucau

SEQ ID NO: 11773 - RNA, 22 nt, Human
agcauugguggcauuugcagcu

SEQ ID NO: 11774 - RNA, 22 nt, Human
agcauuucuacugugucagaaa

SEQ ID NO: 11775 - RNA, 22 nt, Human
agccacggcaaugauaggcugc

SEQ ID NO: 11776 - RNA, 22 nt, Human
agccagcauauauauaguugaa

SEQ ID NO: 11777 - RNA, 22 nt, Human
agccaucuggugucaaugauuc

SEQ ID NO: 11778 - RNA, 22 nt, Human
agccaugcuguuuugccuggga

SEQ ID NO: 11779 - RNA, 22 nt, Human
agccauggagaacagacuugaa

SEQ ID NO: 11780 - RNA, 22 nt, Human
agcccagguggagugugugggg

SEQ ID NO: 11781 - RNA, 22 nt, Human
cuguggaguccuggggaaugga

SEQ ID NO: 11782 - RNA, 22 nt, Human
cuguggcuaggaagcuguggga

SEQ ID NO: 11783 - RNA, 21 nt, Human
cugugggaaggccugaggucu

SEQ ID NO: 11784 - RNA, 22 nt, Human
cugugguuucuaugggccuuga

SEQ ID NO: 11785 - RNA, 22 nt, Human
cugugucucccaaggaggguca

SEQ ID NO: 11786 - RNA, 22 nt, Human
cugugugcagggcacaauggaa

SEQ ID NO: 11787 - RNA, 22 nt, Human
cuguguuaggaucuugcuggca

SEQ ID NO: 11788 - RNA, 22 nt, Human
cuguguuguuugaguagcuuga

SEQ ID NO: 11789 - RNA, 22 nt, Human
cuguuaauugugaauuuuacau

SEQ ID NO: 11790 - RNA, 22 nt, Human
cuguuacggaggcuuucuaguu

SEQ ID NO: 11791 - RNA, 22 nt, Human
cuguucagugcauauguauuga

SEQ ID NO: 11792 - RNA, 22 nt, Human
cuguuccuccaccucaacaaac

SEQ ID NO: 11793 - RNA, 20 nt, Human
cuguucucuugccacaugag

SEQ ID NO: 11794 - RNA, 22 nt, Human
cuguuguucacuuugcugguga

SEQ ID NO: 11795 - RNA, 22 nt, Human
cuguuuuugccugugacaaaaa

SEQ ID NO: 11796 - RNA, 22 nt, Human
cuuacauuuguuuaguguuucc

SEQ ID NO: 11797 - RNA, 22 nt, Human
cuuauaucaacuggaaaaauua

SEQ ID NO: 11798 - RNA, 20 nt, Human
cuuaugcaaaauguuaggga

SEQ ID NO: 11799 - RNA, 22 nt, Human
cuuauuagaaagaaaagacaug

SEQ ID NO: 11800 - RNA, 20 nt, Human
cuuauuuuggagaacuuuuc

SEQ ID NO: 11801 - RNA, 22 nt, Human
cuucaacuucuguuuuaaggaa

SEQ ID NO: 11802 - RNA, 22 nt, Human
cuucacuccuggagugaguuuc

SEQ ID NO: 11803 - RNA, 22 nt, Human
cuucacugcagucauggcucug

SEQ ID NO: 11804 - RNA, 22 nt, Human
cuucagcgucgucaguguugcu

SEQ ID NO: 11805 - RNA, 22 nt, Human
cuucauaagauuguugugagga

SEQ ID NO: 11806 - RNA, 22 nt, Human
cuucauccguaccacggccaca

SEQ ID NO: 11807 - RNA, 22 nt, Human
cuucauuucaggcugaagaaua

SEQ ID NO: 11808 - RNA, 22 nt, Human
cuuccacucaguuuuucauugc

SEQ ID NO: 11809 - RNA, 22 nt, Human
cuuccagugcauagguagauca

SEQ ID NO: 11810 - RNA, 22 nt, Human
cuucccuaagggacuggcauag

SEQ ID NO: 11811 - RNA, 22 nt, Human
cuucccugucuacaacccugcc

SEQ ID NO: 11812 - RNA, 22 nt, Human
cuuccguuacugacaaaauguu

SEQ ID NO: 11813 - RNA, 21 nt, Human
cuucgcuguuccagcucuugg

SEQ ID NO: 11814 - RNA, 23 nt, Human
cuucggcgcucgcugggcggagg

SEQ ID NO: 11815 - RNA, 22 nt, Human
cuucuaauucuuauguaagcuu

SEQ ID NO: 11816 - RNA, 22 nt, Human
cuucuagucaaaauggauaagc

SEQ ID NO: 11817 - RNA, 22 nt, Human
cuucucuugugauguuagcgga

SEQ ID NO: 11818 - RNA, 22 nt, Human
cuucuggaggcucuagaggaga

SEQ ID NO: 11819 - RNA, 22 nt, Human
cuucuggaggcugcagaaaaga

SEQ ID NO: 11820 - RNA, 22 nt, Human
cuucuguggcugagaaggcagc

SEQ ID NO: 11821 - RNA, 22 nt, Human
cuucuucuagaagauggggaag

SEQ ID NO: 11822 - RNA, 22 nt, Human
cuucuuuccauguguuuugguu

SEQ ID NO: 11823 - RNA, 22 nt, Human
cuucuuucuuuucuucuucucu

SEQ ID NO: 11824 - RNA, 22 nt, Human
cuugcaaugaaggcacacuuau

SEQ ID NO: 11825 - RNA, 22 nt, Human
cuugcagccuggagcucagccu

SEQ ID NO: 11826 - RNA, 22 nt, Human
cuugccagggacucagucaggg

SEQ ID NO: 11827 - RNA, 22 nt, Human
cuugccuuugaaagcauuucuc

SEQ ID NO: 11828 - RNA, 22 nt, Human
cuugcugggagagcuuuagaga

SEQ ID NO: 11829 - RNA, 22 nt, Human
cuugcuguccgaugggucugua

SEQ ID NO: 11830 - RNA, 22 nt, Human
cuuggagauacagaggacauuu

SEQ ID NO: 11831 - RNA, 22 nt, Human
cuuggcacauuuuguucuucug

SEQ ID NO: 11832 - RNA, 22 nt, Human
cuuggcuccuucacagggagau

SEQ ID NO: 11833 - RNA, 22 nt, Human
cuugggacucccuguagcagug

SEQ ID NO: 11834 - RNA, 22 nt, Human
cuuggggcuugcuguuguagcc

SEQ ID NO: 11835 - RNA, 22 nt, Human
cuuggggucuuacuuguacccu

SEQ ID NO: 11836 - RNA, 22 nt, Human
cuugggguuugggggcuugacc

SEQ ID NO: 11837 - RNA, 22 nt, Human
cuuggguacaguaaagggaggu

SEQ ID NO: 11838 - RNA, 22 nt, Human
cuuggugcgaagagucagggga

SEQ ID NO: 11839 - RNA, 22 nt, Human
cuugguuugaaacauacucuac

SEQ ID NO: 11840 - RNA, 20 nt, Human
cuuguuaaauaugcagguag

SEQ ID NO: 11841 - RNA, 22 nt, Human
cuuguuaacaauugguaucuuu

SEQ ID NO: 11842 - RNA, 22 nt, Human
cuuuacauuaauuucuacugau

SEQ ID NO: 11843 - RNA, 22 nt, Human
cuuuaguaaaacguauuuagga

SEQ ID NO: 11844 - RNA, 22 nt, Human
cuuuauguuggggugucuuagu

SEQ ID NO: 11845 - RNA, 22 nt, Human
cuuuccaugucuucuuucucca

SEQ ID NO: 11846 - RNA, 22 nt, Human
cuuucuccagagugaagauccu

SEQ ID NO: 11847 - RNA, 22 nt, Human
cuuucucucaaacacacauaca

SEQ ID NO: 11848 - RNA, 18 nt, Human
cuuucugcccccauuagc

SEQ ID NO: 11849 - RNA, 22 nt, Human
cuuugauuucucugguccaauc

SEQ ID NO: 11850 - RNA, 21 nt, Human
cuuugccuccagcagccgcag

SEQ ID NO: 11851 - RNA, 22 nt, Human
cuuuggauuuuuugcuuuugua

SEQ ID NO: 11852 - RNA, 22 nt, Human
cuuugugcagcagaaaugugug

SEQ ID NO: 11853 - RNA, 19 nt, Human
cuuugugguuuucagaacu

SEQ ID NO: 11854 - RNA, 22 nt, Human
cuuuuaccuuaauuucgacaca

SEQ ID NO: 11855 - RNA, 22 nt, Human
cuuuucauuucauggaauacaa

SEQ ID NO: 11856 - RNA, 22 nt, Human
cuuuuccuccaggaagccaagc

SEQ ID NO: 11857 - RNA, 21 nt, Human
cuuuucuagucccagccccgc

SEQ ID NO: 11858 - RNA, 22 nt, Human
cuuuucuuuucuucucuuccca

SEQ ID NO: 11859 - RNA, 22 nt, Human
cuuuugcaauagugacacugau

SEQ ID NO: 11860 - RNA, 22 nt, Human
cuuuuggcaucagccucaggaa

SEQ ID NO: 11861 - RNA, 22 nt, Human
cuuuuucaugggugaugagugg

SEQ ID NO: 11862 - RNA, 22 nt, Human
cuuuuucuuaucuuuuucuaug

SEQ ID NO: 11863 - RNA, 22 nt, Human
cuuuuugccuugaagugaccuc

SEQ ID NO: 11864 - RNA, 22 nt, Human
gaaaaacucagugggggucuuu

SEQ ID NO: 11865 - RNA, 22 nt, Human
gaaaacccuguauguagcguuu

SEQ ID NO: 11866 - RNA, 22 nt, Human
gaaaagaaggcaggagcccaag

SEQ ID NO: 11867 - RNA, 22 nt, Human
gaaaaggaggggaggcagaugg

SEQ ID NO: 11868 - RNA, 22 nt, Human
gaaaaguuuaaccuuguacauu

SEQ ID NO: 11869 - RNA, 22 nt, Human
gaaaauaguucaucacaaugau

SEQ ID NO: 11870 - RNA, 22 nt, Human
gaaaaucaggauggaugugagg

SEQ ID NO: 11871 - RNA, 21 nt, Human
gaaaaucuaaugugacaaugc

SEQ ID NO: 11872 - RNA, 22 nt, Human
gaaaaugcacacauacacaccc

SEQ ID NO: 11873 - RNA, 22 nt, Human
gaaacguuguggaaaauccucu

SEQ ID NO: 11874 - RNA, 22 nt, Human
gaaagagaugucguuugucuuc

SEQ ID NO: 11875 - RNA, 22 nt, Human
gaaagcauucuggaggggcaga

SEQ ID NO: 11876 - RNA, 22 nt, Human
gaaagggggcuuggacacuggc

SEQ ID NO: 11877 - RNA, 22 nt, Human
gaaagugaauguaacauguuau

SEQ ID NO: 11878 - RNA, 22 nt, Human
gaaauagagacaguaagugucu

SEQ ID NO: 11879 - RNA, 22 nt, Human
gaaaucuggugauuuucuguug

SEQ ID NO: 11880 - RNA, 22 nt, Human
gaaaugaaacacacaugcagcu

SEQ ID NO: 11881 - RNA, 22 nt, Human
gaaauguacuuauagggagguu

SEQ ID NO: 11882 - RNA, 22 nt, Human
gaaaugucaagauauguuugga

SEQ ID NO: 11883 - RNA, 22 nt, Human
gaaauuucuuuguuaucuuggu

SEQ ID NO: 11884 - RNA, 22 nt, Human
gaacagauucaucuaguggcua

SEQ ID NO: 11885 - RNA, 20 nt, Human
gaacauaaauaacucuuuac

SEQ ID NO: 11886 - RNA, 22 nt, Human
gaacauuucugcagaugucuga

SEQ ID NO: 11887 - RNA, 22 nt, Human
gaaccauuuaauggagaugcuc

SEQ ID NO: 11888 - RNA, 22 nt, Human
gaaccuggcagcccuauaucug

SEQ ID NO: 11889 - RNA, 22 nt, Human
gaacggccucguuccucggugu

SEQ ID NO: 11890 - RNA, 22 nt, Human
aggcagcagggagggagaaaug

SEQ ID NO: 11891 - RNA, 22 nt, Human
aggcaggagcugugguggugag

SEQ ID NO: 11892 - RNA, 22 nt, Human
aggcagugccuggaccccagcu

SEQ ID NO: 11893 - RNA, 22 nt, Human
aggcaguggagcuggaauaggc

SEQ ID NO: 11894 - RNA, 22 nt, Human
aggcaguggcuuuuguuguguu

SEQ ID NO: 11895 - RNA, 22 nt, Human
aggcagugguguuugcuggugg

SEQ ID NO: 11896 - RNA, 22 nt, Human
aggcaguguguagcuggaagag

SEQ ID NO: 11897 - RNA, 22 nt, Human
aggcaucguguuuuucugcuuu

SEQ ID NO: 11898 - RNA, 22 nt, Human
aggcauuuaaagauguaagacu

SEQ ID NO: 11899 - RNA, 22 nt, Human
aggccacucagggggccaagau

SEQ ID NO: 11900 - RNA, 22 nt, Human
aggccauuucacagguuuugga

SEQ ID NO: 11901 - RNA, 22 nt, Human
aggcccagcaccagcggucuuc

SEQ ID NO: 11902 - RNA, 22 nt, Human
aggccccacaaacucgccuuug

SEQ ID NO: 11903 - RNA, 22 nt, Human
aggcccucucggucccccgccg

SEQ ID NO: 11904 - RNA, 22 nt, Human
aggccgcgguggcgaaggcguu

SEQ ID NO: 11905 - RNA, 22 nt, Human
aggccgguggaggagguggagg

SEQ ID NO: 11906 - RNA, 22 nt, Human
aggccugaggaccagauaaaug

SEQ ID NO: 11907 - RNA, 22 nt, Human
aggccugcccuuggggagccuu

SEQ ID NO: 11908 - RNA, 22 nt, Human
aggcgaagggaccagacgguag

SEQ ID NO: 11909 - RNA, 22 nt, Human
aggcggguuuaggacaaugcuu

SEQ ID NO: 11910 - RNA, 22 nt, Human
aggcuaagugauuagugacaua

SEQ ID NO: 11911 - RNA, 20 nt, Human
aggcuccuccaggaugugug

SEQ ID NO: 11912 - RNA, 22 nt, Human
aggcuccucugggggccccgga

SEQ ID NO: 11913 - RNA, 23 nt, Human
aggcugcagaagaauagggucau

SEQ ID NO: 11914 - RNA, 23 nt, Human
aggcugccacucagggugaggcu

SEQ ID NO: 11915 - RNA, 18 nt, Human
aggcuggggaucacaggg

SEQ ID NO: 11916 - RNA, 22 nt, Human
aggcugucucaccucaggaggg

SEQ ID NO: 11917 - RNA, 22 nt, Human
aggcugucucagccugcuugca

SEQ ID NO: 11918 - RNA, 22 nt, Human
aggcuuaacuacaauuuuugcc

SEQ ID NO: 11919 - RNA, 22 nt, Human
aggcuucauuacagugguucaa

SEQ ID NO: 11920 - RNA, 21 nt, Human
aggcuuggaucuagacaggcc

SEQ ID NO: 11921 - RNA, 22 nt, Human
gaaugacuugcucauucugugu

SEQ ID NO: 11922 - RNA, 22 nt, Human
gaaugcauuuuuuaaaagcaua

SEQ ID NO: 11923 - RNA, 22 nt, Human
gaauggaacauagcaacaucuu

SEQ ID NO: 11924 - RNA, 22 nt, Human
gaaugggaauuauggugggacu

SEQ ID NO: 11925 - RNA, 19 nt, Human
gaauggguucuguagggag

SEQ ID NO: 11926 - RNA, 22 nt, Human
gaaugguuauaugauguuuaaa

SEQ ID NO: 11927 - RNA, 22 nt, Human
gaauguuaaugcacuucuagcu

SEQ ID NO: 11928 - RNA, 22 nt, Human
gaauguuugagugccaugugac

SEQ ID NO: 11929 - RNA, 22 nt, Human
gaauuacagaguuguuaaguca

SEQ ID NO: 11930 - RNA, 22 nt, Human
gaauuacuccaguguguggguu

SEQ ID NO: 11931 - RNA, 16 nt, Human
gaauuccauugcucug

SEQ ID NO: 11932 - RNA, 22 nt, Human
gaauucuaguucuguaucucug

SEQ ID NO: 11933 - RNA, 22 nt, Human
gacaagaagaacggagguuuca

SEQ ID NO: 11934 - RNA, 22 nt, Human
gacaagaugacaucauggcuuc

SEQ ID NO: 11935 - RNA, 22 nt, Human
gacaaguagguuauuuuuagca

SEQ ID NO: 11936 - RNA, 22 nt, Human
gacaauuucucaauauagaaac

SEQ ID NO: 11937 - RNA, 22 nt, Human
gacacaacuucccucccacauu

SEQ ID NO: 11938 - RNA, 22 nt, Human
gacaccuucuacugacuaugga

SEQ ID NO: 11939 - RNA, 22 nt, Human
gacacucauauuaagccuauuu

SEQ ID NO: 11940 - RNA, 22 nt, Human
gacacucuuaauccuaucccug

SEQ ID NO: 11941 - RNA, 22 nt, Human
gacagaccucugcugacuggag

SEQ ID NO: 11942 - RNA, 22 nt, Human
gacagcguaucaauugaacaua

SEQ ID NO: 11943 - RNA, 22 nt, Human
gacagcguguuuugcaugaaca

SEQ ID NO: 11944 - RNA, 22 nt, Human
gacagcuauggaguucacuucu

SEQ ID NO: 11945 - RNA, 22 nt, Human
gacaggaauuaucuaaaguaga

SEQ ID NO: 11946 - RNA, 22 nt, Human
gacagugucccucuggggugga

SEQ ID NO: 11947 - RNA, 20 nt, Human
gacaugagggagcaaagagc

SEQ ID NO: 11948 - RNA, 22 nt, Human
gacauugaauugaauccagauu

SEQ ID NO: 11949 - RNA, 22 nt, Human
gaccacugaaugcacuucuaau

SEQ ID NO: 11950 - RNA, 22 nt, Human
gacccggauguuguacucgagg

SEQ ID NO: 11951 - RNA, 22 nt, Human
gacccucucagacuuccaggca

SEQ ID NO: 11952 - RNA, 22 nt, Human
gacccugaggauucccugcuga

SEQ ID NO: 11953 - RNA, 22 nt, Human
gacccuuugacuugugacauua

SEQ ID NO: 11954 - RNA, 22 nt, Human
gaccgggcucugcugacggucu

SEQ ID NO: 11955 - RNA, 22 nt, Human
gaccucauggaguaagugagug

SEQ ID NO: 11956 - RNA, 22 nt, Human
gaccuccauucugucaugacug

SEQ ID NO: 11957 - RNA, 22 nt, Human
gaccugaccucauuagcaaguu

SEQ ID NO: 11958 - RNA, 22 nt, Human
gaccugguggccauugucccag

SEQ ID NO: 11959 - RNA, 22 nt, Human
gacggagugcgcuugcuguuca

SEQ ID NO: 11960 - RNA, 22 nt, Human
gacuaaggaauagcuaguuguu

SEQ ID NO: 11961 - RNA, 21 nt, Human
gacuacaauauguaaucuaau

SEQ ID NO: 11962 - RNA, 19 nt, Human
gacuccugagaugugaaac

SEQ ID NO: 11963 - RNA, 22 nt, Human
gacuccugccucucuacuucug

SEQ ID NO: 11964 - RNA, 22 nt, Human
gacuccuuaauguggcugaugu

SEQ ID NO: 11965 - RNA, 22 nt, Human
gacucuucucucccaaaugccc

SEQ ID NO: 11966 - RNA, 22 nt, Human
gacugacagugguacuguaauu

SEQ ID NO: 11967 - RNA, 18 nt, Human
gacugccuugaacuauug

SEQ ID NO: 11968 - RNA, 22 nt, Human
gacugggacucaacccaccauu

SEQ ID NO: 11969 - RNA, 22 nt, Human
gacuggggcauuagaguagcuu

SEQ ID NO: 11970 - RNA, 22 nt, Human
gacuuaaaugcuccccucaggg

SEQ ID NO: 11971 - RNA, 20 nt, Human
gacuucaauuucuaucuuuu

SEQ ID NO: 11972 - RNA, 22 nt, Human
gacuugauugguuugucaaguu

SEQ ID NO: 11973 - RNA, 16 nt, Human
gacuuucuacgacucu

SEQ ID NO: 11974 - RNA, 22 nt, Human
gagaaagauuguccuucagggg

SEQ ID NO: 11975 - RNA, 22 nt, Human
gagaaagggagaaaaagaucuu

SEQ ID NO: 11976 - RNA, 22 nt, Human
gagaaauagauucaugguagau

SEQ ID NO: 11977 - RNA, 22 nt, Human
gagaacagauaugaugacuuca

SEQ ID NO: 11978 - RNA, 22 nt, Human
gagaagguggaccugaaggagc

SEQ ID NO: 11979 - RNA, 22 nt, Human
gagaaguagcgucuucccgggg

SEQ ID NO: 11980 - RNA, 22 nt, Human
gagaagugaauaacgaagcagg

SEQ ID NO: 11981 - RNA, 22 nt, Human
gagaagugggggucugggauga

SEQ ID NO: 11982 - RNA, 22 nt, Human
gagaauaauaauaggcauggug

SEQ ID NO: 11983 - RNA, 22 nt, Human
gagaaugagucagagcuggcug

SEQ ID NO: 11984 - RNA, 22 nt, Human
gagaauuauacaugagcuauuu

SEQ ID NO: 11985 - RNA, 22 nt, Human
gagaccuuaagagaugucagcu

SEQ ID NO: 11986 - RNA, 22 nt, Human
gagacugugucugucaagcuag

SEQ ID NO: 11987 - RNA, 22 nt, Human
gagagaggggaagagaagcucu

SEQ ID NO: 11988 - RNA, 22 nt, Human
gagagauacauucccaaccuga

SEQ ID NO: 11989 - RNA, 22 nt, Human
gagagcugucagcguagcaccg

SEQ ID NO: 11990 - RNA, 22 nt, Human
gagaggaagugccugcucccag

SEQ ID NO: 11991 - RNA, 22 nt, Human
gagaggacaggauccggagggc

SEQ ID NO: 11992 - RNA, 22 nt, Human
gagaggcugagcaguccggguu

SEQ ID NO: 11993 - RNA, 20 nt, Human
gagaggguuaggauauuugc

SEQ ID NO: 11994 - RNA, 22 nt, Human
gagauccccagugugucucggc

SEQ ID NO: 11995 - RNA, 22 nt, Human
gagauggauuuuuuugccaguc

SEQ ID NO: 11996 - RNA, 22 nt, Human
gagauuaauuaaaaccuuuaug

SEQ ID NO: 11997 - RNA, 22 nt, Human
gagauuuccauauuuuguaaca

SEQ ID NO: 11998 - RNA, 22 nt, Human
gagcacauguggagagucuggg

SEQ ID NO: 11999 - RNA, 21 nt, Human
aggugaaggcgagggggacag

SEQ ID NO: 12000 - RNA, 22 nt, Human
aggugagaacguggaggggcgg

SEQ ID NO: 12001 - RNA, 22 nt, Human
aggugagaaggacuguugcauu

SEQ ID NO: 12002 - RNA, 18 nt, Human
aggugagaauuuggcuuu

SEQ ID NO: 12003 - RNA, 22 nt, Human
aggugauaugggcuucucugag

SEQ ID NO: 12004 - RNA, 22 nt, Human
aggugauauuauguauuucuau

SEQ ID NO: 12005 - RNA, 22 nt, Human
aggugcauuuacuuggggcccu

SEQ ID NO: 12006 - RNA, 22 nt, Human
aggugcccaaaucuucuguuuu

SEQ ID NO: 12007 - RNA, 21 nt, Human
aggugcccaggauuauuuuuu

SEQ ID NO: 12008 - RNA, 22 nt, Human
agguggcuaugaggaugcaguc

SEQ ID NO: 12009 - RNA, 22 nt, Human
agguggggacuccaccgaugcu

SEQ ID NO: 12010 - RNA, 22 nt, Human
aggugggucgcaggcaucagug

SEQ ID NO: 12011 - RNA, 22 nt, Human
aggugguauuuaaaauuauuug

SEQ ID NO: 12012 - RNA, 22 nt, Human
agguguaauuacucuugcaguu

SEQ ID NO: 12013 - RNA, 22 nt, Human
aggugugcacccggucgcuucc

SEQ ID NO: 12014 - RNA, 16 nt, Human
aggugugugguagaua

SEQ ID NO: 12015 - RNA, 22 nt, Human
agguuagaauauuuuuucaaga

SEQ ID NO: 12016 - RNA, 22 nt, Human
agguuagcuguaugucuguaaa

SEQ ID NO: 12017 - RNA, 22 nt, Human
agguucaucaauaacucagaga

SEQ ID NO: 12018 - RNA, 20 nt, Human
agguugguuuacuagucugu

SEQ ID NO: 12019 - RNA, 22 nt, Human
agguuguaagcuuuauauaaau

SEQ ID NO: 12020 - RNA, 22 nt, Human
agguuguaucauaugaaacugu

SEQ ID NO: 12021 - RNA, 22 nt, Human
agguuuaggaaaacugagaguc

SEQ ID NO: 12022 - RNA, 22 nt, Human
agguuuggccuuggggggaguu

SEQ ID NO: 12023 - RNA, 22 nt, Human
agguuuggguucauugcuggcu

SEQ ID NO: 12024 - RNA, 22 nt, Human
agguuuuagaagcugaagccaa

SEQ ID NO: 12025 - RNA, 22 nt, Human
agguuuuugucauuuucuggua

SEQ ID NO: 12026 - RNA, 22 nt, Human
aguaaaggaaggaagggacagc

SEQ ID NO: 12027 - RNA, 19 nt, Human
aguaaagugguggcauuuu

SEQ ID NO: 12028 - RNA, 22 nt, Human
aguaaaugaaagcaauuuuaga

SEQ ID NO: 12029 - RNA, 22 nt, Human
aguaacuuaagcaauuguguau

SEQ ID NO: 12030 - RNA, 22 nt, Human
aguaagaaagaaugauaggccu

SEQ ID NO: 12031 - RNA, 22 nt, Human
aguaagaacugugggugggguu

SEQ ID NO: 12032 - RNA, 22 nt, Human
aguacuuggaaaaaugcccacu

SEQ ID NO: 12033 - RNA, 22 nt, Human
aguacuuugacuagaggcagcu

SEQ ID NO: 12034 - RNA, 22 nt, Human
gaggcccugagauugcugcccu

SEQ ID NO: 12035 - RNA, 22 nt, Human
gaggcgcgcugcgagggcgcgg

SEQ ID NO: 12036 - RNA, 22 nt, Human
gaggcggugguggcgagaguca

SEQ ID NO: 12037 - RNA, 22 nt, Human
gaggcuaugucuacgcucagcg

SEQ ID NO: 12038 - RNA, 22 nt, Human
gaggcuccgccggggcgggccg

SEQ ID NO: 12039 - RNA, 22 nt, Human
gagggaaauauggguuugguua

SEQ ID NO: 12040 - RNA, 22 nt, Human
gagggagagaugcuggaccggg

SEQ ID NO: 12041 - RNA, 22 nt, Human
gagggaggugacaaggacauag

SEQ ID NO: 12042 - RNA, 22 nt, Human
gagggagugggcccgugggcac

SEQ ID NO: 12043 - RNA, 22 nt, Human
gagggauuuuagugcagcaacu

SEQ ID NO: 12044 - RNA, 22 nt, Human
gaggggaaggagcgaaggcggg

SEQ ID NO: 12045 - RNA, 22 nt, Human
gaggggaaggguguucaauggg

SEQ ID NO: 12046 - RNA, 22 nt, Human
gaggggacugucuggcuccgag

SEQ ID NO: 12047 - RNA, 22 nt, Human
gaggggcaagaaguuggccucu

SEQ ID NO: 12048 - RNA, 22 nt, Human
gaggggcacaguggggccuggg

SEQ ID NO: 12049 - RNA, 22 nt, Human
gaggggcggggcgggaggagag

SEQ ID NO: 12050 - RNA, 22 nt, Human
gaggggcucuugggcaugaagg

SEQ ID NO: 12051 - RNA, 22 nt, Human
gaggggcugggguugacuccaa

SEQ ID NO: 12052 - RNA, 22 nt, Human
gagggggcggccccugugggca

SEQ ID NO: 12053 - RNA, 22 nt, Human
gaggguggagccuccuggaagu

SEQ ID NO: 12054 - RNA, 22 nt, Human
gaggguggggaauagacugcua

SEQ ID NO: 12055 - RNA, 22 nt, Human
gaggguuucagugggacggguu

SEQ ID NO: 12056 - RNA, 22 nt, Human
gagguagaggaaaagauuauca

SEQ ID NO: 12057 - RNA, 22 nt, Human
gagguagcgugcagggcccgaa

SEQ ID NO: 12058 - RNA, 22 nt, Human
gaggucagcaagccaugcuugu

SEQ ID NO: 12059 - RNA, 22 nt, Human
gaggucagugugggggcaaggg

SEQ ID NO: 12060 - RNA, 22 nt, Human
gaggucaugcagcucugaguuc

SEQ ID NO: 12061 - RNA, 22 nt, Human
gaggucauuaaagaaaagaguc

SEQ ID NO: 12062 - RNA, 22 nt, Human
gaggucggaagugaggguaacu

SEQ ID NO: 12063 - RNA, 22 nt, Human
gaggucuugagugacuuagcag

SEQ ID NO: 12064 - RNA, 22 nt, Human
gaggugaacccaggugcuucac

SEQ ID NO: 12065 - RNA, 22 nt, Human
gaggugauuccucccauguaau

SEQ ID NO: 12066 - RNA, 22 nt, Human
gaggugcaggggcccgggcugg

SEQ ID NO: 12067 - RNA, 22 nt, Human
gaggugggaggcgggccugcau

SEQ ID NO: 12068 - RNA, 22 nt, Human
gagguguguuacuaaauuuauc

SEQ ID NO: 12069 - RNA, 22 nt, Human
gagguuauucuucuaucaguau

SEQ ID NO: 12070 - RNA, 22 nt, Human
gagguucacgcagggaggggac

SEQ ID NO: 12071 - RNA, 22 nt, Human
gagguuggagggcugcccugca

SEQ ID NO: 12072 - RNA, 22 nt, Human
gagguuggagggcuggccugca

SEQ ID NO: 12073 - RNA, 19 nt, Human
gaguaaaacuagagagaaa

SEQ ID NO: 12074 - RNA, 22 nt, Human
gaguaaaagaugaggcaguaga

SEQ ID NO: 12075 - RNA, 22 nt, Human
gaguaaacagccuucucccagc

SEQ ID NO: 12076 - RNA, 19 nt, Human
gaguacuuuacaaguuuuc

SEQ ID NO: 12077 - RNA, 22 nt, Human
gaguagaacagauagucaagaa

SEQ ID NO: 12078 - RNA, 22 nt, Human
gaguagcaguucauccacaagc

SEQ ID NO: 12079 - RNA, 22 nt, Human
gaguaucagauuggaguccuca

SEQ ID NO: 12080 - RNA, 22 nt, Human
gaguauuacuaaaauucgccua

SEQ ID NO: 12081 - RNA, 22 nt, Human
gaguauuuaccacuaaaugguu

SEQ ID NO: 12082 - RNA, 22 nt, Human
gagucaauucaccuuggugcuu

SEQ ID NO: 12083 - RNA, 22 nt, Human
gagucaguuguugcaccacuag

SEQ ID NO: 12084 - RNA, 22 nt, Human
gagucaucucuagaaugaugau

SEQ ID NO: 12085 - RNA, 22 nt, Human
gagugaucuguaggcagcaugg

SEQ ID NO: 12086 - RNA, 22 nt, Human
gaguggcaaagagaacaaagau

SEQ ID NO: 12087 - RNA, 22 nt, Human
gaguggccugccccagccaggc

SEQ ID NO: 12088 - RNA, 22 nt, Human
gaguggucacuaauuuccuuaa

SEQ ID NO: 12089 - RNA, 22 nt, Human
gaguucaaagaucuaggaagag

SEQ ID NO: 12090 - RNA, 22 nt, Human
gaguucuagauguauuauuaau

SEQ ID NO: 12091 - RNA, 22 nt, Human
gaguugauggccauugaguuga

SEQ ID NO: 12092 - RNA, 22 nt, Human
gaguuggggcugcguguuucca

SEQ ID NO: 12093 - RNA, 22 nt, Human
gaguugucggaggaagggggcg

SEQ ID NO: 12094 - RNA, 22 nt, Human
gauaaauaguguuuggggacau

SEQ ID NO: 12095 - RNA, 22 nt, Human
gauaagugauucugauucacau

SEQ ID NO: 12096 - RNA, 22 nt, Human
gauaaugcuuuggucagacaug

SEQ ID NO: 12097 - RNA, 22 nt, Human
gauacaugucacaaguugugca

SEQ ID NO: 12098 - RNA, 22 nt, Human
gauaccugccaagcugcacuca

SEQ ID NO: 12099 - RNA, 22 nt, Human
gauacuugaggagaucaccaca

SEQ ID NO: 12100 - RNA, 22 nt, Human
gauacuuuguggaauccuggau

SEQ ID NO: 12101 - RNA, 22 nt, Human
gauagaaagagaaucagaacuu

SEQ ID NO: 12102 - RNA, 20 nt, Human
gauagcacaaagagaauggg

SEQ ID NO: 12103 - RNA, 22 nt, Human
gauagcacacuuguugcuucug

SEQ ID NO: 12104 - RNA, 22 nt, Human
gauaggaggaugggaccuguga

SEQ ID NO: 12105 - RNA, 22 nt, Human
gauagguacuguaagguccucu

SEQ ID NO: 12106 - RNA, 22 nt, Human
gauauauuucaaauucuuuugc

SEQ ID NO: 12107 - RNA, 22 nt, Human
gauauggaaacuugauguugug

SEQ ID NO: 12108 - RNA, 22 nt, Human
agugucagcagcuucauugucu

SEQ ID NO: 12109 - RNA, 22 nt, Human
agugucugcgggcagaggagcg

SEQ ID NO: 12110 - RNA, 22 nt, Human
agugucuuuagucgcugagcaa

SEQ ID NO: 12111 - RNA, 22 nt, Human
agugugaguuacaaagugugaa

SEQ ID NO: 12112 - RNA, 22 nt, Human
aguguucaauuugagcucaaag

SEQ ID NO: 12113 - RNA, 23 nt, Human
aguguucagcauguaguaaauac

SEQ ID NO: 12114 - RNA, 20 nt, Human
aguguugaacuacacuuccc

SEQ ID NO: 12115 - RNA, 22 nt, Human
aguguuugggagagggugugag

SEQ ID NO: 12116 - RNA, 22 nt, Human
aguguuuuaugugccaguuuaa

SEQ ID NO: 12117 - RNA, 22 nt, Human
aguuaacuugugguuuggcugu

SEQ ID NO: 12118 - RNA, 22 nt, Human
aguuaaucuuguauuaaugguu

SEQ ID NO: 12119 - RNA, 22 nt, Human
aguuaauuauagugcuuaauau

SEQ ID NO: 12120 - RNA, 22 nt, Human
aguuacuauuacuuauuauuau

SEQ ID NO: 12121 - RNA, 22 nt, Human
aguuaggaaauaaguugaguuu

SEQ ID NO: 12122 - RNA, 22 nt, Human
aguuaguagacuuuuccauuua

SEQ ID NO: 12123 - RNA, 22 nt, Human
aguuaucuauaaaucccugagg

SEQ ID NO: 12124 - RNA, 22 nt, Human
aguuaugcaagcaaguaccacu

SEQ ID NO: 12125 - RNA, 22 nt, Human
aguuauggguauguauuauaau

SEQ ID NO: 12126 - RNA, 22 nt, Human
aguucaauuguuuuguaaaagu

SEQ ID NO: 12127 - RNA, 20 nt, Human
aguucagguuauuuuccucc

SEQ ID NO: 12128 - RNA, 22 nt, Human
aguucaugcuuagaucucauuu

SEQ ID NO: 12129 - RNA, 22 nt, Human
aguucauucuagcugggagcag

SEQ ID NO: 12130 - RNA, 22 nt, Human
aguuccaaauuugcaagaaaau

SEQ ID NO: 12131 - RNA, 22 nt, Human
aguuccucagaagggccuggga

SEQ ID NO: 12132 - RNA, 22 nt, Human
aguucggauuguaauagauaau

SEQ ID NO: 12133 - RNA, 22 nt, Human
aguucugacucugaaucuggga

SEQ ID NO: 12134 - RNA, 22 nt, Human
aguucuggcccugaaacaggga

SEQ ID NO: 12135 - RNA, 22 nt, Human
aguucuuugcucccugcuuuuu

SEQ ID NO: 12136 - RNA, 22 nt, Human
aguugcagguucacguaucuug

SEQ ID NO: 12137 - RNA, 22 nt, Human
aguugcugccagguccugggag

SEQ ID NO: 12138 - RNA, 22 nt, Human
aguugggaaaugcugcaguagu

SEQ ID NO: 12139 - RNA, 22 nt, Human
aguugguauuuacugcaguugg

SEQ ID NO: 12140 - RNA, 22 nt, Human
aguugguucgucucgccuugag

SEQ ID NO: 12141 - RNA, 22 nt, Human
aguuguucucagcagaagaacu

SEQ ID NO: 12142 - RNA, 22 nt, Human
aguuguuuuucuuagauuuuag

SEQ ID NO: 12143 - RNA, 22 nt, Human
aguuuaaauuguucuaucagaa

SEQ ID NO: 12144 - RNA, 23 nt, Human
aguuuacguauucauucuuacuc

SEQ ID NO: 12145 - RNA, 22 nt, Human
aguuucuugaagacugauguuu

SEQ ID NO: 12146 - RNA, 22 nt, Human
aguuugauuugucuaucuucau

SEQ ID NO: 12147 - RNA, 22 nt, Human
gauuggucacacaauaguauau

SEQ ID NO: 12148 - RNA, 22 nt, Human
gauuguagacauauuagacugc

SEQ ID NO: 12149 - RNA, 22 nt, Human
gauuucauaaaacgagaaacuc

SEQ ID NO: 12150 - RNA, 22 nt, Human
gauuucuucauuuaaaaauauu

SEQ ID NO: 12151 - RNA, 22 nt, Human
gauuugucuauauucaaauaug

SEQ ID NO: 12152 - RNA, 21 nt, Human
gauuuuagggcagccaaacac

SEQ ID NO: 12153 - RNA, 22 nt, Human
gauuuucauuauagcuaguuuc

SEQ ID NO: 12154 - RNA, 22 nt, Human
gauuuugaaccuuauuuggaaa

SEQ ID NO: 12155 - RNA, 22 nt, Human
gauuuugcuuuagugaaggaag

SEQ ID NO: 12156 - RNA, 22 nt, Human
gcaaagaauugauucauuuugc

SEQ ID NO: 12157 - RNA, 22 nt, Human
gcaaaugacuuagucacuccag

SEQ ID NO: 12158 - RNA, 21 nt, Human
gcaaccagaccacagggcagu

SEQ ID NO: 12159 - RNA, 22 nt, Human
gcaacccugggucaugguugac

SEQ ID NO: 12160 - RNA, 22 nt, Human
gcaacguauauggguaaggaua

SEQ ID NO: 12161 - RNA, 22 nt, Human
gcaacuccuaggcgaggccuuc

SEQ ID NO: 12162 - RNA, 22 nt, Human
gcaagagaagaaagaauaguuu

SEQ ID NO: 12163 - RNA, 22 nt, Human
gcaauuguauugucaagacaug

SEQ ID NO: 12164 - RNA, 22 nt, Human
gcacaaaagguacuucauguag

SEQ ID NO: 12165 - RNA, 21 nt, Human
gcacaacucucacauucuucu

SEQ ID NO: 12166 - RNA, 22 nt, Human
gcacacaaaaauauguguugaa

SEQ ID NO: 12167 - RNA, 19 nt, Human
gcacacccugcaccaccau

SEQ ID NO: 12168 - RNA, 22 nt, Human
gcacagucaacacuuauucacc

SEQ ID NO: 12169 - RNA, 22 nt, Human
gcacauauuuagaucuugaugu

SEQ ID NO: 12170 - RNA, 22 nt, Human
gcacccagggcaggaagugagg

SEQ ID NO: 12171 - RNA, 22 nt, Human
gcacggucagggugggggagug

SEQ ID NO: 12172 - RNA, 22 nt, Human
gcacucugggucaucugcugcc

SEQ ID NO: 12173 - RNA, 23 nt, Human
gcacuguuugaggagcacugugc

SEQ ID NO: 12174 - RNA, 21 nt, Human
gcagaaagugauuugcuauuc

SEQ ID NO: 12175 - RNA, 21 nt, Human
gcagaacuaggacuugaacau

SEQ ID NO: 12176 - RNA, 22 nt, Human
gcagaaguauuguacgguggga

SEQ ID NO: 12177 - RNA, 22 nt, Human
gcagacuaacuuuugucagccu

SEQ ID NO: 12178 - RNA, 22 nt, Human
gcagagcugucuaagucacuuc

SEQ ID NO: 12179 - RNA, 22 nt, Human
gcagaggcaaagucuggaugac

SEQ ID NO: 12180 - RNA, 22 nt, Human
gcagauaguaggagcuaaucuu

SEQ ID NO: 12181 - RNA, 22 nt, Human
gcagauccaaauauaguucuug

SEQ ID NO: 12182 - RNA, 22 nt, Human
gcagaugagagugugaucuggg

SEQ ID NO: 12183 - RNA, 22 nt, Human
gcagauuggguacauaaacagu

SEQ ID NO: 12184 - RNA, 22 nt, Human
gcagcaauaaaacugaaggugu

SEQ ID NO: 12185 - RNA, 22 nt, Human
gcagcaaucuucacagugucau

SEQ ID NO: 12186 - RNA, 22 nt, Human
gcagcagugugggcugaaccua

SEQ ID NO: 12187 - RNA, 21 nt, Human
gcagcaugagaaagccccaaa

SEQ ID NO: 12188 - RNA, 22 nt, Human
gcagcauuaccaagacauggca

SEQ ID NO: 12189 - RNA, 22 nt, Human
gcagccaauggcgagccccaca

SEQ ID NO: 12190 - RNA, 22 nt, Human
gcagccaugcacgucauuauga

SEQ ID NO: 12191 - RNA, 22 nt, Human
gcagccauuugcaucuaauuaa

SEQ ID NO: 12192 - RNA, 22 nt, Human
gcagccugaguuuagcucgucg

SEQ ID NO: 12193 - RNA, 22 nt, Human
gcagcgcugagaugauuuguug

SEQ ID NO: 12194 - RNA, 22 nt, Human
gcagcguguggcuaauggcucu

SEQ ID NO: 12195 - RNA, 21 nt, Human
gcagcucaggauauagacuug

SEQ ID NO: 12196 - RNA, 20 nt, Human
gcagcugacccuagugcuug

SEQ ID NO: 12197 - RNA, 22 nt, Human
gcaggaagauugcagaaggcug

SEQ ID NO: 12198 - RNA, 22 nt, Human
gcaggacugauggagcauaugu

SEQ ID NO: 12199 - RNA, 22 nt, Human
gcaggcagauccagaagcacua

SEQ ID NO: 12200 - RNA, 22 nt, Human
gcaggccgauuuguuagaaguc

SEQ ID NO: 12201 - RNA, 22 nt, Human
gcaggccuccccugcuggagcu

SEQ ID NO: 12202 - RNA, 22 nt, Human
gcagggcucagccgcucccacc

SEQ ID NO: 12203 - RNA, 22 nt, Human
gcaggguaggugacagguaguc

SEQ ID NO: 12204 - RNA, 22 nt, Human
gcaggucacagcugauuggcca

SEQ ID NO: 12205 - RNA, 22 nt, Human
gcagguccgagagggucgggua

SEQ ID NO: 12206 - RNA, 22 nt, Human
gcagguggaagcagcagacuca

SEQ ID NO: 12207 - RNA, 22 nt, Human
gcagguuguuuaaauuaggauu

SEQ ID NO: 12208 - RNA, 22 nt, Human
gcaguaaauugagagucauguu

SEQ ID NO: 12209 - RNA, 22 nt, Human
gcaguaaggaggggaaggguuu

SEQ ID NO: 12210 - RNA, 22 nt, Human
gcaguagauccagcagccugca

SEQ ID NO: 12211 - RNA, 22 nt, Human
gcaguauuguguguggucaugg

SEQ ID NO: 12212 - RNA, 22 nt, Human
gcaguccuguagcgacuuuuuu

SEQ ID NO: 12213 - RNA, 22 nt, Human
gcaguccuuaggagaggaagua

SEQ ID NO: 12214 - RNA, 22 nt, Human
gcaguccuugcuguguaauaaa

SEQ ID NO: 12215 - RNA, 22 nt, Human
gcagugcauggaagggggugug

SEQ ID NO: 12216 - RNA, 22 nt, Human
gcagugccauguggaggaucuc

SEQ ID NO: 12217 - RNA, 22 nt, Human
auauuuguacagcuugugaguu

SEQ ID NO: 12218 - RNA, 22 nt, Human
auauuugucuguuuuaguggca

SEQ ID NO: 12219 - RNA, 22 nt, Human
auauuuguuuggcagaguucag

SEQ ID NO: 12220 - RNA, 22 nt, Human
auauuuuacagcucucguugaa

SEQ ID NO: 12221 - RNA, 22 nt, Human
aucaaaauguguagucuugauc

SEQ ID NO: 12222 - RNA, 22 nt, Human
aucaaaauuuucagauacuaca

SEQ ID NO: 12223 - RNA, 22 nt, Human
aucaacacuguuggcggggacc

SEQ ID NO: 12224 - RNA, 20 nt, Human
aucaagugucuugccaggca

SEQ ID NO: 12225 - RNA, 22 nt, Human
aucacuagaguuacauugccag

SEQ ID NO: 12226 - RNA, 22 nt, Human
aucagaagaaauggaugugacu

SEQ ID NO: 12227 - RNA, 21 nt, Human
aucagaggacaucucagggcc

SEQ ID NO: 12228 - RNA, 19 nt, Human
aucagcaguuuugccugga

SEQ ID NO: 12229 - RNA, 20 nt, Human
aucaggagucgcggggagag

SEQ ID NO: 12230 - RNA, 22 nt, Human
aucaucccuuucucccagugaa

SEQ ID NO: 12231 - RNA, 22 nt, Human
aucaugcugacacaguuuaucu

SEQ ID NO: 12232 - RNA, 22 nt, Human
aucaugggauagugggacgagc

SEQ ID NO: 12233 - RNA, 22 nt, Human
aucauguauaugcagcguuugu

SEQ ID NO: 12234 - RNA, 22 nt, Human
aucauguauauuuuugcuauua

SEQ ID NO: 12235 - RNA, 20 nt, Human
aucaugugcacugcugacag

SEQ ID NO: 12236 - RNA, 22 nt, Human
aucauugaaaauuuaugcauuu

SEQ ID NO: 12237 - RNA, 23 nt, Human
aucauuucuuagugagucccugc

SEQ ID NO: 12238 - RNA, 23 nt, Human
auccacauucuaguccuuuaugc

SEQ ID NO: 12239 - RNA, 22 nt, Human
auccaggggucugaauggauau

SEQ ID NO: 12240 - RNA, 22 nt, Human
auccaggguuggggucacgagu

SEQ ID NO: 12241 - RNA, 22 nt, Human
aucccacaccccuacaacauau

SEQ ID NO: 12242 - RNA, 22 nt, Human
auccgugagcgagcgagcaccc

SEQ ID NO: 12243 - RNA, 22 nt, Human
auccuaagacgugugguuugag

SEQ ID NO: 12244 - RNA, 22 nt, Human
auccuagacuccuaugccccaa

SEQ ID NO: 12245 - RNA, 22 nt, Human
auccuccuuugcccugagauca

SEQ ID NO: 12246 - RNA, 19 nt, Human
auccucucuagaaguggga

SEQ ID NO: 12247 - RNA, 22 nt, Human
auccucucuuaugaacaacugu

SEQ ID NO: 12248 - RNA, 22 nt, Human
auccugugggguauugcugcau

SEQ ID NO: 12249 - RNA, 22 nt, Human
auccuucaaaaggaauagcagg

SEQ ID NO: 12250 - RNA, 22 nt, Human
auccuugacuguagugauauua

SEQ ID NO: 12251 - RNA, 19 nt, Human
auccuugcucacucacuga

SEQ ID NO: 12252 - RNA, 18 nt, Human
auccuuugaucaucuguc

SEQ ID NO: 12253 - RNA, 22 nt, Human
aucgaguggugagaacacaaca

SEQ ID NO: 12254 - RNA, 22 nt, Human
aucgcagaguggaaauugauga

SEQ ID NO: 12255 - RNA, 22 nt, Human
aucggggaaugaccuuuucauu

SEQ ID NO: 12256 - RNA, 22 nt, Human
aucggucuccuauaauucaaac

SEQ ID NO: 12257 - RNA, 22 nt, Human
aucguggcacgucgccgcagcg

SEQ ID NO: 12258 - RNA, 22 nt, Human
aucguuaugauagagaaagaga

SEQ ID NO: 12259 - RNA, 22 nt, Human
aucuaaaacuacgaauacuacc

SEQ ID NO: 12260 - RNA, 22 nt, Human
gccauggugagccaccuggugg

SEQ ID NO: 12261 - RNA, 22 nt, Human
gccauguuuugguaaauaccau

SEQ ID NO: 12262 - RNA, 20 nt, Human
gcccacccgcacucccgccg

SEQ ID NO: 12263 - RNA, 22 nt, Human
gcccagaagguagcgaguaguc

SEQ ID NO: 12264 - RNA, 22 nt, Human
gcccagacaucuguugggaccu

SEQ ID NO: 12265 - RNA, 23 nt, Human
gcccagaggccccuggccugagc

SEQ ID NO: 12266 - RNA, 22 nt, Human
gccccaaccccuccuuggucua

SEQ ID NO: 12267 - RNA, 15 nt, Human
gccccaggaaucaaa

SEQ ID NO: 12268 - RNA, 22 nt, Human
gccccaggggaggugcccugca

SEQ ID NO: 12269 - RNA, 22 nt, Human
gcccccagcuggcuugaggauu

SEQ ID NO: 12270 - RNA, 22 nt, Human
gccccgcgcgcguagcgccgcu

SEQ ID NO: 12271 - RNA, 22 nt, Human
gcccgccaacuugccagcggug

SEQ ID NO: 12272 - RNA, 22 nt, Human
gcccucugccacaggacgccag

SEQ ID NO: 12273 - RNA, 22 nt, Human
gcccugaagagguagagaauuu

SEQ ID NO: 12274 - RNA, 22 nt, Human
gcccugccauugaucggcccag

SEQ ID NO: 12275 - RNA, 22 nt, Human
gcccuggucguggagggcaaca

SEQ ID NO: 12276 - RNA, 22 nt, Human
gcccugucagcucucauggaca

SEQ ID NO: 12277 - RNA, 22 nt, Human
gcccuguguguuugcacugauu

SEQ ID NO: 12278 - RNA, 22 nt, Human
gcccuguuauagucugaggccu

SEQ ID NO: 12279 - RNA, 20 nt, Human
gcccuucccccuccgcgagc

SEQ ID NO: 12280 - RNA, 22 nt, Human
gcccuuuuaucaacuccuagaa

SEQ ID NO: 12281 - RNA, 22 nt, Human
gccgcagauucugagacgugua

SEQ ID NO: 12282 - RNA, 18 nt, Human
gccgccuugcucgugaac

SEQ ID NO: 12283 - RNA, 22 nt, Human
gccgcguggcagucuuggugac

SEQ ID NO: 12284 - RNA, 22 nt, Human
gccggagagccaacaccacgga

SEQ ID NO: 12285 - RNA, 22 nt, Human
gccggcccugcgcggggcggaa

SEQ ID NO: 12286 - RNA, 22 nt, Human
gccggcugggggcggagggcag

SEQ ID NO: 12287 - RNA, 22 nt, Human
gccgggagugcagcgggcgcgc

SEQ ID NO: 12288 - RNA, 22 nt, Human
gccggguguuccugggaagaug

SEQ ID NO: 12289 - RNA, 21 nt, Human
gccgugcgccuccaggcgcgc

SEQ ID NO: 12290 - RNA, 22 nt, Human
gccguuccuacucucucugugu

SEQ ID NO: 12291 - RNA, 22 nt, Human
gccuagggacuuugguuuagau

SEQ ID NO: 12292 - RNA, 22 nt, Human
gccucaaaaguguuguagaggg

SEQ ID NO: 12293 - RNA, 22 nt, Human
gccuccgccuuccugucucccc

SEQ ID NO: 12294 - RNA, 22 nt, Human
gccuccuccaucauugcuucau

SEQ ID NO: 12295 - RNA, 22 nt, Human
gccuccuuccgaccucaguccu

SEQ ID NO: 12296 - RNA, 22 nt, Human
gccucucuggcaaagcggugau

SEQ ID NO: 12297 - RNA, 22 nt, Human
gccugcaaagacuuccuucucu

SEQ ID NO: 12298 - RNA, 18 nt, Human
gccugccagccgagggac

SEQ ID NO: 12299 - RNA, 22 nt, Human
gccugccucugacuggggcuga

SEQ ID NO: 12300 - RNA, 22 nt, Human
gccugcugggcucuuccugcug

SEQ ID NO: 12301 - RNA, 22 nt, Human
gccugcuugaaagcacuuucug

SEQ ID NO: 12302 - RNA, 22 nt, Human
gccuggaaugcaaugugacgaa

SEQ ID NO: 12303 - RNA, 22 nt, Human
gccuggccaaucgccgucuagg

SEQ ID NO: 12304 - RNA, 22 nt, Human
gccugggcuuccgggacccggg

SEQ ID NO: 12305 - RNA, 22 nt, Human
gccuggggaacuugauccuguc

SEQ ID NO: 12306 - RNA, 22 nt, Human
gccugggguuugcggggcugca

SEQ ID NO: 12307 - RNA, 22 nt, Human
gccugggugcugugggguggag

SEQ ID NO: 12308 - RNA, 22 nt, Human
gccuucauuggaaucuagcuuc

SEQ ID NO: 12309 - RNA, 22 nt, Human
gccuuggacuaccacucccaca

SEQ ID NO: 12310 - RNA, 22 nt, Human
gccuuuuaaggcagagggagau

SEQ ID NO: 12311 - RNA, 22 nt, Human
gcgcagugagguuaagaaugca

SEQ ID NO: 12312 - RNA, 20 nt, Human
gcgcaguuccgggcgcgucu

SEQ ID NO: 12313 - RNA, 21 nt, Human
gcgcgcucgugcucgacgcgc

SEQ ID NO: 12314 - RNA, 22 nt, Human
gcgcgcucugcgaggacacgcu

SEQ ID NO: 12315 - RNA, 22 nt, Human
gcgcggcgcggguccucggccu

SEQ ID NO: 12316 - RNA, 22 nt, Human
gcgcugagcuuuucuuauugaa

SEQ ID NO: 12317 - RNA, 22 nt, Human
gcggcccggguccccagcagca

SEQ ID NO: 12318 - RNA, 22 nt, Human
gcggccucuuugcugccucagg

SEQ ID NO: 12319 - RNA, 19 nt, Human
gcggcggugccggcuggga

SEQ ID NO: 12320 - RNA, 22 nt, Human
gcgggcgcuguggccccggccu

SEQ ID NO: 12321 - RNA, 23 nt, Human
gcgggcggagccgggaggcgggg

SEQ ID NO: 12322 - RNA, 19 nt, Human
gcgggcucuccaccccauc

SEQ ID NO: 12323 - RNA, 22 nt, Human
gcgggugagauucgagagaugg

SEQ ID NO: 12324 - RNA, 22 nt, Human
gcggucuaggaccucagugugu

SEQ ID NO: 12325 - RNA, 22 nt, Human
gcgguggcuacuaaaguucgaa

SEQ ID NO: 12326 - RNA, 22 nt, Human
augcagcggucagaggaacuca

SEQ ID NO: 12327 - RNA, 22 nt, Human
augcauaucuccuaucuccuca

SEQ ID NO: 12328 - RNA, 22 nt, Human
augcaugaucccgguaugugaa

SEQ ID NO: 12329 - RNA, 22 nt, Human
augccaccucuucugauuccag

SEQ ID NO: 12330 - RNA, 22 nt, Human
augccacuguuuaugucacuua

SEQ ID NO: 12331 - RNA, 22 nt, Human
augcccagaacccccuggaugg

SEQ ID NO: 12332 - RNA, 22 nt, Human
augccgggguggcuccagcacc

SEQ ID NO: 12333 - RNA, 22 nt, Human
augccucuugagagccagugcu

SEQ ID NO: 12334 - RNA, 22 nt, Human
augcgcugugcacacucuuaac

SEQ ID NO: 12335 - RNA, 22 nt, Human
augcuaaucaaacuuucugcag

SEQ ID NO: 12336 - RNA, 22 nt, Human
augcuacauuuugguuuauaaa

SEQ ID NO: 12337 - RNA, 22 nt, Human
augcucuggucucuucuuuccu

SEQ ID NO: 12338 - RNA, 18 nt, Human
augcugacacaaugugga

SEQ ID NO: 12339 - RNA, 22 nt, Human
augcugccuaaagcuacuuaca

SEQ ID NO: 12340 - RNA, 22 nt, Human
augcugccuccucuucagccgc

SEQ ID NO: 12341 - RNA, 22 nt, Human
augcugcuccuuuucaggcauu

SEQ ID NO: 12342 - RNA, 22 nt, Human
augcuugaaaguuauuucauuu

SEQ ID NO: 12343 - RNA, 22 nt, Human
augcuugcccauguuucugaag

SEQ ID NO: 12344 - RNA, 22 nt, Human
auggaaggggagguagggagga

SEQ ID NO: 12345 - RNA, 22 nt, Human
auggaauuuaaauuuugguguc

SEQ ID NO: 12346 - RNA, 22 nt, Human
auggacagcucuuaugugggca

SEQ ID NO: 12347 - RNA, 22 nt, Human
auggacguuuguguauuaugua

SEQ ID NO: 12348 - RNA, 22 nt, Human
auggagggguuguugcuugagu

SEQ ID NO: 12349 - RNA, 22 nt, Human
auggagugggaggacaugaagg

SEQ ID NO: 12350 - RNA, 22 nt, Human
auggcaucuucgguuggacugc

SEQ ID NO: 12351 - RNA, 22 nt, Human
auggccguggccagggucaggg

SEQ ID NO: 12352 - RNA, 22 nt, Human
auggccugaagcuaaccccccu

SEQ ID NO: 12353 - RNA, 20 nt, Human
auggcgagucagcacaaaac

SEQ ID NO: 12354 - RNA, 22 nt, Human
auggcucugcugggcaaagcaa

SEQ ID NO: 12355 - RNA, 22 nt, Human
auggcuguguuguuccucugaa

SEQ ID NO: 12356 - RNA, 19 nt, Human
augggaagcggccagcgga

SEQ ID NO: 12357 - RNA, 22 nt, Human
augggaauggauugagugggug

SEQ ID NO: 12358 - RNA, 22 nt, Human
augggagggagcagugaguguu

SEQ ID NO: 12359 - RNA, 22 nt, Human
augggagggugaggaggcagcu

SEQ ID NO: 12360 - RNA, 22 nt, Human
augggcggugcauuugcacagu

SEQ ID NO: 12361 - RNA, 22 nt, Human
augggcuuuacccucagagcuu

SEQ ID NO: 12362 - RNA, 18 nt, Human
augggggaggaggaaagg

SEQ ID NO: 12363 - RNA, 22 nt, Human
augggggccagggacccuggca

SEQ ID NO: 12364 - RNA, 22 nt, Human
augggugggagugaaggggcuc

SEQ ID NO: 12365 - RNA, 22 nt, Human
auggucugcucagucucuugac

SEQ ID NO: 12366 - RNA, 22 nt, Human
auggugaaaugauuugauguca

SEQ ID NO: 12367 - RNA, 22 nt, Human
auggugaugaugaugaugauaa

SEQ ID NO: 12368 - RNA, 22 nt, Human
augguguaagacuguauuucuu

SEQ ID NO: 12369 - RNA, 22 nt, Human
augguguaggugaagagaacau

SEQ ID NO: 12370 - RNA, 22 nt, Human
augguuagcuauuuuucucuca

SEQ ID NO: 12371 - RNA, 22 nt, Human
augguugugaaagagcaaagac

SEQ ID NO: 12372 - RNA, 22 nt, Human
augguuuuguccucuuugguuc

SEQ ID NO: 12373 - RNA, 22 nt, Human
gcugagcagcgaaggcacaugc

SEQ ID NO: 12374 - RNA, 22 nt, Human
gcugcacgguccuggcaccacg

SEQ ID NO: 12375 - RNA, 22 nt, Human
gcugcaggaggugguagggucu

SEQ ID NO: 12376 - RNA, 23 nt, Human
gcugcagugaauguuguuguugu

SEQ ID NO: 12377 - RNA, 22 nt, Human
gcugcccucccagggcaagcuu

SEQ ID NO: 12378 - RNA, 22 nt, Human
gcugccgcugcggggcgcgggc

SEQ ID NO: 12379 - RNA, 22 nt, Human
gcugccucacuagauagguaug

SEQ ID NO: 12380 - RNA, 22 nt, Human
gcugcgccgggagccggggccg

SEQ ID NO: 12381 - RNA, 22 nt, Human
gcugcgcgcagccggcgccgag

SEQ ID NO: 12382 - RNA, 22 nt, Human
gcugcgcugggacgccaccaac

SEQ ID NO: 12383 - RNA, 22 nt, Human
gcugcucaaaaaaacacuagcu

SEQ ID NO: 12384 - RNA, 22 nt, Human
gcugcuuagaaccauauuuaaa

SEQ ID NO: 12385 - RNA, 22 nt, Human
gcugcuucgcugcacacccgag

SEQ ID NO: 12386 - RNA, 22 nt, Human
gcuggaaauaacuuguguagaa

SEQ ID NO: 12387 - RNA, 22 nt, Human
gcuggaagggccagcuuucagg

SEQ ID NO: 12388 - RNA, 22 nt, Human
gcuggauaaggaucaguuucuu

SEQ ID NO: 12389 - RNA, 22 nt, Human
gcuggauuuaggguucccuccu

SEQ ID NO: 12390 - RNA, 22 nt, Human
gcuggccugcgagggcaggcug

SEQ ID NO: 12391 - RNA, 22 nt, Human
gcugggacacacagucuucuuu

SEQ ID NO: 12392 - RNA, 22 nt, Human
gcugggagaggcagcuuucgga

SEQ ID NO: 12393 - RNA, 19 nt, Human
gcugggauaggauguauuu

SEQ ID NO: 12394 - RNA, 22 nt, Human
gcugggccucuuacuucuuacg

SEQ ID NO: 12395 - RNA, 22 nt, Human
gcuggguaguucuuguuuggga

SEQ ID NO: 12396 - RNA, 22 nt, Human
gcugguggcagagcuccgcggc

SEQ ID NO: 12397 - RNA, 22 nt, Human
gcugguuacuucauuagguccu

SEQ ID NO: 12398 - RNA, 22 nt, Human
gcuguaacuuuuucauuuucaa

SEQ ID NO: 12399 - RNA, 22 nt, Human
gcuguauaucuuuugaagugau

SEQ ID NO: 12400 - RNA, 22 nt, Human
gcugucaggaacaugccuuggu

SEQ ID NO: 12401 - RNA, 22 nt, Human
gcugucauggacaugucuguuu

SEQ ID NO: 12402 - RNA, 20 nt, Human
gcugugccaugacccucgag

SEQ ID NO: 12403 - RNA, 22 nt, Human
gcuguggaaaaugggucuccaa

SEQ ID NO: 12404 - RNA, 22 nt, Human
gcuguggacacagcucucuuca

SEQ ID NO: 12405 - RNA, 22 nt, Human
gcuguggagaagcugccuaugg

SEQ ID NO: 12406 - RNA, 22 nt, Human
gcuguggguuccuccccugucc

SEQ ID NO: 12407 - RNA, 22 nt, Human
gcuguguaugaugcaggcaccu

SEQ ID NO: 12408 - RNA, 22 nt, Human
gcuguguucauccugcccaggu

SEQ ID NO: 12409 - RNA, 22 nt, Human
gcuguuucuuuggcaaacugau

SEQ ID NO: 12410 - RNA, 22 nt, Human
gcuuacagauaaugaggagacu

SEQ ID NO: 12411 - RNA, 22 nt, Human
gcuuagaaucagaccuggguca

SEQ ID NO: 12412 - RNA, 22 nt, Human
gcuuagaugcugucauucacca

SEQ ID NO: 12413 - RNA, 22 nt, Human
gcuuaugauguuuacauaaaag

SEQ ID NO: 12414 - RNA, 22 nt, Human
gcuuauuagguuauuucaagga

SEQ ID NO: 12415 - RNA, 21 nt, Human
gcuucaauucauccaccucuc

SEQ ID NO: 12416 - RNA, 22 nt, Human
gcuucacucugagacuuggagc

SEQ ID NO: 12417 - RNA, 22 nt, Human
gcuuccgacagagaucacauug

SEQ ID NO: 12418 - RNA, 22 nt, Human
gcuuccucaccucaaauuuccg

SEQ ID NO: 12419 - RNA, 22 nt, Human
gcuuccuuagcuuaccaaguau

SEQ ID NO: 12420 - RNA, 22 nt, Human
gcuucucacccuuacuaucucu

SEQ ID NO: 12421 - RNA, 20 nt, Human
gcuugaauuugauggccaga

SEQ ID NO: 12422 - RNA, 22 nt, Human
gcuugcaucaggggcuggggcc

SEQ ID NO: 12423 - RNA, 20 nt, Human
gcuugcggacagguggcuca

SEQ ID NO: 12424 - RNA, 20 nt, Human
gcuugcgugggaggaggggg

SEQ ID NO: 12425 - RNA, 18 nt, Human
gcuuggguggcuauguuu

SEQ ID NO: 12426 - RNA, 22 nt, Human
gcuuucccaaccuucuugguau

SEQ ID NO: 12427 - RNA, 22 nt, Human
gcuuuggcuucuccuggcagga

SEQ ID NO: 12428 - RNA, 22 nt, Human
gcuuuuaaauuaucugacaaug

SEQ ID NO: 12429 - RNA, 22 nt, Human
gcuuuucaaguuacaauuagcu

SEQ ID NO: 12430 - RNA, 22 nt, Human
gcuuuugagaaaguguuuuccc

SEQ ID NO: 12431 - RNA, 22 nt, Human
gcuuuugcaaagcuggagaauu

SEQ ID NO: 12432 - RNA, 22 nt, Human
ggaaaaauggguggugauauga

SEQ ID NO: 12433 - RNA, 22 nt, Human
ggaaaaugcugaagcaucugaa

SEQ ID NO: 12434 - RNA, 22 nt, Human
ggaaagagaaacaugaacuaga

SEQ ID NO: 12435 - RNA, 22 nt, Human
ggcagcgcuuggcugcucgaca

SEQ ID NO: 12436 - RNA, 22 nt, Human
ggcagcuuucaauaggguuaug

SEQ ID NO: 12437 - RNA, 22 nt, Human
ggcaggaaguaaggaugcuaca

SEQ ID NO: 12438 - RNA, 22 nt, Human
ggcaggauggagcagggcuaaa

SEQ ID NO: 12439 - RNA, 22 nt, Human
ggcagggagagcaugcugauaa

SEQ ID NO: 12440 - RNA, 22 nt, Human
ggcagggagagcgccgccaugc

SEQ ID NO: 12441 - RNA, 18 nt, Human
ggcagggcucagcugcuc

SEQ ID NO: 12442 - RNA, 22 nt, Human
ggcagguggcacugcugcuccc

SEQ ID NO: 12443 - RNA, 22 nt, Human
ggcagucaucacuuauucauca

SEQ ID NO: 12444 - RNA, 22 nt, Human
ggcagucuuucccuugagcucu

SEQ ID NO: 12445 - RNA, 22 nt, Human
ggcaucuuuaaugaacaugaau

SEQ ID NO: 12446 - RNA, 22 nt, Human
ggccaaagagcacaaugaauag

SEQ ID NO: 12447 - RNA, 22 nt, Human
ggccaagagaggauggagggau

SEQ ID NO: 12448 - RNA, 19 nt, Human
ggccacacuauuaaaagau

SEQ ID NO: 12449 - RNA, 22 nt, Human
ggccaccuaagguugugcauca

SEQ ID NO: 12450 - RNA, 22 nt, Human
ggccacgggguuugcugaaacu

SEQ ID NO: 12451 - RNA, 22 nt, Human
ggccagcgugggggaguagcgg

SEQ ID NO: 12452 - RNA, 22 nt, Human
ggccagucaaggggauccugaa

SEQ ID NO: 12453 - RNA, 22 nt, Human
ggccccggaggccguuagcuua

SEQ ID NO: 12454 - RNA, 22 nt, Human
ggcccgcgcugcuggcgcgcca

SEQ ID NO: 12455 - RNA, 22 nt, Human
ggcccucucuacauguuagacg

SEQ ID NO: 12456 - RNA, 22 nt, Human
ggcccuggggcaggagcagagg

SEQ ID NO: 12457 - RNA, 22 nt, Human
ggccgccacuuuccagugcugc

SEQ ID NO: 12458 - RNA, 22 nt, Human
ggccgccgcuuagcugagcccc

SEQ ID NO: 12459 - RNA, 22 nt, Human
ggccgggugggaggcagcggag

SEQ ID NO: 12460 - RNA, 22 nt, Human
ggccuccaucuuaucuuacucu

SEQ ID NO: 12461 - RNA, 22 nt, Human
ggccucucuccuuggcuugcag

SEQ ID NO: 12462 - RNA, 20 nt, Human
ggccugagcauggcuggcag

SEQ ID NO: 12463 - RNA, 22 nt, Human
ggccugcuaccagcugugaccu

SEQ ID NO: 12464 - RNA, 22 nt, Human
ggccugcucuggcuguggucag

SEQ ID NO: 12465 - RNA, 22 nt, Human
ggccuggcacauaguaggcagu

SEQ ID NO: 12466 - RNA, 22 nt, Human
ggccuucuuuucaugucuuucg

SEQ ID NO: 12467 - RNA, 22 nt, Human
ggcgaguacagacggggccugg

SEQ ID NO: 12468 - RNA, 22 nt, Human
ggcgcccucccuguccgucuuc

SEQ ID NO: 12469 - RNA, 22 nt, Human
ggcgccugguauucuuccucuc

SEQ ID NO: 12470 - RNA, 22 nt, Human
ggcggcccaggugcuccaggcg

SEQ ID NO: 12471 - RNA, 22 nt, Human
ggcggcugcuccuugcccucgg

SEQ ID NO: 12472 - RNA, 22 nt, Human
ggcgggucuagggcccuggagu

SEQ ID NO: 12473 - RNA, 22 nt, Human
ggcggugcgaggaugcagggcu

SEQ ID NO: 12474 - RNA, 22 nt, Human
ggcguccuccucgucugaggcg

SEQ ID NO: 12475 - RNA, 22 nt, Human
ggcuaagcaguaaaugggguua

SEQ ID NO: 12476 - RNA, 22 nt, Human
ggcuaaggacgggcaaguccca

SEQ ID NO: 12477 - RNA, 22 nt, Human
ggcuaaucaagaaggcccagug

SEQ ID NO: 12478 - RNA, 22 nt, Human
ggcuagggagacagagggcaug

SEQ ID NO: 12479 - RNA, 22 nt, Human
ggcucacuguaccugccgccgc

SEQ ID NO: 12480 - RNA, 22 nt, Human
ggcuccagauguccccuggcaa

SEQ ID NO: 12481 - RNA, 22 nt, Human
ggcuccugggcgucuucgaaca

SEQ ID NO: 12482 - RNA, 22 nt, Human
ggcucguaaaggccucacaggu

SEQ ID NO: 12483 - RNA, 22 nt, Human
ggcucuggcgagcuuuaguaca

SEQ ID NO: 12484 - RNA, 22 nt, Human
ggcugagguguggggaacuaua

SEQ ID NO: 12485 - RNA, 22 nt, Human
ggcugcaagacguuauuagcgu

SEQ ID NO: 12486 - RNA, 22 nt, Human
auguaaauauuuauauaugcau

SEQ ID NO: 12487 - RNA, 22 nt, Human
auguaaugucaaucuucagugg

SEQ ID NO: 12488 - RNA, 22 nt, Human
auguaguccuuauuugacauaa

SEQ ID NO: 12489 - RNA, 22 nt, Human
auguauauauacauguauugua

SEQ ID NO: 12490 - RNA, 22 nt, Human
auguauguauguauauacacac

SEQ ID NO: 12491 - RNA, 20 nt, Human
augucaggaagggagucagg

SEQ ID NO: 12492 - RNA, 22 nt, Human
auguccccagacugcugugcag

SEQ ID NO: 12493 - RNA, 22 nt, Human
auguccugacaguccaagggcg

SEQ ID NO: 12494 - RNA, 22 nt, Human
augugaaccuggguccugggcc

SEQ ID NO: 12495 - RNA, 22 nt, Human
augugaacuccagcugccaacc

SEQ ID NO: 12496 - RNA, 22 nt, Human
augugacaagugugggcagggc

SEQ ID NO: 12497 - RNA, 23 nt, Human
augugaggcaaaggcaggcacuc

SEQ ID NO: 12498 - RNA, 22 nt, Human
augugcacuggugugugcguuc

SEQ ID NO: 12499 - RNA, 22 nt, Human
augugcauguauguaucauauu

SEQ ID NO: 12500 - RNA, 22 nt, Human
augugccuuaauauaggcgcug

SEQ ID NO: 12501 - RNA, 22 nt, Human
augugcucaggucuauaucuca

SEQ ID NO: 12502 - RNA, 21 nt, Human
auguguucugauagugcuugc

SEQ ID NO: 12503 - RNA, 22 nt, Human
auguguuuugaccccugcuaaa

SEQ ID NO: 12504 - RNA, 22 nt, Human
auguuagcaucuggcacuaugg

SEQ ID NO: 12505 - RNA, 22 nt, Human
auguuccuuaaugugcuuguag

SEQ ID NO: 12506 - RNA, 22 nt, Human
auguucucagguuguauuuauu

SEQ ID NO: 12507 - RNA, 22 nt, Human
auguugagaaucucucuucuaa

SEQ ID NO: 12508 - RNA, 22 nt, Human
auguugcugauccuguggcugu

SEQ ID NO: 12509 - RNA, 22 nt, Human
auguuguugaacucuuugcaug

SEQ ID NO: 12510 - RNA, 22 nt, Human
auguuguuuauggguuaucaag

SEQ ID NO: 12511 - RNA, 22 nt, Human
auguuugugauugcugaaaaga

SEQ ID NO: 12512 - RNA, 22 nt, Human
auguuuuaaaaaacaggcuacc

SEQ ID NO: 12513 - RNA, 22 nt, Human
auguuuuauacacauguaucac

SEQ ID NO: 12514 - RNA, 22 nt, Human
auguuuucauuuagaagcuaau

SEQ ID NO: 12515 - RNA, 22 nt, Human
auguuuugaguuuuuuuacacc

SEQ ID NO: 12516 - RNA, 22 nt, Human
auguuuuuugaaaauguauuuu

SEQ ID NO: 12517 - RNA, 22 nt, Human
auuaaaaaugagaguagggauu

SEQ ID NO: 12518 - RNA, 22 nt, Human
auuaaagcuaguugagauuuaa

SEQ ID NO: 12519 - RNA, 22 nt, Human
auuaaauagcagaagaaagaug

SEQ ID NO: 12520 - RNA, 22 nt, Human
auuaacaggcucuguucuaguu

SEQ ID NO: 12521 - RNA, 21 nt, Human
auuaagacaauggcaaugggu

SEQ ID NO: 12522 - RNA, 22 nt, Human
auuaagacugcccauguuuuua

SEQ ID NO: 12523 - RNA, 20 nt, Human
auuaauuuuuagggcucacc

SEQ ID NO: 12524 - RNA, 22 nt, Human
auuacagaagauaugcucaaca

SEQ ID NO: 12525 - RNA, 22 nt, Human
auuagcaccccuggauguggga

SEQ ID NO: 12526 - RNA, 22 nt, Human
auuagguaguauaaucuuuguu

SEQ ID NO: 12527 - RNA, 22 nt, Human
auuaguccuaguucauucugag

SEQ ID NO: 12528 - RNA, 22 nt, Human
auuauaauucauuaggcuuagu

SEQ ID NO: 12529 - RNA, 21 nt, Human
auuauagugacuaaauugaua

SEQ ID NO: 12530 - RNA, 22 nt, Human
auuaucuauccgccaacaguaa

SEQ ID NO: 12531 - RNA, 22 nt, Human
auuaucugacugaguagucugu

SEQ ID NO: 12532 - RNA, 22 nt, Human
auuaugcagcugccuccaaggu

SEQ ID NO: 12533 - RNA, 22 nt, Human
auuauggacuuucuuguuuggg

SEQ ID NO: 12534 - RNA, 22 nt, Human
auuauucuuugggaaaguugaa

SEQ ID NO: 12535 - RNA, 22 nt, Human
auuauugcaagcagugaaggga

SEQ ID NO: 12536 - RNA, 20 nt, Human
auuauuucuucugcccaaag

SEQ ID NO: 12537 - RNA, 22 nt, Human
auuauuugcuuaagcuggucuc

SEQ ID NO: 12538 - RNA, 21 nt, Human
auucaaagaagaggaaggccc

SEQ ID NO: 12539 - RNA, 19 nt, Human
auucaagugcuuagagauc

SEQ ID NO: 12540 - RNA, 22 nt, Human
auucaaugcacauguuuuggau

SEQ ID NO: 12541 - RNA, 22 nt, Human
auucaccaucuugauccccucu

SEQ ID NO: 12542 - RNA, 22 nt, Human
auucaucuguacuucaauaucu

SEQ ID NO: 12543 - RNA, 17 nt, Human
auucaugaacauguccu

SEQ ID NO: 12544 - RNA, 22 nt, Human
gggcaagagaggaagagauggc

SEQ ID NO: 12545 - RNA, 22 nt, Human
gggcaagaggguuugacaugag

SEQ ID NO: 12546 - RNA, 22 nt, Human
gggcacggaaggcgccaggggu

SEQ ID NO: 12547 - RNA, 22 nt, Human
gggcagagagcuggaacuccuu

SEQ ID NO: 12548 - RNA, 22 nt, Human
gggcagagggcgagcugggaga

SEQ ID NO: 12549 - RNA, 22 nt, Human
gggcaggcuggguggugguccc

SEQ ID NO: 12550 - RNA, 22 nt, Human
gggcaggggcagugguggcauu

SEQ ID NO: 12551 - RNA, 22 nt, Human
gggcaguuucaugugguucaac

SEQ ID NO: 12552 - RNA, 22 nt, Human
gggcaugcagcaauucuguggu

SEQ ID NO: 12553 - RNA, 20 nt, Human
gggccagguggaccaggggc

SEQ ID NO: 12554 - RNA, 22 nt, Human
gggcccaacuguuggcagccuc

SEQ ID NO: 12555 - RNA, 22 nt, Human
gggccccgggcgcggcugcggg

SEQ ID NO: 12556 - RNA, 22 nt, Human
gggccccugagauggguuuucu

SEQ ID NO: 12557 - RNA, 22 nt, Human
gggcccggguaggggaagagag

SEQ ID NO: 12558 - RNA, 22 nt, Human
gggccgcagccucuccggccug

SEQ ID NO: 12559 - RNA, 22 nt, Human
gggccggagaagguagcugaag

SEQ ID NO: 12560 - RNA, 19 nt, Human
gggccucacccacaccucc

SEQ ID NO: 12561 - RNA, 22 nt, Human
gggccugcgcuggggggagccg

SEQ ID NO: 12562 - RNA, 21 nt, Human
gggccugggccagggccgggu

SEQ ID NO: 12563 - RNA, 22 nt, Human
gggccuguccccccaggagaac

SEQ ID NO: 12564 - RNA, 22 nt, Human
gggccuuggaggagaaggacuu

SEQ ID NO: 12565 - RNA, 22 nt, Human
gggcgccgggagugagagugag

SEQ ID NO: 12566 - RNA, 22 nt, Human
gggcggcguccucagucgggug

SEQ ID NO: 12567 - RNA, 22 nt, Human
gggcggggggagcuggaaugaa

SEQ ID NO: 12568 - RNA, 22 nt, Human
gggcggugccugucuccgaagc

SEQ ID NO: 12569 - RNA, 22 nt, Human
gggcuacagaugggagggauga

SEQ ID NO: 12570 - RNA, 22 nt, Human
gggcuacugagcuggaacuggg

SEQ ID NO: 12571 - RNA, 22 nt, Human
gggcuagggucagggggccacu

SEQ ID NO: 12572 - RNA, 22 nt, Human
gggcugaugcuuauacauacug

SEQ ID NO: 12573 - RNA, 22 nt, Human
gggcugcuccgcccgcugcgcc

SEQ ID NO: 12574 - RNA, 22 nt, Human
gggcuggggcucuggggcuagg

SEQ ID NO: 12575 - RNA, 22 nt, Human
gggcuuguuaacuuggcuucca

SEQ ID NO: 12576 - RNA, 19 nt, Human
gggcuuguuggcaaaugac

SEQ ID NO: 12577 - RNA, 18 nt, Human
gggcuuugggguucuauc

SEQ ID NO: 12578 - RNA, 22 nt, Human
ggggaagagagaagaaugaucu

SEQ ID NO: 12579 - RNA, 22 nt, Human
ggggaaggaaggggagggcacg

SEQ ID NO: 12580 - RNA, 22 nt, Human
ggggaauaaacacuuugucacu

SEQ ID NO: 12581 - RNA, 22 nt, Human
ggggaauuaaaugagaagccuu

SEQ ID NO: 12582 - RNA, 22 nt, Human
ggggagggcugagcacgguuga

SEQ ID NO: 12583 - RNA, 22 nt, Human
ggggaggguuuggaugagaguc

SEQ ID NO: 12584 - RNA, 22 nt, Human
ggggaggugugcaggacaccuc

SEQ ID NO: 12585 - RNA, 22 nt, Human
ggggcaucguugauugcauggu

SEQ ID NO: 12586 - RNA, 22 nt, Human
ggggccaaggcaaacuugaggg

SEQ ID NO: 12587 - RNA, 21 nt, Human
ggggcccccacacaugccucc

SEQ ID NO: 12588 - RNA, 21 nt, Human
ggggccucaucagaaauguua

SEQ ID NO: 12589 - RNA, 22 nt, Human
ggggcgaguguggaccgcagcc

SEQ ID NO: 12590 - RNA, 17 nt, Human
ggggcguguauuugaug

SEQ ID NO: 12591 - RNA, 22 nt, Human
ggggcguugccacggggacggg

SEQ ID NO: 12592 - RNA, 22 nt, Human
ggggcugggaggccggcgcgca

SEQ ID NO: 12593 - RNA, 22 nt, Human
ggggcuuggguaagaaugcaaa

SEQ ID NO: 12594 - RNA, 22 nt, Human
gggggaaaguggagguucguga

SEQ ID NO: 12595 - RNA, 22 nt, Human
gggggacaggaugaauaucugu

SEQ ID NO: 12596 - RNA, 22 nt, Human
gggggagaauaugugaaggggg

SEQ ID NO: 12597 - RNA, 22 nt, Human
gggggagcuacaggucccuugg

SEQ ID NO: 12598 - RNA, 23 nt, Human
gggggagcuggacuccuagaucc

SEQ ID NO: 12599 - RNA, 22 nt, Human
gggggcagguuccaggccagcu

SEQ ID NO: 12600 - RNA, 22 nt, Human
gggggcgcguggagggccgugg

SEQ ID NO: 12601 - RNA, 22 nt, Human
gggguacgaugguggggggcga

SEQ ID NO: 12602 - RNA, 22 nt, Human
ggggugaggcagggcagggguc

SEQ ID NO: 12603 - RNA, 22 nt, Human
gggguguuagucuuacccagag

SEQ ID NO: 12604 - RNA, 22 nt, Human
gggguguuuugaagagguucag

SEQ ID NO: 12605 - RNA, 22 nt, Human
gggguugauaauuagagaaaug

SEQ ID NO: 12606 - RNA, 22 nt, Human
gggguuggaugccuuggaaauu

SEQ ID NO: 12607 - RNA, 21 nt, Human
gggguuuuguucuuauaaugu

SEQ ID NO: 12608 - RNA, 22 nt, Human
ggguacaccaauggaugccagg

SEQ ID NO: 12609 - RNA, 22 nt, Human
ggguauuugacaaacugacacu

SEQ ID NO: 12610 - RNA, 22 nt, Human
gggucauugcgugacgcgagca

SEQ ID NO: 12611 - RNA, 22 nt, Human
gggucucucuucuuucugugaa

SEQ ID NO: 12612 - RNA, 22 nt, Human
gggucuggagauccgggugaag

SEQ ID NO: 12613 - RNA, 20 nt, Human
gggucuggcaucucucucug

SEQ ID NO: 12614 - RNA, 22 nt, Human
gggugcauggcagcccuucugg

SEQ ID NO: 12615 - RNA, 22 nt, Human
gggugcucagugccaaggagug

SEQ ID NO: 12616 - RNA, 22 nt, Human
gggugcuuaagcuuguuuguaa

SEQ ID NO: 12617 - RNA, 22 nt, Human
gggugcuucauaggugaugcug

SEQ ID NO: 12618 - RNA, 22 nt, Human
gggugguuccuggaucugacug

SEQ ID NO: 12619 - RNA, 22 nt, Human
gggugucugcugaauuucccuu

SEQ ID NO: 12620 - RNA, 22 nt, Human
gggugugcuaaaccuacgcaca

SEQ ID NO: 12621 - RNA, 22 nt, Human
ggguguggaggugacacauuug

SEQ ID NO: 12622 - RNA, 22 nt, Human
ggguguuaugccucugagucag

SEQ ID NO: 12623 - RNA, 22 nt, Human
ggguguuuuuggugacagggag

SEQ ID NO: 12624 - RNA, 22 nt, Human
ggguuaaauggauggcauuugc

SEQ ID NO: 12625 - RNA, 22 nt, Human
ggguuacgaugauuucaugugu

SEQ ID NO: 12626 - RNA, 22 nt, Human
ggguucugggaggacuagggga

SEQ ID NO: 12627 - RNA, 22 nt, Human
ggguuguuuguauuucucugaa

SEQ ID NO: 12628 - RNA, 22 nt, Human
ggguuuccugcucgcggguagc

SEQ ID NO: 12629 - RNA, 22 nt, Human
ggguuuuaccagauguguggug

SEQ ID NO: 12630 - RNA, 22 nt, Human
ggguuuuggggaggaagugagc

SEQ ID NO: 12631 - RNA, 22 nt, Human
ggguuuugugauugccucugaa

SEQ ID NO: 12632 - RNA, 22 nt, Human
gguaagcacuucauguacauga

SEQ ID NO: 12633 - RNA, 22 nt, Human
gguaagcauuaagugagggaau

SEQ ID NO: 12634 - RNA, 22 nt, Human
gguaaucuccucauugacguua

SEQ ID NO: 12635 - RNA, 22 nt, Human
gguaauguucugaugaauuugu

SEQ ID NO: 12636 - RNA, 22 nt, Human
gguaccuggcccuggggcugcu

SEQ ID NO: 12637 - RNA, 22 nt, Human
gguagacugagcuccuugagga

SEQ ID NO: 12638 - RNA, 22 nt, Human
gguagggaaggucucccacauu

SEQ ID NO: 12639 - RNA, 21 nt, Human
gguagggaagguguuccucau

SEQ ID NO: 12640 - RNA, 22 nt, Human
gguagggggaggagaagaaaaa

SEQ ID NO: 12641 - RNA, 23 nt, Human
gguagguggggagauuaaagucu

SEQ ID NO: 12642 - RNA, 22 nt, Human
gguauccaaauaaagcagguaa

SEQ ID NO: 12643 - RNA, 22 nt, Human
ggucaaauaugaguaauuuccu

SEQ ID NO: 12644 - RNA, 22 nt, Human
ggucaauuuggucaaucguuua

SEQ ID NO: 12645 - RNA, 22 nt, Human
ggucaucacugagagcagaucc

SEQ ID NO: 12646 - RNA, 22 nt, Human
ggucgacuaauguuucauuuca

SEQ ID NO: 12647 - RNA, 22 nt, Human
ggucgagcagcacccguucggc

SEQ ID NO: 12648 - RNA, 22 nt, Human
ggucggggcuggccggcguggu

SEQ ID NO: 12649 - RNA, 22 nt, Human
ggucgguuggagagaucaugaa

SEQ ID NO: 12650 - RNA, 22 nt, Human
ggucuagcucggugcuggcgac

SEQ ID NO: 12651 - RNA, 22 nt, Human
ggucucugggacguuggaucgc

SEQ ID NO: 12652 - RNA, 22 nt, Human
ggucugcaaugauuugaaaaac

SEQ ID NO: 12653 - RNA, 22 nt, Human
caaaccuagagaggagaggaca

SEQ ID NO: 12654 - RNA, 22 nt, Human
caaagaaccuucgagacagggc

SEQ ID NO: 12655 - RNA, 22 nt, Human
caaaggaaagagaaaaagucuu

SEQ ID NO: 12656 - RNA, 22 nt, Human
caaaggagcccuuugccggguu

SEQ ID NO: 12657 - RNA, 22 nt, Human
caaaggauguguagugcaacca

SEQ ID NO: 12658 - RNA, 22 nt, Human
caaaguaggcuaagaccuucca

SEQ ID NO: 12659 - RNA, 22 nt, Human
caaauacaaauacgggcagcuu

SEQ ID NO: 12660 - RNA, 22 nt, Human
caaauacguuuggcuggagcac

SEQ ID NO: 12661 - RNA, 22 nt, Human
caaaucagaucagagacaggcu

SEQ ID NO: 12662 - RNA, 22 nt, Human
caaaugcaguggucgugcugga

SEQ ID NO: 12663 - RNA, 22 nt, Human
caaauggggaauagaugauggg

SEQ ID NO: 12664 - RNA, 22 nt, Human
caaauguuugguggcauuuugu

SEQ ID NO: 12665 - RNA, 22 nt, Human
caaauuuuuauuuaccaucugc

SEQ ID NO: 12666 - RNA, 22 nt, Human
caacaaguugauuucacgcugc

SEQ ID NO: 12667 - RNA, 22 nt, Human
caacacaucaguucagucuuga

SEQ ID NO: 12668 - RNA, 22 nt, Human
caacauuucaaggucuuuagga

SEQ ID NO: 12669 - RNA, 22 nt, Human
caaccucuaucggucaggaagc

SEQ ID NO: 12670 - RNA, 22 nt, Human
caacuucuauucagucugcagu

SEQ ID NO: 12671 - RNA, 22 nt, Human
caacuucugcuuucuuccuugc

SEQ ID NO: 12672 - RNA, 22 nt, Human
caagaaaaaacaugaugagugu

SEQ ID NO: 12673 - RNA, 22 nt, Human
caagagcucccagaccugggca

SEQ ID NO: 12674 - RNA, 22 nt, Human
caagagcuuuagaaaugcucau

SEQ ID NO: 12675 - RNA, 22 nt, Human
caagagguaugagccgggauga

SEQ ID NO: 12676 - RNA, 22 nt, Human
caagauauguccuguuacuaag

SEQ ID NO: 12677 - RNA, 22 nt, Human
caagcacaauuucuacauguua

SEQ ID NO: 12678 - RNA, 22 nt, Human
caagcagauauuuuagucaaga

SEQ ID NO: 12679 - RNA, 22 nt, Human
caaggaaaacagaugaucaaca

SEQ ID NO: 12680 - RNA, 22 nt, Human
caaggguguacagauaugagag

SEQ ID NO: 12681 - RNA, 22 nt, Human
caagguauugaggccagugucc

SEQ ID NO: 12682 - RNA, 22 nt, Human
caaggucagacagccaggacag

SEQ ID NO: 12683 - RNA, 22 nt, Human
caagguugugacccaaugacca

SEQ ID NO: 12684 - RNA, 22 nt, Human
caaguaugagaaagcuauuacc

SEQ ID NO: 12685 - RNA, 22 nt, Human
caaguauuuauugaggcccugu

SEQ ID NO: 12686 - RNA, 22 nt, Human
caagucucuagaaugcaauagu

SEQ ID NO: 12687 - RNA, 22 nt, Human
caaguugcaugugcuugaaaua

SEQ ID NO: 12688 - RNA, 22 nt, Human
caauaccucuuggugauugggc

SEQ ID NO: 12689 - RNA, 22 nt, Human
caauagcuauguaaccugaaga

SEQ ID NO: 12690 - RNA, 22 nt, Human
caauccccaggucccagaacag

SEQ ID NO: 12691 - RNA, 22 nt, Human
caaucuucucuagaguauucua

SEQ ID NO: 12692 - RNA, 22 nt, Human
caaugcacauggacaucaggcu

SEQ ID NO: 12693 - RNA, 22 nt, Human
caaugccaggaaccugggggaa

SEQ ID NO: 12694 - RNA, 22 nt, Human
caauggagccaagaggaggaaa

SEQ ID NO: 12695 - RNA, 20 nt, Human
caauguuggcaguauagagc

SEQ ID NO: 12696 - RNA, 22 nt, Human
caauguuuuuccuuccuuaaua

SEQ ID NO: 12697 - RNA, 22 nt, Human
caauuaccaguaauugagguuu

SEQ ID NO: 12698 - RNA, 22 nt, Human
caauuuggaaagcaugcccccc

SEQ ID NO: 12699 - RNA, 22 nt, Human
cacaaagugucaggggagagaa

SEQ ID NO: 12700 - RNA, 22 nt, Human
cacaacaaaaaauaaguaugag

SEQ ID NO: 12701 - RNA, 22 nt, Human
cacaagacuaaguggcagagca

SEQ ID NO: 12702 - RNA, 22 nt, Human
cacaaggagaaauagauauuga

SEQ ID NO: 12703 - RNA, 22 nt, Human
cacaauuuccauugagcagcag

SEQ ID NO: 12704 - RNA, 22 nt, Human
cacacagcuagugacaggagaa

SEQ ID NO: 12705 - RNA, 22 nt, Human
cacacgagcccuggagccagca

SEQ ID NO: 12706 - RNA, 22 nt, Human
cacacguuuagcuucuggcggc

SEQ ID NO: 12707 - RNA, 22 nt, Human
cacagaauuaagggagaaauau

SEQ ID NO: 12708 - RNA, 22 nt, Human
cacagauaaggcuuugucccca

SEQ ID NO: 12709 - RNA, 18 nt, Human
cacagcauccaaguuaug

SEQ ID NO: 12710 - RNA, 19 nt, Human
cacagcccucacuuuuagc

SEQ ID NO: 12711 - RNA, 20 nt, Human
cacagcugacgaguauccaa

SEQ ID NO: 12712 - RNA, 22 nt, Human
guacugguuuucuuacucuggc

SEQ ID NO: 12713 - RNA, 22 nt, Human
guacuugauucauuauugcauu

SEQ ID NO: 12714 - RNA, 22 nt, Human
guagaaaauagauugucucuug

SEQ ID NO: 12715 - RNA, 22 nt, Human
guagaacucuuuccugcguggg

SEQ ID NO: 12716 - RNA, 22 nt, Human
guagagcagaaacauggagaaa

SEQ ID NO: 12717 - RNA, 22 nt, Human
guagagccaccaccaccauagc

SEQ ID NO: 12718 - RNA, 22 nt, Human
guagccacugaaguaaggccac

SEQ ID NO: 12719 - RNA, 22 nt, Human
guagccauuuucuagagaguua

SEQ ID NO: 12720 - RNA, 22 nt, Human
guaggaaaugaauaagguaccu

SEQ ID NO: 12721 - RNA, 22 nt, Human
guaggggccagaaagacuuaga

SEQ ID NO: 12722 - RNA, 22 nt, Human
guagguggaggcaacacagcca

SEQ ID NO: 12723 - RNA, 22 nt, Human
guaguauuuucugaggacuggu

SEQ ID NO: 12724 - RNA, 22 nt, Human
guagucauugggucugugguca

SEQ ID NO: 12725 - RNA, 22 nt, Human
guagucuuaggaaugauuuugu

SEQ ID NO: 12726 - RNA, 22 nt, Human
guagugauuguuccucaggggu

SEQ ID NO: 12727 - RNA, 22 nt, Human
guaguuagaguugugcuggaga

SEQ ID NO: 12728 - RNA, 22 nt, Human
guaguucuccaggggcuguuca

SEQ ID NO: 12729 - RNA, 22 nt, Human
guaguuuuugagcuguaaucuu

SEQ ID NO: 12730 - RNA, 22 nt, Human
guauaaauaucuauauuguuac

SEQ ID NO: 12731 - RNA, 22 nt, Human
guauauccaauaggugaugaaa

SEQ ID NO: 12732 - RNA, 22 nt, Human
guaucaggugugagcauuuuaa

SEQ ID NO: 12733 - RNA, 22 nt, Human
guauccuccccgcuggccuuca

SEQ ID NO: 12734 - RNA, 22 nt, Human
guaucugaaaaagaauucugac

SEQ ID NO: 12735 - RNA, 22 nt, Human
guaucuuuauuuuaauuaagau

SEQ ID NO: 12736 - RNA, 22 nt, Human
guauggaguuuuguugcacuuc

SEQ ID NO: 12737 - RNA, 22 nt, Human
guauggggugacaaaaauuagu

SEQ ID NO: 12738 - RNA, 22 nt, Human
guauuaagaaaugccugugaaa

SEQ ID NO: 12739 - RNA, 22 nt, Human
guauugauuguuuuaaaagauu

SEQ ID NO: 12740 - RNA, 22 nt, Human
guauuggcaguauacauagcac

SEQ ID NO: 12741 - RNA, 22 nt, Human
guauuugacaccagugaauggu

SEQ ID NO: 12742 - RNA, 22 nt, Human
guauuugcaaucacaaacaaaa

SEQ ID NO: 12743 - RNA, 22 nt, Human
guauuuggacugccuguucauu

SEQ ID NO: 12744 - RNA, 22 nt, Human
gucaaaguuaacuagcaggugc

SEQ ID NO: 12745 - RNA, 22 nt, Human
gucaagaugcuacauaauggga

SEQ ID NO: 12746 - RNA, 22 nt, Human
gucaaugcuuaguuugccugaa

SEQ ID NO: 12747 - RNA, 22 nt, Human
gucacaaaugauuuagcaauca

SEQ ID NO: 12748 - RNA, 22 nt, Human
gucacuccuucccagagggagc

SEQ ID NO: 12749 - RNA, 22 nt, Human
gucacuuuuaagggccuuuucu

SEQ ID NO: 12750 - RNA, 22 nt, Human
gucagaagauagaggaaguuug

SEQ ID NO: 12751 - RNA, 22 nt, Human
gucagacucuggggccccaggc

SEQ ID NO: 12752 - RNA, 22 nt, Human
gucagacugaguuccuggguac

SEQ ID NO: 12753 - RNA, 20 nt, Human
gucagaggacccuagagcga

SEQ ID NO: 12754 - RNA, 22 nt, Human
gucagauucuuucauuugcuga

SEQ ID NO: 12755 - RNA, 22 nt, Human
gucaggugcaccuccaccaaca

SEQ ID NO: 12756 - RNA, 22 nt, Human
gucaguccugugccuuuccgga

SEQ ID NO: 12757 - RNA, 22 nt, Human
gucaguggugcuuaaaguuuca

SEQ ID NO: 12758 - RNA, 20 nt, Human
gucaucucagggacugucug

SEQ ID NO: 12759 - RNA, 22 nt, Human
gucaucugagggacgagauuuc

SEQ ID NO: 12760 - RNA, 22 nt, Human
gucaugaugauacagguggagg

SEQ ID NO: 12761 - RNA, 23 nt, Human
gucauuacuguuaccuuauucuu

SEQ ID NO: 12762 - RNA, 22 nt, Human
guccaauguggcaccacagggg

SEQ ID NO: 12763 - RNA, 22 nt, Human
guccaucuugcaaugagaccua

SEQ ID NO: 12764 - RNA, 22 nt, Human
guccaugugcuaacagugcuua

SEQ ID NO: 12765 - RNA, 22 nt, Human
gucccagaaugguuucccagaa

SEQ ID NO: 12766 - RNA, 22 nt, Human
guccccuauaugaggaagccau

SEQ ID NO: 12767 - RNA, 22 nt, Human
gucccucauaacuggcaggugu

SEQ ID NO: 12768 - RNA, 22 nt, Human
gucccuggucuaccguggcuuc

SEQ ID NO: 12769 - RNA, 22 nt, Human
guccguaauuuuugcuugcaga

SEQ ID NO: 12770 - RNA, 22 nt, Human
guccucugggagccuugagccu

SEQ ID NO: 12771 - RNA, 22 nt, Human
guccugauggccauuuuucacu

SEQ ID NO: 12772 - RNA, 22 nt, Human
guccuggugccaccugcgggau

SEQ ID NO: 12773 - RNA, 22 nt, Human
guccuguaagauacaaguuuaa

SEQ ID NO: 12774 - RNA, 22 nt, Human
guccuguccugcugagcuccug

SEQ ID NO: 12775 - RNA, 22 nt, Human
guccuguguaaguacuugcuca

SEQ ID NO: 12776 - RNA, 22 nt, Human
guccuuaaauacgaugaacaug

SEQ ID NO: 12777 - RNA, 22 nt, Human
guccuucgcggcugaggccauu

SEQ ID NO: 12778 - RNA, 22 nt, Human
gucgagaacauucauuaugcaa

SEQ ID NO: 12779 - RNA, 22 nt, Human
gucgagcuggaggagcgaaugg

SEQ ID NO: 12780 - RNA, 22 nt, Human
gucgcuugaacccaggaagugg

SEQ ID NO: 12781 - RNA, 22 nt, Human
gucggagcggcugcacaggggg

SEQ ID NO: 12782 - RNA, 22 nt, Human
gucgucgcucccaccuuccgcu

SEQ ID NO: 12783 - RNA, 22 nt, Human
gucguucugcuauucuaugagg

SEQ ID NO: 12784 - RNA, 22 nt, Human
gucguuugucaauuuugaugug

SEQ ID NO: 12785 - RNA, 22 nt, Human
gucuauuuauagacagauccua

SEQ ID NO: 12786 - RNA, 23 nt, Human
gucucacaaccaccugagaaaau

SEQ ID NO: 12787 - RNA, 22 nt, Human
gucucacuucauuuucuuagcc

SEQ ID NO: 12788 - RNA, 22 nt, Human
gucucuuguggauguugggaag

SEQ ID NO: 12789 - RNA, 22 nt, Human
gucugaaauaucuuuugucuug

SEQ ID NO: 12790 - RNA, 22 nt, Human
gucugaggagaggcagcauaac

SEQ ID NO: 12791 - RNA, 22 nt, Human
gucugcacgugccagggagggg

SEQ ID NO: 12792 - RNA, 22 nt, Human
gucugcagcacugugcacgguc

SEQ ID NO: 12793 - RNA, 22 nt, Human
gucugccagauucugcuggauc

SEQ ID NO: 12794 - RNA, 22 nt, Human
gucugcccuuggccugggacuu

SEQ ID NO: 12795 - RNA, 22 nt, Human
gucugcuuuuaucacaugucau

SEQ ID NO: 12796 - RNA, 18 nt, Human
gucuguuccuuuaauguc

SEQ ID NO: 12797 - RNA, 19 nt, Human
gucuuauggauagcuccuc

SEQ ID NO: 12798 - RNA, 22 nt, Human
gucuucugacacuguuaggagg

SEQ ID NO: 12799 - RNA, 22 nt, Human
gucuugugaagacggcagaaag

SEQ ID NO: 12800 - RNA, 22 nt, Human
gucuuucuuuuacauauuugug

SEQ ID NO: 12801 - RNA, 22 nt, Human
gugaaaaauggccaucaggaca

SEQ ID NO: 12802 - RNA, 22 nt, Human
gugaaaugaagugacuggauau

SEQ ID NO: 12803 - RNA, 22 nt, Human
gugaaauuguacacucaguacc

SEQ ID NO: 12804 - RNA, 22 nt, Human
gugaagaugccucaggugaccc

SEQ ID NO: 12805 - RNA, 22 nt, Human
gugaagcacaugggcguugggu

SEQ ID NO: 12806 - RNA, 22 nt, Human
gugaaggggaagcagggagagg

SEQ ID NO: 12807 - RNA, 20 nt, Human
gugaaguuuucugaagacag

SEQ ID NO: 12808 - RNA, 22 nt, Human
gugaccagacagagucuagccc

SEQ ID NO: 12809 - RNA, 22 nt, Human
gugacugagugaagguugggua

SEQ ID NO: 12810 - RNA, 23 nt, Human
gugagaccagagccuauucucag

SEQ ID NO: 12811 - RNA, 17 nt, Human
gugagcugagucaggac

SEQ ID NO: 12812 - RNA, 22 nt, Human
gugaggugauugcugguguuug

SEQ ID NO: 12813 - RNA, 22 nt, Human
gugaguuuucgugacacuauuu

SEQ ID NO: 12814 - RNA, 22 nt, Human
gugauauaacaauuuagggaau

SEQ ID NO: 12815 - RNA, 22 nt, Human
gugaucagaagaaccugccgaa

SEQ ID NO: 12816 - RNA, 22 nt, Human
gugauggggagagcgcagcuuu

SEQ ID NO: 12817 - RNA, 22 nt, Human
gugauggucgagcgcuuguugu

SEQ ID NO: 12818 - RNA, 22 nt, Human
gugaugugugaaggucugcagg

SEQ ID NO: 12819 - RNA, 22 nt, Human
gugauuucaaauauagagugag

SEQ ID NO: 12820 - RNA, 22 nt, Human
gugcacagaaacauacaaugug

SEQ ID NO: 12821 - RNA, 19 nt, Human
gugcacugucacuuugcuc

SEQ ID NO: 12822 - RNA, 22 nt, Human
gugcacuugaucuagacagauu

SEQ ID NO: 12823 - RNA, 22 nt, Human
cacaggacuuggcuucucacag

SEQ ID NO: 12824 - RNA, 23 nt, Human
cacaggcagaaaucaagacggua

SEQ ID NO: 12825 - RNA, 22 nt, Human
cacaguccugcauuuacugccu

SEQ ID NO: 12826 - RNA, 22 nt, Human
cacaucaaacuuacuaagauuu

SEQ ID NO: 12827 - RNA, 22 nt, Human
cacaucugaaggcggcucuagg

SEQ ID NO: 12828 - RNA, 22 nt, Human
cacauguguaccugccucucug

SEQ ID NO: 12829 - RNA, 22 nt, Human
cacaugugugugccuacaugca

SEQ ID NO: 12830 - RNA, 22 nt, Human
cacauugguagaauuuagaaga

SEQ ID NO: 12831 - RNA, 22 nt, Human
cacauuguuuggucagagcaua

SEQ ID NO: 12832 - RNA, 22 nt, Human
cacauuucagcacucagggcau

SEQ ID NO: 12833 - RNA, 22 nt, Human
cacauuuuccagaagaaucaga

SEQ ID NO: 12834 - RNA, 22 nt, Human
caccaaaauaucccuuuguaca

SEQ ID NO: 12835 - RNA, 22 nt, Human
caccaccaguaccaucacacgc

SEQ ID NO: 12836 - RNA, 22 nt, Human
caccaucugaauauucuccaag

SEQ ID NO: 12837 - RNA, 22 nt, Human
caccccauccccucccaauucc

SEQ ID NO: 12838 - RNA, 22 nt, Human
cacccgacugaggacgccgccc

SEQ ID NO: 12839 - RNA, 22 nt, Human
caccgagagccacuuccggaac

SEQ ID NO: 12840 - RNA, 20 nt, Human
caccggguugcugguuucuu

SEQ ID NO: 12841 - RNA, 22 nt, Human
caccuggaggcagcaccgggcu

SEQ ID NO: 12842 - RNA, 22 nt, Human
caccuuccgcccacugaccgcc

SEQ ID NO: 12843 - RNA, 22 nt, Human
cacgggcgacgugaucuaggac

SEQ ID NO: 12844 - RNA, 22 nt, Human
cacuaaccauguucccaacagc

SEQ ID NO: 12845 - RNA, 22 nt, Human
cacuaggauccuucuucuucuu

SEQ ID NO: 12846 - RNA, 22 nt, Human
cacuauaaugugauuucgcccu

SEQ ID NO: 12847 - RNA, 22 nt, Human
cacucaaacugaaauccuuuuu

SEQ ID NO: 12848 - RNA, 23 nt, Human
cacucgcaggcccagcucucagg

SEQ ID NO: 12849 - RNA, 22 nt, Human
cacucuagagcauugcuuacag

SEQ ID NO: 12850 - RNA, 22 nt, Human
cacucuucucucauuuuccuuu

SEQ ID NO: 12851 - RNA, 22 nt, Human
cacugcaaccuccaccucccgg

SEQ ID NO: 12852 - RNA, 22 nt, Human
cacugcacuccagccugggcaa

SEQ ID NO: 12853 - RNA, 22 nt, Human
cacugguugccucuuucuguuc

SEQ ID NO: 12854 - RNA, 21 nt, Human
cacuguauagcaggagaaaac

SEQ ID NO: 12855 - RNA, 22 nt, Human
cacugugagugcaagcaggggu

SEQ ID NO: 12856 - RNA, 22 nt, Human
cacuguugagcaauguacagug

SEQ ID NO: 12857 - RNA, 22 nt, Human
cacuuagugcuuuuguguuucu

SEQ ID NO: 12858 - RNA, 22 nt, Human
cacuucaguacuagaggaugaa

SEQ ID NO: 12859 - RNA, 22 nt, Human
cacuugagagcugaagaagucu

SEQ ID NO: 12860 - RNA, 22 nt, Human
cagaaaaaaaugcagacuagca

SEQ ID NO: 12861 - RNA, 22 nt, Human
cagaaacacuguauuuagggaa

SEQ ID NO: 12862 - RNA, 22 nt, Human
cagaaagaaguggggauagagg

SEQ ID NO: 12863 - RNA, 22 nt, Human
cagaaauuggcagagaagaccu

SEQ ID NO: 12864 - RNA, 22 nt, Human
cagaaguugcuugagagagagc

SEQ ID NO: 12865 - RNA, 22 nt, Human
cagacaaauccuuaugagacug

SEQ ID NO: 12866 - RNA, 22 nt, Human
cagacagagcucacaagucuuu

SEQ ID NO: 12867 - RNA, 22 nt, Human
cagacagaguuguuucuucucc

SEQ ID NO: 12868 - RNA, 22 nt, Human
cagaccucuaugggguaaaucu

SEQ ID NO: 12869 - RNA, 22 nt, Human
cagaccuggaaaacaggcuugc

SEQ ID NO: 12870 - RNA, 22 nt, Human
cagacuccugcuccucuggggc

SEQ ID NO: 12871 - RNA, 22 nt, Human
gugggggcagaagcgagugcag

SEQ ID NO: 12872 - RNA, 22 nt, Human
guggggguaggggguuuccugg

SEQ ID NO: 12873 - RNA, 22 nt, Human
guggggguaggggguuuucugg

SEQ ID NO: 12874 - RNA, 22 nt, Human
guggguccaaccugugugugug

SEQ ID NO: 12875 - RNA, 22 nt, Human
gugggugauacugccgugggag

SEQ ID NO: 12876 - RNA, 22 nt, Human
guggguuggguuuuugaaggga

SEQ ID NO: 12877 - RNA, 22 nt, Human
guggucaagaccgggaauagga

SEQ ID NO: 12878 - RNA, 22 nt, Human
gugguccuaggugcucaaguca

SEQ ID NO: 12879 - RNA, 22 nt, Human
gugguccugguugucugagaga

SEQ ID NO: 12880 - RNA, 22 nt, Human
gugguggugaggcaaggggugu

SEQ ID NO: 12881 - RNA, 23 nt, Human
gugguguaaaugccaaaaugaaa

SEQ ID NO: 12882 - RNA, 17 nt, Human
gugguguacauuuccau

SEQ ID NO: 12883 - RNA, 22 nt, Human
gugguuuagccuucauuaaccu

SEQ ID NO: 12884 - RNA, 22 nt, Human
guguagauuuguucaccuauua

SEQ ID NO: 12885 - RNA, 22 nt, Human
guguagugugcuguucaguguu

SEQ ID NO: 12886 - RNA, 22 nt, Human
guguauaguggugucgguagaa

SEQ ID NO: 12887 - RNA, 22 nt, Human
guguaucagaggcuguguuaua

SEQ ID NO: 12888 - RNA, 22 nt, Human
gugucauuggcuucccaagucc

SEQ ID NO: 12889 - RNA, 22 nt, Human
guguccaugugggugcucuccu

SEQ ID NO: 12890 - RNA, 22 nt, Human
gugucuuauugauguuggcacu

SEQ ID NO: 12891 - RNA, 22 nt, Human
gugugaguggcuaagugugccu

SEQ ID NO: 12892 - RNA, 22 nt, Human
gugugcacaaucuggcaugugc

SEQ ID NO: 12893 - RNA, 23 nt, Human
gugugccuuuaucuucuguacuc

SEQ ID NO: 12894 - RNA, 22 nt, Human
gugugucucaguugcuccgaag

SEQ ID NO: 12895 - RNA, 22 nt, Human
guguguggacgucugagcccag

SEQ ID NO: 12896 - RNA, 22 nt, Human
gugugugucuacuuucaucucu

SEQ ID NO: 12897 - RNA, 22 nt, Human
guguucuucacuguuagaaggu

SEQ ID NO: 12898 - RNA, 22 nt, Human
guguucuuuaugguuguagugu

SEQ ID NO: 12899 - RNA, 22 nt, Human
guguucuuuguagaggaucuug

SEQ ID NO: 12900 - RNA, 22 nt, Human
guguugaugugucuguauucua

SEQ ID NO: 12901 - RNA, 22 nt, Human
guguugcaggaagauauagcug

SEQ ID NO: 12902 - RNA, 22 nt, Human
guguuguaguguguguuucuuu

SEQ ID NO: 12903 - RNA, 21 nt, Human
guguugugagguugguguuag

SEQ ID NO: 12904 - RNA, 22 nt, Human
guguugugauuggucagucacu

SEQ ID NO: 12905 - RNA, 22 nt, Human
guguuucccuggcacaagaacc

SEQ ID NO: 12906 - RNA, 22 nt, Human
guguuugagagguacaagggaa

SEQ ID NO: 12907 - RNA, 22 nt, Human
guguuuguauccuccauauaac

SEQ ID NO: 12908 - RNA, 22 nt, Human
guguuuugagaggaugguuuua

SEQ ID NO: 12909 - RNA, 22 nt, Human
guuaaaugcagauucugacuca

SEQ ID NO: 12910 - RNA, 22 nt, Human
guuaauaugcaaaacggaugcg

SEQ ID NO: 12911 - RNA, 21 nt, Human
guuaccacugaugcaacagga

SEQ ID NO: 12912 - RNA, 23 nt, Human
guuaccgaccugauucggcagcc

SEQ ID NO: 12913 - RNA, 22 nt, Human
guuacuacccacccuucucccc

SEQ ID NO: 12914 - RNA, 22 nt, Human
guuagaauggacaaagcugaaa

SEQ ID NO: 12915 - RNA, 22 nt, Human
guuaguucccaccccuguaaga

SEQ ID NO: 12916 - RNA, 22 nt, Human
guuaucauccucagaggcaguu

SEQ ID NO: 12917 - RNA, 22 nt, Human
guuauuaaauauuuuggugauu

SEQ ID NO: 12918 - RNA, 23 nt, Human
guuauugcuggugcuggccagcc

SEQ ID NO: 12919 - RNA, 22 nt, Human
guuauuuugucuuguucaugaa

SEQ ID NO: 12920 - RNA, 22 nt, Human
guucaaccaugauuaggaacug

SEQ ID NO: 12921 - RNA, 18 nt, Human
guucaagcauuuugcucu

SEQ ID NO: 12922 - RNA, 22 nt, Human
guucaaucucucaugcauuuuc

SEQ ID NO: 12923 - RNA, 22 nt, Human
guucacaguauaucuuuuaacu

SEQ ID NO: 12924 - RNA, 22 nt, Human
guucacauccuugugaggauuu

SEQ ID NO: 12925 - RNA, 22 nt, Human
guucaccaguagcugggcuguu

SEQ ID NO: 12926 - RNA, 22 nt, Human
guucauuucaagucuaauccau

SEQ ID NO: 12927 - RNA, 22 nt, Human
guuccgcggccucgcgcugagc

SEQ ID NO: 12928 - RNA, 22 nt, Human
guuccuaaauuugaaggacuuu

SEQ ID NO: 12929 - RNA, 22 nt, Human
guuccuauauagccuuaaggau

SEQ ID NO: 12930 - RNA, 22 nt, Human
guuccucucacaggcuggagcu

SEQ ID NO: 12931 - RNA, 22 nt, Human
guuccucugugguggaggaagg

SEQ ID NO: 12932 - RNA, 22 nt, Human
guuccugagcaguuccuggcca

SEQ ID NO: 12933 - RNA, 22 nt, Human
guuccugugcccuguucuuucc

SEQ ID NO: 12934 - RNA, 16 nt, Human
guuccuguguguacaa

SEQ ID NO: 12935 - RNA, 22 nt, Human
guucuacaacuucgcuugcaga

SEQ ID NO: 12936 - RNA, 22 nt, Human
caggcacagcuaagacuggcca

SEQ ID NO: 12937 - RNA, 22 nt, Human
caggcagagagggcagugugga

SEQ ID NO: 12938 - RNA, 22 nt, Human
caggcaggagaaaaggcgcggg

SEQ ID NO: 12939 - RNA, 22 nt, Human
caggcagggagcuggaaaggau

SEQ ID NO: 12940 - RNA, 22 nt, Human
caggccacagcuaaagaggauu

SEQ ID NO: 12941 - RNA, 22 nt, Human
caggccagcuggaggggcagcu

SEQ ID NO: 12942 - RNA, 20 nt, Human
caggccuucaggauggcugg

SEQ ID NO: 12943 - RNA, 22 nt, Human
caggcgcugacgggaccgggcu

SEQ ID NO: 12944 - RNA, 22 nt, Human
cagggaaguauuacauguuucc

SEQ ID NO: 12945 - RNA, 22 nt, Human
cagggagguuggauuggggccu

SEQ ID NO: 12946 - RNA, 22 nt, Human
cagggcagaguuaagaugcugg

SEQ ID NO: 12947 - RNA, 22 nt, Human
cagggcaucucugaaucuucac

SEQ ID NO: 12948 - RNA, 22 nt, Human
caggggaagccagcugccaugu

SEQ ID NO: 12949 - RNA, 19 nt, Human
caggggcuuaugcgaccuc

SEQ ID NO: 12950 - RNA, 22 nt, Human
caggggcuuuccuguuuaugga

SEQ ID NO: 12951 - RNA, 22 nt, Human
cagggggacuuguuagguuuua

SEQ ID NO: 12952 - RNA, 22 nt, Human
cagggguaccuggguuaccugu

SEQ ID NO: 12953 - RNA, 22 nt, Human
caggggucccccggcucccugg

SEQ ID NO: 12954 - RNA, 22 nt, Human
caggguaguaauuuaauacaag

SEQ ID NO: 12955 - RNA, 22 nt, Human
cagggugaagaugcgccuccug

SEQ ID NO: 12956 - RNA, 22 nt, Human
caggguuuuaguugcagguuau

SEQ ID NO: 12957 - RNA, 22 nt, Human
cagguauaugugugucuaauac

SEQ ID NO: 12958 - RNA, 22 nt, Human
caggucauaacuaugcaugaac

SEQ ID NO: 12959 - RNA, 22 nt, Human
cagguggauggcgagcccugca

SEQ ID NO: 12960 - RNA, 22 nt, Human
cagguggccggguaggaggugg

SEQ ID NO: 12961 - RNA, 22 nt, Human
cagguguugcaguugaagacug

SEQ ID NO: 12962 - RNA, 22 nt, Human
cagguugaagagguuaacgaua

SEQ ID NO: 12963 - RNA, 22 nt, Human
cagguuguugacugcauauagg

SEQ ID NO: 12964 - RNA, 22 nt, Human
cagguuuggaagucacgaagcu

SEQ ID NO: 12965 - RNA, 22 nt, Human
cagguuuuccuuuuaaaaggaa

SEQ ID NO: 12966 - RNA, 22 nt, Human
caguacugucuuccugauggca

SEQ ID NO: 12967 - RNA, 22 nt, Human
caguaguucucauaacucauga

SEQ ID NO: 12968 - RNA, 22 nt, Human
caguaugagcacagugccugga

SEQ ID NO: 12969 - RNA, 22 nt, Human
caguauguuuauuagaacugca

SEQ ID NO: 12970 - RNA, 20 nt, Human
cagugcccguggaaaagaug

SEQ ID NO: 12971 - RNA, 22 nt, Human
cagugccggccaggaccuccug

SEQ ID NO: 12972 - RNA, 22 nt, Human
cagugcucauagcuguuccucc

SEQ ID NO: 12973 - RNA, 22 nt, Human
cagugcuccugccccugcccuu

SEQ ID NO: 12974 - RNA, 22 nt, Human
cagugcuggaggggugcuugca

SEQ ID NO: 12975 - RNA, 22 nt, Human
caguggagaccugccugcugga

SEQ ID NO: 12976 - RNA, 22 nt, Human
caguggaugucucauaguguga

SEQ ID NO: 12977 - RNA, 22 nt, Human
caguggggaggccaggauagaa

SEQ ID NO: 12978 - RNA, 22 nt, Human
caguggggcuuccagacgcuga

SEQ ID NO: 12979 - RNA, 22 nt, Human
caguuaaugauaggaauucggu

SEQ ID NO: 12980 - RNA, 22 nt, Human
guuuugaugugauuucucaugu

SEQ ID NO: 12981 - RNA, 22 nt, Human
guuuuggagauguccauuuucc

SEQ ID NO: 12982 - RNA, 22 nt, Human
guuuuguagucuggagacuguc

SEQ ID NO: 12983 - RNA, 22 nt, Human
guuuugugugugugcccacacg

SEQ ID NO: 12984 - RNA, 22 nt, Human
guuuuuacuuccaaugcuauga

SEQ ID NO: 12985 - RNA, 22 nt, Human
guuuuucuagaaaucuccuccu

SEQ ID NO: 12986 - RNA, 22 nt, Human
guuuuucuuugauuuagaacca

SEQ ID NO: 12987 - RNA, 22 nt, Human
uaaaaaccuuguauuuaacucu

SEQ ID NO: 12988 - RNA, 22 nt, Human
uaaaacuaugcaaccuacuacc

SEQ ID NO: 12989 - RNA, 22 nt, Human
uaaaaguuagcuaggacaaagu

SEQ ID NO: 12990 - RNA, 22 nt, Human
uaaaccuuauuugaauaccaac

SEQ ID NO: 12991 - RNA, 22 nt, Human
uaaacgaagcuucaugcuugaa

SEQ ID NO: 12992 - RNA, 22 nt, Human
uaaagacaauuucgagcuguag

SEQ ID NO: 12993 - RNA, 23 nt, Human
uaaagauaguuuaaaggugaguu

SEQ ID NO: 12994 - RNA, 22 nt, Human
uaaagcauguuucaguaagguu

SEQ ID NO: 12995 - RNA, 22 nt, Human
uaaaggaccuguacuagguuua

SEQ ID NO: 12996 - RNA, 22 nt, Human
uaaaguguacaagucauaagua

SEQ ID NO: 12997 - RNA, 22 nt, Human
uaaauaugcaugugguauucau

SEQ ID NO: 12998 - RNA, 22 nt, Human
uaaaugaaaggguuuaauuuau

SEQ ID NO: 12999 - RNA, 22 nt, Human
uaaaugaaaugaagugaaagcu

SEQ ID NO: 13000 - RNA, 22 nt, Human
uaaaugauaguauugaagguag

SEQ ID NO: 13001 - RNA, 22 nt, Human
uaaauguacugaggcaacagga

SEQ ID NO: 13002 - RNA, 22 nt, Human
uaaauguugcuugugcugcuca

SEQ ID NO: 13003 - RNA, 22 nt, Human
uaaauuagauucccagcgcuau

SEQ ID NO: 13004 - RNA, 22 nt, Human
uaacaacuuucugguguaacuu

SEQ ID NO: 13005 - RNA, 22 nt, Human
uaacacauagauauuuuaacuu

SEQ ID NO: 13006 - RNA, 22 nt, Human
uaacagugcuacaguuacuuuc

SEQ ID NO: 13007 - RNA, 22 nt, Human
uaacaguggucugugguaucug

SEQ ID NO: 13008 - RNA, 22 nt, Human
uaacauuuaguuuuaagauggu

SEQ ID NO: 13009 - RNA, 22 nt, Human
uaacccaaaggcaaugucucga

SEQ ID NO: 13010 - RNA, 22 nt, Human
uaacccuucauaacuagaugaa

SEQ ID NO: 13011 - RNA, 22 nt, Human
uaaccuuuuuuaaaguuuccug

SEQ ID NO: 13012 - RNA, 22 nt, Human
uaacuuuuuauccuguuaaaug

SEQ ID NO: 13013 - RNA, 22 nt, Human
uaagaaacauuuuuaugacagu

SEQ ID NO: 13014 - RNA, 22 nt, Human
uaagagcagacacaaccugaga

SEQ ID NO: 13015 - RNA, 22 nt, Human
uaagauggaagaaaaggcggau

SEQ ID NO: 13016 - RNA, 23 nt, Human
uaagccacgugacccuuuauuug

SEQ ID NO: 13017 - RNA, 22 nt, Human
uaagcgagccaguggaaaaagc

SEQ ID NO: 13018 - RNA, 22 nt, Human
uaagcguuugggaguuaugaac

SEQ ID NO: 13019 - RNA, 21 nt, Human
uaagcuaaacauucaguuaac

SEQ ID NO: 13020 - RNA, 22 nt, Human
uaagcuauuccugaagaagguu

SEQ ID NO: 13021 - RNA, 22 nt, Human
uaaggaaaugcaaauuuaagaa

SEQ ID NO: 13022 - RNA, 21 nt, Human
uaaggaagagcauuuuagguc

SEQ ID NO: 13023 - RNA, 22 nt, Human
uaaggcuguuaggaggauuaaa

SEQ ID NO: 13024 - RNA, 22 nt, Human
uaagggagcagaagcugugaaa

SEQ ID NO: 13025 - RNA, 22 nt, Human
uaaguaauugugguuuuugcca

SEQ ID NO: 13026 - RNA, 22 nt, Human
uaaguauguuagaaaaucaagu

SEQ ID NO: 13027 - RNA, 22 nt, Human
uaagugguagaaagagaaaggu

SEQ ID NO: 13028 - RNA, 22 nt, Human
uaagugugcauguguauuauau

SEQ ID NO: 13029 - RNA, 22 nt, Human
uaauaaaaauuuaauucacauu

SEQ ID NO: 13030 - RNA, 22 nt, Human
uaauaagugcuggcuguacauc

SEQ ID NO: 13031 - RNA, 21 nt, Human
uaauaauugggggcagggugg

SEQ ID NO: 13032 - RNA, 22 nt, Human
uaauauaacugccaguuaaggu

SEQ ID NO: 13033 - RNA, 22 nt, Human
uaauauccaguuauuucccuca

SEQ ID NO: 13034 - RNA, 22 nt, Human
uaauaucuuuacacauuuucaa

SEQ ID NO: 13035 - RNA, 22 nt, Human
uaauccaaaccaggaauucccu

SEQ ID NO: 13036 - RNA, 22 nt, Human
uaauggagggucugagucuggg

SEQ ID NO: 13037 - RNA, 22 nt, Human
uaauuccacacucccgcaagcg

SEQ ID NO: 13038 - RNA, 22 nt, Human
uaauucuucaauccaguguuca

SEQ ID NO: 13039 - RNA, 22 nt, Human
uaauugagauuucuggcugcuu

SEQ ID NO: 13040 - RNA, 22 nt, Human
uaauuugauuucucccuggaaa

SEQ ID NO: 13041 - RNA, 22 nt, Human
uacaaaugaucaucucuuugaa

SEQ ID NO: 13042 - RNA, 22 nt, Human
uacaagcucuuguagggggaaa

SEQ ID NO: 13043 - RNA, 22 nt, Human
uacaccuuaagccgcggcuccc

SEQ ID NO: 13044 - RNA, 22 nt, Human
uacagauaaaaaugcuguucuu

SEQ ID NO: 13045 - RNA, 22 nt, Human
uacagauggacacuguuucaag

SEQ ID NO: 13046 - RNA, 23 nt, Human
uacagccaugucgcugauuuaac

SEQ ID NO: 13047 - RNA, 22 nt, Human
uacagcgaaaauuuagcuugau

SEQ ID NO: 13048 - RNA, 22 nt, Human
uacaguauuuuuuaagaaaaaa

SEQ ID NO: 13049 - RNA, 22 nt, Human
uacagucauaagguuucucucc

SEQ ID NO: 13050 - RNA, 22 nt, Human
uacauaauagcaaggugcuguc

SEQ ID NO: 13051 - RNA, 22 nt, Human
uacauaauucauuagcuccucu

SEQ ID NO: 13052 - RNA, 21 nt, Human
uacaucaguuuucuuggcuca

SEQ ID NO: 13053 - RNA, 22 nt, Human
uacauggauguuauccuuacug

SEQ ID NO: 13054 - RNA, 22 nt, Human
uacauguggagauaacugaagc

SEQ ID NO: 13055 - RNA, 22 nt, Human
uacauuugauuuuugcuucuuu

SEQ ID NO: 13056 - RNA, 21 nt, Human
uaccacugaaauugaucguuc

SEQ ID NO: 13057 - RNA, 23 nt, Human
uaccagacccugaaagaaagugu

SEQ ID NO: 13058 - RNA, 19 nt, Human
uaccagguuggagaggccc

SEQ ID NO: 13059 - RNA, 20 nt, Human
uaccaucauuggcaaaccuc

SEQ ID NO: 13060 - RNA, 20 nt, Human
uacccgcagcugggucuggc

SEQ ID NO: 13061 - RNA, 19 nt, Human
uacccggauagccagguag

SEQ ID NO: 13062 - RNA, 22 nt, Human
uaccgcagagucauugugagga

SEQ ID NO: 13063 - RNA, 22 nt, Human
uaccuagaagagacuuuucugg

SEQ ID NO: 13064 - RNA, 22 nt, Human
uaccuuuuuauucuuaaggccg

SEQ ID NO: 13065 - RNA, 22 nt, Human
uacguggcucguuaauuuccug

SEQ ID NO: 13066 - RNA, 22 nt, Human
uacgugucacugaugaaguuua

SEQ ID NO: 13067 - RNA, 22 nt, Human
uacguuuuauaucuuuuggaau

SEQ ID NO: 13068 - RNA, 22 nt, Human
uacuaaacugcauuucuaucua

SEQ ID NO: 13069 - RNA, 22 nt, Human
uacuagacugagaaucagcuga

SEQ ID NO: 13070 - RNA, 22 nt, Human
uacuaucauuuuuuguugccaa

SEQ ID NO: 13071 - RNA, 22 nt, Human
uacuauuuugacaugaaauuga

SEQ ID NO: 13072 - RNA, 22 nt, Human
uacucauuggagaauuacgagg

SEQ ID NO: 13073 - RNA, 22 nt, Human
uacucuggaguugagaugcgag

SEQ ID NO: 13074 - RNA, 22 nt, Human
uacugaagaugccaucacaagc

SEQ ID NO: 13075 - RNA, 22 nt, Human
uacugaauuacugcugguaaau

SEQ ID NO: 13076 - RNA, 22 nt, Human
uacugagcauaaaacccauacu

SEQ ID NO: 13077 - RNA, 22 nt, Human
uacugccauuauccugcugaaa

SEQ ID NO: 13078 - RNA, 22 nt, Human
uacuuaaaacacauuuagcauu

SEQ ID NO: 13079 - RNA, 22 nt, Human
uacuuacacugaagcaaagaua

SEQ ID NO: 13080 - RNA, 22 nt, Human
uacuuagagucgggaugcacaa

SEQ ID NO: 13081 - RNA, 22 nt, Human
uacuuaucuuagggaugcuugc

SEQ ID NO: 13082 - RNA, 22 nt, Human
uacuucccacuggggucuacca

SEQ ID NO: 13083 - RNA, 22 nt, Human
uacuucuuuuguaaaguauuga

SEQ ID NO: 13084 - RNA, 22 nt, Human
uacuugcaaggcucuuggaaua

SEQ ID NO: 13085 - RNA, 22 nt, Human
uacuuugucauucuaaccuucc

SEQ ID NO: 13086 - RNA, 22 nt, Human
uacuuuuuucacuucuagcccc

SEQ ID NO: 13087 - RNA, 22 nt, Human
uagaagaacaugucaaacuaua

SEQ ID NO: 13088 - RNA, 22 nt, Human
uagaagagcaugucaaacuaua

SEQ ID NO: 13089 - RNA, 22 nt, Human
ccagccugccaagcccagcccu

SEQ ID NO: 13090 - RNA, 22 nt, Human
ccagcucgaggcaggggcugca

SEQ ID NO: 13091 - RNA, 17 nt, Human
ccagcugcucccucaga

SEQ ID NO: 13092 - RNA, 23 nt, Human
ccagcugugccuggcccaggagc

SEQ ID NO: 13093 - RNA, 22 nt, Human
ccagcuuuucagaaucugccug

SEQ ID NO: 13094 - RNA, 22 nt, Human
ccaggcccugcuccucacacca

SEQ ID NO: 13095 - RNA, 22 nt, Human
ccagggcugcugccugggcugg

SEQ ID NO: 13096 - RNA, 22 nt, Human
ccagggcuggaccagugcuugg

SEQ ID NO: 13097 - RNA, 22 nt, Human
ccagggcuggguuugucggugu

SEQ ID NO: 13098 - RNA, 22 nt, Human
ccaggggagagucugagucguu

SEQ ID NO: 13099 - RNA, 22 nt, Human
ccagggucggcaucagcguggg

SEQ ID NO: 13100 - RNA, 22 nt, Human
ccagucagccuaguucuucuuu

SEQ ID NO: 13101 - RNA, 23 nt, Human
ccagucgagucccaaccuucgcc

SEQ ID NO: 13102 - RNA, 22 nt, Human
ccagucuuggugucuguagcac

SEQ ID NO: 13103 - RNA, 22 nt, Human
ccagugcaguacaaaccuuagu

SEQ ID NO: 13104 - RNA, 22 nt, Human
ccaguuguggagaauuguuuga

SEQ ID NO: 13105 - RNA, 22 nt, Human
ccauaaaagagaaucuaaauga

SEQ ID NO: 13106 - RNA, 22 nt, Human
ccauaaaguaggaaacacuaca

SEQ ID NO: 13107 - RNA, 22 nt, Human
ccauagucacuuguccucuuuu

SEQ ID NO: 13108 - RNA, 21 nt, Human
ccaucuugaaccaugcccacu

SEQ ID NO: 13109 - RNA, 22 nt, Human
ccaugauguugccuacacugcu

SEQ ID NO: 13110 - RNA, 22 nt, Human
ccauggaaaagacgggcaggcc

SEQ ID NO: 13111 - RNA, 22 nt, Human
ccauggaugcucagauguuagc

SEQ ID NO: 13112 - RNA, 22 nt, Human
ccaugggugucuggagcacccu

SEQ ID NO: 13113 - RNA, 22 nt, Human
ccauguaagcuggacuccuggg

SEQ ID NO: 13114 - RNA, 22 nt, Human
ccaugugaccugugucaguugc

SEQ ID NO: 13115 - RNA, 23 nt, Human
ccaugugcaggguucagcacuua

SEQ ID NO: 13116 - RNA, 22 nt, Human
ccauuucacaucccugacaugu

SEQ ID NO: 13117 - RNA, 22 nt, Human
ccauuuggccauucaguuguuc

SEQ ID NO: 13118 - RNA, 18 nt, Human
cccaccugcccagguuca

SEQ ID NO: 13119 - RNA, 22 nt, Human
cccagaagaguauguguuugcu

SEQ ID NO: 13120 - RNA, 22 nt, Human
cccagaaugauucagcgacagu

SEQ ID NO: 13121 - RNA, 22 nt, Human
cccagagacuuuguccgacgac

SEQ ID NO: 13122 - RNA, 22 nt, Human
cccagaggcugaguugggagca

SEQ ID NO: 13123 - RNA, 22 nt, Human
cccagagggcugaggauaugaa

SEQ ID NO: 13124 - RNA, 22 nt, Human
cccagccgcuguggucuagggu

SEQ ID NO: 13125 - RNA, 22 nt, Human
cccagccuuugcuuccugguuc

SEQ ID NO: 13126 - RNA, 22 nt, Human
cccagcgccugcccuccgccgc

SEQ ID NO: 13127 - RNA, 22 nt, Human
cccagcucuggaagguggggga

SEQ ID NO: 13128 - RNA, 22 nt, Human
cccagcugaacuugcauuccaa

SEQ ID NO: 13129 - RNA, 22 nt, Human
cccagcuuugcggacccgggag

SEQ ID NO: 13130 - RNA, 22 nt, Human
cccaggucgucagcaguguggu

SEQ ID NO: 13131 - RNA, 22 nt, Human
cccauggacuagcuaugagcag

SEQ ID NO: 13132 - RNA, 22 nt, Human
ccccaaauuugugcuuucauag

SEQ ID NO: 13133 - RNA, 20 nt, Human
ccccagcauccuuuucaucu

SEQ ID NO: 13134 - RNA, 22 nt, Human
ccccaguuucaccuaccccgcc

SEQ ID NO: 13135 - RNA, 22 nt, Human
ccccauggaaaacccaccuagg

SEQ ID NO: 13136 - RNA, 22 nt, Human
ccccccaaaacuacuggccugu

SEQ ID NO: 13137 - RNA, 22 nt, Human
cccccucuggcuccagucugac

SEQ ID NO: 13138 - RNA, 22 nt, Human
ccccguggcugggggacagagc

SEQ ID NO: 13139 - RNA, 22 nt, Human
ccccuauaugccugcagugauu

SEQ ID NO: 13140 - RNA, 16 nt, Human
ccccucaggaaguaca

SEQ ID NO: 13141 - RNA, 22 nt, Human
ccccucuguagcccgagcugcu

SEQ ID NO: 13142 - RNA, 22 nt, Human
ccccugggcccugagccgcgau

SEQ ID NO: 13143 - RNA, 22 nt, Human
ccccuuuguagcccagcaguug

SEQ ID NO: 13144 - RNA, 22 nt, Human
cccgaaaauuguuguacugcag

SEQ ID NO: 13145 - RNA, 22 nt, Human
cccgacuccuccugguaccuaa

SEQ ID NO: 13146 - RNA, 22 nt, Human
cccgaggagagguccaggcccu

SEQ ID NO: 13147 - RNA, 22 nt, Human
cccgcucaccccacuccaccag

SEQ ID NO: 13148 - RNA, 22 nt, Human
cccggagcagucgggcuccggg

SEQ ID NO: 13149 - RNA, 22 nt, Human
cccggcgccucguuuccuaguc

SEQ ID NO: 13150 - RNA, 22 nt, Human
cccggcucggcuucuuccccac

SEQ ID NO: 13151 - RNA, 22 nt, Human
cccgguugggguuccagggcgc

SEQ ID NO: 13152 - RNA, 22 nt, Human
cccgugggaugagaggcccugg

SEQ ID NO: 13153 - RNA, 22 nt, Human
cccuagccuuguuuuccuuaga

SEQ ID NO: 13154 - RNA, 19 nt, Human
cccucggcuucugguuacu

SEQ ID NO: 13155 - RNA, 17 nt, Human
cccugcacccuacucuc

SEQ ID NO: 13156 - RNA, 22 nt, Human
cccugcacuguguggacucugg

SEQ ID NO: 13157 - RNA, 20 nt, Human
cccuggaaugagaugcauau

SEQ ID NO: 13158 - RNA, 22 nt, Human
cccuggcucaggcagcuuuguu

SEQ ID NO: 13159 - RNA, 22 nt, Human
cccugggccccgaacugcugag

SEQ ID NO: 13160 - RNA, 22 nt, Human
cccugggucagagcgacuucuc

SEQ ID NO: 13161 - RNA, 22 nt, Human
cccuguccugcuaggcccuggu

SEQ ID NO: 13162 - RNA, 22 nt, Human
cccuuggaaaugguucuuaacu

SEQ ID NO: 13163 - RNA, 22 nt, Human
uagguuguaagaggucuuuugu

SEQ ID NO: 13164 - RNA, 22 nt, Human
uagguuguuguggggauuaagu

SEQ ID NO: 13165 - RNA, 22 nt, Human
uaguaauauuccuacauuaugu

SEQ ID NO: 13166 - RNA, 22 nt, Human
uaguacuaaauagggugauaaa

SEQ ID NO: 13167 - RNA, 22 nt, Human
uaguacuugauuuuaaauguua

SEQ ID NO: 13168 - RNA, 22 nt, Human
uaguagcuguuguuuuuuaaac

SEQ ID NO: 13169 - RNA, 22 nt, Human
uaguaugaaaauuagcgggagg

SEQ ID NO: 13170 - RNA, 22 nt, Human
uaguauuguguuguuugacagu

SEQ ID NO: 13171 - RNA, 22 nt, Human
uaguccacagagggcaggguca

SEQ ID NO: 13172 - RNA, 22 nt, Human
uagucucagaauauuugcugau

SEQ ID NO: 13173 - RNA, 22 nt, Human
uagucuuuguggucuuuagcua

SEQ ID NO: 13174 - RNA, 22 nt, Human
uagugauuuaagaaaggugacu

SEQ ID NO: 13175 - RNA, 22 nt, Human
uaguggaaacagacugagcccg

SEQ ID NO: 13176 - RNA, 22 nt, Human
uaguggccacugaagugcuaga

SEQ ID NO: 13177 - RNA, 22 nt, Human
uagugggguccacuuccuucac

SEQ ID NO: 13178 - RNA, 22 nt, Human
uagugucuuccaggacauggua

SEQ ID NO: 13179 - RNA, 22 nt, Human
uaguguguggucucucccuugu

SEQ ID NO: 13180 - RNA, 23 nt, Human
uaguguuauuaauuaguaaggau

SEQ ID NO: 13181 - RNA, 22 nt, Human
uaguguuauuucuuaugugcua

SEQ ID NO: 13182 - RNA, 22 nt, Human
uaguuacuuuugcucuucauua

SEQ ID NO: 13183 - RNA, 22 nt, Human
uaguuagagggaagcgacucgg

SEQ ID NO: 13184 - RNA, 22 nt, Human
uaguuaggauucccaggaaacc

SEQ ID NO: 13185 - RNA, 22 nt, Human
uaguuauuucugcacuuaauga

SEQ ID NO: 13186 - RNA, 22 nt, Human
uaguuccucuucucagggccau

SEQ ID NO: 13187 - RNA, 22 nt, Human
uaguucugaauagcauugaaga

SEQ ID NO: 13188 - RNA, 22 nt, Human
uaguugaauuuaucaguagcau

SEQ ID NO: 13189 - RNA, 22 nt, Human
uaguuggguagacaguucuaca

SEQ ID NO: 13190 - RNA, 22 nt, Human
uaguugguggagcgauuugucu

SEQ ID NO: 13191 - RNA, 22 nt, Human
uaguuuucuuuuguguuauucu

SEQ ID NO: 13192 - RNA, 22 nt, Human
uauaagaaacaaggcaaauuuu

SEQ ID NO: 13193 - RNA, 22 nt, Human
uauaaugucuuuguugaaaucu

SEQ ID NO: 13194 - RNA, 22 nt, Human
uauagcccaaucuggaugcagu

SEQ ID NO: 13195 - RNA, 22 nt, Human
uauaggguggguaaggaaaaaa

SEQ ID NO: 13196 - RNA, 22 nt, Human
uauauacuugaaaauugcugag

SEQ ID NO: 13197 - RNA, 22 nt, Human
uauauauaauguguacagguga

SEQ ID NO: 13198 - RNA, 22 nt, Human
ucagaaacuaaauguggauuug

SEQ ID NO: 13199 - RNA, 22 nt, Human
ucagaacugcggggaagguggg

SEQ ID NO: 13200 - RNA, 22 nt, Human
ucagaaggagagacagcgugga

SEQ ID NO: 13201 - RNA, 22 nt, Human
ucagaagguacugaagacaugg

SEQ ID NO: 13202 - RNA, 21 nt, Human
ucagaaucguuccagguagau

SEQ ID NO: 13203 - RNA, 22 nt, Human
ucagaaugaaauuucuuucaga

SEQ ID NO: 13204 - RNA, 20 nt, Human
ucagaaugugacccccaugg

SEQ ID NO: 13205 - RNA, 23 nt, Human
ucagaccaaccucuugcuggaac

SEQ ID NO: 13206 - RNA, 21 nt, Human
ucagaccaacucuuguauccu

SEQ ID NO: 13207 - RNA, 22 nt, Human
ucagacucaguuuugucuccug

SEQ ID NO: 13208 - RNA, 22 nt, Human
ucagagaaguaggcuaauggug

SEQ ID NO: 13209 - RNA, 22 nt, Human
ucagagacaucagguuguagca

SEQ ID NO: 13210 - RNA, 22 nt, Human
ucagagagagagaggcggaaga

SEQ ID NO: 13211 - RNA, 22 nt, Human
ucagagccagacacacagcaga

SEQ ID NO: 13212 - RNA, 22 nt, Human
ucagauagcaagggauaccugu

SEQ ID NO: 13213 - RNA, 22 nt, Human
ucagauggucauucacuagggu

SEQ ID NO: 13214 - RNA, 22 nt, Human
ucagcacagcugcuuuuacuuc

SEQ ID NO: 13215 - RNA, 22 nt, Human
ucagcaggugcuuuguuuacuc

SEQ ID NO: 13216 - RNA, 23 nt, Human
ucagccgcuggcgaguccacugg

SEQ ID NO: 13217 - RNA, 22 nt, Human
ucagcgucuccaaaagagcccg

SEQ ID NO: 13218 - RNA, 22 nt, Human
ucagcguuggccuccuccaggg

SEQ ID NO: 13219 - RNA, 22 nt, Human
ucagcucaggggauguggggga

SEQ ID NO: 13220 - RNA, 22 nt, Human
ucagcugggagaaaguuuuagg

SEQ ID NO: 13221 - RNA, 22 nt, Human
ucagcuucaucuugagcccaca

SEQ ID NO: 13222 - RNA, 21 nt, Human
ucaggaagagccaguucaugc

SEQ ID NO: 13223 - RNA, 22 nt, Human
ucaggacacuuaauaggaacag

SEQ ID NO: 13224 - RNA, 22 nt, Human
ucaggagaguguucaguggagg

SEQ ID NO: 13225 - RNA, 19 nt, Human
ucaggaggucgaccuggca

SEQ ID NO: 13226 - RNA, 22 nt, Human
ucaggaggucugcugcggggug

SEQ ID NO: 13227 - RNA, 22 nt, Human
ucaggcaggaucccagggaagg

SEQ ID NO: 13228 - RNA, 22 nt, Human
ucaggcuagcccagugcuuggg

SEQ ID NO: 13229 - RNA, 20 nt, Human
ucaggguuucccauucuugg

SEQ ID NO: 13230 - RNA, 22 nt, Human
ucagguuuaagcuacuggaauc

SEQ ID NO: 13231 - RNA, 22 nt, Human
ucagguuugcaaccucgggcaa

SEQ ID NO: 13232 - RNA, 22 nt, Human
ucaguauaugaauuugggggua

SEQ ID NO: 13233 - RNA, 22 nt, Human
ucaguauuagugcauuaucagg

SEQ ID NO: 13234 - RNA, 22 nt, Human
ucagucacugucucagacagga

SEQ ID NO: 13235 - RNA, 22 nt, Human
ucagucauguuuaccagacgua

SEQ ID NO: 13236 - RNA, 22 nt, Human
ucagucucuggggcuucuguuu

SEQ ID NO: 13237 - RNA, 22 nt, Human
ucagucugguggaugcucauug

SEQ ID NO: 13238 - RNA, 22 nt, Human
ucagugagauuuuuagcaguag

SEQ ID NO: 13239 - RNA, 22 nt, Human
ucagugauccagauauuugagc

SEQ ID NO: 13240 - RNA, 23 nt, Human
ucagugccaaggagaacuuggug

SEQ ID NO: 13241 - RNA, 20 nt, Human
ucaguggcauaguugcuaag

SEQ ID NO: 13242 - RNA, 20 nt, Human
ucagugggaaagugagagug

SEQ ID NO: 13243 - RNA, 22 nt, Human
ucagugugacccuucuauuuuu

SEQ ID NO: 13244 - RNA, 22 nt, Human
ucaguuacucugauguccugug

SEQ ID NO: 13245 - RNA, 22 nt, Human
ucaguuccccaaagccuccuag

SEQ ID NO: 13246 - RNA, 22 nt, Human
ucaguugagguggucuauugcg

SEQ ID NO: 13247 - RNA, 22 nt, Human
ucaguuguuggaaguagaugua

SEQ ID NO: 13248 - RNA, 22 nt, Human
ucaguuuaauuggaucuuuuuc

SEQ ID NO: 13249 - RNA, 22 nt, Human
ucaguuuaucuagcugggggaa

SEQ ID NO: 13250 - RNA, 16 nt, Human
ucauaaacugcagcuu

SEQ ID NO: 13251 - RNA, 22 nt, Human
ucauaaguuguugacuagcaaa

SEQ ID NO: 13252 - RNA, 22 nt, Human
ucauaggaguagcagugagagg

SEQ ID NO: 13253 - RNA, 22 nt, Human
ucauaucauuuugaaagcugag

SEQ ID NO: 13254 - RNA, 22 nt, Human
ucauauugguagagauguguaa

SEQ ID NO: 13255 - RNA, 22 nt, Human
ucaucagccaaagaguccuuca

SEQ ID NO: 13256 - RNA, 22 nt, Human
ucaucauccuuuuuugaagagu

SEQ ID NO: 13257 - RNA, 22 nt, Human
ucauccgcaaccacuuuagccu

SEQ ID NO: 13258 - RNA, 22 nt, Human
ucauccugaagaaccugcuucc

SEQ ID NO: 13259 - RNA, 22 nt, Human
ucauccugucucuguucggaau

SEQ ID NO: 13260 - RNA, 22 nt, Human
ucaucgauggggagcucuacaa

SEQ ID NO: 13261 - RNA, 22 nt, Human
ucaucggcugucaucuucacgu

SEQ ID NO: 13262 - RNA, 22 nt, Human
ucaucuauaaguagcaucuggg

SEQ ID NO: 13263 - RNA, 22 nt, Human
ucaucuuuauaaugcaaguuuu

SEQ ID NO: 13264 - RNA, 22 nt, Human
ucaucuuucuuuauggaaauac

SEQ ID NO: 13265 - RNA, 22 nt, Human
ucaugagagaaaacgugcuucu

SEQ ID NO: 13266 - RNA, 22 nt, Human
ucaugccugcgauugucccugg

SEQ ID NO: 13267 - RNA, 22 nt, Human
ucauggcucuaaagacauagau

SEQ ID NO: 13268 - RNA, 22 nt, Human
ucaugggcaaacuuggggauca

SEQ ID NO: 13269 - RNA, 22 nt, Human
ucauggguauaauuuuagaugu

SEQ ID NO: 13270 - RNA, 22 nt, Human
ucauggucucccagcccccucu

SEQ ID NO: 13271 - RNA, 22 nt, Human
ucauguauucugggcaggagau

SEQ ID NO: 13272 - RNA, 22 nt, Human
ucauuagaccucucugguucag

SEQ ID NO: 13273 - RNA, 22 nt, Human
ucauuagauuccugugguggau

SEQ ID NO: 13274 - RNA, 22 nt, Human
ucauuagcuaucagaguggaac

SEQ ID NO: 13275 - RNA, 22 nt, Human
ucauuagucuuuaauacauaau

SEQ ID NO: 13276 - RNA, 22 nt, Human
ucauuauuuggaauaugggacu

SEQ ID NO: 13277 - RNA, 20 nt, Human
ucauucagaaucaguaugca

SEQ ID NO: 13278 - RNA, 22 nt, Human
ucauucucucguauucgcgaau

SEQ ID NO: 13279 - RNA, 22 nt, Human
ucauugguugcauaauuugauc

SEQ ID NO: 13280 - RNA, 22 nt, Human
ucauuguguaguagagguggca

SEQ ID NO: 13281 - RNA, 22 nt, Human
ucauugugugugcuucuugggc

SEQ ID NO: 13282 - RNA, 22 nt, Human
ucauuguuuacugucuuuuuuc

SEQ ID NO: 13283 - RNA, 22 nt, Human
ucauuuaauuuggaacucagag

SEQ ID NO: 13284 - RNA, 22 nt, Human
ucauuugggauuuuuuauaauu

SEQ ID NO: 13285 - RNA, 22 nt, Human
ucauuuuaucaggaauggaauc

SEQ ID NO: 13286 - RNA, 19 nt, Human
uccaaaauacuuguuacug

SEQ ID NO: 13287 - RNA, 18 nt, Human
uccaaaccuuuuacuucc

SEQ ID NO: 13288 - RNA, 21 nt, Human
uccaaaggagacugagugugu

SEQ ID NO: 13289 - RNA, 22 nt, Human
uccaaauagcuggaugauggug

SEQ ID NO: 13290 - RNA, 22 nt, Human
uccaaauucccaugacagaagu

SEQ ID NO: 13291 - RNA, 22 nt, Human
uccaacuuaauugggaagauua

SEQ ID NO: 13292 - RNA, 22 nt, Human
uccaagcgcuucuggagcuccu

SEQ ID NO: 13293 - RNA, 22 nt, Human
uccaaggcagacacauuuuuug

SEQ ID NO: 13294 - RNA, 22 nt, Human
uccaaggcuggaucuuuucuuu

SEQ ID NO: 13295 - RNA, 22 nt, Human
uccacaaagucuaugagaguug

SEQ ID NO: 13296 - RNA, 22 nt, Human
uccacagcagagcacgguaccu

SEQ ID NO: 13297 - RNA, 22 nt, Human
uccaccuaagucuccgggagcu

SEQ ID NO: 13298 - RNA, 22 nt, Human
uccaccugucccugcuuccugc

SEQ ID NO: 13299 - RNA, 22 nt, Human
uccacuaucagaccuguagucu

SEQ ID NO: 13300 - RNA, 22 nt, Human
uccacuguguagucucccaagu

SEQ ID NO: 13301 - RNA, 22 nt, Human
uccacuuaaaacucuuuuuguc

SEQ ID NO: 13302 - RNA, 22 nt, Human
uccagaaagccguugacuuauu

SEQ ID NO: 13303 - RNA, 22 nt, Human
uccagaaaucucuguugauugu

SEQ ID NO: 13304 - RNA, 22 nt, Human
uccagccauaucuuguagcccu

SEQ ID NO: 13305 - RNA, 22 nt, Human
uccagcugugcuccaggaggug

SEQ ID NO: 13306 - RNA, 22 nt, Human
uccaggagucagacagauggug

SEQ ID NO: 13307 - RNA, 23 nt, Human
ccuagcuuacugucaggugucuu

SEQ ID NO: 13308 - RNA, 22 nt, Human
ccuaggcccauuaauuccccuu

SEQ ID NO: 13309 - RNA, 22 nt, Human
ccuaggcuggcugucuucaggu

SEQ ID NO: 13310 - RNA, 22 nt, Human
ccuauuuucaaaauuguuuauc

SEQ ID NO: 13311 - RNA, 22 nt, Human
ccucaauucgugccucacauug

SEQ ID NO: 13312 - RNA, 22 nt, Human
ccucacaaagaaugucuagaca

SEQ ID NO: 13313 - RNA, 22 nt, Human
ccucaguguguggauguuagag

SEQ ID NO: 13314 - RNA, 22 nt, Human
ccucauagccuuuccuacuuua

SEQ ID NO: 13315 - RNA, 20 nt, Human
ccucauucucgcguguguuu

SEQ ID NO: 13316 - RNA, 22 nt, Human
ccuccccugccugugcuguugg

SEQ ID NO: 13317 - RNA, 19 nt, Human
ccuccgcauccucaucugu

SEQ ID NO: 13318 - RNA, 19 nt, Human
ccuccguguuaccuguccu

SEQ ID NO: 13319 - RNA, 22 nt, Human
ccuccugggccuugcucuguga

SEQ ID NO: 13320 - RNA, 22 nt, Human
ccuccuuucaggaaguaggugg

SEQ ID NO: 13321 - RNA, 22 nt, Human
ccucgcucauggauucugccug

SEQ ID NO: 13322 - RNA, 22 nt, Human
ccucgugcgauaguuaugucag

SEQ ID NO: 13323 - RNA, 22 nt, Human
ccucuaugcccuucuggggguc

SEQ ID NO: 13324 - RNA, 22 nt, Human
ccucuccuugcuccccuuccuu

SEQ ID NO: 13325 - RNA, 22 nt, Human
ccucucugcgaaugcugauagu

SEQ ID NO: 13326 - RNA, 20 nt, Human
ccucuuuaguugauggguuu

SEQ ID NO: 13327 - RNA, 22 nt, Human
ccugaagaugguugauccccuu

SEQ ID NO: 13328 - RNA, 22 nt, Human
ccugaauuuaucugaauggugg

SEQ ID NO: 13329 - RNA, 22 nt, Human
ccugacuugguuuaggagaugg

SEQ ID NO: 13330 - RNA, 22 nt, Human
ccugagacucuccugugcagcc

SEQ ID NO: 13331 - RNA, 22 nt, Human
ccugagccgagcgcucuuucuc

SEQ ID NO: 13332 - RNA, 21 nt, Human
ccugagccuguuuauccagaa

SEQ ID NO: 13333 - RNA, 22 nt, Human
ccugaggcccuggcugugcuga

SEQ ID NO: 13334 - RNA, 21 nt, Human
ccugagucccccagacccugg

SEQ ID NO: 13335 - RNA, 22 nt, Human
ccugaguucuuauuuccaguca

SEQ ID NO: 13336 - RNA, 21 nt, Human
ccugcacuucccuccucaagu

SEQ ID NO: 13337 - RNA, 22 nt, Human
ccugcaguuuuuccaugauaca

SEQ ID NO: 13338 - RNA, 22 nt, Human
ccugcaugacuuugucagaccu

SEQ ID NO: 13339 - RNA, 22 nt, Human
ccugccagccugccaucccaca

SEQ ID NO: 13340 - RNA, 22 nt, Human
ccugccuuccagcucuggggag

SEQ ID NO: 13341 - RNA, 19 nt, Human
ccugcugaagugaugcagc

SEQ ID NO: 13342 - RNA, 22 nt, Human
ccugcugagccuggugggcagc

SEQ ID NO: 13343 - RNA, 22 nt, Human
ccugcugcugaugcuguuucac

SEQ ID NO: 13344 - RNA, 22 nt, Human
ccugcuggagucuaguuggucu

SEQ ID NO: 13345 - RNA, 22 nt, Human
ccuggaccgacacaggaaggga

SEQ ID NO: 13346 - RNA, 22 nt, Human
ccuggcauuagaaauuccguca

SEQ ID NO: 13347 - RNA, 22 nt, Human
ccuggccacagggcucugcauu

SEQ ID NO: 13348 - RNA, 23 nt, Human
ccuggcugaccugaagguguagu

SEQ ID NO: 13349 - RNA, 22 nt, Human
ccugggcauuuguuucacaggu

SEQ ID NO: 13350 - RNA, 20 nt, Human
ccugggcuccaggagccccg

SEQ ID NO: 13351 - RNA, 22 nt, Human
ccugggcucgcgcacuucaccc

SEQ ID NO: 13352 - RNA, 21 nt, Human
ccugucagcccaacuuuugga

SEQ ID NO: 13353 - RNA, 22 nt, Human
ccugucugaaggcagggggaug

SEQ ID NO: 13354 - RNA, 22 nt, Human
ccugucuuuucugaucauacua

SEQ ID NO: 13355 - RNA, 22 nt, Human
ccugugacucugucugaugguc

SEQ ID NO: 13356 - RNA, 19 nt, Human
ccugugaguuaagcuaugu

SEQ ID NO: 13357 - RNA, 22 nt, Human
ccugugcuucacucaacaagcc

SEQ ID NO: 13358 - RNA, 20 nt, Human
ccuguucacugcgcaguuuc

SEQ ID NO: 13359 - RNA, 22 nt, Human
ccuguuuguucauguacuguga

SEQ ID NO: 13360 - RNA, 22 nt, Human
ccuuaauaguguucuaauguuu

SEQ ID NO: 13361 - RNA, 22 nt, Human
ccuuagcuggguaacuuugggc

SEQ ID NO: 13362 - RNA, 18 nt, Human
ccuucaucucugcuucuu

SEQ ID NO: 13363 - RNA, 22 nt, Human
ccuucgcuggcaucuccaggua

SEQ ID NO: 13364 - RNA, 22 nt, Human
ccuucugcuggucaucccagug

SEQ ID NO: 13365 - RNA, 22 nt, Human
ccuucuuaaacaucauuuuggc

SEQ ID NO: 13366 - RNA, 22 nt, Human
ccuugauaugcuucagagaauu

SEQ ID NO: 13367 - RNA, 22 nt, Human
ccuugcgaggaugcugugagcu

SEQ ID NO: 13368 - RNA, 22 nt, Human
ccuugcuucuagcauucccaug

SEQ ID NO: 13369 - RNA, 22 nt, Human
ccuuuccuggaaaugguaaguu

SEQ ID NO: 13370 - RNA, 22 nt, Human
ccuuucuaacagauuguggauc

SEQ ID NO: 13371 - RNA, 22 nt, Human
ccuuucucuuggauaccgauug

SEQ ID NO: 13372 - RNA, 22 nt, Human
ccuuucuggucucugagagacu

SEQ ID NO: 13373 - RNA, 21 nt, Human
ccuuugaguguguuugaagua

SEQ ID NO: 13374 - RNA, 22 nt, Human
ccuuugcugggccucuccaucu

SEQ ID NO: 13375 - RNA, 21 nt, Human
ccuuuggagacugcagcaaug

SEQ ID NO: 13376 - RNA, 22 nt, Human
ccuuuuaagggagacuagagau

SEQ ID NO: 13377 - RNA, 20 nt, Human
ccuuuuguugcuguuuggau

SEQ ID NO: 13378 - RNA, 22 nt, Human
ccuuuuguuucccuuuauguuc

SEQ ID NO: 13379 - RNA, 22 nt, Human
ccuuuuuagaugugcgaauguu

SEQ ID NO: 13380 - RNA, 22 nt, Human
cgaacggcagagagcccguccc

SEQ ID NO: 13381 - RNA, 22 nt, Human
cgaagcuuuuguuggcgugucg

SEQ ID NO: 13382 - RNA, 22 nt, Human
cgaaggaaucacuuaacacuuu

SEQ ID NO: 13383 - RNA, 22 nt, Human
cgacagauuauuuugugacugc

SEQ ID NO: 13384 - RNA, 23 nt, Human
cgagagccugcaggaccuucgga

SEQ ID NO: 13385 - RNA, 22 nt, Human
cgagcccacacuccuguccucu

SEQ ID NO: 13386 - RNA, 22 nt, Human
cgaggagguccaggagcaguag

SEQ ID NO: 13387 - RNA, 22 nt, Human
cgaggccgcuucauggcuggca

SEQ ID NO: 13388 - RNA, 22 nt, Human
cgagggcuggaggggagacaga

SEQ ID NO: 13389 - RNA, 22 nt, Human
uccucuucucuagagccggaau

SEQ ID NO: 13390 - RNA, 20 nt, Human
uccugaaauuacgugauuca

SEQ ID NO: 13391 - RNA, 22 nt, Human
uccugagaagcacuuaauacac

SEQ ID NO: 13392 - RNA, 23 nt, Human
uccugcagauaagcugguugaca

SEQ ID NO: 13393 - RNA, 21 nt, Human
uccugcagggcagcagagugg

SEQ ID NO: 13394 - RNA, 21 nt, Human
uccugccuuaguccagagcag

SEQ ID NO: 13395 - RNA, 22 nt, Human
uccugcucucuccauuccuucc

SEQ ID NO: 13396 - RNA, 22 nt, Human
uccugcuucaaucugcugcugg

SEQ ID NO: 13397 - RNA, 22 nt, Human
uccuggccucugagucaagaac

SEQ ID NO: 13398 - RNA, 22 nt, Human
uccuggccuuggggagagaagu

SEQ ID NO: 13399 - RNA, 22 nt, Human
uccuggcgugggcuggcugcag

SEQ ID NO: 13400 - RNA, 22 nt, Human
uccugggcuugcucuuuccauu

SEQ ID NO: 13401 - RNA, 22 nt, Human
uccugggucugugagccauacu

SEQ ID NO: 13402 - RNA, 22 nt, Human
uccugguaaagaguaucagauu

SEQ ID NO: 13403 - RNA, 22 nt, Human
uccuuaggaccuagagguagua

SEQ ID NO: 13404 - RNA, 19 nt, Human
uccuuaguugcugccgcua

SEQ ID NO: 13405 - RNA, 22 nt, Human
uccuucuguuguuuauuuuaaa

SEQ ID NO: 13406 - RNA, 22 nt, Human
uccuucuuuucgccggaguuga

SEQ ID NO: 13407 - RNA, 22 nt, Human
uccuugaauugcguccacaaga

SEQ ID NO: 13408 - RNA, 19 nt, Human
uccuugacuguauucagag

SEQ ID NO: 13409 - RNA, 22 nt, Human
uccuuggagaaucuuguuuuac

SEQ ID NO: 13410 - RNA, 22 nt, Human
uccuuguuggaauauccuuacc

SEQ ID NO: 13411 - RNA, 21 nt, Human
uccuuguuucuuccaaaacug

SEQ ID NO: 13412 - RNA, 22 nt, Human
uccuuuauuuaugggcagugua

SEQ ID NO: 13413 - RNA, 22 nt, Human
uccuuucaaauuuauuugacau

SEQ ID NO: 13414 - RNA, 22 nt, Human
uccuuuucuuugaggaaggugu

SEQ ID NO: 13415 - RNA, 22 nt, Human
ucgaaacuucucauuuaucugu

SEQ ID NO: 13416 - RNA, 22 nt, Human
ucuggaaauggaaguaacuaug

SEQ ID NO: 13417 - RNA, 22 nt, Human
ucuggcacuugccaguuucuau

SEQ ID NO: 13418 - RNA, 22 nt, Human
ucuggcuucaguaggguucacu

SEQ ID NO: 13419 - RNA, 22 nt, Human
ucugggaccuagacccauuguu

SEQ ID NO: 13420 - RNA, 22 nt, Human
ucugggccaacccuuccauggg

SEQ ID NO: 13421 - RNA, 22 nt, Human
ucuggggaugagugaugucgua

SEQ ID NO: 13422 - RNA, 22 nt, Human
ucugggguucuuaauuuggaag

SEQ ID NO: 13423 - RNA, 22 nt, Human
ucuggguaacugaggcuaauau

SEQ ID NO: 13424 - RNA, 22 nt, Human
ucugguagauuauuuagaguac

SEQ ID NO: 13425 - RNA, 22 nt, Human
ucugguuaggcuugugaggucc

SEQ ID NO: 13426 - RNA, 22 nt, Human
ucugguuucccaguuccuccgu

SEQ ID NO: 13427 - RNA, 22 nt, Human
ucuguaacaucaguguaauuuu

SEQ ID NO: 13428 - RNA, 22 nt, Human
ucuguaauccacacagguggau

SEQ ID NO: 13429 - RNA, 22 nt, Human
ucuguaccuuauguucagagug

SEQ ID NO: 13430 - RNA, 22 nt, Human
ucuguagcuuuagaggacagga

SEQ ID NO: 13431 - RNA, 22 nt, Human
ucuguagucuuggagccgcaca

SEQ ID NO: 13432 - RNA, 22 nt, Human
ucugucaguguccucguguggu

SEQ ID NO: 13433 - RNA, 21 nt, Human
ucugucuaguuaccaccgccc

SEQ ID NO: 13434 - RNA, 22 nt, Human
ucugugcuggacugauuucaua

SEQ ID NO: 13435 - RNA, 21 nt, Human
ucugugcuuuuuuggcuccua

SEQ ID NO: 13436 - RNA, 19 nt, Human
ucuguggagcucagaguag

SEQ ID NO: 13437 - RNA, 20 nt, Human
ucuguggcagguggcgcuug

SEQ ID NO: 13438 - RNA, 19 nt, Human
ucuguggccuucccugaug

SEQ ID NO: 13439 - RNA, 17 nt, Human
ucuguguccgcucaguc

SEQ ID NO: 13440 - RNA, 20 nt, Human
ucugugugccaucaccuaac

SEQ ID NO: 13441 - RNA, 22 nt, Human
ucugugugugcauguguguaua

SEQ ID NO: 13442 - RNA, 22 nt, Human
ucuguguguguggcuaaacaag

SEQ ID NO: 13443 - RNA, 22 nt, Human
ucuguguuccuggcaccaaacu

SEQ ID NO: 13444 - RNA, 22 nt, Human
ucuguucacaauuacacacacu

SEQ ID NO: 13445 - RNA, 22 nt, Human
ucuguucaugucuuuuuaagug

SEQ ID NO: 13446 - RNA, 22 nt, Human
ucuguucucuuguucugacggu

SEQ ID NO: 13447 - RNA, 19 nt, Human
ucuguugcuuuguguccuc

SEQ ID NO: 13448 - RNA, 22 nt, Human
ucuguuuacaugucagcagcaa

SEQ ID NO: 13449 - RNA, 22 nt, Human
ucuguuuuuaucuauucuguua

SEQ ID NO: 13450 - RNA, 22 nt, Human
ucuguuuuucagaccuuuuugg

SEQ ID NO: 13451 - RNA, 22 nt, Human
ucuuaaauaugaaaaggauuau

SEQ ID NO: 13452 - RNA, 22 nt, Human
ucuuagacagagaagacuauug

SEQ ID NO: 13453 - RNA, 22 nt, Human
ucuuauugguaaugauggcauu

SEQ ID NO: 13454 - RNA, 22 nt, Human
ucuuauugugaugaugaagaac

SEQ ID NO: 13455 - RNA, 22 nt, Human
ucuuauuucuuucuuuuccugu

SEQ ID NO: 13456 - RNA, 22 nt, Human
ucuucaaauacagucauauuga

SEQ ID NO: 13457 - RNA, 22 nt, Human
ucuucacagaugcauauacuuc

SEQ ID NO: 13458 - RNA, 22 nt, Human
ucuucaguaaucgacauuccac

SEQ ID NO: 13459 - RNA, 22 nt, Human
ucuucaugaaauugauugcuua

SEQ ID NO: 13460 - RNA, 22 nt, Human
ucuucauuucuggggaauuggc

SEQ ID NO: 13461 - RNA, 22 nt, Human
ucuuccacuugaaccuucuguc

SEQ ID NO: 13462 - RNA, 19 nt, Human
ucuuccaucuauccuccuc

SEQ ID NO: 13463 - RNA, 22 nt, Human
ucuucccgggcaucucugcuca

SEQ ID NO: 13464 - RNA, 22 nt, Human
ucuuccucuccuggggcauuug

SEQ ID NO: 13465 - RNA, 22 nt, Human
ucuucuuacauuaaguugaaac

SEQ ID NO: 13466 - RNA, 22 nt, Human
ucuucuuaggaaagucaggagg

SEQ ID NO: 13467 - RNA, 22 nt, Human
ucuucuuugugguugcccaagg

SEQ ID NO: 13468 - RNA, 19 nt, Human
ucuugaggaaaguaaggca

SEQ ID NO: 13469 - RNA, 19 nt, Human
ucuugcaucuuccuacugu

SEQ ID NO: 13470 - RNA, 22 nt, Human
ucuugccuuuucuagcuucuag

SEQ ID NO: 13471 - RNA, 22 nt, Human
ucuugcuguagcuguuucuucu

SEQ ID NO: 13472 - RNA, 22 nt, Human
ucuugcuguggcagaucuggag

SEQ ID NO: 13473 - RNA, 22 nt, Human
ucuugggcaguccucuacuggu

SEQ ID NO: 13474 - RNA, 22 nt, Human
ucuuggucccugagcucuuuca

SEQ ID NO: 13475 - RNA, 22 nt, Human
ucuugugguggaucccucauuu

SEQ ID NO: 13476 - RNA, 22 nt, Human
ucuuguuaaagguuaaagguga

SEQ ID NO: 13477 - RNA, 22 nt, Human
ucuuuaaggggccuuuguguca

SEQ ID NO: 13478 - RNA, 22 nt, Human
ucuuuaagugugugccuccagg

SEQ ID NO: 13479 - RNA, 22 nt, Human
ucuuuaucugugagcagucucc

SEQ ID NO: 13480 - RNA, 22 nt, Human
ucuuuauuucccuaacuugcua

SEQ ID NO: 13481 - RNA, 19 nt, Human
ucuuucauuucuagcucug

SEQ ID NO: 13482 - RNA, 22 nt, Human
ucuuuccagaccagccccagcu

SEQ ID NO: 13483 - RNA, 23 nt, Human
ucuuuccuuucauacagucagcu

SEQ ID NO: 13484 - RNA, 22 nt, Human
ucuuucugaugggaagggucaa

SEQ ID NO: 13485 - RNA, 22 nt, Human
ucuuugcagaauuuaacuuugc

SEQ ID NO: 13486 - RNA, 17 nt, Human
ucuuuuacuuucucucc

SEQ ID NO: 13487 - RNA, 22 nt, Human
ucuuuuaucuguuguguaacaa

SEQ ID NO: 13488 - RNA, 22 nt, Human
ucuuuuucccugguuccuuuuu

SEQ ID NO: 13489 - RNA, 22 nt, Human
ugaaagccuacagcucacuguu

SEQ ID NO: 13490 - RNA, 22 nt, Human
ugaaagcuggcucugcagagug

SEQ ID NO: 13491 - RNA, 22 nt, Human
ugaaauugaguaccucuuuaua

SEQ ID NO: 13492 - RNA, 22 nt, Human
ugaacagacuauucucccaugu

SEQ ID NO: 13493 - RNA, 22 nt, Human
ugaacagugugagggugugacc

SEQ ID NO: 13494 - RNA, 22 nt, Human
ugaacauuuuugcuugcagcuu

SEQ ID NO: 13495 - RNA, 22 nt, Human
ugaaccaugaauuacaggagca

SEQ ID NO: 13496 - RNA, 22 nt, Human
ugaaccgcuucauggugccugu

SEQ ID NO: 13497 - RNA, 22 nt, Human
ugaacuaauguuguguccuaau

SEQ ID NO: 13498 - RNA, 22 nt, Human
ugaacuggauuugugagcuccu

SEQ ID NO: 13499 - RNA, 22 nt, Human
ugaacuguccuuguugucuaga

SEQ ID NO: 13500 - RNA, 22 nt, Human
ugaagaauuccauggcuuccau

SEQ ID NO: 13501 - RNA, 22 nt, Human
ugaagacaguuuuacucaugag

SEQ ID NO: 13502 - RNA, 22 nt, Human
ugaagacuucuuuuggucacca

SEQ ID NO: 13503 - RNA, 21 nt, Human
ugaagccuagagaauugggga

SEQ ID NO: 13504 - RNA, 22 nt, Human
ugaagcuagguucaugaggucg

SEQ ID NO: 13505 - RNA, 21 nt, Human
ugaagggugagauauaaguga

SEQ ID NO: 13506 - RNA, 23 nt, Human
ugaagugaaauuucacaagggac

SEQ ID NO: 13507 - RNA, 22 nt, Human
ugaaguuuagaaaaagugccuu

SEQ ID NO: 13508 - RNA, 22 nt, Human
ugaauaaauaaacuuuuacuac

SEQ ID NO: 13509 - RNA, 22 nt, Human
ugaauagcaccuugaguaauga

SEQ ID NO: 13510 - RNA, 22 nt, Human
ugaauagucaaagcacaagagg

SEQ ID NO: 13511 - RNA, 22 nt, Human
ugaaucagaccuucauugggua

SEQ ID NO: 13512 - RNA, 22 nt, Human
ugaaucugagccugcgcaaagu

SEQ ID NO: 13513 - RNA, 22 nt, Human
ugaaugcuacccugcuggcucu

SEQ ID NO: 13514 - RNA, 22 nt, Human
ugaauguggucaggaaauuguu

SEQ ID NO: 13515 - RNA, 22 nt, Human
ugaauuacacugggaucagggc

SEQ ID NO: 13516 - RNA, 22 nt, Human
ugaauuauaugguauugaacau

SEQ ID NO: 13517 - RNA, 22 nt, Human
ugaauucaaacuuuuuaacaag

SEQ ID NO: 13518 - RNA, 22 nt, Human
ugaauuuguaggaauucuccau

SEQ ID NO: 13519 - RNA, 22 nt, Human
ugaauuuuaacauucugcugga

SEQ ID NO: 13520 - RNA, 22 nt, Human
ugacaagagaccccuccgcagg

SEQ ID NO: 13521 - RNA, 22 nt, Human
ugacacacagggggauggaguu

SEQ ID NO: 13522 - RNA, 22 nt, Human
ugacagaaaccaccccccaggu

SEQ ID NO: 13523 - RNA, 17 nt, Human
ugacagcuaaggggcuu

SEQ ID NO: 13524 - RNA, 22 nt, Human
ugacagucacagcagaaacucg

SEQ ID NO: 13525 - RNA, 22 nt, Human
cgcuggagagcaagugcgugca

SEQ ID NO: 13526 - RNA, 22 nt, Human
cgcugggugguugauguacagc

SEQ ID NO: 13527 - RNA, 22 nt, Human
cgcuucauugugggggccccca

SEQ ID NO: 13528 - RNA, 22 nt, Human
cgcuuuccaggcacauccucuu

SEQ ID NO: 13529 - RNA, 22 nt, Human
cggaggcugcuuucuguugcua

SEQ ID NO: 13530 - RNA, 22 nt, Human
cggagggcccucaggacugggu

SEQ ID NO: 13531 - RNA, 22 nt, Human
cggcccggccucgcggcgcaug

SEQ ID NO: 13532 - RNA, 22 nt, Human
cggccuuuggcuucuccugugu

SEQ ID NO: 13533 - RNA, 22 nt, Human
cggcgccccgcgcgggcggcuc

SEQ ID NO: 13534 - RNA, 22 nt, Human
cggcgcugguacaguggaagag

SEQ ID NO: 13535 - RNA, 22 nt, Human
cggcggcgaaccgaccugggug

SEQ ID NO: 13536 - RNA, 20 nt, Human
cgggacacucaagcucuggg

SEQ ID NO: 13537 - RNA, 22 nt, Human
cgggagagacagaggaggcgcc

SEQ ID NO: 13538 - RNA, 22 nt, Human
cgggagaugaggagagcuucgg

SEQ ID NO: 13539 - RNA, 22 nt, Human
cgggaggcggagcuccgcgggg

SEQ ID NO: 13540 - RNA, 22 nt, Human
cgggcacagguugagguagaug

SEQ ID NO: 13541 - RNA, 22 nt, Human
cgggcccaggcaggggcucccc

SEQ ID NO: 13542 - RNA, 22 nt, Human
cgggcuccaagcuuucacccca

SEQ ID NO: 13543 - RNA, 22 nt, Human
cggggcaaggggggcuggugga

SEQ ID NO: 13544 - RNA, 22 nt, Human
cggggccccccagugaaccucu

SEQ ID NO: 13545 - RNA, 22 nt, Human
cggggcggcgagcgggccgggc

SEQ ID NO: 13546 - RNA, 22 nt, Human
cggggcgggcgugggaggugga

SEQ ID NO: 13547 - RNA, 22 nt, Human
cggggcucugcacaggccagga

SEQ ID NO: 13548 - RNA, 19 nt, Human
cggggcuugguggguucuc

SEQ ID NO: 13549 - RNA, 22 nt, Human
cggggucuggaguuguggugug

SEQ ID NO: 13550 - RNA, 22 nt, Human
cggguccuucugucuucucugg

SEQ ID NO: 13551 - RNA, 19 nt, Human
cgguaugaauguacuaugg

SEQ ID NO: 13552 - RNA, 22 nt, Human
cggucggagagaaugaccugga

SEQ ID NO: 13553 - RNA, 22 nt, Human
cggucuauuguguaucauuuca

SEQ ID NO: 13554 - RNA, 22 nt, Human
cggugccccuagcgcgccgccc

SEQ ID NO: 13555 - RNA, 19 nt, Human
cggugcugauuggugcagu

SEQ ID NO: 13556 - RNA, 22 nt, Human
cggugcuuuccauaucagcagc

SEQ ID NO: 13557 - RNA, 22 nt, Human
cgguugcaggaugugcgggcag

SEQ ID NO: 13558 - RNA, 22 nt, Human
cgguuuuuaaaagucucuucua

SEQ ID NO: 13559 - RNA, 22 nt, Human
cguauauaaauguauauacaca

SEQ ID NO: 13560 - RNA, 21 nt, Human
cgucccggcgugagagagcug

SEQ ID NO: 13561 - RNA, 22 nt, Human
cgucuaaggaacuccauucaca

SEQ ID NO: 13562 - RNA, 22 nt, Human
cgugaagaaguaauagguggug

SEQ ID NO: 13563 - RNA, 17 nt, Human
cgugaggaccaggcagc

SEQ ID NO: 13564 - RNA, 22 nt, Human
cgugcaggagcuggagguccga

SEQ ID NO: 13565 - RNA, 22 nt, Human
cguggaggucgcauauuccucu

SEQ ID NO: 13566 - RNA, 22 nt, Human
cguggcaguagagcuggaacuu

SEQ ID NO: 13567 - RNA, 22 nt, Human
cgugggggcaacgaccccuccc

SEQ ID NO: 13568 - RNA, 17 nt, Human
cguuccagaacaaauga

SEQ ID NO: 13569 - RNA, 22 nt, Human
cguucccuccugccacgggagg

SEQ ID NO: 13570 - RNA, 20 nt, Human
cguugccagcccggcccggg

SEQ ID NO: 13571 - RNA, 22 nt, Human
cguugguggguguguggucgga

SEQ ID NO: 13572 - RNA, 22 nt, Human
cguuuugaguagauagccauau

SEQ ID NO: 13573 - RNA, 22 nt, Human
cuaaaaauguucuaguaguuca

SEQ ID NO: 13574 - RNA, 20 nt, Human
cuaaaacaggugucuaguga

SEQ ID NO: 13575 - RNA, 22 nt, Human
cuaaaacuuuuccaaauuaugu

SEQ ID NO: 13576 - RNA, 22 nt, Human
cuaaacacuauucuggaaauag

SEQ ID NO: 13577 - RNA, 22 nt, Human
cuaaaccaauauauuuucuucc

SEQ ID NO: 13578 - RNA, 22 nt, Human
cuaaacuucauauguugcuuua

SEQ ID NO: 13579 - RNA, 22 nt, Human
cuaaagacagcaagacaucauc

SEQ ID NO: 13580 - RNA, 22 nt, Human
cuaaagucauacaaggugggag

SEQ ID NO: 13581 - RNA, 22 nt, Human
cuaaauguuuuaucuuccuggc

SEQ ID NO: 13582 - RNA, 22 nt, Human
cuaaauuuuuuagugaaauagg

SEQ ID NO: 13583 - RNA, 18 nt, Human
cuaagaggucguuucuca

SEQ ID NO: 13584 - RNA, 22 nt, Human
cuaagguacuugaugcacauau

SEQ ID NO: 13585 - RNA, 22 nt, Human
cuaauaauuuacugagugcuac

SEQ ID NO: 13586 - RNA, 22 nt, Human
cuaauugcuggcugcuggcaga

SEQ ID NO: 13587 - RNA, 22 nt, Human
cuacaaggucuuuaucugcuuu

SEQ ID NO: 13588 - RNA, 22 nt, Human
cuacacgauaaauuuuaguggu

SEQ ID NO: 13589 - RNA, 19 nt, Human
cuacaguguuuuucuuucc

SEQ ID NO: 13590 - RNA, 22 nt, Human
cuacauaaauuuaucacagacu

SEQ ID NO: 13591 - RNA, 18 nt, Human
cuacauucauaggaaagg

SEQ ID NO: 13592 - RNA, 22 nt, Human
cuaccagcacgccuuccucuac

SEQ ID NO: 13593 - RNA, 22 nt, Human
cuaccccaggccccucgaugcc

SEQ ID NO: 13594 - RNA, 22 nt, Human
cuacugaagcaugcuuauaugu

SEQ ID NO: 13595 - RNA, 22 nt, Human
cuacugacugaccauaguuuca

SEQ ID NO: 13596 - RNA, 22 nt, Human
cuacugaugccccgcugugccu

SEQ ID NO: 13597 - RNA, 22 nt, Human
cuacuucucccuagaucagaaa

SEQ ID NO: 13598 - RNA, 22 nt, Human
cuagaaaguaugcuuuuauaau

SEQ ID NO: 13599 - RNA, 22 nt, Human
cuagcaggacucagcagauauu

SEQ ID NO: 13600 - RNA, 19 nt, Human
cuagccucagugguuagua

SEQ ID NO: 13601 - RNA, 22 nt, Human
cuaggaugcuguaauggugucu

SEQ ID NO: 13602 - RNA, 22 nt, Human
cuaggggucccaagggugcucu

SEQ ID NO: 13603 - RNA, 22 nt, Human
cuagguggcagcacuccgaggu

SEQ ID NO: 13604 - RNA, 18 nt, Human
cuaguuuguuuucuacau

SEQ ID NO: 13605 - RNA, 22 nt, Human
cuaguuuucacaaaggaagggc

SEQ ID NO: 13606 - RNA, 21 nt, Human
cuauaaaaaugguucuuugcg

SEQ ID NO: 13607 - RNA, 22 nt, Human
cuaugaaucaauuucugcaguu

SEQ ID NO: 13608 - RNA, 22 nt, Human
cuaugguaguggcacaggagga

SEQ ID NO: 13609 - RNA, 22 nt, Human
cuauguuuugcuagugaugggu

SEQ ID NO: 13610 - RNA, 22 nt, Human
cuauuaauggccaggagucaug

SEQ ID NO: 13611 - RNA, 22 nt, Human
cuauuauuauugucguuuuaca

SEQ ID NO: 13612 - RNA, 22 nt, Human
cuauuuucccauaugguugaca

SEQ ID NO: 13613 - RNA, 22 nt, Human
cucaaaauccauaaaaucaggu

SEQ ID NO: 13614 - RNA, 22 nt, Human
cucaagacacccuggccucuac

SEQ ID NO: 13615 - RNA, 22 nt, Human
cucaagugacucagccugguug

SEQ ID NO: 13616 - RNA, 22 nt, Human
cucaaugagcuauuuguuucau

SEQ ID NO: 13617 - RNA, 22 nt, Human
cucaauuguuuggucucugguu

SEQ ID NO: 13618 - RNA, 22 nt, Human
ugcaaggcacccacucugcuuu

SEQ ID NO: 13619 - RNA, 22 nt, Human
ugcaagugccauggauucaggu

SEQ ID NO: 13620 - RNA, 22 nt, Human
ugcaaugagcuucuuugauaaa

SEQ ID NO: 13621 - RNA, 22 nt, Human
ugcaauggauaucugaacgugg

SEQ ID NO: 13622 - RNA, 22 nt, Human
ugcacauuucucacaauguaca

SEQ ID NO: 13623 - RNA, 18 nt, Human
ugcacccuaagggcccca

SEQ ID NO: 13624 - RNA, 22 nt, Human
ugcacgcgcccuucgauggccc

SEQ ID NO: 13625 - RNA, 22 nt, Human
ugcagacuguuucuugacugaa

SEQ ID NO: 13626 - RNA, 22 nt, Human
ugcagagagccagcucucucgg

SEQ ID NO: 13627 - RNA, 22 nt, Human
ugcagaggagcuggaaggcugg

SEQ ID NO: 13628 - RNA, 22 nt, Human
ugcagcaucuccuugugccaug

SEQ ID NO: 13629 - RNA, 20 nt, Human
ugcagcucccccgcaguuuc

SEQ ID NO: 13630 - RNA, 22 nt, Human
ugcagcuucucugcaacaggag

SEQ ID NO: 13631 - RNA, 22 nt, Human
ugcagcuuuugguuucuagaug

SEQ ID NO: 13632 - RNA, 22 nt, Human
ugcaggagaaaguacggagcgu

SEQ ID NO: 13633 - RNA, 22 nt, Human
ugcaggagcaccagcucacccu

SEQ ID NO: 13634 - RNA, 22 nt, Human
ugcaggagcccaggaauacuau

SEQ ID NO: 13635 - RNA, 22 nt, Human
cuccaggacugaggacagagcu

SEQ ID NO: 13636 - RNA, 22 nt, Human
cuccaggcccagggccaagagc

SEQ ID NO: 13637 - RNA, 22 nt, Human
cuccagggcuaccagguuuuag

SEQ ID NO: 13638 - RNA, 22 nt, Human
cuccagucccuccuugcccagc

SEQ ID NO: 13639 - RNA, 22 nt, Human
cuccaguugugucuuguaagaa

SEQ ID NO: 13640 - RNA, 22 nt, Human
cuccaucccccugugugucaau

SEQ ID NO: 13641 - RNA, 22 nt, Human
cucccaucacaauucagggccu

SEQ ID NO: 13642 - RNA, 22 nt, Human
cuccccacucaacucccagacc

SEQ ID NO: 13643 - RNA, 22 nt, Human
cuccccauuuucaugggcaggu

SEQ ID NO: 13644 - RNA, 22 nt, Human
cucccucacaaagcauucucuu

SEQ ID NO: 13645 - RNA, 22 nt, Human
cucccucauaugguugcuuauc

SEQ ID NO: 13646 - RNA, 22 nt, Human
cucccuucaggggaggacuagg

SEQ ID NO: 13647 - RNA, 22 nt, Human
cuccgccuguccugggcccacg

SEQ ID NO: 13648 - RNA, 22 nt, Human
cuccggccuucugacuccccug

SEQ ID NO: 13649 - RNA, 22 nt, Human
cuccggggacgcagucgccgcc

SEQ ID NO: 13650 - RNA, 22 nt, Human
cuccucguccucuucauccucu

SEQ ID NO: 13651 - RNA, 22 nt, Human
cuccuuaaagggagcagcagcu

SEQ ID NO: 13652 - RNA, 22 nt, Human
cuccuuccuccgcccuuccucg

SEQ ID NO: 13653 - RNA, 22 nt, Human
cuccuugagaaugaacaaagga

SEQ ID NO: 13654 - RNA, 22 nt, Human
cuccuugguuccggcguuggag

SEQ ID NO: 13655 - RNA, 22 nt, Human
cuccuuuuuauaucuuucucug

SEQ ID NO: 13656 - RNA, 22 nt, Human
cuccuuuuuuuaaagauggauu

SEQ ID NO: 13657 - RNA, 22 nt, Human
cucggaggaccuguuuuaugca

SEQ ID NO: 13658 - RNA, 22 nt, Human
cucggcccuggucuuacgggac

SEQ ID NO: 13659 - RNA, 22 nt, Human
cucuaaauguggucugcagaua

SEQ ID NO: 13660 - RNA, 22 nt, Human
cucuaccugcacaugccugacu

SEQ ID NO: 13661 - RNA, 22 nt, Human
cucuauucuaauggauucuggg

SEQ ID NO: 13662 - RNA, 22 nt, Human
cucucacucccuccuucccucu

SEQ ID NO: 13663 - RNA, 22 nt, Human
cucucuccuuuuugauauuuag

SEQ ID NO: 13664 - RNA, 22 nt, Human
cucucuguuaugcuuucaugaa

SEQ ID NO: 13665 - RNA, 22 nt, Human
cucugauuuuucuaauacuuca

SEQ ID NO: 13666 - RNA, 22 nt, Human
cucugcuagaaggucaaucucu

SEQ ID NO: 13667 - RNA, 22 nt, Human
cucuggagggaggcugagcugg

SEQ ID NO: 13668 - RNA, 22 nt, Human
cucuggcaacgauggugcuuau

SEQ ID NO: 13669 - RNA, 22 nt, Human
cucuggggaagugcacucgcug

SEQ ID NO: 13670 - RNA, 22 nt, Human
cucugguuucgcaggaaauaga

SEQ ID NO: 13671 - RNA, 22 nt, Human
cucuguauauugagugcuuacu

SEQ ID NO: 13672 - RNA, 22 nt, Human
cucugugggcauauuuguaaaa

SEQ ID NO: 13673 - RNA, 22 nt, Human
cucuguggucugaagccuguga

SEQ ID NO: 13674 - RNA, 22 nt, Human
cucuguguguuugugugugugu

SEQ ID NO: 13675 - RNA, 22 nt, Human
cucuguugucaguggaagcagc

SEQ ID NO: 13676 - RNA, 22 nt, Human
cucuuagucugcuuuuuuucca

SEQ ID NO: 13677 - RNA, 22 nt, Human
cucuuauaaagaugucucuguu

SEQ ID NO: 13678 - RNA, 22 nt, Human
cucuucauuauucacgcccugu

SEQ ID NO: 13679 - RNA, 22 nt, Human
cucuugugucaccauggauaaa

SEQ ID NO: 13680 - RNA, 20 nt, Human
cucuuuaugagaccacuguc

SEQ ID NO: 13681 - RNA, 22 nt, Human
cucuuucauucuguccuuguuu

SEQ ID NO: 13682 - RNA, 22 nt, Human
cucuuuucaaaccuguuuaugg

SEQ ID NO: 13683 - RNA, 22 nt, Human
cucuuuuuuugucuuaagaacc

SEQ ID NO: 13684 - RNA, 19 nt, Human
cugaaacacagagagggcu

SEQ ID NO: 13685 - RNA, 22 nt, Human
cugaaacuauggggaggggagc

SEQ ID NO: 13686 - RNA, 22 nt, Human
cugaaagcaaaguaauucuuaa

SEQ ID NO: 13687 - RNA, 22 nt, Human
cugaacuaagcccaaagacacu

SEQ ID NO: 13688 - RNA, 22 nt, Human
cugaaggacacgugaggagcca

SEQ ID NO: 13689 - RNA, 22 nt, Human
cugaaggcuuugaauggaauga

SEQ ID NO: 13690 - RNA, 20 nt, Human
cugaauaccacagagccauc

SEQ ID NO: 13691 - RNA, 22 nt, Human
cugaaucaaaugacuuagccau

SEQ ID NO: 13692 - RNA, 22 nt, Human
cugaaucugccuccgaggguuu

SEQ ID NO: 13693 - RNA, 22 nt, Human
cugacagaucuggaucugaacu

SEQ ID NO: 13694 - RNA, 22 nt, Human
cugaccucuaaguaacagagaa

SEQ ID NO: 13695 - RNA, 22 nt, Human
cugacugaggaucaguucauca

SEQ ID NO: 13696 - RNA, 22 nt, Human
cugagaggcacaaggcauuucg

SEQ ID NO: 13697 - RNA, 22 nt, Human
cugagaucaugggucagguggu

SEQ ID NO: 13698 - RNA, 19 nt, Human
cugagcagggaaaaacccu

SEQ ID NO: 13699 - RNA, 22 nt, Human
cugagcuauauauuaugcauag

SEQ ID NO: 13700 - RNA, 22 nt, Human
cugagcuuuucucugcuucuua

SEQ ID NO: 13701 - RNA, 22 nt, Human
cugagggagacagugcggacua

SEQ ID NO: 13702 - RNA, 22 nt, Human
cugagggagcugcuggccuugg

SEQ ID NO: 13703 - RNA, 23 nt, Human
cugagggcuggucugaagucugc

SEQ ID NO: 13704 - RNA, 22 nt, Human
cugagguccucagagggaaagg

SEQ ID NO: 13705 - RNA, 22 nt, Human
cugauaauaaccauuuuaaaau

SEQ ID NO: 13706 - RNA, 22 nt, Human
cugauagagcauuagugugaga

SEQ ID NO: 13707 - RNA, 22 nt, Human
cugaucccuuuucauuugcagg

SEQ ID NO: 13708 - RNA, 22 nt, Human
cugauccuauauugguaugagg

SEQ ID NO: 13709 - RNA, 22 nt, Human
cugaucuuaaguaacauuauuu

SEQ ID NO: 13710 - RNA, 22 nt, Human
cugauggagagugugauuuggg

SEQ ID NO: 13711 - RNA, 22 nt, Human
cugaugucaaauuuaucaaagc

SEQ ID NO: 13712 - RNA, 20 nt, Human
cugauguucgugcuuccugg

SEQ ID NO: 13713 - RNA, 22 nt, Human
cugauuguagccacugugauga

SEQ ID NO: 13714 - RNA, 22 nt, Human
cugauuucaaauggugcuagau

SEQ ID NO: 13715 - RNA, 22 nt, Human
cugcacagucauuuccucucaa

SEQ ID NO: 13716 - RNA, 22 nt, Human
cugcacuggguacauagaaaca

SEQ ID NO: 13717 - RNA, 21 nt, Human
cugcacugugauuuaaaaugu

SEQ ID NO: 13718 - RNA, 22 nt, Human
cugcagauaaguguuuugaaaa

SEQ ID NO: 13719 - RNA, 22 nt, Human
cugcagauguagcugcuuuccu

SEQ ID NO: 13720 - RNA, 22 nt, Human
cugcaguaacuauuuucaauaa

SEQ ID NO: 13721 - RNA, 22 nt, Human
cugccacuaccaugcuggauga

SEQ ID NO: 13722 - RNA, 22 nt, Human
cugccaggagaggccagggccc

SEQ ID NO: 13723 - RNA, 22 nt, Human
cugccaguaucuuuggggcugu

SEQ ID NO: 13724 - RNA, 22 nt, Human
cugccccucgcucaccagcucu

SEQ ID NO: 13725 - RNA, 22 nt, Human
cugccgaugcgcaguggcgccu

SEQ ID NO: 13726 - RNA, 22 nt, Human
cugccucucaugccugcuugcu

SEQ ID NO: 13727 - RNA, 22 nt, Human
cugcgcgagcacugccggcggg

SEQ ID NO: 13728 - RNA, 22 nt, Human
cugcggcaccaaccccuucaug

SEQ ID NO: 13729 - RNA, 22 nt, Human
cugcgguucuguuuaguggcga

SEQ ID NO: 13730 - RNA, 22 nt, Human
cugcuauaacacuaacaucuaa

SEQ ID NO: 13731 - RNA, 22 nt, Human
ugcuguacaagacccucuguuu

SEQ ID NO: 13732 - RNA, 22 nt, Human
ugcugugagaccauuuguugag

SEQ ID NO: 13733 - RNA, 22 nt, Human
ugcugugcuggcggcagaggcc

SEQ ID NO: 13734 - RNA, 20 nt, Human
ugcugugugucuacuguggg

SEQ ID NO: 13735 - RNA, 22 nt, Human
ugcuguugacuuuguuguucuu

SEQ ID NO: 13736 - RNA, 22 nt, Human
ugcuuaaagcauuucucuuuaa

SEQ ID NO: 13737 - RNA, 22 nt, Human
ugcuuacauuuugcuggucucc

SEQ ID NO: 13738 - RNA, 22 nt, Human
ugcuuacgcaaccuguguuugg

SEQ ID NO: 13739 - RNA, 22 nt, Human
ugcuuagcggugggggcuccau

SEQ ID NO: 13740 - RNA, 22 nt, Human
ugcuuaucuccuuaguuuuugc

SEQ ID NO: 13741 - RNA, 22 nt, Human
ugcuucucucuaggaagacgcu

SEQ ID NO: 13742 - RNA, 22 nt, Human
ugcuucuuuaggauguaguuau

SEQ ID NO: 13743 - RNA, 22 nt, Human
ugcuucuuuccuuggugacuuc

SEQ ID NO: 13744 - RNA, 22 nt, Human
ugggaagaguuagagacagcug

SEQ ID NO: 13745 - RNA, 22 nt, Human
ugggaaggggagcuggaaagga

SEQ ID NO: 13746 - RNA, 22 nt, Human
ugggacaugaugcauuugaaag

SEQ ID NO: 13747 - RNA, 18 nt, Human
ugggacucugacuugguu

SEQ ID NO: 13748 - RNA, 22 nt, Human
ugggagagauaggcuucuggac

SEQ ID NO: 13749 - RNA, 23 nt, Human
ugggagcuauguuuggaaugggg

SEQ ID NO: 13750 - RNA, 22 nt, Human
ugggauggacuuuagagaaucg

SEQ ID NO: 13751 - RNA, 22 nt, Human
ugggauucucagaaacacagag

SEQ ID NO: 13752 - RNA, 22 nt, Human
ugggcacacugaaucugcuauu

SEQ ID NO: 13753 - RNA, 22 nt, Human
ugggcagagggugaggaaggcg

SEQ ID NO: 13754 - RNA, 22 nt, Human
ugggccaaaugucugcauaagu

SEQ ID NO: 13755 - RNA, 22 nt, Human
ugggccacguggagucuguagg

SEQ ID NO: 13756 - RNA, 22 nt, Human
ugggccccucuucuucaguugg

SEQ ID NO: 13757 - RNA, 22 nt, Human
ugggccucuguuuccucaucug

SEQ ID NO: 13758 - RNA, 22 nt, Human
uggggagacauggaguaaaaga

SEQ ID NO: 13759 - RNA, 22 nt, Human
uggggagcucagcaccaucagu

SEQ ID NO: 13760 - RNA, 22 nt, Human
uggggcgcaggcccagcgggcu

SEQ ID NO: 13761 - RNA, 22 nt, Human
uggggcggaaggaggagaggug

SEQ ID NO: 13762 - RNA, 22 nt, Human
uggggcuauggcccgaccacgu

SEQ ID NO: 13763 - RNA, 22 nt, Human
uggggcuggccaggaggagucu

SEQ ID NO: 13764 - RNA, 22 nt, Human
uggggcugguaccguaauauau

SEQ ID NO: 13765 - RNA, 22 nt, Human
uggggcuuggcucacagaagcu

SEQ ID NO: 13766 - RNA, 22 nt, Human
uggggcuuucgcggagcgucgg

SEQ ID NO: 13767 - RNA, 22 nt, Human
ugggggauucaucucagagcgu

SEQ ID NO: 13768 - RNA, 22 nt, Human
ugggggcacccagccgaugagg

SEQ ID NO: 13769 - RNA, 20 nt, Human
ugggggugcccaucuccccu

SEQ ID NO: 13770 - RNA, 22 nt, Human
uggggguuggaguccccaaggu

SEQ ID NO: 13771 - RNA, 22 nt, Human
uggggugccccccucgguuugc

SEQ ID NO: 13772 - RNA, 22 nt, Human
ugggguguuacacaacauugag

SEQ ID NO: 13773 - RNA, 22 nt, Human
uggguagcucaauagagccaca

SEQ ID NO: 13774 - RNA, 22 nt, Human
uggguagggagcuggaauccua

SEQ ID NO: 13775 - RNA, 22 nt, Human
uggguauauauguugcuacaga

SEQ ID NO: 13776 - RNA, 21 nt, Human
uggguccuuggucuaguuuuc

SEQ ID NO: 13777 - RNA, 22 nt, Human
ugggugaagaggcuaugcuacu

SEQ ID NO: 13778 - RNA, 22 nt, Human
ugggugccgcaucuugcuguuc

SEQ ID NO: 13779 - RNA, 22 nt, Human
uggguggauucgggaacuuguu

SEQ ID NO: 13780 - RNA, 22 nt, Human
ugggugggcagagucuaagaua

SEQ ID NO: 13781 - RNA, 22 nt, Human
uggguggugaaauggaugggaa

SEQ ID NO: 13782 - RNA, 22 nt, Human
ugggugugcaccuacgaucucu

SEQ ID NO: 13783 - RNA, 22 nt, Human
uggguguggaagcagcgugggg

SEQ ID NO: 13784 - RNA, 22 nt, Human
ugggugugggguaggguaagag

SEQ ID NO: 13785 - RNA, 22 nt, Human
uggguucaaauccugguuccac

SEQ ID NO: 13786 - RNA, 20 nt, Human
uggguucaguuguuucuggc

SEQ ID NO: 13787 - RNA, 22 nt, Human
uggguucugaucccaggacugc

SEQ ID NO: 13788 - RNA, 22 nt, Human
uggguuuaccaguguuucuucc

SEQ ID NO: 13789 - RNA, 22 nt, Human
uggguuugcuuguucagguucu

SEQ ID NO: 13790 - RNA, 21 nt, Human
ugguaaggggauccuguuacu

SEQ ID NO: 13791 - RNA, 22 nt, Human
ugguaaguuacaugucugccuc

SEQ ID NO: 13792 - RNA, 22 nt, Human
ugguaauuuaacaaaauuguca

SEQ ID NO: 13793 - RNA, 22 nt, Human
ugguagcaggugcuaaaggccu

SEQ ID NO: 13794 - RNA, 22 nt, Human
ugguauaaaaaaaugaguauaa

SEQ ID NO: 13795 - RNA, 22 nt, Human
ugguauauuugaccauaugugu

SEQ ID NO: 13796 - RNA, 22 nt, Human
ugguaugaaggaggccggcagc

SEQ ID NO: 13797 - RNA, 22 nt, Human
uggucacgucgggguauugcca

SEQ ID NO: 13798 - RNA, 22 nt, Human
ugguccaccgccucauucucug

SEQ ID NO: 13799 - RNA, 22 nt, Human
uggucccuagugugggagcuug

SEQ ID NO: 13800 - RNA, 22 nt, Human
ugguccuuuccauuggagacac

SEQ ID NO: 13801 - RNA, 22 nt, Human
uggucggugguguggggaggca

SEQ ID NO: 13802 - RNA, 22 nt, Human
uggucucuacggaggaaagcug

SEQ ID NO: 13803 - RNA, 20 nt, Human
uggucucuugaaagaggcuc

SEQ ID NO: 13804 - RNA, 22 nt, Human
uggucuuuccuucauuguccag

SEQ ID NO: 13805 - RNA, 22 nt, Human
uggugacaucuaccuagguaaa

SEQ ID NO: 13806 - RNA, 22 nt, Human
uggugaggacccagauuuuccu

SEQ ID NO: 13807 - RNA, 22 nt, Human
uggugcacgugggcagucggcc

SEQ ID NO: 13808 - RNA, 22 nt, Human
uggugcagacaggagccccgcu

SEQ ID NO: 13809 - RNA, 22 nt, Human
uggugcaggauuuauuuaacua

SEQ ID NO: 13810 - RNA, 22 nt, Human
uggugcccguggaaagagggag

SEQ ID NO: 13811 - RNA, 22 nt, Human
uggugccuuccgagagcuguga

SEQ ID NO: 13812 - RNA, 19 nt, Human
uggugcgcuguuccugagc

SEQ ID NO: 13813 - RNA, 19 nt, Human
ugguggaggugcaccugac

SEQ ID NO: 13814 - RNA, 22 nt, Human
ugguggaggugggggguauuuu

SEQ ID NO: 13815 - RNA, 22 nt, Human
ugguggagucugggggaggcuu

SEQ ID NO: 13816 - RNA, 22 nt, Human
ugguggcaauuuuuggggucaa

SEQ ID NO: 13817 - RNA, 20 nt, Human
ugguguacauuuccauaguu

SEQ ID NO: 13818 - RNA, 20 nt, Human
ugguguccuaugcuugugcu

SEQ ID NO: 13819 - RNA, 22 nt, Human
uggugugggauccugggaagga

SEQ ID NO: 13820 - RNA, 20 nt, Human
ugguuaaagugggugagcgg

SEQ ID NO: 13821 - RNA, 22 nt, Human
ugguuacagaugaagaucggcc

SEQ ID NO: 13822 - RNA, 22 nt, Human
ugguuagucaugguacugcagc

SEQ ID NO: 13823 - RNA, 22 nt, Human
ugguuauauaaggauuaaauac

SEQ ID NO: 13824 - RNA, 22 nt, Human
ugguucacaagaauccagguag

SEQ ID NO: 13825 - RNA, 22 nt, Human
ugguucugccacuuuccccuug

SEQ ID NO: 13826 - RNA, 22 nt, Human
ugguugagguugacucuauaua

SEQ ID NO: 13827 - RNA, 22 nt, Human
ugguugggguaacaaaaaggaa

SEQ ID NO: 13828 - RNA, 18 nt, Human
ugguuggugggggugaag

SEQ ID NO: 13829 - RNA, 22 nt, Human
ugguugguuaaugugcccauuu

SEQ ID NO: 13830 - RNA, 22 nt, Human
ugguuuacucuguaaaccagga

SEQ ID NO: 13831 - RNA, 21 nt, Human
ugguuuuaucuugguggcugc

SEQ ID NO: 13832 - RNA, 23 nt, Human
ugguuuucagaagaccuuguuag

SEQ ID NO: 13833 - RNA, 22 nt, Human
ugguuuucuuaauuagcaguca

SEQ ID NO: 13834 - RNA, 23 nt, Human
uguaaaacaccguuauugcaccu

SEQ ID NO: 13835 - RNA, 22 nt, Human
uguaauguuagaaacaauugcu

SEQ ID NO: 13836 - RNA, 22 nt, Human
uguaauuugguuagauuucuuu

SEQ ID NO: 13837 - RNA, 22 nt, Human
uguacauacauagauauacaca

SEQ ID NO: 13838 - RNA, 22 nt, Human
uguacauuuacaaaagcuuuau

SEQ ID NO: 13839 - RNA, 23 nt, Human
uguacugucuuucagguucuuau

SEQ ID NO: 13840 - RNA, 22 nt, Human
uguagaccaaaccuucuaaacu

SEQ ID NO: 13841 - RNA, 22 nt, Human
uguagggaggaaggguuggaaa

SEQ ID NO: 13842 - RNA, 22 nt, Human
uguaguacuuagaaguauacug

SEQ ID NO: 13843 - RNA, 22 nt, Human
uguagugaaauuaaaccaaagc

SEQ ID NO: 13844 - RNA, 20 nt, Human
cugcuccauggcaucuuuag

SEQ ID NO: 13845 - RNA, 22 nt, Human
cugcugccagcuuaauacucac

SEQ ID NO: 13846 - RNA, 22 nt, Human
cugcugcuugauugcaggaagu

SEQ ID NO: 13847 - RNA, 22 nt, Human
cugcuggugcugcccacacggu

SEQ ID NO: 13848 - RNA, 22 nt, Human
cugcugucuuuauuucacugcu

SEQ ID NO: 13849 - RNA, 22 nt, Human
cugcuguugagguuccaggcca

SEQ ID NO: 13850 - RNA, 22 nt, Human
cugcuguuuuccccaccaucuc

SEQ ID NO: 13851 - RNA, 22 nt, Human
cugcuucacccugccugagaac

SEQ ID NO: 13852 - RNA, 22 nt, Human
cugcuugguuuggagggcccac

SEQ ID NO: 13853 - RNA, 18 nt, Human
uguauuguucacuucugu

SEQ ID NO: 13854 - RNA, 22 nt, Human
uguauuuauuuuucaacuacca

SEQ ID NO: 13855 - RNA, 22 nt, Human
ugucacagagcgugcaacagaa

SEQ ID NO: 13856 - RNA, 23 nt, Human
ugucacuuguggucacuaggcug

SEQ ID NO: 13857 - RNA, 21 nt, Human
ugucagaaagccugugacuuu

SEQ ID NO: 13858 - RNA, 22 nt, Human
ugucaguuugucaaauacccca

SEQ ID NO: 13859 - RNA, 21 nt, Human
ugucaucucuaaaaagauugu

SEQ ID NO: 13860 - RNA, 22 nt, Human
ugucaucuuucuaaagcugguc

SEQ ID NO: 13861 - RNA, 22 nt, Human
ugucauggacuggauuucugcu

SEQ ID NO: 13862 - RNA, 22 nt, Human
ugucauuuauucucuuauucua

SEQ ID NO: 13863 - RNA, 22 nt, Human
ugucccuaucagucccaaguca

SEQ ID NO: 13864 - RNA, 22 nt, Human
uguccuauuugugauaggugac

SEQ ID NO: 13865 - RNA, 22 nt, Human
uguccuuuauauguuuuuuagu

SEQ ID NO: 13866 - RNA, 22 nt, Human
uguccuuucagagcuccuuuug

SEQ ID NO: 13867 - RNA, 22 nt, Human
ugucuagacauuagcuucagcu

SEQ ID NO: 13868 - RNA, 22 nt, Human
ugucucuuccuccucuugguac

SEQ ID NO: 13869 - RNA, 22 nt, Human
ugucugaauuguaauguugcgu

SEQ ID NO: 13870 - RNA, 22 nt, Human
ugucugauccuucaggagcccc

SEQ ID NO: 13871 - RNA, 22 nt, Human
ugucugcauucgaguucaugga

SEQ ID NO: 13872 - RNA, 23 nt, Human
ugucugccuaucaugugaaggac

SEQ ID NO: 13873 - RNA, 22 nt, Human
ugucugggauguuggcagccac

SEQ ID NO: 13874 - RNA, 20 nt, Human
ugucugguaagacgcccauc

SEQ ID NO: 13875 - RNA, 22 nt, Human
ugucugucugccauuuauucuc

SEQ ID NO: 13876 - RNA, 20 nt, Human
ugucugugugugauaauagu

SEQ ID NO: 13877 - RNA, 22 nt, Human
ugucuuaggcuccgccggccca

SEQ ID NO: 13878 - RNA, 22 nt, Human
ugucuuuagagugaacagaaga

SEQ ID NO: 13879 - RNA, 22 nt, Human
ugucuuugaccuuaagaaguuu

SEQ ID NO: 13880 - RNA, 22 nt, Human
ugucuuuuaaaaauguguaaaa

SEQ ID NO: 13881 - RNA, 19 nt, Human
ugugaagaccucagugcgg

SEQ ID NO: 13882 - RNA, 22 nt, Human
ugugaaugacuguguucuuugc

SEQ ID NO: 13883 - RNA, 22 nt, Human
ugugaaugacuuuguucuuugc

SEQ ID NO: 13884 - RNA, 22 nt, Human
ugugacaugauggcgucaugua

SEQ ID NO: 13885 - RNA, 22 nt, Human
ugugaggggcguucacucucgu

SEQ ID NO: 13886 - RNA, 22 nt, Human
ugugagucuugcaggucgcuca

SEQ ID NO: 13887 - RNA, 22 nt, Human
ugugauuucaaagggugucuuu

SEQ ID NO: 13888 - RNA, 22 nt, Human
ugugcagaaggagguucuccgg

SEQ ID NO: 13889 - RNA, 22 nt, Human
ugugcagugcguggguguugaa

SEQ ID NO: 13890 - RNA, 22 nt, Human
ugugcaucuggaggcaauguuu

SEQ ID NO: 13891 - RNA, 22 nt, Human
ugugccuagauuccaugcacuc

SEQ ID NO: 13892 - RNA, 22 nt, Human
ugugccuuucacuaugucauuc

SEQ ID NO: 13893 - RNA, 22 nt, Human
ugugcuaauguuaggauugaau

SEQ ID NO: 13894 - RNA, 22 nt, Human
ugugcuauuuuugcauaugugu

SEQ ID NO: 13895 - RNA, 22 nt, Human
ugugcugcagcgagagcuacga

SEQ ID NO: 13896 - RNA, 22 nt, Human
ugugcuggcuucugugagcuga

SEQ ID NO: 13897 - RNA, 22 nt, Human
ugugcuugucuguuuugauugu

SEQ ID NO: 13898 - RNA, 22 nt, Human
uguggacaccuauuaccaguga

SEQ ID NO: 13899 - RNA, 22 nt, Human
uguggcaauauggaauguguuu

SEQ ID NO: 13900 - RNA, 21 nt, Human
uguggccauuugaaaacaggg

SEQ ID NO: 13901 - RNA, 22 nt, Human
ugugggaggaugggccccuaga

SEQ ID NO: 13902 - RNA, 22 nt, Human
ugugggaggauuuaggugaauc

SEQ ID NO: 13903 - RNA, 22 nt, Human
ugugggcguggguuggggaggg

SEQ ID NO: 13904 - RNA, 22 nt, Human
ugugggcugcuguuuccuugua

SEQ ID NO: 13905 - RNA, 22 nt, Human
uguggguggucagcgugugaug

SEQ ID NO: 13906 - RNA, 22 nt, Human
ugugguagagcuuaaaugaggu

SEQ ID NO: 13907 - RNA, 22 nt, Human
uguggugacuugagcuuccuaa

SEQ ID NO: 13908 - RNA, 22 nt, Human
uguggugcucagggaggauggg

SEQ ID NO: 13909 - RNA, 22 nt, Human
ugugguuggggucagauaggga

SEQ ID NO: 13910 - RNA, 22 nt, Human
uguguaacaacauaaugguuau

SEQ ID NO: 13911 - RNA, 22 nt, Human
uguguacggugcacacacacag

SEQ ID NO: 13912 - RNA, 22 nt, Human
uguguauaugugugugugugug

SEQ ID NO: 13913 - RNA, 17 nt, Human
uguguauucuccaggug

SEQ ID NO: 13914 - RNA, 22 nt, Human
ugugucauuugagaggagacga

SEQ ID NO: 13915 - RNA, 22 nt, Human
uguguggaaaugcuguauaugu

SEQ ID NO: 13916 - RNA, 22 nt, Human
uguguggccuccauaggguacu

SEQ ID NO: 13917 - RNA, 22 nt, Human
ugugugggcgaagacagccuuu

SEQ ID NO: 13918 - RNA, 22 nt, Human
uguguguguguguaugugcgug

SEQ ID NO: 13919 - RNA, 22 nt, Human
uguguguguguguguguuugug

SEQ ID NO: 13920 - RNA, 22 nt, Human
uguguguguuguaugaaauuuu

SEQ ID NO: 13921 - RNA, 19 nt, Human
uguguuccauccaccaccc

SEQ ID NO: 13922 - RNA, 22 nt, Human
uguguuccugucuuauucuuau

SEQ ID NO: 13923 - RNA, 22 nt, Human
uguguucuuugcuuaauuaaag

SEQ ID NO: 13924 - RNA, 22 nt, Human
uguguuguuggggauguuuuca

SEQ ID NO: 13925 - RNA, 22 nt, Human
uguguuguuuggggauguccau

SEQ ID NO: 13926 - RNA, 22 nt, Human
uguguuucggauagcagauucu

SEQ ID NO: 13927 - RNA, 22 nt, Human
uguguuucucugaggggucccu

SEQ ID NO: 13928 - RNA, 22 nt, Human
uguguuuuucauuuuaaguccu

SEQ ID NO: 13929 - RNA, 22 nt, Human
uguuaaaaagucccuguuuugu

SEQ ID NO: 13930 - RNA, 22 nt, Human
uguucaguuugcuaucauaauc

SEQ ID NO: 13931 - RNA, 22 nt, Human
uguuccaacuacugaauuggca

SEQ ID NO: 13932 - RNA, 22 nt, Human
uguucccgaugacaggaccagg

SEQ ID NO: 13933 - RNA, 20 nt, Human
uguuccgugguguccuuuuc

SEQ ID NO: 13934 - RNA, 23 nt, Human
uguuccugaugccucguccuguc

SEQ ID NO: 13935 - RNA, 22 nt, Human
uguucugauggauuacaugucu

SEQ ID NO: 13936 - RNA, 22 nt, Human
uguucuuacuaaguaccugaaa

SEQ ID NO: 13937 - RNA, 22 nt, Human
uguucuucaaacucaguuccac

SEQ ID NO: 13938 - RNA, 22 nt, Human
uguugaaacagcuauugacuuu

SEQ ID NO: 13939 - RNA, 22 nt, Human
uguugaagcaccucugucuuuc

SEQ ID NO: 13940 - RNA, 22 nt, Human
uguugaucucuuuccaaauucu

SEQ ID NO: 13941 - RNA, 22 nt, Human
uguugauuaauuuucccaaaca

SEQ ID NO: 13942 - RNA, 22 nt, Human
uguugcauguggcuguuugcca

SEQ ID NO: 13943 - RNA, 21 nt, Human
uguugcuugucugagacuaug

SEQ ID NO: 13944 - RNA, 22 nt, Human
uguuggaauaagugcuugaagg

SEQ ID NO: 13945 - RNA, 22 nt, Human
uguuggcagugcuacagucagu

SEQ ID NO: 13946 - RNA, 21 nt, Human
uguuggccuucauucucuguc

SEQ ID NO: 13947 - RNA, 23 nt, Human
uguuggcucccagucucccccuc

SEQ ID NO: 13948 - RNA, 22 nt, Human
uguuggugcacugaaaggcagg

SEQ ID NO: 13949 - RNA, 18 nt, Human
uguugguguucacucacu

SEQ ID NO: 13950 - RNA, 21 nt, Human
uguugguugugggaaggagga

SEQ ID NO: 13951 - RNA, 22 nt, Human
uguugguuucaagcaggagccu

SEQ ID NO: 13952 - RNA, 22 nt, Human
uguuguagacaguucacucgug

SEQ ID NO: 13953 - RNA, 17 nt, Human
uguuguguggauuuucc

SEQ ID NO: 13954 - RNA, 22 nt, Human
uguuguuguuguuguuguuguu

SEQ ID NO: 13955 - RNA, 22 nt, Human
uguuuaaauagaacauacugca

SEQ ID NO: 13956 - RNA, 22 nt, Human
uguuuaagugguuaaaggauuc

SEQ ID NO: 13957 - RNA, 22 nt, Human
cuucuugucagugauuucuucc

SEQ ID NO: 13958 - RNA, 22 nt, Human
cuucuuugacucacugguacgc

SEQ ID NO: 13959 - RNA, 22 nt, Human
cuucuuuucuacuggccuagaa

SEQ ID NO: 13960 - RNA, 22 nt, Human
cuucuuuuggggaugaaaaugg

SEQ ID NO: 13961 - RNA, 22 nt, Human
cuugagcugaguuugcagcucu

SEQ ID NO: 13962 - RNA, 22 nt, Human
uguuugagaauuugcugauguu

SEQ ID NO: 13963 - RNA, 22 nt, Human
uguuugaggugacucuggaaug

SEQ ID NO: 13964 - RNA, 22 nt, Human
uguuuguaugauggcacaucca

SEQ ID NO: 13965 - RNA, 22 nt, Human
uguuuguuuuguauuuuuaauu

SEQ ID NO: 13966 - RNA, 22 nt, Human
uguuuucccacugguuuguaca

SEQ ID NO: 13967 - RNA, 22 nt, Human
uguuuucuauuaccugagauug

SEQ ID NO: 13968 - RNA, 21 nt, Human
uguuuuguaauagauacuaug

SEQ ID NO: 13969 - RNA, 22 nt, Human
uguuuuuauucuuaauguuuca

SEQ ID NO: 13970 - RNA, 22 nt, Human
uuaaaagaauccuguuauccuc

SEQ ID NO: 13971 - RNA, 22 nt, Human
uuaaaauuguuaacuuugguga

SEQ ID NO: 13972 - RNA, 22 nt, Human
uuaaacauuuccacuugccagu

SEQ ID NO: 13973 - RNA, 22 nt, Human
uuaaagaguuuauuacuuguaa

SEQ ID NO: 13974 - RNA, 22 nt, Human
uuaaagguacuccuaagcgggg

SEQ ID NO: 13975 - RNA, 22 nt, Human
uuaacauuguccuuagcagauu

SEQ ID NO: 13976 - RNA, 22 nt, Human
uuaacggugagacgccccaaau

SEQ ID NO: 13977 - RNA, 22 nt, Human
uuaagagaagaguaucuagaac

SEQ ID NO: 13978 - RNA, 22 nt, Human
uuaaggcuguggggauuacugc

SEQ ID NO: 13979 - RNA, 23 nt, Human
uuaaggugccguguaauucaugc

SEQ ID NO: 13980 - RNA, 22 nt, Human
uuaaguauauccauuugacugg

SEQ ID NO: 13981 - RNA, 22 nt, Human
uuaaguauggaggccuaacuga

SEQ ID NO: 13982 - RNA, 22 nt, Human
uuaaguccuugguaauuuucuu

SEQ ID NO: 13983 - RNA, 22 nt, Human
uuaauaaauugugguaccagag

SEQ ID NO: 13984 - RNA, 22 nt, Human
uuaauacugugucuuuuuuaau

SEQ ID NO: 13985 - RNA, 22 nt, Human
uuaauauuaagauauugagugg

SEQ ID NO: 13986 - RNA, 22 nt, Human
uuaaucagacauucucaaguuu

SEQ ID NO: 13987 - RNA, 22 nt, Human
uuaaucuauuucauauaaggga

SEQ ID NO: 13988 - RNA, 22 nt, Human
uuaaugcauguaaaugugcaaa

SEQ ID NO: 13989 - RNA, 21 nt, Human
uuaaugcuaugcagaaaaucu

SEQ ID NO: 13990 - RNA, 22 nt, Human
uuaauguggaagaguuuggcua

SEQ ID NO: 13991 - RNA, 22 nt, Human
uuaauguugacacacuagcaca

SEQ ID NO: 13992 - RNA, 22 nt, Human
uuaauguuuuagaaugagagug

SEQ ID NO: 13993 - RNA, 21 nt, Human
uuaauugagggauggggguga

SEQ ID NO: 13994 - RNA, 22 nt, Human
uuaauuguuagauagauuauag

SEQ ID NO: 13995 - RNA, 22 nt, Human
uuacaacgcacacagauuucac

SEQ ID NO: 13996 - RNA, 22 nt, Human
uuacaagaucuuugaaggcaag

SEQ ID NO: 13997 - RNA, 22 nt, Human
uuacacaugaagguccaauguu

SEQ ID NO: 13998 - RNA, 22 nt, Human
uuacaugcuugugcagguuuug

SEQ ID NO: 13999 - RNA, 22 nt, Human
uuaccauaguacuaucaguuua

SEQ ID NO: 14000 - RNA, 22 nt, Human
uuacccuugaauuugugacaaa

SEQ ID NO: 14001 - RNA, 22 nt, Human
uuaccugagcggauuuguugca

SEQ ID NO: 14002 - RNA, 22 nt, Human
uuaccugccucaaacacgaaug

SEQ ID NO: 14003 - RNA, 22 nt, Human
uuaccuuuucuuguuuacaagu

SEQ ID NO: 14004 - RNA, 21 nt, Human
uuacuaagagagcagagggac

SEQ ID NO: 14005 - RNA, 23 nt, Human
uuacuaugaaaauuccagucacu

SEQ ID NO: 14006 - RNA, 20 nt, Human
uuacucaaccaggcuucuac

SEQ ID NO: 14007 - RNA, 22 nt, Human
uuacuggaauauaaagauaaga

SEQ ID NO: 14008 - RNA, 22 nt, Human
uuacuguaggugggugaauuug

SEQ ID NO: 14009 - RNA, 22 nt, Human
uuacuuaucugaugugauuuuu

SEQ ID NO: 14010 - RNA, 22 nt, Human
uuacuuucugggauaucaaaug

SEQ ID NO: 14011 - RNA, 22 nt, Human
uuagaaaaaggcuguggucuua

SEQ ID NO: 14012 - RNA, 22 nt, Human
uuagaaauguccuacuaauaug

SEQ ID NO: 14013 - RNA, 22 nt, Human
uuagagagguuggagugguaga

SEQ ID NO: 14014 - RNA, 22 nt, Human
uuagagauuuuauguuaaugua

SEQ ID NO: 14015 - RNA, 17 nt, Human
uuagagcuacauguuga

SEQ ID NO: 14016 - RNA, 22 nt, Human
uuagaguguguguaguagggug

SEQ ID NO: 14017 - RNA, 22 nt, Human
uuagauaaaucagcccugagua

SEQ ID NO: 14018 - RNA, 22 nt, Human
uuagauaguaaauagcacuaag

SEQ ID NO: 14019 - RNA, 22 nt, Human
uuagaugaaaaucggaacaugu

SEQ ID NO: 14020 - RNA, 22 nt, Human
uuagaugugaucagcuggcuua

SEQ ID NO: 14021 - RNA, 21 nt, Human
uuagcaguuguugauuuccag

SEQ ID NO: 14022 - RNA, 23 nt, Human
uuagcccaggcuggagguagccc

SEQ ID NO: 14023 - RNA, 22 nt, Human
uuaggaauugcuucauguuugg

SEQ ID NO: 14024 - RNA, 22 nt, Human
uuaggagugccaucuuguggac

SEQ ID NO: 14025 - RNA, 22 nt, Human
uuaggcugcuuuggaaaacugu

SEQ ID NO: 14026 - RNA, 22 nt, Human
uuagggacagcucuguagguga

SEQ ID NO: 14027 - RNA, 22 nt, Human
uuagguuuaugaggucugcauu

SEQ ID NO: 14028 - RNA, 22 nt, Human
uuaguccucaugaccaccaagu

SEQ ID NO: 14029 - RNA, 22 nt, Human
uuagugaagaagcaucuuuagu

SEQ ID NO: 14030 - RNA, 22 nt, Human
uuaguggguuccauuucuaugg

SEQ ID NO: 14031 - RNA, 22 nt, Human
uuagugucugacgcaggcgcca

SEQ ID NO: 14032 - RNA, 22 nt, Human
uuaguuaauaaauauugagugu

SEQ ID NO: 14033 - RNA, 22 nt, Human
uuaguuaccacugcagaucuuu

SEQ ID NO: 14034 - RNA, 20 nt, Human
uuaguuacuuagugagaguc

SEQ ID NO: 14035 - RNA, 22 nt, Human
uuaguuacuugacucaagaccc

SEQ ID NO: 14036 - RNA, 22 nt, Human
uuaguuagucuaugccugacca

SEQ ID NO: 14037 - RNA, 22 nt, Human
uuaguuauaggugaaucagaga

SEQ ID NO: 14038 - RNA, 22 nt, Human
uuauaaaccgcuaacagcacuu

SEQ ID NO: 14039 - RNA, 22 nt, Human
uuauaaguaagggucucuggca

SEQ ID NO: 14040 - RNA, 22 nt, Human
uuauacugaaagucuuuuaaua

SEQ ID NO: 14041 - RNA, 22 nt, Human
uuauacuucugccagaggacaa

SEQ ID NO: 14042 - RNA, 22 nt, Human
uuauaguggcuuggggaaaaaa

SEQ ID NO: 14043 - RNA, 22 nt, Human
uuauaguuuucaaggauuggag

SEQ ID NO: 14044 - RNA, 22 nt, Human
uuauauuuuauuuaauuaaaua

SEQ ID NO: 14045 - RNA, 22 nt, Human
uuaucaaaaaauaguacuuuga

SEQ ID NO: 14046 - RNA, 22 nt, Human
uuaucagggaguuguguguucu

SEQ ID NO: 14047 - RNA, 22 nt, Human
uuaucugugcuuuacugacaga

SEQ ID NO: 14048 - RNA, 22 nt, Human
uuaucuguuuuaaugaauaauu

SEQ ID NO: 14049 - RNA, 22 nt, Human
uuaugccuguuaggcagcaucu

SEQ ID NO: 14050 - RNA, 22 nt, Human
uuauggauuagaguuugauucu

SEQ ID NO: 14051 - RNA, 22 nt, Human
uuaugggcgaugcaaaccugau

SEQ ID NO: 14052 - RNA, 22 nt, Human
uuaugugcuuuuugagcucuaa

SEQ ID NO: 14053 - RNA, 22 nt, Human
uuauuaauacaugcaccugcau

SEQ ID NO: 14054 - RNA, 22 nt, Human
uuauuccauagaagucaaggaa

SEQ ID NO: 14055 - RNA, 22 nt, Human
uuauucuuagccucgguauuuc

SEQ ID NO: 14056 - RNA, 22 nt, Human
uuauuggcagcuccugcacaug

SEQ ID NO: 14057 - RNA, 22 nt, Human
uuauuguuuggguauaauuuga

SEQ ID NO: 14058 - RNA, 22 nt, Human
uuauuuaaaauguagguuggga

SEQ ID NO: 14059 - RNA, 22 nt, Human
uuauuuaagaucuuaauauaua

SEQ ID NO: 14060 - RNA, 22 nt, Human
uuauuuaaguauuuauugaagu

SEQ ID NO: 14061 - RNA, 22 nt, Human
uuauuucauguaaaauuuaugu

SEQ ID NO: 14062 - RNA, 22 nt, Human
uuauuucuucucgaagcuuggg

SEQ ID NO: 14063 - RNA, 22 nt, Human
uuauuugcccauguuuagcaga

SEQ ID NO: 14064 - RNA, 22 nt, Human
uuauuuuauaaagagaagacuu

SEQ ID NO: 14065 - RNA, 22 nt, Human
uuauuuuuaggaauguagaggu

SEQ ID NO: 14066 - RNA, 22 nt, Human
uucaaaaugcagaauaguuugg

SEQ ID NO: 14067 - RNA, 22 nt, Human
uucaaacacugugcaauugggu

SEQ ID NO: 14068 - RNA, 22 nt, Human
uucaaacaguguagaauauaug

SEQ ID NO: 14069 - RNA, 22 nt, Human
uucaacaacuugguucaaaugg

SEQ ID NO: 14070 - RNA, 22 nt, Human
uucaacacaaguugugcaguaa

SEQ ID NO: 14071 - RNA, 22 nt, Human
gaggacccuuaggucagacaga

SEQ ID NO: 14072 - RNA, 22 nt, Human
gaggagagcuggccagguuucu

SEQ ID NO: 14073 - RNA, 22 nt, Human
gaggagcggugcaugugggggc

SEQ ID NO: 14074 - RNA, 19 nt, Human
uucugcucaguaacacccu

SEQ ID NO: 14075 - RNA, 20 nt, Human
uucugcucuagagucuagaa

SEQ ID NO: 14076 - RNA, 21 nt, Human
uucugcuguucaccaccaccc

SEQ ID NO: 14077 - RNA, 23 nt, Human
uucugcuucccauagcacuuugu

SEQ ID NO: 14078 - RNA, 22 nt, Human
uucuggacuuccaaauggcuuc

SEQ ID NO: 14079 - RNA, 22 nt, Human
uucuggagucuauuuugaaaag

SEQ ID NO: 14080 - RNA, 22 nt, Human
uucuggaguuugaagaucaggu

SEQ ID NO: 14081 - RNA, 22 nt, Human
uucugggguaagcacugaggau

SEQ ID NO: 14082 - RNA, 22 nt, Human
uucuguacuagaucuuaucagu

SEQ ID NO: 14083 - RNA, 22 nt, Human
uucugugacgcaaagcugggaa

SEQ ID NO: 14084 - RNA, 22 nt, Human
uucugugacuccucagagauuu

SEQ ID NO: 14085 - RNA, 19 nt, Human
uucuguggucccaggccuu

SEQ ID NO: 14086 - RNA, 22 nt, Human
uucuguguauggaagaaugucc

SEQ ID NO: 14087 - RNA, 22 nt, Human
uucuguuuaaccuggaaagugu

SEQ ID NO: 14088 - RNA, 22 nt, Human
uucuuaaugcauccuguguuca

SEQ ID NO: 14089 - RNA, 22 nt, Human
uucuuacuaaguagaguacuca

SEQ ID NO: 14090 - RNA, 22 nt, Human
uucuuccagugaaacgugcauc

SEQ ID NO: 14091 - RNA, 22 nt, Human
uucuucuguuggcagagcauac

SEQ ID NO: 14092 - RNA, 22 nt, Human
uucuucuuuccuauaauuaauu

SEQ ID NO: 14093 - RNA, 22 nt, Human
uucuugcgaaagaaugagcuga

SEQ ID NO: 14094 - RNA, 22 nt, Human
uucuugucuuuguuauguagga

SEQ ID NO: 14095 - RNA, 22 nt, Human
uucuugugugaauauaauuaca

SEQ ID NO: 14096 - RNA, 19 nt, Human
uucuuuccccaccccuacc

SEQ ID NO: 14097 - RNA, 23 nt, Human
uucuuuccuuaucccauuuacuu

SEQ ID NO: 14098 - RNA, 21 nt, Human
uucuuugaagacccauuugag

SEQ ID NO: 14099 - RNA, 22 nt, Human
uucuuugcccauguuuccuaag

SEQ ID NO: 14100 - RNA, 22 nt, Human
uucuuuguccuagcauucuaca

SEQ ID NO: 14101 - RNA, 22 nt, Human
uucuuuuaauuucugucugcag

SEQ ID NO: 14102 - RNA, 22 nt, Human
uucuuuuuagcugguuguaaga

SEQ ID NO: 14103 - RNA, 22 nt, Human
uugaaaaaaucugaggaggacc

SEQ ID NO: 14104 - RNA, 22 nt, Human
uugaaaaaauguguuuaaggag

SEQ ID NO: 14105 - RNA, 22 nt, Human
uugaaaaaugcccagcagacaa

SEQ ID NO: 14106 - RNA, 22 nt, Human
uugaaaacugucaccuuuauuc

SEQ ID NO: 14107 - RNA, 22 nt, Human
uugaaaauuaauagguguacaa

SEQ ID NO: 14108 - RNA, 22 nt, Human
uugaaagaacaauucugugaug

SEQ ID NO: 14109 - RNA, 22 nt, Human
uugaaaucuucccuccugucug

SEQ ID NO: 14110 - RNA, 22 nt, Human
uugaacaguuuugucagguuca

SEQ ID NO: 14111 - RNA, 22 nt, Human
uugaacauuagaauaaguaauu

SEQ ID NO: 14112 - RNA, 22 nt, Human
uugaaccaggauaaacauagaa

SEQ ID NO: 14113 - RNA, 22 nt, Human
uugaacguguaggaagcugguu

SEQ ID NO: 14114 - RNA, 22 nt, Human
uugaacucagcuacugguuggu

SEQ ID NO: 14115 - RNA, 22 nt, Human
uugaaggugggaggauuuauau

SEQ ID NO: 14116 - RNA, 21 nt, Human
uugaaguggguagcuggcggg

SEQ ID NO: 14117 - RNA, 22 nt, Human
uugaaucauauguaauugacuu

SEQ ID NO: 14118 - RNA, 22 nt, Human
uugaauggaauuggaaucuuau

SEQ ID NO: 14119 - RNA, 22 nt, Human
uugaauuuagguuuaugugaaa

SEQ ID NO: 14120 - RNA, 22 nt, Human
uugacacauggcuucaauugca

SEQ ID NO: 14121 - RNA, 22 nt, Human
uugacacauuagagcuuguaaa

SEQ ID NO: 14122 - RNA, 22 nt, Human
uugaccagaaaaguuaguaauu

SEQ ID NO: 14123 - RNA, 22 nt, Human
uugacucuuucauuuauuauuu

SEQ ID NO: 14124 - RNA, 22 nt, Human
uugagacucgagucucucagac

SEQ ID NO: 14125 - RNA, 22 nt, Human
uugagaugacuuaaaucacugu

SEQ ID NO: 14126 - RNA, 22 nt, Human
uugaggaagggaggcaaaacug

SEQ ID NO: 14127 - RNA, 20 nt, Human
uugaggagauauugaauacu

SEQ ID NO: 14128 - RNA, 22 nt, Human
uugaggcugaucacuccuauaa

SEQ ID NO: 14129 - RNA, 22 nt, Human
uugaggguggauugucagggga

SEQ ID NO: 14130 - RNA, 22 nt, Human
uugaggucuguguaggcagcaa

SEQ ID NO: 14131 - RNA, 22 nt, Human
uugaguaaugcaagccuuugua

SEQ ID NO: 14132 - RNA, 22 nt, Human
uugauaacuuagcugggcugcu

SEQ ID NO: 14133 - RNA, 22 nt, Human
uugauagauuuuagaggcaggc

SEQ ID NO: 14134 - RNA, 23 nt, Human
uugaucuggaaaauacuuguuug

SEQ ID NO: 14135 - RNA, 22 nt, Human
uugaugacauuuagcauaauug

SEQ ID NO: 14136 - RNA, 22 nt, Human
uugaugacuaaagaaagcugcu

SEQ ID NO: 14137 - RNA, 22 nt, Human
uugauggaggaaaaguuggaau

SEQ ID NO: 14138 - RNA, 22 nt, Human
uugauuaauugaugaaccucuc

SEQ ID NO: 14139 - RNA, 21 nt, Human
uugauuuagcagaucuagcug

SEQ ID NO: 14140 - RNA, 22 nt, Human
uugauuuccauuguccagcauu

SEQ ID NO: 14141 - RNA, 22 nt, Human
uugauuugcagaagguguagag

SEQ ID NO: 14142 - RNA, 22 nt, Human
uugauuuggcguuuuccuccug

SEQ ID NO: 14143 - RNA, 20 nt, Human
uugcaaagugaauagcaauu

SEQ ID NO: 14144 - RNA, 22 nt, Human
uugcaagcccugaagggcugga

SEQ ID NO: 14145 - RNA, 22 nt, Human
uugcacuccagcccgagcaaca

SEQ ID NO: 14146 - RNA, 22 nt, Human
uugcagagaacuaaagggagua

SEQ ID NO: 14147 - RNA, 22 nt, Human
uugcagauuucuuguccccauu

SEQ ID NO: 14148 - RNA, 22 nt, Human
uugcaucagcaggcauaauugg

SEQ ID NO: 14149 - RNA, 22 nt, Human
uugcaugauuuaagaauaucug

SEQ ID NO: 14150 - RNA, 20 nt, Human
uugcaugcagccggaugcug

SEQ ID NO: 14151 - RNA, 22 nt, Human
uugcaugugugaaaugcacaga

SEQ ID NO: 14152 - RNA, 22 nt, Human
uugccaggagacaucuggagcc

SEQ ID NO: 14153 - RNA, 22 nt, Human
uugccaggggacaucuggagcc

SEQ ID NO: 14154 - RNA, 22 nt, Human
uugccauacuugaaaggagaaa

SEQ ID NO: 14155 - RNA, 22 nt, Human
uugccccugcccucuguggucc

SEQ ID NO: 14156 - RNA, 22 nt, Human
uugcccuaccccaggccuuuuu

SEQ ID NO: 14157 - RNA, 22 nt, Human
uugccgacuggccaaggaguaa

SEQ ID NO: 14158 - RNA, 22 nt, Human
uugccucuaauuagcucuguga

SEQ ID NO: 14159 - RNA, 22 nt, Human
uugcggauguccacgucacacu

SEQ ID NO: 14160 - RNA, 22 nt, Human
uugcguaauuugagauuguaaa

SEQ ID NO: 14161 - RNA, 22 nt, Human
uugcuaagguuuaacuauugga

SEQ ID NO: 14162 - RNA, 22 nt, Human
uugcucaccugagaagaauaga

SEQ ID NO: 14163 - RNA, 20 nt, Human
uugcucucuuguguugaugu

SEQ ID NO: 14164 - RNA, 22 nt, Human
uugcugaggcuggggagaggug

SEQ ID NO: 14165 - RNA, 22 nt, Human
uugcugccagcgcccugcaggg

SEQ ID NO: 14166 - RNA, 22 nt, Human
uugcugggauucauugaagggu

SEQ ID NO: 14167 - RNA, 22 nt, Human
uugcugguggcucugauuucau

SEQ ID NO: 14168 - RNA, 22 nt, Human
uugcugugucauuuguuuaauc

SEQ ID NO: 14169 - RNA, 22 nt, Human
uugcuugaacccaggaagugga

SEQ ID NO: 14170 - RNA, 23 nt, Human
uugcuugagcccaggaaguggag

SEQ ID NO: 14171 - RNA, 22 nt, Human
uugcuugcggccuuugugccuu

SEQ ID NO: 14172 - RNA, 23 nt, Human
uugcuuuugccccaaaagaguua

SEQ ID NO: 14173 - RNA, 22 nt, Human
uuggaagagagauggggagaga

SEQ ID NO: 14174 - RNA, 22 nt, Human
uuggacugguuuacauuucaag

SEQ ID NO: 14175 - RNA, 22 nt, Human
uuggagagggugggcuuugaag

SEQ ID NO: 14176 - RNA, 20 nt, Human
uuggagaucacguguccagg

SEQ ID NO: 14177 - RNA, 19 nt, Human
uuggagcaucccaaaggcu

SEQ ID NO: 14178 - RNA, 22 nt, Human
uuggaggcagagucuugcugag

SEQ ID NO: 14179 - RNA, 22 nt, Human
uuggaguucuucaugcucugua

SEQ ID NO: 14180 - RNA, 19 nt, Human
gcaaguuaucugucuccau

SEQ ID NO: 14181 - RNA, 22 nt, Human
gcaauaaguuuucucuucuguc

SEQ ID NO: 14182 - RNA, 22 nt, Human
gcaauagccuacaugcgucaga

SEQ ID NO: 14183 - RNA, 22 nt, Human
gcaauuggaaugaauucuauuu

SEQ ID NO: 14184 - RNA, 22 nt, Human
gcacaaguccuccgacagcacg

SEQ ID NO: 14185 - RNA, 22 nt, Human
gcacacaagagauuguuauugc

SEQ ID NO: 14186 - RNA, 22 nt, Human
gcacacuguaugcugguauuug

SEQ ID NO: 14187 - RNA, 22 nt, Human
uuggcgcuauuauuaccacauu

SEQ ID NO: 14188 - RNA, 22 nt, Human
uuggcuguguugaaaacgugga

SEQ ID NO: 14189 - RNA, 22 nt, Human
uugggaaauuugaaaauaaaag

SEQ ID NO: 14190 - RNA, 22 nt, Human
uugggaacaggcuucccacugg

SEQ ID NO: 14191 - RNA, 20 nt, Human
uugggaagccuacaccauuc

SEQ ID NO: 14192 - RNA, 22 nt, Human
uugggagaaaguuaacuuucua

SEQ ID NO: 14193 - RNA, 22 nt, Human
uugggagagaaaccuaaugccu

SEQ ID NO: 14194 - RNA, 22 nt, Human
uugggcauuucuuauguauuuu

SEQ ID NO: 14195 - RNA, 22 nt, Human
uuggggaaaaagaccuaaugac

SEQ ID NO: 14196 - RNA, 20 nt, Human
uuggggacaggagugugaug

SEQ ID NO: 14197 - RNA, 22 nt, Human
uuggggaugccccuacgggcua

SEQ ID NO: 14198 - RNA, 22 nt, Human
uuggggccggcgcggaggaggg

SEQ ID NO: 14199 - RNA, 22 nt, Human
uuggggcugcguauuuccaugu

SEQ ID NO: 14200 - RNA, 22 nt, Human
uuggggcugcguguuuccaugu

SEQ ID NO: 14201 - RNA, 22 nt, Human
uuggguaacuucccagaggguc

SEQ ID NO: 14202 - RNA, 22 nt, Human
uugggucagcuuucagguagua

SEQ ID NO: 14203 - RNA, 22 nt, Human
uuggguguugguuccugggagg

SEQ ID NO: 14204 - RNA, 22 nt, Human
uugguaaccaaucaaaugugag

SEQ ID NO: 14205 - RNA, 22 nt, Human
uugguauucaguuggauuugga

SEQ ID NO: 14206 - RNA, 22 nt, Human
uugguauuuguuuaaauuacac

SEQ ID NO: 14207 - RNA, 22 nt, Human
uuggugaugaaagugcugcgcu

SEQ ID NO: 14208 - RNA, 22 nt, Human
uuggugaugcccaccuuuucau

SEQ ID NO: 14209 - RNA, 22 nt, Human
uuggugauugggaauggauggg

SEQ ID NO: 14210 - RNA, 22 nt, Human
uugguguaauacaagcaauuug

SEQ ID NO: 14211 - RNA, 22 nt, Human
uugguuccauuuuaccagcucu

SEQ ID NO: 14212 - RNA, 22 nt, Human
uugguugaaauguguucaugcu

SEQ ID NO: 14213 - RNA, 19 nt, Human
uugguuuguugcuuaggug

SEQ ID NO: 14214 - RNA, 22 nt, Human
uugguuuuuugguguaucuuau

SEQ ID NO: 14215 - RNA, 22 nt, Human
uuguaaguuuuagguguuucaa

SEQ ID NO: 14216 - RNA, 22 nt, Human
uuguacaaauaggaaccucuga

SEQ ID NO: 14217 - RNA, 22 nt, Human
uuguacccaccuuggggccuca

SEQ ID NO: 14218 - RNA, 22 nt, Human
uuguacuuaaauaugcaaauag

SEQ ID NO: 14219 - RNA, 22 nt, Human
uuguacuuguucuguuuccuug

SEQ ID NO: 14220 - RNA, 22 nt, Human
uuguagaucagauggccaguag

SEQ ID NO: 14221 - RNA, 22 nt, Human
uuguauaaagauggcuagaucc

SEQ ID NO: 14222 - RNA, 22 nt, Human
uugucaagauauuuuaggaggc

SEQ ID NO: 14223 - RNA, 22 nt, Human
uugucaguggccugaggacaga

SEQ ID NO: 14224 - RNA, 21 nt, Human
uuguccacacacaccaacugc

SEQ ID NO: 14225 - RNA, 22 nt, Human
uuguccacuaagaaagugcccu

SEQ ID NO: 14226 - RNA, 22 nt, Human
uugucccuaugagugguaauca

SEQ ID NO: 14227 - RNA, 22 nt, Human
uugucuguacuggcugcaucga

SEQ ID NO: 14228 - RNA, 22 nt, Human
uugugacuauuuuucauugaag

SEQ ID NO: 14229 - RNA, 15 nt, Human
uugugauauuuaccg

SEQ ID NO: 14230 - RNA, 22 nt, Human
uugugauuaauaacuuuucucu

SEQ ID NO: 14231 - RNA, 22 nt, Human
uugugcacauuucauugaccug

SEQ ID NO: 14232 - RNA, 22 nt, Human
uugugcauuugcuaugggccau

SEQ ID NO: 14233 - RNA, 22 nt, Human
uugugcauuuuguuuuacuuau

SEQ ID NO: 14234 - RNA, 18 nt, Human
uugugccugagaaggugg

SEQ ID NO: 14235 - RNA, 22 nt, Human
uuguggacgcaauucaaggaua

SEQ ID NO: 14236 - RNA, 22 nt, Human
uuguggagaggaagcaaggagg

SEQ ID NO: 14237 - RNA, 22 nt, Human
uuguggcaggauggacagcaga

SEQ ID NO: 14238 - RNA, 22 nt, Human
uuguguugaagugguuagggcg

SEQ ID NO: 14239 - RNA, 22 nt, Human
uuguguuuaaucuguuccacua

SEQ ID NO: 14240 - RNA, 22 nt, Human
uuguuauaggaucagugucacu

SEQ ID NO: 14241 - RNA, 22 nt, Human
uuguuauuauuauuuucguucu

SEQ ID NO: 14242 - RNA, 22 nt, Human
uuguucacuaugaagagguugg

SEQ ID NO: 14243 - RNA, 22 nt, Human
uuguuccagaaacccaggggaa

SEQ ID NO: 14244 - RNA, 22 nt, Human
uuguuccuuucuucuguagucg

SEQ ID NO: 14245 - RNA, 22 nt, Human
uuguugcaagccuggaaucugg

SEQ ID NO: 14246 - RNA, 22 nt, Human
uuguugcuguugaacccugcug

SEQ ID NO: 14247 - RNA, 22 nt, Human
uuguuuaaagaacuucugacuu

SEQ ID NO: 14248 - RNA, 22 nt, Human
uuguuucagcuuccuccuccau

SEQ ID NO: 14249 - RNA, 22 nt, Human
uuguuuggcaaaugugugugug

SEQ ID NO: 14250 - RNA, 22 nt, Human
uuguuugguugacugauuuacc

SEQ ID NO: 14251 - RNA, 22 nt, Human
uuguuuguaaggcucuuagaau

SEQ ID NO: 14252 - RNA, 22 nt, Human
uuguuuuaaaaagaauaacuac

SEQ ID NO: 14253 - RNA, 22 nt, Human
uuguuuuucucuagggaaggcu

SEQ ID NO: 14254 - RNA, 22 nt, Human
uuuaaaacagcauuuaaaaggu

SEQ ID NO: 14255 - RNA, 23 nt, Human
uuuaaacaauguggucguggugg

SEQ ID NO: 14256 - RNA, 22 nt, Human
uuuaaaccuaucuaagaaauag

SEQ ID NO: 14257 - RNA, 22 nt, Human
uuuaaacuaacaguacacguug

SEQ ID NO: 14258 - RNA, 22 nt, Human
uuuaaagucaggcuguaguggu

SEQ ID NO: 14259 - RNA, 22 nt, Human
uuuaacauaugaaagaauauuu

SEQ ID NO: 14260 - RNA, 22 nt, Human
uuuaacccaaauaaccacagga

SEQ ID NO: 14261 - RNA, 20 nt, Human
uuuaacuggccuucuggcuc

SEQ ID NO: 14262 - RNA, 22 nt, Human
uuuaagguacagcuagcagcau

SEQ ID NO: 14263 - RNA, 18 nt, Human
uuuaauaagccuguuaug

SEQ ID NO: 14264 - RNA, 22 nt, Human
uuuaauauuacacuuaccuugu

SEQ ID NO: 14265 - RNA, 22 nt, Human
uuuaauauucucuuugaaggaa

SEQ ID NO: 14266 - RNA, 22 nt, Human
uuuaaucaauaaccuccugggu

SEQ ID NO: 14267 - RNA, 22 nt, Human
uuuaaugaugucuaugccuguu

SEQ ID NO: 14268 - RNA, 22 nt, Human
uuuaaugucuuggaaaaagacu

SEQ ID NO: 14269 - RNA, 22 nt, Human
uuuaaugucuuuggccuuuaau

SEQ ID NO: 14270 - RNA, 22 nt, Human
uuuaauuauaucugggcaguua

SEQ ID NO: 14271 - RNA, 22 nt, Human
uuuacaaggcaguuauuuuccu

SEQ ID NO: 14272 - RNA, 22 nt, Human
uuuacaagucuguugaucccaa

SEQ ID NO: 14273 - RNA, 22 nt, Human
uuuaccugucuguagaacauaa

SEQ ID NO: 14274 - RNA, 22 nt, Human
uuuacuaauuaguuuuggaaca

SEQ ID NO: 14275 - RNA, 22 nt, Human
uuuacucagucugagcaggugu

SEQ ID NO: 14276 - RNA, 22 nt, Human
uuuacuguuuacagcuaaugca

SEQ ID NO: 14277 - RNA, 19 nt, Human
uuuacuuaggccacagaau

SEQ ID NO: 14278 - RNA, 22 nt, Human
uuuacuuuugguaaggucauuu

SEQ ID NO: 14279 - RNA, 22 nt, Human
uuuagacuacuaugcugccaga

SEQ ID NO: 14280 - RNA, 22 nt, Human
uuuagagauaaaugcucuccca

SEQ ID NO: 14281 - RNA, 22 nt, Human
uuuagaugcuguauguuauuuc

SEQ ID NO: 14282 - RNA, 22 nt, Human
uuuagcaaaaaagcucugcgua

SEQ ID NO: 14283 - RNA, 22 nt, Human
uuuagcaguuuauuuaaggggg

SEQ ID NO: 14284 - RNA, 22 nt, Human
uuuagcauggacacugagggcu

SEQ ID NO: 14285 - RNA, 22 nt, Human
uuuaggaauuugcugggcauga

SEQ ID NO: 14286 - RNA, 22 nt, Human
uuuaggucacuccaccgaagag

SEQ ID NO: 14287 - RNA, 22 nt, Human
uuuagguccguguugcaguugg

SEQ ID NO: 14288 - RNA, 22 nt, Human
uuuaggugucugcucauugaag

SEQ ID NO: 14289 - RNA, 21 nt, Human
uuuguucaggggcaaaguuaa

SEQ ID NO: 14290 - RNA, 22 nt, Human
uuuguucaguuuguugugggug

SEQ ID NO: 14291 - RNA, 22 nt, Human
uuuguucuagauaacugguaau

SEQ ID NO: 14292 - RNA, 22 nt, Human
uuuguucuucucaugcacacaa

SEQ ID NO: 14293 - RNA, 22 nt, Human
uuuguugguugcacuggugggu

SEQ ID NO: 14294 - RNA, 22 nt, Human
uuuguuuauuuacuuugggccu

SEQ ID NO: 14295 - RNA, 22 nt, Human
uuuguuugcugagugaauucaa

SEQ ID NO: 14296 - RNA, 22 nt, Human
uuuguuuuggugucaugcguga

SEQ ID NO: 14297 - RNA, 22 nt, Human
uuuuaaaacaugucaaaaugug

SEQ ID NO: 14298 - RNA, 22 nt, Human
uuuuaaaguaauugaagcuugu

SEQ ID NO: 14299 - RNA, 22 nt, Human
uuuuaaauaaacuacacugauu

SEQ ID NO: 14300 - RNA, 22 nt, Human
gcacagaguguaaaaguuucau

SEQ ID NO: 14301 - RNA, 22 nt, Human
gcacagauaaucugccuuacca

SEQ ID NO: 14302 - RNA, 22 nt, Human
gcacagcuaugagcugaauugu

SEQ ID NO: 14303 - RNA, 22 nt, Human
gcacaggcugcacgaccccagc

SEQ ID NO: 14304 - RNA, 22 nt, Human
gcacauaugcuguaagcacaug

SEQ ID NO: 14305 - RNA, 22 nt, Human
gcaccacccaaaggcggggcuc

SEQ ID NO: 14306 - RNA, 22 nt, Human
gcaccauagagaagagacacaa

SEQ ID NO: 14307 - RNA, 22 nt, Human
gcaccgagaaggaagcaugccu

SEQ ID NO: 14308 - RNA, 22 nt, Human
gcacgugugugagagauaugaa

SEQ ID NO: 14309 - RNA, 22 nt, Human
gcacuaccaguaauuaaaucug

SEQ ID NO: 14310 - RNA, 21 nt, Human
gcacucagucacuacucaaga

SEQ ID NO: 14311 - RNA, 23 nt, Human
gcacuccgagggcacgugucucu

SEQ ID NO: 14312 - RNA, 22 nt, Human
gcacucuguggagacaagauag

SEQ ID NO: 14313 - RNA, 22 nt, Human
gcacugagacuuuagauuggag

SEQ ID NO: 14314 - RNA, 22 nt, Human
gcacuguauuuaaauauuuaaa

SEQ ID NO: 14315 - RNA, 22 nt, Human
gcagagaaugucagauuuuguu

SEQ ID NO: 14316 - RNA, 22 nt, Human
gcagagcacccugcagugguau

SEQ ID NO: 14317 - RNA, 22 nt, Human
gcagaggcugccgugggcagga

SEQ ID NO: 14318 - RNA, 22 nt, Human
gcagaguauaaguguggagcug

SEQ ID NO: 14319 - RNA, 21 nt, Human
gcagaguauagauuaggagcc

SEQ ID NO: 14320 - RNA, 22 nt, Human
gcagauaaaauuuuugauggga

SEQ ID NO: 14321 - RNA, 20 nt, Human
gcagcagacagacaggggac

SEQ ID NO: 14322 - RNA, 23 nt, Human
gcagccaacccacgugagagaag

SEQ ID NO: 14323 - RNA, 22 nt, Human
gcagccagggaccuuugacuau

SEQ ID NO: 14324 - RNA, 22 nt, Human
gcagccauggcuggccgggcau

SEQ ID NO: 14325 - RNA, 22 nt, Human
gcagcccucuuggucacuaggc

SEQ ID NO: 14326 - RNA, 22 nt, Human
gcagccuccggccuggcccccu

SEQ ID NO: 14327 - RNA, 22 nt, Human
gcagccucugcaguucaggagg

SEQ ID NO: 14328 - RNA, 22 nt, Human
gcagcguuaacauuuuuccugu

SEQ ID NO: 14329 - RNA, 22 nt, Human
gcagcucagcacgcacagguaa

SEQ ID NO: 14330 - RNA, 22 nt, Human
gcagcuuuggagguggaacucu

SEQ ID NO: 14331 - RNA, 22 nt, Human
gcaggaaugguacauaccuguu

SEQ ID NO: 14332 - RNA, 22 nt, Human
gcaggacuucuguuuaaccagu

SEQ ID NO: 14333 - RNA, 22 nt, Human
gcaggagggggccuggagccca

SEQ ID NO: 14334 - RNA, 22 nt, Human
gcaggcaggauucagagauaca

SEQ ID NO: 14335 - RNA, 22 nt, Human
gcagggcucuggagucaggcug

SEQ ID NO: 14336 - RNA, 22 nt, Human
gcaggggguaaggggcagggcu

SEQ ID NO: 14337 - RNA, 21 nt, Human
gcaggggugugugagcugggg

SEQ ID NO: 14338 - RNA, 22 nt, Human
gcagucauggguagaacucaag

SEQ ID NO: 14339 - RNA, 22 nt, Human
gcagucuacuuaagaaucucag

SEQ ID NO: 14340 - RNA, 22 nt, Human
gcagugacagacaacuguuuga

SEQ ID NO: 14341 - RNA, 23 nt, Human
gcagugacugggauggaaguaga

SEQ ID NO: 14342 - RNA, 22 nt, Human
gcagugcugcgacagucgggug

SEQ ID NO: 14343 - RNA, 19 nt, Human
gcaguuauggcccacuucc

SEQ ID NO: 14344 - RNA, 19 nt, Human
gcaguuccucuuaagagaa

SEQ ID NO: 14345 - RNA, 22 nt, Human
gcaguugguccagccucggcug

SEQ ID NO: 14346 - RNA, 22 nt, Human
gcaguuguagcuguuucuacuc

SEQ ID NO: 14347 - RNA, 22 nt, Human
gcaguuugugauguggcaguca

SEQ ID NO: 14348 - RNA, 22 nt, Human
gcauaaaggacuauaaggauca

SEQ ID NO: 14349 - RNA, 22 nt, Human
gcauagauauguaaugcaucau

SEQ ID NO: 14350 - RNA, 22 nt, Human
gcaucacacgcacauacacaca

SEQ ID NO: 14351 - RNA, 22 nt, Human
gcaucccagaagauucugauuu

SEQ ID NO: 14352 - RNA, 22 nt, Human
gcauccugacuauggugguggu

SEQ ID NO: 14353 - RNA, 22 nt, Human
gcaucuguuagagugugcaugc

SEQ ID NO: 14354 - RNA, 22 nt, Human
gcaucuguuguguuaauuuaca

SEQ ID NO: 14355 - RNA, 23 nt, Human
gcaugcccauauguguauauaua

SEQ ID NO: 14356 - RNA, 22 nt, Human
gcaugcgugcgugcgugcaugu

SEQ ID NO: 14357 - RNA, 22 nt, Human
gcaugcuguuuggaaacgauaa

SEQ ID NO: 14358 - RNA, 22 nt, Human
gcauggaaaagggaugcuaacu

SEQ ID NO: 14359 - RNA, 20 nt, Human
gcauggcuggcugcugucug

SEQ ID NO: 14360 - RNA, 22 nt, Human
gcauguucaaguuaguauauuu

SEQ ID NO: 14361 - RNA, 22 nt, Human
gcauucuugucaguggggucag

SEQ ID NO: 14362 - RNA, 22 nt, Human
gcauuggaaacugcuuuaugcu

SEQ ID NO: 14363 - RNA, 22 nt, Human
gcauuuaaauuugaacuucaga

SEQ ID NO: 14364 - RNA, 22 nt, Human
gcauuucuguuuuuuuaaauga

SEQ ID NO: 14365 - RNA, 23 nt, Human
gcauuugcaggaaacuggaaaag

SEQ ID NO: 14366 - RNA, 22 nt, Human
gccaaccagucgguccaggaag

SEQ ID NO: 14367 - RNA, 20 nt, Human
gccaaggaggagaaacaggc

SEQ ID NO: 14368 - RNA, 22 nt, Human
gccaaucaggaggcuguacauc

SEQ ID NO: 14369 - RNA, 19 nt, Human
gccacguuggcuaguugcc

SEQ ID NO: 14370 - RNA, 16 nt, Human
gccagauugaacuuug

SEQ ID NO: 14371 - RNA, 22 nt, Human
gccagccggugaguggaagcgg

SEQ ID NO: 14372 - RNA, 22 nt, Human
gccaggccuggguggagcgcuc

SEQ ID NO: 14373 - RNA, 22 nt, Human
gccauaggggcuuacauaguua

SEQ ID NO: 14374 - RNA, 23 nt, Human
gccaucugcugggugccccggcc

SEQ ID NO: 14375 - RNA, 22 nt, Human
gccaucuucggcagccgccugg

SEQ ID NO: 14376 - RNA, 22 nt, Human
gccaugguggggccucccugac

SEQ ID NO: 14377 - RNA, 22 nt, Human
gccauguucuugaaucuggguc

SEQ ID NO: 14378 - RNA, 22 nt, Human
gcccaauuugaacaaagauacu

SEQ ID NO: 14379 - RNA, 22 nt, Human
gcccagccucagggcaucagcu

SEQ ID NO: 14380 - RNA, 22 nt, Human
gcccagcucucuggccugucuu

SEQ ID NO: 14381 - RNA, 22 nt, Human
gcccagcuuuuugaggcaggca

SEQ ID NO: 14382 - RNA, 22 nt, Human
gcccauggagaccucaggcugg

SEQ ID NO: 14383 - RNA, 22 nt, Human
gcccccauuccugcggccuuca

SEQ ID NO: 14384 - RNA, 22 nt, Human
gcccccgccuugcugggccagg

SEQ ID NO: 14385 - RNA, 22 nt, Human
gccccucuccuugugcaccugc

SEQ ID NO: 14386 - RNA, 22 nt, Human
gcccgaccgcgccggcccgcac

SEQ ID NO: 14387 - RNA, 22 nt, Human
gcccguuuagcaaacgccuccu

SEQ ID NO: 14388 - RNA, 22 nt, Human
gcccuagaguugagagcaccca

SEQ ID NO: 14389 - RNA, 22 nt, Human
gcccugaaggccuccaggacuc

SEQ ID NO: 14390 - RNA, 22 nt, Human
gcccuggagauggaaguucuga

SEQ ID NO: 14391 - RNA, 22 nt, Human
gcccuggcauuucuauucaugu

SEQ ID NO: 14392 - RNA, 22 nt, Human
gcccuguuuucuggguuccuug

SEQ ID NO: 14393 - RNA, 21 nt, Human
gccgaugugacucuacguagu

SEQ ID NO: 14394 - RNA, 22 nt, Human
gccgcaacggacccugggaguc

SEQ ID NO: 14395 - RNA, 22 nt, Human
gccgccgccgccuuuguugcgg

SEQ ID NO: 14396 - RNA, 22 nt, Human
gccgccgcucaccugggcgccg

SEQ ID NO: 14397 - RNA, 15 nt, Human
gccgcgcuggggagc

SEQ ID NO: 14398 - RNA, 23 nt, Human
uguuugggcuaucuuuuguucuc

SEQ ID NO: 14399 - RNA, 22 nt, Human
uguuuucaucucucacccagaa

SEQ ID NO: 14400 - RNA, 22 nt, Human
uguuuucuuuccccuucuuuuc

SEQ ID NO: 14401 - RNA, 22 nt, Human
uguuuuguuuagguuuguuuuu

SEQ ID NO: 14402 - RNA, 22 nt, Human
uguuuuuagcuguuuuuuggau

SEQ ID NO: 14403 - RNA, 22 nt, Human
uguuuuucaagcauuuauuaau

SEQ ID NO: 14404 - RNA, 22 nt, Human
uguuuuuuagagugauacuuuu

SEQ ID NO: 14405 - RNA, 22 nt, Human
uguuuuuucccccccuucuaaa

SEQ ID NO: 14406 - RNA, 22 nt, Human
uuaaaucaggcaucauuucagu

SEQ ID NO: 14407 - RNA, 22 nt, Human
uuaacccagccauuuucaauuu

SEQ ID NO: 14408 - RNA, 22 nt, Human
uuaacgaauugugcauaauucc

SEQ ID NO: 14409 - RNA, 22 nt, Human
uuaacuaguauuuuuaguccug

SEQ ID NO: 14410 - RNA, 23 nt, Human
uuaagacuggcugaacuuaguag

SEQ ID NO: 14411 - RNA, 22 nt, Human
uuaaggcauagcuuguguugac

SEQ ID NO: 14412 - RNA, 22 nt, Human
uuaagggauugagauggaauga

SEQ ID NO: 14413 - RNA, 22 nt, Human
uuaagguggcauacaacacagc

SEQ ID NO: 14414 - RNA, 22 nt, Human
uuaauaaggaccugugacaugc

SEQ ID NO: 14415 - RNA, 22 nt, Human
uuaauauuuauugguaaucacu

SEQ ID NO: 14416 - RNA, 22 nt, Human
uuaaugauuaauguggacccaa

SEQ ID NO: 14417 - RNA, 22 nt, Human
uuaaugcagguacuguuacaau

SEQ ID NO: 14418 - RNA, 22 nt, Human
uuaauucuugagcugucuuucc

SEQ ID NO: 14419 - RNA, 22 nt, Human
uuaauugggugcuuuguaaaua

SEQ ID NO: 14420 - RNA, 22 nt, Human
uuacaguuuacauaagaauugu

SEQ ID NO: 14421 - RNA, 22 nt, Human
uuacaucacuuuacuuaauaau

SEQ ID NO: 14422 - RNA, 19 nt, Human
uuacaugacauaugaagga

SEQ ID NO: 14423 - RNA, 22 nt, Human
uuaccgagaacaugacuggaau

SEQ ID NO: 14424 - RNA, 22 nt, Human
uuaccuaagaaacucauuucgu

SEQ ID NO: 14425 - RNA, 22 nt, Human
uuaccugcagagacguggaggc

SEQ ID NO: 14426 - RNA, 22 nt, Human
uuaccuuggaccggguaucaga

SEQ ID NO: 14427 - RNA, 22 nt, Human
uuacucucugaggcacucaaaa

SEQ ID NO: 14428 - RNA, 20 nt, Human
uuacugagguauuuuuauca

SEQ ID NO: 14429 - RNA, 21 nt, Human
uuacuggcagcagaaaccuga

SEQ ID NO: 14430 - RNA, 22 nt, Human
uuacuguguguaaaauaucuuu

SEQ ID NO: 14431 - RNA, 22 nt, Human
uuacuuacagggggucaggcug

SEQ ID NO: 14432 - RNA, 22 nt, Human
uuacuuuuuucccccuuagaug

SEQ ID NO: 14433 - RNA, 22 nt, Human
uuagaauggaaucauuugcauu

SEQ ID NO: 14434 - RNA, 22 nt, Human
uuagacagagcuccuugagggc

SEQ ID NO: 14435 - RNA, 22 nt, Human
uuagacaucaagaagccaaugu

SEQ ID NO: 14436 - RNA, 22 nt, Human
uuagagaagcacuguaggugaa

SEQ ID NO: 14437 - RNA, 22 nt, Human
uuagagaauagacuuuacccug

SEQ ID NO: 14438 - RNA, 22 nt, Human
uuagagagaggagagagagaga

SEQ ID NO: 14439 - RNA, 20 nt, Human
uuagaggccaugucuuguuu

SEQ ID NO: 14440 - RNA, 22 nt, Human
uuagagguuuuuuuccucauuc

SEQ ID NO: 14441 - RNA, 22 nt, Human
uuagaguacaggauuguuuuaa

SEQ ID NO: 14442 - RNA, 22 nt, Human
uuagaguucaagcuuuaggaaa

SEQ ID NO: 14443 - RNA, 22 nt, Human
uuagaugcugugauuuuucaaa

SEQ ID NO: 14444 - RNA, 22 nt, Human
uuagcacugucugguuaucuug

SEQ ID NO: 14445 - RNA, 22 nt, Human
uuagcagacagauggagagaga

SEQ ID NO: 14446 - RNA, 22 nt, Human
uuagcccaggacuuuuuauagc

SEQ ID NO: 14447 - RNA, 18 nt, Human
uuagccuaggagggagcc

SEQ ID NO: 14448 - RNA, 22 nt, Human
uuagccuccaguuuucucauuu

SEQ ID NO: 14449 - RNA, 22 nt, Human
uuagcgcucucuccauucuuaa

SEQ ID NO: 14450 - RNA, 22 nt, Human
uuaggacucuauuuggguaucu

SEQ ID NO: 14451 - RNA, 22 nt, Human
uuaggagugaguuacuuagggu

SEQ ID NO: 14452 - RNA, 22 nt, Human
uuaggcuaauagagauggaaug

SEQ ID NO: 14453 - RNA, 22 nt, Human
uuaggcuuuauugaaaacaaua

SEQ ID NO: 14454 - RNA, 22 nt, Human
uuaggggcuuaggcagaguuug

SEQ ID NO: 14455 - RNA, 19 nt, Human
uuaggguccauuuuuuuau

SEQ ID NO: 14456 - RNA, 22 nt, Human
uuaggucuugggccugccucca

SEQ ID NO: 14457 - RNA, 22 nt, Human
uuaguauuuucaccauaugagg

SEQ ID NO: 14458 - RNA, 22 nt, Human
uuaguauuuuuugaaugaugaa

SEQ ID NO: 14459 - RNA, 22 nt, Human
uuagucauucccucuugauauu

SEQ ID NO: 14460 - RNA, 22 nt, Human
uuaguccuaaauuuagauuuuc

SEQ ID NO: 14461 - RNA, 22 nt, Human
uuauaagugccucuuuauuuuc

SEQ ID NO: 14462 - RNA, 18 nt, Human
uuauacaauuuuuuuuca

SEQ ID NO: 14463 - RNA, 22 nt, Human
uuauaggugauuaauuuuaacc

SEQ ID NO: 14464 - RNA, 22 nt, Human
uuauaucagaaggugagauuga

SEQ ID NO: 14465 - RNA, 22 nt, Human
uuauauuaaaaaucgcuaacag

SEQ ID NO: 14466 - RNA, 19 nt, Human
uuauccacagggaauuuau

SEQ ID NO: 14467 - RNA, 20 nt, Human
uuauccccauucuuguucuc

SEQ ID NO: 14468 - RNA, 19 nt, Human
uuauccggacuuaauuuau

SEQ ID NO: 14469 - RNA, 22 nt, Human
uuaucugcccauuguagaauug

SEQ ID NO: 14470 - RNA, 22 nt, Human
uuaucuuuuaaaaacacuugug

SEQ ID NO: 14471 - RNA, 22 nt, Human
uuaugcaaaggggccucuuccu

SEQ ID NO: 14472 - RNA, 22 nt, Human
uuaugggguuaaauuucuccua

SEQ ID NO: 14473 - RNA, 22 nt, Human
uuaugguuuaauauccagcaca

SEQ ID NO: 14474 - RNA, 22 nt, Human
uuaugucauuugaauuaauuuu

SEQ ID NO: 14475 - RNA, 22 nt, Human
uuaugugcuacacauaauuugu

SEQ ID NO: 14476 - RNA, 22 nt, Human
uuauguugauaggaaucugauu

SEQ ID NO: 14477 - RNA, 22 nt, Human
uuauuguagcacuuuggcagug

SEQ ID NO: 14478 - RNA, 22 nt, Human
uuauuucaggcauuuguaaaug

SEQ ID NO: 14479 - RNA, 22 nt, Human
uuauuugguuuuggcuuuagcu

SEQ ID NO: 14480 - RNA, 22 nt, Human
uuauuuucgugugugugugugu

SEQ ID NO: 14481 - RNA, 22 nt, Human
uuauuuuguagcucugaucuuu

SEQ ID NO: 14482 - RNA, 22 nt, Human
uuauuuuuguaacacuguauag

SEQ ID NO: 14483 - RNA, 22 nt, Human
uuauuuuuguuuguuaagccua

SEQ ID NO: 14484 - RNA, 22 nt, Human
uucaaaccuaucuaagaaauag

SEQ ID NO: 14485 - RNA, 21 nt, Human
uucaaccagcaauuggcagaa

SEQ ID NO: 14486 - RNA, 22 nt, Human
uucaaccuucagcuugaguugg

SEQ ID NO: 14487 - RNA, 21 nt, Human
uucaaguucacacucaaaggu

SEQ ID NO: 14488 - RNA, 22 nt, Human
uucaaguucccucagggagccc

SEQ ID NO: 14489 - RNA, 22 nt, Human
uucaaugcaagggaggucugaa

SEQ ID NO: 14490 - RNA, 22 nt, Human
uucaauuacaucagaaucuaaa

SEQ ID NO: 14491 - RNA, 22 nt, Human
uucacaauuuuaaaaaguggaa

SEQ ID NO: 14492 - RNA, 22 nt, Human
uucacauucauuucuuauguuu

SEQ ID NO: 14493 - RNA, 23 nt, Human
uucaccaaugcuguccaaguacc

SEQ ID NO: 14494 - RNA, 22 nt, Human
uucacccaaaucaagcuggccu

SEQ ID NO: 14495 - RNA, 22 nt, Human
uucacccuucucuggcuuucag

SEQ ID NO: 14496 - RNA, 22 nt, Human
uucacguuguugaagaaaauac

SEQ ID NO: 14497 - RNA, 22 nt, Human
uucacucagagcaggacagccc

SEQ ID NO: 14498 - RNA, 22 nt, Human
uucacugacaguauugaggagg

SEQ ID NO: 14499 - RNA, 22 nt, Human
uucacugugauguuuaagagaa

SEQ ID NO: 14500 - RNA, 22 nt, Human
uucacugugauugggguggauu

SEQ ID NO: 14501 - RNA, 22 nt, Human
uucacuuuuuccugguccauuu

SEQ ID NO: 14502 - RNA, 22 nt, Human
uucagaacugucuguccuuuuc

SEQ ID NO: 14503 - RNA, 22 nt, Human
uucagaagguaggaaugucccu

SEQ ID NO: 14504 - RNA, 22 nt, Human
uucagaauguacugauagaaca

SEQ ID NO: 14505 - RNA, 22 nt, Human
uucagacugcccauguuugcca

SEQ ID NO: 14506 - RNA, 22 nt, Human
uucagcaagugucucuacuguc

SEQ ID NO: 14507 - RNA, 22 nt, Human
uucagcauggcuguuuucccuu

SEQ ID NO: 14508 - RNA, 22 nt, Human
uucagcugcuugccugaaguca

SEQ ID NO: 14509 - RNA, 22 nt, Human
uugguuaccuucagaaaugagu

SEQ ID NO: 14510 - RNA, 22 nt, Human
uugguugcugaugagcuuugag

SEQ ID NO: 14511 - RNA, 22 nt, Human
uugguuuacucuggggauaucu

SEQ ID NO: 14512 - RNA, 22 nt, Human
uugguuuuauucguauuuguau

SEQ ID NO: 14513 - RNA, 22 nt, Human
uuguaagacuguagaaugcaaa

SEQ ID NO: 14514 - RNA, 22 nt, Human
uuguaauaguguuuuacguugu

SEQ ID NO: 14515 - RNA, 20 nt, Human
uuguacuuaugugagaagga

SEQ ID NO: 14516 - RNA, 22 nt, Human
uuguagccaugucacaagcaca

SEQ ID NO: 14517 - RNA, 22 nt, Human
uuguaggguauagcaggagaac

SEQ ID NO: 14518 - RNA, 22 nt, Human
uuguaugcugggaagcgggagg

SEQ ID NO: 14519 - RNA, 22 nt, Human
uuguauguuucugugcacauga

SEQ ID NO: 14520 - RNA, 22 nt, Human
uuguauuaauacacuccuuuuc

SEQ ID NO: 14521 - RNA, 22 nt, Human
uuguauuguuugcgucuguguu

SEQ ID NO: 14522 - RNA, 22 nt, Human
uugucagcuagugaugcuguuc

SEQ ID NO: 14523 - RNA, 22 nt, Human
uugucaggaacuaugauuaugc

SEQ ID NO: 14524 - RNA, 22 nt, Human
uugucaugauccuucuguuagg

SEQ ID NO: 14525 - RNA, 22 nt, Human
uugucauuuucuuaauguuccu

SEQ ID NO: 14526 - RNA, 22 nt, Human
uugucucuacagagaguaguag

SEQ ID NO: 14527 - RNA, 19 nt, Human
uugucuuagcugcauaaga

SEQ ID NO: 14528 - RNA, 22 nt, Human
uugucuuggcauaccguuauau

SEQ ID NO: 14529 - RNA, 22 nt, Human
uugucuuucguauggaacacua

SEQ ID NO: 14530 - RNA, 21 nt, Human
uugugaaaguccaggaacaac

SEQ ID NO: 14531 - RNA, 22 nt, Human
uugugacaauacagcauggaga

SEQ ID NO: 14532 - RNA, 22 nt, Human
uugugaggaugugcuuuuuagu

SEQ ID NO: 14533 - RNA, 22 nt, Human
uugugcagugccuggacccagg

SEQ ID NO: 14534 - RNA, 22 nt, Human
uugugccuuaauauaggcgcug

SEQ ID NO: 14535 - RNA, 23 nt, Human
uugugcggugcuuuggguuuaca

SEQ ID NO: 14536 - RNA, 22 nt, Human
uugugcucaguuguggucuauu

SEQ ID NO: 14537 - RNA, 23 nt, Human
uugugguuauauuugcccauuuu

SEQ ID NO: 14538 - RNA, 22 nt, Human
uugugugugcccaccuguggcc

SEQ ID NO: 14539 - RNA, 20 nt, Human
uuguuagguucaguguuucc

SEQ ID NO: 14540 - RNA, 22 nt, Human
uuguuccuaguuguccaucaca

SEQ ID NO: 14541 - RNA, 22 nt, Human
uuguuccuucuuuuuguaucag

SEQ ID NO: 14542 - RNA, 22 nt, Human
uuguuguuguuguuauuuaguu

SEQ ID NO: 14543 - RNA, 22 nt, Human
uuguuuacuugagcugcacucu

SEQ ID NO: 14544 - RNA, 22 nt, Human
uuguuucauggggacgacuggc

SEQ ID NO: 14545 - RNA, 22 nt, Human
uuguuugcacuuuagagacugu

SEQ ID NO: 14546 - RNA, 22 nt, Human
uuguuuuaguagaaguuacaug

SEQ ID NO: 14547 - RNA, 22 nt, Human
uuguuuucuaguguuuugaaua

SEQ ID NO: 14548 - RNA, 22 nt, Human
uuguuuucuugaugaaauuauu

SEQ ID NO: 14549 - RNA, 22 nt, Human
uuuaaaacaguacguuuucuua

SEQ ID NO: 14550 - RNA, 22 nt, Human
uuuaaaauguuuuauuuauuua

SEQ ID NO: 14551 - RNA, 22 nt, Human
uuuaaaccuuggaagccacaua

SEQ ID NO: 14552 - RNA, 22 nt, Human
uuuaaauaguugguuuuuuugc

SEQ ID NO: 14553 - RNA, 22 nt, Human
uuuaaauuucugaaucuugagg

SEQ ID NO: 14554 - RNA, 21 nt, Human
uuuaaggccagcaggagguga

SEQ ID NO: 14555 - RNA, 22 nt, Human
uuuaaguuaguauggguuaggu

SEQ ID NO: 14556 - RNA, 22 nt, Human
uuuaaucaguugguaauauuga

SEQ ID NO: 14557 - RNA, 22 nt, Human
uuuaaugguuuauggucuaaga

SEQ ID NO: 14558 - RNA, 19 nt, Human
uuuaaugugugcugcaauc

SEQ ID NO: 14559 - RNA, 22 nt, Human
uuuaccucguuguguccuuguu

SEQ ID NO: 14560 - RNA, 22 nt, Human
uuuaccuuauguaaauaagagu

SEQ ID NO: 14561 - RNA, 18 nt, Human
uuuacgaacucacuugag

SEQ ID NO: 14562 - RNA, 22 nt, Human
uuuacuauuaguauuucauuuu

SEQ ID NO: 14563 - RNA, 22 nt, Human
uguagcaauauaucagugcaca

SEQ ID NO: 14564 - RNA, 22 nt, Human
uguagcucaaggaauuguucuc

SEQ ID NO: 14565 - RNA, 22 nt, Human
uguagcuccuaaagcccagcug

SEQ ID NO: 14566 - RNA, 22 nt, Human
uguaggcacauguauauauccc

SEQ ID NO: 14567 - RNA, 22 nt, Human
uguagggaucugccucuuccuc

SEQ ID NO: 14568 - RNA, 22 nt, Human
uguagucucagggagcugcuuc

SEQ ID NO: 14569 - RNA, 22 nt, Human
uguaguguuuagucuagugucg

SEQ ID NO: 14570 - RNA, 22 nt, Human
uguaguuuuaggagggguaaau

SEQ ID NO: 14571 - RNA, 22 nt, Human
uguauaaaauggaaugucagaa

SEQ ID NO: 14572 - RNA, 23 nt, Human
uguauacacccugugcaucuggg

SEQ ID NO: 14573 - RNA, 22 nt, Human
uguauagcaggguucuuccucc

SEQ ID NO: 14574 - RNA, 22 nt, Human
uguauauuccagggguagggcc

SEQ ID NO: 14575 - RNA, 22 nt, Human
uguauauuuucuguauaaaaua

SEQ ID NO: 14576 - RNA, 22 nt, Human
uguaucucugacacagucucac

SEQ ID NO: 14577 - RNA, 22 nt, Human
uguauguguuuuauguguguuu

SEQ ID NO: 14578 - RNA, 22 nt, Human
uguauugaggauucauuuuugu

SEQ ID NO: 14579 - RNA, 19 nt, Human
uguauuuauauuucugugc

SEQ ID NO: 14580 - RNA, 22 nt, Human
uguauuugaagaaagagcuucu

SEQ ID NO: 14581 - RNA, 22 nt, Human
uguauuuuuucccugaaauaaa

SEQ ID NO: 14582 - RNA, 22 nt, Human
ugucaaguuguuaaguucuggg

SEQ ID NO: 14583 - RNA, 22 nt, Human
ugucacaccucguuuagcauuc

SEQ ID NO: 14584 - RNA, 22 nt, Human
ugucacaccuggcgauaauggg

SEQ ID NO: 14585 - RNA, 22 nt, Human
ugucacagggauaccauggggc

SEQ ID NO: 14586 - RNA, 22 nt, Human
ugucacagugcacagcuaagaa

SEQ ID NO: 14587 - RNA, 22 nt, Human
ugucaccucauacaguaccuca

SEQ ID NO: 14588 - RNA, 22 nt, Human
ugucacggccggguggcaccga

SEQ ID NO: 14589 - RNA, 22 nt, Human
ugucacguaaaaacuagauuuc

SEQ ID NO: 14590 - RNA, 23 nt, Human
ugucacugcggaguggccugcag

SEQ ID NO: 14591 - RNA, 22 nt, Human
ugucacuuaagguuggugucuc

SEQ ID NO: 14592 - RNA, 22 nt, Human
ugucagacagggcugcagucag

SEQ ID NO: 14593 - RNA, 21 nt, Human
ugucagcaacaauacuuucuc

SEQ ID NO: 14594 - RNA, 22 nt, Human
ugucagccacggugugaccggc

SEQ ID NO: 14595 - RNA, 22 nt, Human
ugucauauagaauguucuauga

SEQ ID NO: 14596 - RNA, 22 nt, Human
ugucaucuuggugcugugagag

SEQ ID NO: 14597 - RNA, 22 nt, Human
ugucauuggugaucugaugccu

SEQ ID NO: 14598 - RNA, 22 nt, Human
uguccagcuauauguguaugug

SEQ ID NO: 14599 - RNA, 22 nt, Human
ugucccaucacagaggagacua

SEQ ID NO: 14600 - RNA, 22 nt, Human
uguccccugcccagggauggga

SEQ ID NO: 14601 - RNA, 22 nt, Human
ugucccuggacuccaggagcca

SEQ ID NO: 14602 - RNA, 20 nt, Human
ugucccuggagagcugcaga

SEQ ID NO: 14603 - RNA, 21 nt, Human
uguccucggaucaguccacaa

SEQ ID NO: 14604 - RNA, 20 nt, Human
aaaaacaguaaugcugaaga

SEQ ID NO: 14605 - RNA, 22 nt, Human
aaaaacuuaccccagggcaagg

SEQ ID NO: 14606 - RNA, 22 nt, Human
aaaaaggagaaagagagggaga

SEQ ID NO: 14607 - RNA, 22 nt, Human
aaaaaguaccacuuggacacuu

SEQ ID NO: 14608 - RNA, 22 nt, Human
aaaacauuuaggguuuuuuuua

SEQ ID NO: 14609 - RNA, 22 nt, Human
aaaacauuuuacugccaucuca

SEQ ID NO: 14610 - RNA, 22 nt, Human
aaaagaaugaugggagcugggu

SEQ ID NO: 14611 - RNA, 22 nt, Human
aaaagauguaaacauauauuaa

SEQ ID NO: 14612 - RNA, 22 nt, Human
aaaaggaacaauaugguauuuu

SEQ ID NO: 14613 - RNA, 22 nt, Human
aaaaggacaguagccuugaggu

SEQ ID NO: 14614 - RNA, 22 nt, Human
aaaaggauauuuggugcaaagc

SEQ ID NO: 14615 - RNA, 22 nt, Human
aaaagggucugacacugcuuga

SEQ ID NO: 14616 - RNA, 22 nt, Human
aaaagguauuuagcgauugcau

SEQ ID NO: 14617 - RNA, 22 nt, Human
aaaaggucacuguaaaaugacg

SEQ ID NO: 14618 - RNA, 22 nt, Human
aaaauaaccuucauuugcauug

SEQ ID NO: 14619 - RNA, 22 nt, Human
aaaauaauauuauaccacugcu

SEQ ID NO: 14620 - RNA, 22 nt, Human
aaaauauaaaggauguggguuu

SEQ ID NO: 14621 - RNA, 22 nt, Human
aaaauauuuaucuagcucuuaa

SEQ ID NO: 14622 - RNA, 17 nt, Human
aaaaucaaaggaggugc

SEQ ID NO: 14623 - RNA, 22 nt, Human
aaaaucucagaaaaguuuaggu

SEQ ID NO: 14624 - RNA, 22 nt, Human
aaacaagagcuuacauggcugc

SEQ ID NO: 14625 - RNA, 22 nt, Human
aaacacacaacauauuuuggaa

SEQ ID NO: 14626 - RNA, 22 nt, Human
aaacagcugcaguacacggccu

SEQ ID NO: 14627 - RNA, 22 nt, Human
aaacagguuugaacuucuuaac

SEQ ID NO: 14628 - RNA, 21 nt, Human
aaacaugcagccugccaauuc

SEQ ID NO: 14629 - RNA, 18 nt, Human
aaacauggcuuaaaggcu

SEQ ID NO: 14630 - RNA, 22 nt, Human
aaaccagaguucauaguauuca

SEQ ID NO: 14631 - RNA, 22 nt, Human
aaacccacauuccugcuuaggc

SEQ ID NO: 14632 - RNA, 18 nt, Human
aaacccacguauucaggc

SEQ ID NO: 14633 - RNA, 22 nt, Human
aaacccuagcguuguuuauuga

SEQ ID NO: 14634 - RNA, 22 nt, Human
aaacgcaauuucuugcauguca

SEQ ID NO: 14635 - RNA, 22 nt, Human
aaacgcauucuuacaugcuucc

SEQ ID NO: 14636 - RNA, 18 nt, Human
aaacgguuucaugcugua

SEQ ID NO: 14637 - RNA, 22 nt, Human
aaacuagaacagagagagaagc

SEQ ID NO: 14638 - RNA, 22 nt, Human
aaacucaucaguuuagaaaccu

SEQ ID NO: 14639 - RNA, 22 nt, Human
aaacucaugccagagaacuuaa

SEQ ID NO: 14640 - RNA, 20 nt, Human
aaacucucugaucuuacagu

SEQ ID NO: 14641 - RNA, 22 nt, Human
aaacugcuuucucugccuuucc

SEQ ID NO: 14642 - RNA, 22 nt, Human
aaacuugaggcaaugaaggugu

SEQ ID NO: 14643 - RNA, 22 nt, Human
aaagaacguuucugggaaucag

SEQ ID NO: 14644 - RNA, 21 nt, Human
aaagaagagcucagagguaga

SEQ ID NO: 14645 - RNA, 22 nt, Human
aucagcucuugaugccuuucuu

SEQ ID NO: 14646 - RNA, 22 nt, Human
aucagugcacgcgaugggcaga

SEQ ID NO: 14647 - RNA, 22 nt, Human
aucauaccaguuuccaucagga

SEQ ID NO: 14648 - RNA, 22 nt, Human
aucauaugugauaccauaauga

SEQ ID NO: 14649 - RNA, 22 nt, Human
aucauccuagaaggaagcuagg

SEQ ID NO: 14650 - RNA, 22 nt, Human
aucaucuaaaauuggcucagau

SEQ ID NO: 14651 - RNA, 22 nt, Human
aucaugcgguuaaggagugugu

SEQ ID NO: 14652 - RNA, 22 nt, Human
aucaugugacuagguuuggcca

SEQ ID NO: 14653 - RNA, 22 nt, Human
aaagagacaacaacaacuucua

SEQ ID NO: 14654 - RNA, 22 nt, Human
aaagagccaacuaccgcaaauu

SEQ ID NO: 14655 - RNA, 22 nt, Human
aaagagcugccaagguuacagu

SEQ ID NO: 14656 - RNA, 22 nt, Human
aaagaggacgugcuauuuuuua

SEQ ID NO: 14657 - RNA, 23 nt, Human
aaagaggugaauccaggacaagc

SEQ ID NO: 14658 - RNA, 22 nt, Human
aaagaguuaagagucuuaagcu

SEQ ID NO: 14659 - RNA, 22 nt, Human
aaagaguuguauucuuuuugag

SEQ ID NO: 14660 - RNA, 22 nt, Human
aaagaugucauacacauuaaga

SEQ ID NO: 14661 - RNA, 22 nt, Human
aaagcaaagaucuguagcccaa

SEQ ID NO: 14662 - RNA, 22 nt, Human
aaagcaaauaguugcuuaauau

SEQ ID NO: 14663 - RNA, 22 nt, Human
aaagcagucuguuuuaaccuga

SEQ ID NO: 14664 - RNA, 22 nt, Human
aaagcauucuaaccgaucgacg

SEQ ID NO: 14665 - RNA, 22 nt, Human
aaagccagggacagugugcaug

SEQ ID NO: 14666 - RNA, 22 nt, Human
aaagccuacagucaugguuaga

SEQ ID NO: 14667 - RNA, 22 nt, Human
aaagcugaaacgaaaugacaac

SEQ ID NO: 14668 - RNA, 22 nt, Human
aaaggaaacuaugaaucucugg

SEQ ID NO: 14669 - RNA, 22 nt, Human
aaaggagugaaaugagaggaaa

SEQ ID NO: 14670 - RNA, 22 nt, Human
aaagggaugauuucugaagaua

SEQ ID NO: 14671 - RNA, 22 nt, Human
aaagggcugaaguagucucugu

SEQ ID NO: 14672 - RNA, 22 nt, Human
aaaggggugguauuucuuuugg

SEQ ID NO: 14673 - RNA, 22 nt, Human
aaaggucagaugugucgaggag

SEQ ID NO: 14674 - RNA, 22 nt, Human
aaagguggugguuagggaauau

SEQ ID NO: 14675 - RNA, 22 nt, Human
aaagguguagacucaguuaugc

SEQ ID NO: 14676 - RNA, 22 nt, Human
aaaguaaagccuauuuaauaau

SEQ ID NO: 14677 - RNA, 22 nt, Human
aaagucgugucagaaguuggga

SEQ ID NO: 14678 - RNA, 22 nt, Human
aaagucugaaaaaguuuguggg

SEQ ID NO: 14679 - RNA, 21 nt, Human
aaagugguaaggauuauuuug

SEQ ID NO: 14680 - RNA, 22 nt, Human
aaaguuaauucuuguuuuuuau

SEQ ID NO: 14681 - RNA, 22 nt, Human
aaaguuguccuuugugccuuua

SEQ ID NO: 14682 - RNA, 22 nt, Human
aaauaggaguagugauguauua

SEQ ID NO: 14683 - RNA, 22 nt, Human
aaauaggucaaucagacuauga

SEQ ID NO: 14684 - RNA, 22 nt, Human
aaauauagugacacuuauaguc

SEQ ID NO: 14685 - RNA, 22 nt, Human
aaauauugaauuugaggaugua

SEQ ID NO: 14686 - RNA, 22 nt, Human
aaauauuugaaugguguaagau

SEQ ID NO: 14687 - RNA, 22 nt, Human
aaaucauguuaaagagggaguu

SEQ ID NO: 14688 - RNA, 22 nt, Human
aaauccaucaaaucuucuagaa

SEQ ID NO: 14689 - RNA, 20 nt, Human
aaauccuugggaguggugca

SEQ ID NO: 14690 - RNA, 22 nt, Human
aaaucugaaggaaacagcuuca

SEQ ID NO: 14691 - RNA, 22 nt, Human
aaaucugaauuaaaaucugguu

SEQ ID NO: 14692 - RNA, 22 nt, Human
aaaucuuccugaaauuuguuca

SEQ ID NO: 14693 - RNA, 22 nt, Human
aaaugcacaauaaaguaaaggc

SEQ ID NO: 14694 - RNA, 22 nt, Human
aaaugcucgccagguuuuauua

SEQ ID NO: 14695 - RNA, 22 nt, Human
aaaugcuuuaauugaguucaug

SEQ ID NO: 14696 - RNA, 22 nt, Human
aaauggaaguuuguucucagcc

SEQ ID NO: 14697 - RNA, 22 nt, Human
aaaugggagucacacagguuua

SEQ ID NO: 14698 - RNA, 17 nt, Human
aaaugguccuagggauu

SEQ ID NO: 14699 - RNA, 22 nt, Human
aaauguaaacuguauuuauaaa

SEQ ID NO: 14700 - RNA, 22 nt, Human
aaauguauuagccuaugugaga

SEQ ID NO: 14701 - RNA, 22 nt, Human
aaauuaggcccugauuuuaugu

SEQ ID NO: 14702 - RNA, 22 nt, Human
aaauuagucacaccagugucuu

SEQ ID NO: 14703 - RNA, 20 nt, Human
aaauucgacuaaaaccagaa

SEQ ID NO: 14704 - RNA, 22 nt, Human
aaauucggggaguuuugaggau

SEQ ID NO: 14705 - RNA, 22 nt, Human
aaauucuuccaggaggaaauac

SEQ ID NO: 14706 - RNA, 20 nt, Human
aaauugaacaagccaggcug

SEQ ID NO: 14707 - RNA, 22 nt, Human
aaauugcauuuuaaagguagau

SEQ ID NO: 14708 - RNA, 22 nt, Human
aaauugucuuuaaucaggucau

SEQ ID NO: 14709 - RNA, 22 nt, Human
aaauuugggagaaaugggucau

SEQ ID NO: 14710 - RNA, 22 nt, Human
aaauuuuguugaaaaauauuuu

SEQ ID NO: 14711 - RNA, 21 nt, Human
aacaaaagggaagaacagcug

SEQ ID NO: 14712 - RNA, 22 nt, Human
aacaaagaaaagcuugagguuu

SEQ ID NO: 14713 - RNA, 22 nt, Human
aacaaccuaguaguaucuuuca

SEQ ID NO: 14714 - RNA, 22 nt, Human
aacaaguagaauagguuuuuuu

SEQ ID NO: 14715 - RNA, 22 nt, Human
aacacaguuucucuaugagagu

SEQ ID NO: 14716 - RNA, 22 nt, Human
aacacaucagcacacuaacgga

SEQ ID NO: 14717 - RNA, 22 nt, Human
aacacguuuauccuaagaacuc

SEQ ID NO: 14718 - RNA, 22 nt, Human
aacacuaaaggucaguuagaag

SEQ ID NO: 14719 - RNA, 22 nt, Human
aacacugaaaugucuuaagauu

SEQ ID NO: 14720 - RNA, 22 nt, Human
aacagaaaucauuuagggcucu

SEQ ID NO: 14721 - RNA, 22 nt, Human
aacagaauaucaaaagauuaug

SEQ ID NO: 14722 - RNA, 22 nt, Human
aacagagauucuucccuucuuu

SEQ ID NO: 14723 - RNA, 20 nt, Human
aacagcucucgacuuaucuu

SEQ ID NO: 14724 - RNA, 22 nt, Human
aacagguucaucuuggaagcag

SEQ ID NO: 14725 - RNA, 22 nt, Human
aacaguacaucaugaggucauc

SEQ ID NO: 14726 - RNA, 22 nt, Human
aacaguguaggagcugguuuau

SEQ ID NO: 14727 - RNA, 22 nt, Human
aacaguuaagaggaggcagaga

SEQ ID NO: 14728 - RNA, 22 nt, Human
aacauuguggacaagggcaggu

SEQ ID NO: 14729 - RNA, 22 nt, Human
aacauuguuuaaguuaaauugu

SEQ ID NO: 14730 - RNA, 22 nt, Human
aacauuuccggccuuuuguucu

SEQ ID NO: 14731 - RNA, 22 nt, Human
aaccaaguaaagagguuucauu

SEQ ID NO: 14732 - RNA, 22 nt, Human
aaccagaagucaucagagcuga

SEQ ID NO: 14733 - RNA, 22 nt, Human
aaccauauugauuauguuuuau

SEQ ID NO: 14734 - RNA, 22 nt, Human
aacccaagacaagcacuggcca

SEQ ID NO: 14735 - RNA, 22 nt, Human
aacccguagaucaguucuaggu

SEQ ID NO: 14736 - RNA, 22 nt, Human
aacccugaacuuaguucuagga

SEQ ID NO: 14737 - RNA, 22 nt, Human
aacccuguuguguacaugcaua

SEQ ID NO: 14738 - RNA, 22 nt, Human
aaccguguucgggaacacuugu

SEQ ID NO: 14739 - RNA, 20 nt, Human
aaccuauuguaauauucuaa

SEQ ID NO: 14740 - RNA, 22 nt, Human
aaccucuuuaaaagggauauug

SEQ ID NO: 14741 - RNA, 22 nt, Human
aaccucuuugugaaugucauga

SEQ ID NO: 14742 - RNA, 22 nt, Human
aaccugagggcaggaccccaua

SEQ ID NO: 14743 - RNA, 22 nt, Human
aaccuggguguacauuaugguc

SEQ ID NO: 14744 - RNA, 22 nt, Human
aaccuuauuguguaucaccaua

SEQ ID NO: 14745 - RNA, 22 nt, Human
aaccuuucucccugcacacugg

SEQ ID NO: 14746 - RNA, 22 nt, Human
aacgagcugggggggccggggg

SEQ ID NO: 14747 - RNA, 22 nt, Human
aacgcugugcacuggguccagg

SEQ ID NO: 14748 - RNA, 22 nt, Human
aacgggguugauuauuggaaga

SEQ ID NO: 14749 - RNA, 22 nt, Human
aacguaauuuguggaaggggua

SEQ ID NO: 14750 - RNA, 22 nt, Human
aacgucugagaccccuccucuc

SEQ ID NO: 14751 - RNA, 22 nt, Human
aacgugcuuuacaaaugaccuu

SEQ ID NO: 14752 - RNA, 21 nt, Human
aacuaaugacugcagcaggaa

SEQ ID NO: 14753 - RNA, 22 nt, Human
aacuacucugggguggcagguu

SEQ ID NO: 14754 - RNA, 21 nt, Human
aacuauuaauaccauuagcaa

SEQ ID NO: 14755 - RNA, 22 nt, Human
aacucaggagagaguaacaggg

SEQ ID NO: 14756 - RNA, 22 nt, Human
aacucgaugcaauucacuuugu

SEQ ID NO: 14757 - RNA, 22 nt, Human
aacucugacgcugucaaauaca

SEQ ID NO: 14758 - RNA, 22 nt, Human
auggaggagcagaggguuucca

SEQ ID NO: 14759 - RNA, 22 nt, Human
auggaggaugugcagcaugggc

SEQ ID NO: 14760 - RNA, 22 nt, Human
auggagggcagccccacuaaag

SEQ ID NO: 14761 - RNA, 22 nt, Human
auggaggugagccccccauccu

SEQ ID NO: 14762 - RNA, 22 nt, Human
aacugggugauucaggcuguuu

SEQ ID NO: 14763 - RNA, 22 nt, Human
aacuguugucacgaauguggcu

SEQ ID NO: 14764 - RNA, 22 nt, Human
aacuuaaacaagcucccaaguu

SEQ ID NO: 14765 - RNA, 22 nt, Human
aacuuaacucugcaauccagcu

SEQ ID NO: 14766 - RNA, 22 nt, Human
aacuugaagacaccccacauuc

SEQ ID NO: 14767 - RNA, 22 nt, Human
aacuuguaaugaaaggcaauag

SEQ ID NO: 14768 - RNA, 22 nt, Human
aacuuuacagacuagagcuuuc

SEQ ID NO: 14769 - RNA, 22 nt, Human
aacuuucagaauccuaugcauu

SEQ ID NO: 14770 - RNA, 21 nt, Human
aacuuucccaauccagauuug

SEQ ID NO: 14771 - RNA, 22 nt, Human
aacuuucuuugcaucuaaguuu

SEQ ID NO: 14772 - RNA, 22 nt, Human
aacuuuuucuuaggggaaagca

SEQ ID NO: 14773 - RNA, 22 nt, Human
aagaaaagaaacauggguaugc

SEQ ID NO: 14774 - RNA, 22 nt, Human
aagaaaagcaucuuuguaguag

SEQ ID NO: 14775 - RNA, 22 nt, Human
aagaaaggagauauucuuuuag

SEQ ID NO: 14776 - RNA, 22 nt, Human
aagaaauagauagaggaauacu

SEQ ID NO: 14777 - RNA, 22 nt, Human
aagaacaugggugugggcauuc

SEQ ID NO: 14778 - RNA, 22 nt, Human
aagaagagaauauauuuacguc

SEQ ID NO: 14779 - RNA, 22 nt, Human
aagaagcuacugucacuaucag

SEQ ID NO: 14780 - RNA, 22 nt, Human
aagaaggaaggcaagagauggg

SEQ ID NO: 14781 - RNA, 23 nt, Human
aagaaugcuucugaagagcugcc

SEQ ID NO: 14782 - RNA, 20 nt, Human
aagacacuguccccacugga

SEQ ID NO: 14783 - RNA, 22 nt, Human
aagacagugacagucacaauug

SEQ ID NO: 14784 - RNA, 22 nt, Human
aagagaaacauauggccagauu

SEQ ID NO: 14785 - RNA, 22 nt, Human
aagagaaaugcuuuaacuuuau

SEQ ID NO: 14786 - RNA, 22 nt, Human
aagagaggaaagggugugaggu

SEQ ID NO: 14787 - RNA, 22 nt, Human
aagagaggcccaaguggcuggc

SEQ ID NO: 14788 - RNA, 21 nt, Human
aagagcgccgggcagggcuga

SEQ ID NO: 14789 - RNA, 22 nt, Human
aagagcuuguuaugcugcucuu

SEQ ID NO: 14790 - RNA, 22 nt, Human
aagaggacagucaaauggccgg

SEQ ID NO: 14791 - RNA, 22 nt, Human
aagaggaggacgguucccagaa

SEQ ID NO: 14792 - RNA, 22 nt, Human
aagaggaggcuggaauccuaaa

SEQ ID NO: 14793 - RNA, 22 nt, Human
aagaggauuuuaguuugccaga

SEQ ID NO: 14794 - RNA, 22 nt, Human
aagaggcuacagcccugugucu

SEQ ID NO: 14795 - RNA, 22 nt, Human
aagagggguggucugugaggau

SEQ ID NO: 14796 - RNA, 22 nt, Human
aagaguggagcuggaaaguggg

SEQ ID NO: 14797 - RNA, 22 nt, Human
aagauauauaacccuuucacuu

SEQ ID NO: 14798 - RNA, 22 nt, Human
aagauauauaaggaaguucagu

SEQ ID NO: 14799 - RNA, 22 nt, Human
aagaugaguuacaaaggaguaa

SEQ ID NO: 14800 - RNA, 22 nt, Human
aagaugaucagagggcaagagg

SEQ ID NO: 14801 - RNA, 22 nt, Human
aagauucaguugguuuuggaaa

SEQ ID NO: 14802 - RNA, 22 nt, Human
aagcaaaaucgcaucuggggcc

SEQ ID NO: 14803 - RNA, 22 nt, Human
aagcaaaugguauugguauuau

SEQ ID NO: 14804 - RNA, 22 nt, Human
aagcacagggacucaggaccgg

SEQ ID NO: 14805 - RNA, 22 nt, Human
aagcagaaaaacugagcuccaa

SEQ ID NO: 14806 - RNA, 22 nt, Human
aagcagcauaugacagcaucca

SEQ ID NO: 14807 - RNA, 21 nt, Human
aagcagcugcagaauuucagu

SEQ ID NO: 14808 - RNA, 22 nt, Human
aagcaggaaaugaaaugcuugc

SEQ ID NO: 14809 - RNA, 22 nt, Human
aagcagugacucucagaggcag

SEQ ID NO: 14810 - RNA, 22 nt, Human
aagcaguuuagucaucgggauu

SEQ ID NO: 14811 - RNA, 22 nt, Human
aagcauaucaaguuuuaugugc

SEQ ID NO: 14812 - RNA, 22 nt, Human
aagcaugagguggugagugaca

SEQ ID NO: 14813 - RNA, 22 nt, Human
aagcauuuuagauaaagcauca

SEQ ID NO: 14814 - RNA, 22 nt, Human
aagcccucagagccucuuugac

SEQ ID NO: 14815 - RNA, 22 nt, Human
aagccgagggaggugauggaga

SEQ ID NO: 14816 - RNA, 22 nt, Human
aagccuccgugcugcuggaucu

SEQ ID NO: 14817 - RNA, 22 nt, Human
aagccuuagauuggcgaugucg

SEQ ID NO: 14818 - RNA, 22 nt, Human
aagcuagguccuccugaacugc

SEQ ID NO: 14819 - RNA, 22 nt, Human
aagcucagcugguggugauugc

SEQ ID NO: 14820 - RNA, 22 nt, Human
aagcucugggacugaggcuccu

SEQ ID NO: 14821 - RNA, 22 nt, Human
aagcucuuuccacuaaaccacu

SEQ ID NO: 14822 - RNA, 22 nt, Human
aagcugaguaggaaugguaggu

SEQ ID NO: 14823 - RNA, 18 nt, Human
aagcugcauuauuuuggc

SEQ ID NO: 14824 - RNA, 22 nt, Human
aaggaaaaaauggcuugugaua

SEQ ID NO: 14825 - RNA, 22 nt, Human
aaggaaaaccugacugaagaac

SEQ ID NO: 14826 - RNA, 22 nt, Human
aaggaaaguuaagguaaacucu

SEQ ID NO: 14827 - RNA, 22 nt, Human
aaggacaaaacagcuguucuaa

SEQ ID NO: 14828 - RNA, 22 nt, Human
aaggagaggagucauugggaua

SEQ ID NO: 14829 - RNA, 18 nt, Human
aaggaggaaugaauagca

SEQ ID NO: 14830 - RNA, 22 nt, Human
aaggaggaugaauugucugcaa

SEQ ID NO: 14831 - RNA, 22 nt, Human
aaggaggugauucaccuuuugg

SEQ ID NO: 14832 - RNA, 22 nt, Human
aaggaguggugaagucagaugu

SEQ ID NO: 14833 - RNA, 22 nt, Human
aaggaucuuucuuuuuaccauu

SEQ ID NO: 14834 - RNA, 22 nt, Human
aaggauuuccaggccugcgccu

SEQ ID NO: 14835 - RNA, 22 nt, Human
aaggcacauauuuuagagucac

SEQ ID NO: 14836 - RNA, 22 nt, Human
aaggcacuugcccagagcugca

SEQ ID NO: 14837 - RNA, 22 nt, Human
aaggcaguuaauuuggcuagaa

SEQ ID NO: 14838 - RNA, 22 nt, Human
aaggccuaggaguugacauggg

SEQ ID NO: 14839 - RNA, 22 nt, Human
aaggcgaggggcacagcugaga

SEQ ID NO: 14840 - RNA, 22 nt, Human
aaggcgccacagugauugcaaa

SEQ ID NO: 14841 - RNA, 22 nt, Human
aaggcggcggcggcggcugcgg

SEQ ID NO: 14842 - RNA, 22 nt, Human
aaggcgguuccgguucgcggcg

SEQ ID NO: 14843 - RNA, 22 nt, Human
aaggcuguuugagcacuggagc

SEQ ID NO: 14844 - RNA, 22 nt, Human
aaggcuuguugucacgcucuug

SEQ ID NO: 14845 - RNA, 19 nt, Human
aaggcuuucugagugaaaa

SEQ ID NO: 14846 - RNA, 22 nt, Human
aaggcuuugugcugaguugucg

SEQ ID NO: 14847 - RNA, 22 nt, Human
aagggaaaagcugaaugagaug

SEQ ID NO: 14848 - RNA, 22 nt, Human
aagggaaacagccaggcccugu

SEQ ID NO: 14849 - RNA, 22 nt, Human
aagggaauagagcagcaaaaau

SEQ ID NO: 14850 - RNA, 22 nt, Human
aagggagaguauccagaaacag

SEQ ID NO: 14851 - RNA, 22 nt, Human
aagggaggguaggaagagggag

SEQ ID NO: 14852 - RNA, 22 nt, Human
aagggccacaugccauuuaaaa

SEQ ID NO: 14853 - RNA, 22 nt, Human
aagggccuccuggggagccugg

SEQ ID NO: 14854 - RNA, 23 nt, Human
aagggcgauuaacauucgcucga

SEQ ID NO: 14855 - RNA, 22 nt, Human
aagggggacaagcauuggcuua

SEQ ID NO: 14856 - RNA, 22 nt, Human
aaggggggcaccugcaugcccg

SEQ ID NO: 14857 - RNA, 22 nt, Human
aagguauaucuuuaaaagugaa

SEQ ID NO: 14858 - RNA, 22 nt, Human
aaggucaggggcuuuugaaaca

SEQ ID NO: 14859 - RNA, 22 nt, Human
aagguccaugaauaucuaagcc

SEQ ID NO: 14860 - RNA, 22 nt, Human
aagguccuguagccacagagcc

SEQ ID NO: 14861 - RNA, 22 nt, Human
aaggucuucgaaccuuauguua

SEQ ID NO: 14862 - RNA, 22 nt, Human
aaggugggacugagaggggaca

SEQ ID NO: 14863 - RNA, 22 nt, Human
aaguaaaucuuaugucagggag

SEQ ID NO: 14864 - RNA, 21 nt, Human
aaguaaauuuuuacuuaggcc

SEQ ID NO: 14865 - RNA, 22 nt, Human
aaguaacuggggagggagggug

SEQ ID NO: 14866 - RNA, 22 nt, Human
aaguacugauucuguuccucaa

SEQ ID NO: 14867 - RNA, 18 nt, Human
aaguaguuugagauuguu

SEQ ID NO: 14868 - RNA, 21 nt, Human
aaguccaauaccuaaggcucc

SEQ ID NO: 14869 - RNA, 20 nt, Human
aagucuauuuagaguugcuu

SEQ ID NO: 14870 - RNA, 22 nt, Human
aagugaaaaaagucaguacuga

SEQ ID NO: 14871 - RNA, 20 nt, Human
cacccgguccucagcgacuc

SEQ ID NO: 14872 - RNA, 22 nt, Human
cacccugacuggcccugcagga

SEQ ID NO: 14873 - RNA, 22 nt, Human
caccgaacuuugcaaaugcaau

SEQ ID NO: 14874 - RNA, 22 nt, Human
caccucagagcuccuucuucuc

SEQ ID NO: 14875 - RNA, 22 nt, Human
caccugcaaauuccagauuucu

SEQ ID NO: 14876 - RNA, 18 nt, Human
cacgcaacuguaaaaccc

SEQ ID NO: 14877 - RNA, 22 nt, Human
cacuauguacauaauagcugcu

SEQ ID NO: 14878 - RNA, 22 nt, Human
cacugcguaguggcccgaagcu

SEQ ID NO: 14879 - RNA, 22 nt, Human
cacugcugaggcccguguuacu

SEQ ID NO: 14880 - RNA, 23 nt, Human
cacuggugggguuuaaaagaagc

SEQ ID NO: 14881 - RNA, 19 nt, Human
cacuguccuagucgaggcc

SEQ ID NO: 14882 - RNA, 22 nt, Human
cacuguugaagauacuuccucu

SEQ ID NO: 14883 - RNA, 22 nt, Human
cacuuaaaauucagggcuuaua

SEQ ID NO: 14884 - RNA, 22 nt, Human
cacuuauuuuuccuuugugauu

SEQ ID NO: 14885 - RNA, 22 nt, Human
cacuugauugucagaaaaaugg

SEQ ID NO: 14886 - RNA, 22 nt, Human
cacuuguuaaaugccaauggca

SEQ ID NO: 14887 - RNA, 22 nt, Human
cacuuuuucccccuggugucau

SEQ ID NO: 14888 - RNA, 22 nt, Human
cagaaaacauuguguguauaag

SEQ ID NO: 14889 - RNA, 22 nt, Human
cagaaaguauguucuaguaguu

SEQ ID NO: 14890 - RNA, 22 nt, Human
cagaaagugauuugcuauucca

SEQ ID NO: 14891 - RNA, 22 nt, Human
cagaacugaauaaagccaggau

SEQ ID NO: 14892 - RNA, 22 nt, Human
cagaaugugacaucaaaggcuc

SEQ ID NO: 14893 - RNA, 22 nt, Human
cagacacgucccuguugaccug

SEQ ID NO: 14894 - RNA, 22 nt, Human
cagacagaaggcuccuugaggu

SEQ ID NO: 14895 - RNA, 22 nt, Human
cagacagagucuucccaucagu

SEQ ID NO: 14896 - RNA, 22 nt, Human
cagaccagaaggaagccgacaa

SEQ ID NO: 14897 - RNA, 23 nt, Human
cagaccccuggcucugacccccu

SEQ ID NO: 14898 - RNA, 22 nt, Human
cagaccucucaggcuguucuug

SEQ ID NO: 14899 - RNA, 22 nt, Human
cagacgguuaaacgauuuugcu

SEQ ID NO: 14900 - RNA, 22 nt, Human
cagacugagaaagugccacagg

SEQ ID NO: 14901 - RNA, 22 nt, Human
cagagaagaggucuugaccccu

SEQ ID NO: 14902 - RNA, 20 nt, Human
cagagacaagagggaaggga

SEQ ID NO: 14903 - RNA, 19 nt, Human
cagagacuguaacacuuuu

SEQ ID NO: 14904 - RNA, 22 nt, Human
cagagagcguccauccggugcc

SEQ ID NO: 14905 - RNA, 22 nt, Human
cagagaggagcacaaagugaag

SEQ ID NO: 14906 - RNA, 22 nt, Human
cagagcagaaaccugggugauu

SEQ ID NO: 14907 - RNA, 20 nt, Human
cagagccaggguuuuguuuu

SEQ ID NO: 14908 - RNA, 22 nt, Human
cagagcucacaaacugaaaacc

SEQ ID NO: 14909 - RNA, 22 nt, Human
cagagcugagucuucaagguug

SEQ ID NO: 14910 - RNA, 21 nt, Human
cagagcuuuggagacggagga

SEQ ID NO: 14911 - RNA, 22 nt, Human
cagaggauggaaaugagaacaa

SEQ ID NO: 14912 - RNA, 22 nt, Human
cagaggcugggugggguggggg

SEQ ID NO: 14913 - RNA, 22 nt, Human
cagagguagaaguagauguuug

SEQ ID NO: 14914 - RNA, 22 nt, Human
cagaguccugcaccagcuccag

SEQ ID NO: 14915 - RNA, 22 nt, Human
cagaguccuguaguauugcugg

SEQ ID NO: 14916 - RNA, 22 nt, Human
cagauaagcuauaaguaguacc

SEQ ID NO: 14917 - RNA, 22 nt, Human
cagauacaacagcaggaaugaa

SEQ ID NO: 14918 - RNA, 22 nt, Human
cagaucacauccauccgucacc

SEQ ID NO: 14919 - RNA, 22 nt, Human
cagaucacucugggcggcggga

SEQ ID NO: 14920 - RNA, 20 nt, Human
cagaucuuauguuuuucugu

SEQ ID NO: 14921 - RNA, 22 nt, Human
cagaugccauagguauaguaua

SEQ ID NO: 14922 - RNA, 22 nt, Human
cagauggagaaagagugaaugg

SEQ ID NO: 14923 - RNA, 22 nt, Human
cagauuuaauaaaaaaugcauc

SEQ ID NO: 14924 - RNA, 22 nt, Human
cagauuuagcacugauaggacu

SEQ ID NO: 14925 - RNA, 19 nt, Human
cagcaaacacuguaaaugg

SEQ ID NO: 14926 - RNA, 21 nt, Human
cagcagaaaugagaggagaaa

SEQ ID NO: 14927 - RNA, 22 nt, Human
cagcagaggagguggcagcacc

SEQ ID NO: 14928 - RNA, 22 nt, Human
cagcagccuccccggccgaccu

SEQ ID NO: 14929 - RNA, 20 nt, Human
cagcagucagcucuccaaug

SEQ ID NO: 14930 - RNA, 22 nt, Human
cagcauggagacaaagugggca

SEQ ID NO: 14931 - RNA, 22 nt, Human
cagcaugguggagcugcucuuu

SEQ ID NO: 14932 - RNA, 22 nt, Human
cagccagaucgccuuccgccuc

SEQ ID NO: 14933 - RNA, 22 nt, Human
cagcccaggcucagauguuggg

SEQ ID NO: 14934 - RNA, 21 nt, Human
cagcccccauacccugcccag

SEQ ID NO: 14935 - RNA, 22 nt, Human
cagccccucuucucuccucgga

SEQ ID NO: 14936 - RNA, 22 nt, Human
cagcccuggccucuucgcuuuc

SEQ ID NO: 14937 - RNA, 22 nt, Human
cagcccuguugcgcuuccggcg

SEQ ID NO: 14938 - RNA, 22 nt, Human
cagcccuugcgacacccuggcu

SEQ ID NO: 14939 - RNA, 22 nt, Human
cagccgcucaugggcccggagc

SEQ ID NO: 14940 - RNA, 22 nt, Human
cagcuacuaccuguagacaaag

SEQ ID NO: 14941 - RNA, 22 nt, Human
cagcuauggaauuggcccagau

SEQ ID NO: 14942 - RNA, 22 nt, Human
cagcucugcugggaggaugcag

SEQ ID NO: 14943 - RNA, 22 nt, Human
cagcuggaggagcagcuuccag

SEQ ID NO: 14944 - RNA, 22 nt, Human
cagcuguauuucucugguuaga

SEQ ID NO: 14945 - RNA, 22 nt, Human
cagcuguggagauggggugcau

SEQ ID NO: 14946 - RNA, 22 nt, Human
cagcuuaccucccacagcucuc

SEQ ID NO: 14947 - RNA, 22 nt, Human
cagcuuauggcuucuccaguag

SEQ ID NO: 14948 - RNA, 22 nt, Human
cagcuugcccugauguggaaga

SEQ ID NO: 14949 - RNA, 22 nt, Human
caggaaaauaauggugauggga

SEQ ID NO: 14950 - RNA, 22 nt, Human
caggaacucggagcccaucucu

SEQ ID NO: 14951 - RNA, 22 nt, Human
caggaagucugaauucugagag

SEQ ID NO: 14952 - RNA, 22 nt, Human
caggacacaaaagguggagaag

SEQ ID NO: 14953 - RNA, 22 nt, Human
caggacagaaauaaggaauaua

SEQ ID NO: 14954 - RNA, 19 nt, Human
caggacaguuugccaagaa

SEQ ID NO: 14955 - RNA, 22 nt, Human
caggagaaauucacauuaguga

SEQ ID NO: 14956 - RNA, 22 nt, Human
caggagagucucugucuguacu

SEQ ID NO: 14957 - RNA, 22 nt, Human
caggaggaggccgggaggaagc

SEQ ID NO: 14958 - RNA, 19 nt, Human
caggauuguuuaaagcuuu

SEQ ID NO: 14959 - RNA, 22 nt, Human
caggauuuaauaagauaguguu

SEQ ID NO: 14960 - RNA, 22 nt, Human
caggcacaagaucggcuagaua

SEQ ID NO: 14961 - RNA, 22 nt, Human
caggcagggcugccuucugcuu

SEQ ID NO: 14962 - RNA, 21 nt, Human
caggccaaaagguucaacauu

SEQ ID NO: 14963 - RNA, 22 nt, Human
caggccccagggacugggcgcu

SEQ ID NO: 14964 - RNA, 22 nt, Human
caggccgccacugcagcagcug

SEQ ID NO: 14965 - RNA, 22 nt, Human
caggccgcccucuccuguuagc

SEQ ID NO: 14966 - RNA, 22 nt, Human
caggcgcauggugagcagauga

SEQ ID NO: 14967 - RNA, 22 nt, Human
cagggacgugagccaugucagu

SEQ ID NO: 14968 - RNA, 22 nt, Human
cagggacugcaggaggacaggu

SEQ ID NO: 14969 - RNA, 22 nt, Human
cagggagcggggagaucucggg

SEQ ID NO: 14970 - RNA, 22 nt, Human
cagggcacaguuauggaggugg

SEQ ID NO: 14971 - RNA, 22 nt, Human
cagggccaggccucaggggcgc

SEQ ID NO: 14972 - RNA, 22 nt, Human
cagggccagggcuauggugaag

SEQ ID NO: 14973 - RNA, 22 nt, Human
cagggcuugaaucaaggaaguc

SEQ ID NO: 14974 - RNA, 22 nt, Human
cagggcuuuuuccuccucuuug

SEQ ID NO: 14975 - RNA, 22 nt, Human
caggggacacuccugcuugggc

SEQ ID NO: 14976 - RNA, 23 nt, Human
caggggacaggugaccugggcuc

SEQ ID NO: 14977 - RNA, 22 nt, Human
caggggcuccaggugagccugg

SEQ ID NO: 14978 - RNA, 22 nt, Human
cagggggcagcguagaaaauga

SEQ ID NO: 14979 - RNA, 22 nt, Human
cagggggcccagcugggagggg

SEQ ID NO: 14980 - RNA, 18 nt, Human
acaaaaauagugcuuugg

SEQ ID NO: 14981 - RNA, 22 nt, Human
acaaaucccuguaaacacagcu

SEQ ID NO: 14982 - RNA, 20 nt, Human
acaaccacugcucacaguuu

SEQ ID NO: 14983 - RNA, 22 nt, Human
acaaccaugucaguucaaacca

SEQ ID NO: 14984 - RNA, 22 nt, Human
acaacccacacguuccgggugg

SEQ ID NO: 14985 - RNA, 20 nt, Human
acaacuuaguugagagacua

SEQ ID NO: 14986 - RNA, 22 nt, Human
cagguaguuagaaugaccagga

SEQ ID NO: 14987 - RNA, 22 nt, Human
cagguauuugaaggcaguggga

SEQ ID NO: 14988 - RNA, 22 nt, Human
caggucagcacuuggaggugca

SEQ ID NO: 14989 - RNA, 19 nt, Human
caggucuucuuggaggacu

SEQ ID NO: 14990 - RNA, 22 nt, Human
caggugauuuuguuuucaaaug

SEQ ID NO: 14991 - RNA, 22 nt, Human
caggugccucugccccacgcgg

SEQ ID NO: 14992 - RNA, 22 nt, Human
caggugcucugauauggggcug

SEQ ID NO: 14993 - RNA, 22 nt, Human
caggugggauuuugcugcuuga

SEQ ID NO: 14994 - RNA, 23 nt, Human
cagguuacacuuuaaaauaugca

SEQ ID NO: 14995 - RNA, 22 nt, Human
cagguugaaaguggaggagcua

SEQ ID NO: 14996 - RNA, 20 nt, Human
cagguugcugcccccgccuc

SEQ ID NO: 14997 - RNA, 22 nt, Human
cagguugucuaauuccaagggg

SEQ ID NO: 14998 - RNA, 22 nt, Human
cagguuguucugggcauggagg

SEQ ID NO: 14999 - RNA, 22 nt, Human
cagguuucuggaugcagcccca

SEQ ID NO: 15000 - RNA, 22 nt, Human
cagguuuuuauuacaacuuuga

SEQ ID NO: 15001 - RNA, 22 nt, Human
caguaaccaguaguuuuggaaa

SEQ ID NO: 15002 - RNA, 21 nt, Human
caguagcgcgacaugguuagc

SEQ ID NO: 15003 - RNA, 22 nt, Human
caguagcuuuuugcagacaaga

SEQ ID NO: 15004 - RNA, 22 nt, Human
caguaucucccauucacagugu

SEQ ID NO: 15005 - RNA, 22 nt, Human
caguaucucuaaaauuacucuu

SEQ ID NO: 15006 - RNA, 22 nt, Human
cagucaaauuugaaaacuuuga

SEQ ID NO: 15007 - RNA, 22 nt, Human
caguccaugaugacuuuugcuc

SEQ ID NO: 15008 - RNA, 23 nt, Human
cagucgacugugcccucccgagc

SEQ ID NO: 15009 - RNA, 22 nt, Human
cagucucuggugaguugacagu

SEQ ID NO: 15010 - RNA, 22 nt, Human
cagucucuugcuucauuaguug

SEQ ID NO: 15011 - RNA, 22 nt, Human
cagucugcuggcuuuuucagca

SEQ ID NO: 15012 - RNA, 22 nt, Human
cagugcaacguugugcauucaa

SEQ ID NO: 15013 - RNA, 17 nt, Human
cagugcuguuuuagaaa

SEQ ID NO: 15014 - RNA, 22 nt, Human
caguggacacuuccucuacaau

SEQ ID NO: 15015 - RNA, 22 nt, Human
cagugguaaaugucguuccugu

SEQ ID NO: 15016 - RNA, 22 nt, Human
caguguugcuaaugaauucauu

SEQ ID NO: 15017 - RNA, 22 nt, Human
caguguuuagcacagugcuugg

SEQ ID NO: 15018 - RNA, 22 nt, Human
caguucaagauuguugcuuucu

SEQ ID NO: 15019 - RNA, 22 nt, Human
caguucacggcugguaugaauu

SEQ ID NO: 15020 - RNA, 21 nt, Human
caguucuaagugucaucuuuu

SEQ ID NO: 15021 - RNA, 22 nt, Human
caguucuguaccaggagaagcu

SEQ ID NO: 15022 - RNA, 22 nt, Human
caguugcagagugauguguuug

SEQ ID NO: 15023 - RNA, 22 nt, Human
caguugcuauugagagaacaca

SEQ ID NO: 15024 - RNA, 22 nt, Human
caguuuccagacauuauugaua

SEQ ID NO: 15025 - RNA, 21 nt, Human
caguuugcuauuuuaguauga

SEQ ID NO: 15026 - RNA, 22 nt, Human
caguuuuggaagaaacaaggaa

SEQ ID NO: 15027 - RNA, 22 nt, Human
cauaacuugguguuggaaacug

SEQ ID NO: 15028 - RNA, 22 nt, Human
cauaauuggugcuuauuaaaug

SEQ ID NO: 15029 - RNA, 22 nt, Human
cauaccuugguaagagugauca

SEQ ID NO: 15030 - RNA, 22 nt, Human
cauagacauugauagguuauau

SEQ ID NO: 15031 - RNA, 22 nt, Human
cauaggaaauugcuguuaugga

SEQ ID NO: 15032 - RNA, 22 nt, Human
cauaggcucuucagagaacuga

SEQ ID NO: 15033 - RNA, 22 nt, Human
cauauacauauacaugcauaca

SEQ ID NO: 15034 - RNA, 22 nt, Human
cauaucuccagguucugcugga

SEQ ID NO: 15035 - RNA, 22 nt, Human
cauauuaugcauguuguucuuu

SEQ ID NO: 15036 - RNA, 22 nt, Human
caucaaaugcaagagcguucuu

SEQ ID NO: 15037 - RNA, 20 nt, Human
caucaacaccuugucagccu

SEQ ID NO: 15038 - RNA, 21 nt, Human
caucaagaucaauggagggcu

SEQ ID NO: 15039 - RNA, 22 nt, Human
caucacggagcaugagaagaca

SEQ ID NO: 15040 - RNA, 22 nt, Human
caucaguaaaguacuuuuaugu

SEQ ID NO: 15041 - RNA, 22 nt, Human
caucccaacaggugaucuggua

SEQ ID NO: 15042 - RNA, 22 nt, Human
cauccuauuacugaggcucccc

SEQ ID NO: 15043 - RNA, 22 nt, Human
caucgagaauuggcagcuaaag

SEQ ID NO: 15044 - RNA, 22 nt, Human
caucuaaaauaagccuuauaau

SEQ ID NO: 15045 - RNA, 22 nt, Human
caucucagguuuguucugagac

SEQ ID NO: 15046 - RNA, 22 nt, Human
caucugcagccucugcauuccc

SEQ ID NO: 15047 - RNA, 22 nt, Human
caucuuuguuuuggauauaauc

SEQ ID NO: 15048 - RNA, 22 nt, Human
caugaacucucggguuuggaau

SEQ ID NO: 15049 - RNA, 22 nt, Human
caugaauaauucuuuuucuugg

SEQ ID NO: 15050 - RNA, 20 nt, Human
caugaguccgugaguggccc

SEQ ID NO: 15051 - RNA, 22 nt, Human
caugaugaacugugcuguuagg

SEQ ID NO: 15052 - RNA, 22 nt, Human
caugaugacagcauuccuuuua

SEQ ID NO: 15053 - RNA, 22 nt, Human
caugaugagaguaauaacacag

SEQ ID NO: 15054 - RNA, 20 nt, Human
caugaugcaaacaguaacgu

SEQ ID NO: 15055 - RNA, 22 nt, Human
caugccaguagccggcuugacu

SEQ ID NO: 15056 - RNA, 22 nt, Human
caugccucuguuuuaguuguug

SEQ ID NO: 15057 - RNA, 22 nt, Human
caugcgucugcauuggguggug

SEQ ID NO: 15058 - RNA, 22 nt, Human
caugcuaacacguugcucaccg

SEQ ID NO: 15059 - RNA, 22 nt, Human
caugcuggcacugaccagccua

SEQ ID NO: 15060 - RNA, 22 nt, Human
cauggcacagaagaugucguuu

SEQ ID NO: 15061 - RNA, 22 nt, Human
cauggcacuuuugugucuaaau

SEQ ID NO: 15062 - RNA, 22 nt, Human
cauggcaggugcagauucugug

SEQ ID NO: 15063 - RNA, 22 nt, Human
caugggaauaaaguuauuucaa

SEQ ID NO: 15064 - RNA, 22 nt, Human
caugguaaucggggccaucugu

SEQ ID NO: 15065 - RNA, 22 nt, Human
caugguacugccacagaagagu

SEQ ID NO: 15066 - RNA, 23 nt, Human
cauguacacacagcuguacagug

SEQ ID NO: 15067 - RNA, 22 nt, Human
cauguauguuaguggcugcuuu

SEQ ID NO: 15068 - RNA, 22 nt, Human
caugugacuuagguuuuaucac

SEQ ID NO: 15069 - RNA, 22 nt, Human
cauguggaaaugcaugcuuuuu

SEQ ID NO: 15070 - RNA, 22 nt, Human
cauguguuucuuaagccaggcc

SEQ ID NO: 15071 - RNA, 22 nt, Human
cauuagugaggggcugccugcu

SEQ ID NO: 15072 - RNA, 22 nt, Human
cauuccaaguauauacaugaua

SEQ ID NO: 15073 - RNA, 20 nt, Human
cauuccaugcaucuuggucc

SEQ ID NO: 15074 - RNA, 22 nt, Human
cauuccuaccauaucugcucuu

SEQ ID NO: 15075 - RNA, 22 nt, Human
cauugcaaccauuccaaauggc

SEQ ID NO: 15076 - RNA, 22 nt, Human
cauuggaugagggccucaucga

SEQ ID NO: 15077 - RNA, 22 nt, Human
cauuggcacauguauucugggc

SEQ ID NO: 15078 - RNA, 22 nt, Human
cauugggcggggaccucggcug

SEQ ID NO: 15079 - RNA, 22 nt, Human
cauugguacaaaauguacuuug

SEQ ID NO: 15080 - RNA, 18 nt, Human
cauuguacaaugcuuuau

SEQ ID NO: 15081 - RNA, 22 nt, Human
cauuuaaccccuugguacugaa

SEQ ID NO: 15082 - RNA, 22 nt, Human
cauuuacguaacaguaacgcug

SEQ ID NO: 15083 - RNA, 22 nt, Human
cauuucaaacaguuacagcugc

SEQ ID NO: 15084 - RNA, 22 nt, Human
cauuucuggccuggggagcggg

SEQ ID NO: 15085 - RNA, 22 nt, Human
cauuucuugugagccgcauccu

SEQ ID NO: 15086 - RNA, 22 nt, Human
cauuugacaauugggauagauc

SEQ ID NO: 15087 - RNA, 23 nt, Human
cauuugauccucacaauaaaugg

SEQ ID NO: 15088 - RNA, 22 nt, Human
cauuugcuuaucacucuucuuu

SEQ ID NO: 15089 - RNA, 22 nt, Human
accccagcucugagccacacca

SEQ ID NO: 15090 - RNA, 22 nt, Human
acccccacuccgcaguagaacu

SEQ ID NO: 15091 - RNA, 22 nt, Human
acccccaggacacugccucuga

SEQ ID NO: 15092 - RNA, 22 nt, Human
acccccuuucuugaccucaugu

SEQ ID NO: 15093 - RNA, 22 nt, Human
accccgugucccugaggguccu

SEQ ID NO: 15094 - RNA, 22 nt, Human
accccuacugaaauuuccuggu

SEQ ID NO: 15095 - RNA, 22 nt, Human
acccggccuacucagugcccag

SEQ ID NO: 15096 - RNA, 22 nt, Human
acccgguuuucccagcaccucc

SEQ ID NO: 15097 - RNA, 22 nt, Human
acccuauuaacuacuacguugg

SEQ ID NO: 15098 - RNA, 22 nt, Human
acccugacggugggcagcuuga

SEQ ID NO: 15099 - RNA, 22 nt, Human
acccuuucgagauuucugccuu

SEQ ID NO: 15100 - RNA, 22 nt, Human
ccaaggcugcagccgugacgcg

SEQ ID NO: 15101 - RNA, 22 nt, Human
ccaaggcuggagggcuuaugua

SEQ ID NO: 15102 - RNA, 19 nt, Human
ccaagucuuugugguugug

SEQ ID NO: 15103 - RNA, 22 nt, Human
ccaauguuaggcucugguuuua

SEQ ID NO: 15104 - RNA, 22 nt, Human
ccaauuuuggaauuauuaggca

SEQ ID NO: 15105 - RNA, 19 nt, Human
ccacacacuggucucuggg

SEQ ID NO: 15106 - RNA, 22 nt, Human
ccacagcauugaaaucuauaau

SEQ ID NO: 15107 - RNA, 23 nt, Human
ccacaugugagcccaccgugccc

SEQ ID NO: 15108 - RNA, 22 nt, Human
ccaccacauuugccuagacuuu

SEQ ID NO: 15109 - RNA, 22 nt, Human
ccaccacugaggcacaggagcc

SEQ ID NO: 15110 - RNA, 16 nt, Human
ccacccagagaauauu

SEQ ID NO: 15111 - RNA, 22 nt, Human
ccaccccagaaagggaaggcca

SEQ ID NO: 15112 - RNA, 22 nt, Human
ccacccugguuacugugccagg

SEQ ID NO: 15113 - RNA, 22 nt, Human
ccaccuggcagcaggcucggca

SEQ ID NO: 15114 - RNA, 22 nt, Human
ccacguguugcucagacagggu

SEQ ID NO: 15115 - RNA, 21 nt, Human
ccacuaagccccaguaaugga

SEQ ID NO: 15116 - RNA, 22 nt, Human
ccacucagaagaaacaagagag

SEQ ID NO: 15117 - RNA, 23 nt, Human
ccacuccucccaggccacccugc

SEQ ID NO: 15118 - RNA, 22 nt, Human
ccacuguuggcccgaagggguc

SEQ ID NO: 15119 - RNA, 22 nt, Human
ccacuuucuaaauuggcgauuu

SEQ ID NO: 15120 - RNA, 22 nt, Human
ccacuuugagaagcugaugaaa

SEQ ID NO: 15121 - RNA, 20 nt, Human
ccagaagagaagaaaaggaa

SEQ ID NO: 15122 - RNA, 22 nt, Human
ccagaauuugaacccacaaaug

SEQ ID NO: 15123 - RNA, 22 nt, Human
ccagacucucucauuuuccugu

SEQ ID NO: 15124 - RNA, 22 nt, Human
ccagacuggggauuuugccagg

SEQ ID NO: 15125 - RNA, 22 nt, Human
ccagagaugcagugggugcagu

SEQ ID NO: 15126 - RNA, 22 nt, Human
ccagaggcuuaugcagcugcug

SEQ ID NO: 15127 - RNA, 16 nt, Human
ccagaugaaugggagu

SEQ ID NO: 15128 - RNA, 22 nt, Human
ccagaugggggcugugggaggg

SEQ ID NO: 15129 - RNA, 22 nt, Human
ccagcagaagcucccgcugggu

SEQ ID NO: 15130 - RNA, 22 nt, Human
ccagccacagcuuccagcuccu

SEQ ID NO: 15131 - RNA, 22 nt, Human
ccagccacugacugauuuaaaa

SEQ ID NO: 15132 - RNA, 22 nt, Human
ccagccuucugaugggacccuc

SEQ ID NO: 15133 - RNA, 22 nt, Human
ccagcugcugcaccgugcaugg

SEQ ID NO: 15134 - RNA, 22 nt, Human
ccagcugggucccugcuggggc

SEQ ID NO: 15135 - RNA, 22 nt, Human
ccaggacuuauuacaguauaac

SEQ ID NO: 15136 - RNA, 22 nt, Human
ccaggaguccgugggucuugag

SEQ ID NO: 15137 - RNA, 22 nt, Human
ccaggcagaggggucuggagca

SEQ ID NO: 15138 - RNA, 22 nt, Human
ccaggcccugccugugguuccu

SEQ ID NO: 15139 - RNA, 22 nt, Human
ccaggcuaggaccgauuucccu

SEQ ID NO: 15140 - RNA, 22 nt, Human
ccaggcucaccuggagccccug

SEQ ID NO: 15141 - RNA, 22 nt, Human
ccaggcuccccaggaggcccuu

SEQ ID NO: 15142 - RNA, 22 nt, Human
ccagggaagaaagaugaagugc

SEQ ID NO: 15143 - RNA, 22 nt, Human
ccagggacuauuaguuguguau

SEQ ID NO: 15144 - RNA, 22 nt, Human
ccagggagggccacagggccau

SEQ ID NO: 15145 - RNA, 22 nt, Human
ccagggaggucauagugcuggu

SEQ ID NO: 15146 - RNA, 22 nt, Human
ccagggcggacaaggucuuuga

SEQ ID NO: 15147 - RNA, 22 nt, Human
ccagggcuggaggaggucagga

SEQ ID NO: 15148 - RNA, 22 nt, Human
ccagguggacggcgaguacagg

SEQ ID NO: 15149 - RNA, 22 nt, Human
ccagguuggccaccuucacggg

SEQ ID NO: 15150 - RNA, 22 nt, Human
ccaguccacgucaagaagaggu

SEQ ID NO: 15151 - RNA, 22 nt, Human
ccaguccugucaggggagggga

SEQ ID NO: 15152 - RNA, 23 nt, Human
ccagucgagucccaaccuucacc

SEQ ID NO: 15153 - RNA, 22 nt, Human
ccagucugccggcccggccccu

SEQ ID NO: 15154 - RNA, 22 nt, Human
ccagugacaaagucggaagucc

SEQ ID NO: 15155 - RNA, 22 nt, Human
ccagugagauagugguauaugc

SEQ ID NO: 15156 - RNA, 22 nt, Human
ccagugcagacgcggaacuggc

SEQ ID NO: 15157 - RNA, 22 nt, Human
ccagugcuuccaggaauacggu

SEQ ID NO: 15158 - RNA, 16 nt, Human
ccaguggacuugcuac

SEQ ID NO: 15159 - RNA, 22 nt, Human
ccaguggugcauguuugagcaa

SEQ ID NO: 15160 - RNA, 22 nt, Human
ccaguguguuuuucucugacuc

SEQ ID NO: 15161 - RNA, 22 nt, Human
ccaguuuuuccagugcuuucug

SEQ ID NO: 15162 - RNA, 19 nt, Human
ccaguuuuuuaauauucaa

SEQ ID NO: 15163 - RNA, 22 nt, Human
ccaucccugagucacaggaggg

SEQ ID NO: 15164 - RNA, 22 nt, Human
ccaucucaucugguugggggug

SEQ ID NO: 15165 - RNA, 22 nt, Human
ccaucuuugcucuuuuauugca

SEQ ID NO: 15166 - RNA, 22 nt, Human
ccaugaggcaaagacugauaua

SEQ ID NO: 15167 - RNA, 22 nt, Human
ccauggauacuaagguauguga

SEQ ID NO: 15168 - RNA, 22 nt, Human
ccauggccaauugcaccuugcu

SEQ ID NO: 15169 - RNA, 22 nt, Human
ccauuuuccuguauggacucga

SEQ ID NO: 15170 - RNA, 22 nt, Human
cccaaccagaaauugacagaga

SEQ ID NO: 15171 - RNA, 22 nt, Human
cccaagcuccacauuuuagcuu

SEQ ID NO: 15172 - RNA, 22 nt, Human
cccacccuacugcuacccagga

SEQ ID NO: 15173 - RNA, 16 nt, Human
cccaccuggacuaccu

SEQ ID NO: 15174 - RNA, 22 nt, Human
cccacgccuucuuucuucaaau

SEQ ID NO: 15175 - RNA, 22 nt, Human
cccagaccagagugccuggacg

SEQ ID NO: 15176 - RNA, 18 nt, Human
cccagaggaaugccugga

SEQ ID NO: 15177 - RNA, 19 nt, Human
cccagaggaaugccuggaa

SEQ ID NO: 15178 - RNA, 22 nt, Human
cccagcaccauaacucaggccu

SEQ ID NO: 15179 - RNA, 22 nt, Human
cccagcccaucauuccugcaaa

SEQ ID NO: 15180 - RNA, 22 nt, Human
cccagccgaaugcucccuuccc

SEQ ID NO: 15181 - RNA, 22 nt, Human
cccagccugaucucggccagcu

SEQ ID NO: 15182 - RNA, 22 nt, Human
cccagcuggcaaaggcguccuu

SEQ ID NO: 15183 - RNA, 22 nt, Human
cccaggaaugagcaggcagggg

SEQ ID NO: 15184 - RNA, 22 nt, Human
cccaggccguguaaucagcagc

SEQ ID NO: 15185 - RNA, 22 nt, Human
cccaggcuggggcuccuccagc

SEQ ID NO: 15186 - RNA, 22 nt, Human
cccagggguugaggccguaggg

SEQ ID NO: 15187 - RNA, 22 nt, Human
cccaguuguuccuauucuucuu

SEQ ID NO: 15188 - RNA, 22 nt, Human
cccauauacuuuuucuggucca

SEQ ID NO: 15189 - RNA, 22 nt, Human
cccaucugugaaauggggcugc

SEQ ID NO: 15190 - RNA, 22 nt, Human
cccaugacucucauucacaguc

SEQ ID NO: 15191 - RNA, 22 nt, Human
cccauggaaggguuggcccaga

SEQ ID NO: 15192 - RNA, 22 nt, Human
cccauuaguuguuaaucaucaa

SEQ ID NO: 15193 - RNA, 22 nt, Human
cccauuuuuuggauguguggau

SEQ ID NO: 15194 - RNA, 22 nt, Human
ccccacaugaauacaguguagu

SEQ ID NO: 15195 - RNA, 22 nt, Human
ccccaggcagcccuccaggagc

SEQ ID NO: 15196 - RNA, 22 nt, Human
ccccagugguugcaacagcaga

SEQ ID NO: 15197 - RNA, 22 nt, Human
ccccaguuccugucaaggguaa

SEQ ID NO: 15198 - RNA, 22 nt, Human
ccugcccaucccaccccagcau

SEQ ID NO: 15199 - RNA, 22 nt, Human
ccugccugggcucacuugccag

SEQ ID NO: 15200 - RNA, 18 nt, Human
ccugcguggauguccucu

SEQ ID NO: 15201 - RNA, 22 nt, Human
ccugcucccccugcaagccuug

SEQ ID NO: 15202 - RNA, 22 nt, Human
ccugcucuaauucauucaugcu

SEQ ID NO: 15203 - RNA, 21 nt, Human
ccuggagacaaagacagggug

SEQ ID NO: 15204 - RNA, 19 nt, Human
ccuggccaacgucaacauu

SEQ ID NO: 15205 - RNA, 22 nt, Human
ccuggcccagcuggaagcggga

SEQ ID NO: 15206 - RNA, 22 nt, Human
ccuggcccugcugcuugccagc

SEQ ID NO: 15207 - RNA, 22 nt, Human
ccugggcauaaaucacuccaag

SEQ ID NO: 15208 - RNA, 22 nt, Human
ccugggccuaaacaaacaagag

SEQ ID NO: 15209 - RNA, 22 nt, Human
ccuggggcucugcacagagcag

SEQ ID NO: 15210 - RNA, 22 nt, Human
ccuggguccucacaaucccagg

SEQ ID NO: 15211 - RNA, 22 nt, Human
ccugggugaugugcugcccucg

SEQ ID NO: 15212 - RNA, 22 nt, Human
ccugugcaugccaggguacacc

SEQ ID NO: 15213 - RNA, 22 nt, Human
ccugugucaucagcuguggcua

SEQ ID NO: 15214 - RNA, 22 nt, Human
ccuguguucguccucaccuugc

SEQ ID NO: 15215 - RNA, 22 nt, Human
ccuguuccaacccucccuggcu

SEQ ID NO: 15216 - RNA, 22 nt, Human
acugugauuuguuuuuguguuu

SEQ ID NO: 15217 - RNA, 22 nt, Human
acugugcaugaaccgaaacaaa

SEQ ID NO: 15218 - RNA, 22 nt, Human
acuguucacccagcacuagcag

SEQ ID NO: 15219 - RNA, 22 nt, Human
acuguugagggaagcagaugaa

SEQ ID NO: 15220 - RNA, 22 nt, Human
acuguugcuuguuuggaauguu

SEQ ID NO: 15221 - RNA, 22 nt, Human
acuguugugaauaaugaaaugc

SEQ ID NO: 15222 - RNA, 22 nt, Human
acuuagaacagccuaugggaag

SEQ ID NO: 15223 - RNA, 22 nt, Human
acuucccacugcagugacugag

SEQ ID NO: 15224 - RNA, 22 nt, Human
acuugauggaguuucacuguau

SEQ ID NO: 15225 - RNA, 22 nt, Human
acuugcauuguguaguguuuuu

SEQ ID NO: 15226 - RNA, 19 nt, Human
acuugcuuucauuuaagau

SEQ ID NO: 15227 - RNA, 22 nt, Human
acuuggucguggugcagcaugg

SEQ ID NO: 15228 - RNA, 16 nt, Human
acuuguuguuuugguu

SEQ ID NO: 15229 - RNA, 22 nt, Human
acuuguuuacaagcaguucuga

SEQ ID NO: 15230 - RNA, 22 nt, Human
acuuuaaaucuguugcuuagcu

SEQ ID NO: 15231 - RNA, 20 nt, Human
acuuucacaugaacauuuaa

SEQ ID NO: 15232 - RNA, 23 nt, Human
acuuugaggagaagaaugucagu

SEQ ID NO: 15233 - RNA, 22 nt, Human
acuuugccuucuuacuguguug

SEQ ID NO: 15234 - RNA, 22 nt, Human
acuuuggugcgaagucacuuua

SEQ ID NO: 15235 - RNA, 22 nt, Human
acuuugugaauagaacuggaug

SEQ ID NO: 15236 - RNA, 22 nt, Human
acuuuuaaggggccuugauuua

SEQ ID NO: 15237 - RNA, 22 nt, Human
acuuuuagccuucccacaacag

SEQ ID NO: 15238 - RNA, 22 nt, Human
acuuuugaguuacauaccugaa

SEQ ID NO: 15239 - RNA, 22 nt, Human
acuuuuuugccaucccuccagc

SEQ ID NO: 15240 - RNA, 22 nt, Human
agaaaagagacaauguuuuugg

SEQ ID NO: 15241 - RNA, 22 nt, Human
agaaacacaaguaaagcuccca

SEQ ID NO: 15242 - RNA, 20 nt, Human
agaaaggaguaaagaagaga

SEQ ID NO: 15243 - RNA, 19 nt, Human
agaaauagccuuccuuguc

SEQ ID NO: 15244 - RNA, 22 nt, Human
agaaauggccagacuugccccu

SEQ ID NO: 15245 - RNA, 22 nt, Human
agaacaggaggaagccagcucc

SEQ ID NO: 15246 - RNA, 22 nt, Human
agaacauaucuguuuucuaacu

SEQ ID NO: 15247 - RNA, 22 nt, Human
agaaccaauacuacagcaagua

SEQ ID NO: 15248 - RNA, 19 nt, Human
agaacccccuuccucugcu

SEQ ID NO: 15249 - RNA, 22 nt, Human
agaagaagacccuaaggaaagg

SEQ ID NO: 15250 - RNA, 22 nt, Human
agaagaaugguuugaaagauuu

SEQ ID NO: 15251 - RNA, 22 nt, Human
agaagaucccugugguuacgac

SEQ ID NO: 15252 - RNA, 22 nt, Human
agaagauucagcaguagggugg

SEQ ID NO: 15253 - RNA, 22 nt, Human
agaagcaauuggaaaguacagg

SEQ ID NO: 15254 - RNA, 22 nt, Human
agaagcauaagggcuuugccag

SEQ ID NO: 15255 - RNA, 21 nt, Human
agaagcggucgaaucgcagac

SEQ ID NO: 15256 - RNA, 20 nt, Human
agaaggagagaugaggcaaa

SEQ ID NO: 15257 - RNA, 22 nt, Human
agaagggaagcaggagaggcau

SEQ ID NO: 15258 - RNA, 22 nt, Human
agaagggcugcuuagaauauac

SEQ ID NO: 15259 - RNA, 22 nt, Human
agaagguggaguagaacaagcu

SEQ ID NO: 15260 - RNA, 22 nt, Human
agaaguagacaguuggauauaa

SEQ ID NO: 15261 - RNA, 22 nt, Human
agaaguuuguuauguaaacaaa

SEQ ID NO: 15262 - RNA, 22 nt, Human
agaauacaauuguucaguaaua

SEQ ID NO: 15263 - RNA, 22 nt, Human
agaauauaguaaauauuuucua

SEQ ID NO: 15264 - RNA, 22 nt, Human
agaaucagagcagaaucuucau

SEQ ID NO: 15265 - RNA, 22 nt, Human
agaauccucuagggauggcagg

SEQ ID NO: 15266 - RNA, 22 nt, Human
agaaucucuagaaaugggucuc

SEQ ID NO: 15267 - RNA, 22 nt, Human
agaaugcaagguauuuggaggg

SEQ ID NO: 15268 - RNA, 22 nt, Human
agaauguaagaaugcaaagauu

SEQ ID NO: 15269 - RNA, 19 nt, Human
agaauuggaaccaugaacc

SEQ ID NO: 15270 - RNA, 22 nt, Human
agaauuuguaucuacggugugc

SEQ ID NO: 15271 - RNA, 22 nt, Human
agacaaucaacuguugaugccu

SEQ ID NO: 15272 - RNA, 22 nt, Human
agacacugacaggguccaugga

SEQ ID NO: 15273 - RNA, 22 nt, Human
agacagaacauaauuaguacug

SEQ ID NO: 15274 - RNA, 22 nt, Human
agacagcggugcaauaaauggu

SEQ ID NO: 15275 - RNA, 22 nt, Human
agacauauuggcuugcuuuaau

SEQ ID NO: 15276 - RNA, 20 nt, Human
agacauugaggagagagcau

SEQ ID NO: 15277 - RNA, 22 nt, Human
agacauuuggugugaagggagg

SEQ ID NO: 15278 - RNA, 22 nt, Human
agaccagugaguaggccuuaga

SEQ ID NO: 15279 - RNA, 22 nt, Human
agaccauguuauccuucauuuu

SEQ ID NO: 15280 - RNA, 22 nt, Human
agaccauuuuguagccagcaua

SEQ ID NO: 15281 - RNA, 22 nt, Human
agaccccuggggaggauuauag

SEQ ID NO: 15282 - RNA, 22 nt, Human
agacccugauucugcuggcggu

SEQ ID NO: 15283 - RNA, 22 nt, Human
agacccuugcagucugguuguc

SEQ ID NO: 15284 - RNA, 22 nt, Human
agaccguguguggguugcggug

SEQ ID NO: 15285 - RNA, 22 nt, Human
agacgacucuuaaggcagaauu

SEQ ID NO: 15286 - RNA, 22 nt, Human
agacgcgcagaaggaagcggcc

SEQ ID NO: 15287 - RNA, 22 nt, Human
agacgggacagacuuuugagug

SEQ ID NO: 15288 - RNA, 22 nt, Human
agacuaauaucccauuucugac

SEQ ID NO: 15289 - RNA, 22 nt, Human
agacuacggggaggggagggaa

SEQ ID NO: 15290 - RNA, 22 nt, Human
agacuauuuugugauaacuaau

SEQ ID NO: 15291 - RNA, 22 nt, Human
agacucacuucuuucucguauu

SEQ ID NO: 15292 - RNA, 17 nt, Human
agacucuagccacuagc

SEQ ID NO: 15293 - RNA, 22 nt, Human
agacucuaguggaggugcuagg

SEQ ID NO: 15294 - RNA, 19 nt, Human
agacugaagggcccgaguc

SEQ ID NO: 15295 - RNA, 22 nt, Human
agacugugagaagauggcugcg

SEQ ID NO: 15296 - RNA, 22 nt, Human
agacuguuuucccaucucuugg

SEQ ID NO: 15297 - RNA, 22 nt, Human
agacuucucuuggcuauauuau

SEQ ID NO: 15298 - RNA, 22 nt, Human
agacuugguaacuagugaagaa

SEQ ID NO: 15299 - RNA, 22 nt, Human
agacuuugaaugaugacagcgu

SEQ ID NO: 15300 - RNA, 22 nt, Human
agagaaacauuaauugaugagg

SEQ ID NO: 15301 - RNA, 22 nt, Human
agagaacaggcagcuggugccg

SEQ ID NO: 15302 - RNA, 22 nt, Human
agagaacauuuucaggguuuca

SEQ ID NO: 15303 - RNA, 22 nt, Human
agagaaccauggcauccaggua

SEQ ID NO: 15304 - RNA, 22 nt, Human
agagaagaauccccugguggag

SEQ ID NO: 15305 - RNA, 22 nt, Human
agagaauuugggaauauaaauc

SEQ ID NO: 15306 - RNA, 22 nt, Human
agagaccugaaugaguugaaca

SEQ ID NO: 15307 - RNA, 22 nt, Human
cgugugugugcgugugcgugug

SEQ ID NO: 15308 - RNA, 22 nt, Human
cguuauagagcacucgaacuuu

SEQ ID NO: 15309 - RNA, 22 nt, Human
cguuugagggaguuggaacugc

SEQ ID NO: 15310 - RNA, 16 nt, Human
cuaaaaugucuacuug

SEQ ID NO: 15311 - RNA, 22 nt, Human
cuaaauucuauauccuugcuuc

SEQ ID NO: 15312 - RNA, 22 nt, Human
cuaacuuugucuugguaauugc

SEQ ID NO: 15313 - RNA, 22 nt, Human
cuaagaaggaggaaaagugcca

SEQ ID NO: 15314 - RNA, 23 nt, Human
cuaagcuugaguauagcuuagga

SEQ ID NO: 15315 - RNA, 22 nt, Human
cuaagguuggcaguggaauugg

SEQ ID NO: 15316 - RNA, 22 nt, Human
cuaaugaaaugauggcuccuac

SEQ ID NO: 15317 - RNA, 22 nt, Human
cuaauuguaagcuccuugaggg

SEQ ID NO: 15318 - RNA, 22 nt, Human
cuacauuuacacaguuaggcuu

SEQ ID NO: 15319 - RNA, 22 nt, Human
cuacuguaguuaaaguuuugua

SEQ ID NO: 15320 - RNA, 22 nt, Human
cuacuucuguggcucuaagaga

SEQ ID NO: 15321 - RNA, 22 nt, Human
cuacuuucuucuucagaauugu

SEQ ID NO: 15322 - RNA, 22 nt, Human
cuagaaguuuggguccauuaag

SEQ ID NO: 15323 - RNA, 22 nt, Human
cuagagaaaaagcuuagguacg

SEQ ID NO: 15324 - RNA, 22 nt, Human
cuagaggaacaguuucagguuu

SEQ ID NO: 15325 - RNA, 22 nt, Human
cuagaucuggcaggcacaaggu

SEQ ID NO: 15326 - RNA, 22 nt, Human
cuagaucuuuaaaaaucuggaa

SEQ ID NO: 15327 - RNA, 22 nt, Human
cuagcacagugcuuggcacaca

SEQ ID NO: 15328 - RNA, 22 nt, Human
cuagcagaagcuccuugagggu

SEQ ID NO: 15329 - RNA, 22 nt, Human
cuaggcuuucugugugacuaga

SEQ ID NO: 15330 - RNA, 22 nt, Human
cuaggucagaggacacagcuua

SEQ ID NO: 15331 - RNA, 22 nt, Human
cuagguuuuuuccuuuccccac

SEQ ID NO: 15332 - RNA, 22 nt, Human
cuaguagcccauuuuggauacc

SEQ ID NO: 15333 - RNA, 22 nt, Human
cuaguauuaagugugaguaaaa

SEQ ID NO: 15334 - RNA, 22 nt, Human
cuaguucugccauucaguguca

SEQ ID NO: 15335 - RNA, 22 nt, Human
cuaguuuuaagcuccuugaggu

SEQ ID NO: 15336 - RNA, 22 nt, Human
cuauaagguguuucuauugguc

SEQ ID NO: 15337 - RNA, 22 nt, Human
cuauaauuguacuuguuuuuua

SEQ ID NO: 15338 - RNA, 22 nt, Human
cuauacuuagaacuccauuuuc

SEQ ID NO: 15339 - RNA, 22 nt, Human
cuauaucuguggauaguguaug

SEQ ID NO: 15340 - RNA, 22 nt, Human
cuauauucuggaauguccauuu

SEQ ID NO: 15341 - RNA, 22 nt, Human
cuauguuucagauauauauaua

SEQ ID NO: 15342 - RNA, 22 nt, Human
cuauugguaucacacugauuuc

SEQ ID NO: 15343 - RNA, 22 nt, Human
cucaaagcagacuuuucccuuu

SEQ ID NO: 15344 - RNA, 22 nt, Human
cucaaauggguuuguagaauau

SEQ ID NO: 15345 - RNA, 22 nt, Human
cucaagagaaaucggaaucaga

SEQ ID NO: 15346 - RNA, 22 nt, Human
cucaauuuuuauugcuuuuuug

SEQ ID NO: 15347 - RNA, 22 nt, Human
cucacauacaagagauggugga

SEQ ID NO: 15348 - RNA, 22 nt, Human
cucacccaaacuauaucuuuaa

SEQ ID NO: 15349 - RNA, 22 nt, Human
cucaccugccuccccgcccucc

SEQ ID NO: 15350 - RNA, 22 nt, Human
cucacgguuugcaucaagagug

SEQ ID NO: 15351 - RNA, 22 nt, Human
cucacugucagcugcagggcuu

SEQ ID NO: 15352 - RNA, 22 nt, Human
cucacugugggcuaugaauggg

SEQ ID NO: 15353 - RNA, 22 nt, Human
cucagaagaacaaaggcucuac

SEQ ID NO: 15354 - RNA, 22 nt, Human
cucagaauugucaccucaaaaa

SEQ ID NO: 15355 - RNA, 22 nt, Human
cucagcaacccacacacggucu

SEQ ID NO: 15356 - RNA, 22 nt, Human
cucagcaauuaccugugucucu

SEQ ID NO: 15357 - RNA, 22 nt, Human
cucagcacauuccuaagggaug

SEQ ID NO: 15358 - RNA, 22 nt, Human
cucagcugcuuuguuuugcuuu

SEQ ID NO: 15359 - RNA, 22 nt, Human
cucaggugagcgagcuaaauua

SEQ ID NO: 15360 - RNA, 22 nt, Human
cucaguauugacgaaagagauu

SEQ ID NO: 15361 - RNA, 22 nt, Human
cucagugacuuccugcucaauu

SEQ ID NO: 15362 - RNA, 22 nt, Human
cucaucagagcccuccucuggc

SEQ ID NO: 15363 - RNA, 22 nt, Human
cucaugaauggcucuuugugcu

SEQ ID NO: 15364 - RNA, 22 nt, Human
cucaugagucugucagagucau

SEQ ID NO: 15365 - RNA, 21 nt, Human
cucauuccccgucccggcccc

SEQ ID NO: 15366 - RNA, 20 nt, Human
cucauugcuuucauuuucuu

SEQ ID NO: 15367 - RNA, 22 nt, Human
cuccaaaucugauugcuaccuu

SEQ ID NO: 15368 - RNA, 22 nt, Human
cuccacagccccuccaguggca

SEQ ID NO: 15369 - RNA, 22 nt, Human
cuccacccuagagggcccaugc

SEQ ID NO: 15370 - RNA, 22 nt, Human
cuccaccucagugucaucuucu

SEQ ID NO: 15371 - RNA, 22 nt, Human
cuccagcagaaagggcgagugg

SEQ ID NO: 15372 - RNA, 22 nt, Human
cuccaugagccaggagggcuac

SEQ ID NO: 15373 - RNA, 22 nt, Human
cucccaauaauaacaagcaggu

SEQ ID NO: 15374 - RNA, 22 nt, Human
cucccccugccucuccucccug

SEQ ID NO: 15375 - RNA, 22 nt, Human
cuccccucccuuuaacccccuu

SEQ ID NO: 15376 - RNA, 22 nt, Human
cuccccuuauuccucaacauga

SEQ ID NO: 15377 - RNA, 22 nt, Human
cucccgagccuuacucuguucc

SEQ ID NO: 15378 - RNA, 22 nt, Human
cucccugagaugcaggagagag

SEQ ID NO: 15379 - RNA, 22 nt, Human
cuccgaaaugcaucccagggca

SEQ ID NO: 15380 - RNA, 22 nt, Human
cuccgcagcugggguuggcgcu

SEQ ID NO: 15381 - RNA, 22 nt, Human
cuccuagagcacaaaaggccau

SEQ ID NO: 15382 - RNA, 22 nt, Human
cuccuauugaucaguacuauuu

SEQ ID NO: 15383 - RNA, 22 nt, Human
cuccucccagcccaggcgccac

SEQ ID NO: 15384 - RNA, 20 nt, Human
cuccuccccucggccccacc

SEQ ID NO: 15385 - RNA, 22 nt, Human
cuccugauuucuaggccuuauc

SEQ ID NO: 15386 - RNA, 22 nt, Human
cuccugcuuuuucuucuuccga

SEQ ID NO: 15387 - RNA, 22 nt, Human
cuccuggagcagcaggcgcagg

SEQ ID NO: 15388 - RNA, 21 nt, Human
cuccuguaaaucaccuccgca

SEQ ID NO: 15389 - RNA, 22 nt, Human
cuccuuuacaauugugggaaaa

SEQ ID NO: 15390 - RNA, 22 nt, Human
cuccuuugagcaaaucuuugau

SEQ ID NO: 15391 - RNA, 22 nt, Human
cuccuuuuccuacucauacuau

SEQ ID NO: 15392 - RNA, 22 nt, Human
cuccuuuuugggaccgugcagc

SEQ ID NO: 15393 - RNA, 22 nt, Human
cucgccugacucggaugggcug

SEQ ID NO: 15394 - RNA, 22 nt, Human
cucggagggcaaguacuggcug

SEQ ID NO: 15395 - RNA, 22 nt, Human
cucggggcguggcaguagcaug

SEQ ID NO: 15396 - RNA, 22 nt, Human
cucguccugguuuaaguguccu

SEQ ID NO: 15397 - RNA, 22 nt, Human
cucuaagcuuugguguuucacu

SEQ ID NO: 15398 - RNA, 22 nt, Human
cucuauuuuuucaucuuucagg

SEQ ID NO: 15399 - RNA, 22 nt, Human
cucuccagucauauucucaguc

SEQ ID NO: 15400 - RNA, 22 nt, Human
cucuccaguuauagcugauuug

SEQ ID NO: 15401 - RNA, 22 nt, Human
cucucuaacuagagacaggagu

SEQ ID NO: 15402 - RNA, 22 nt, Human
cucucuccuuagcugcagacca

SEQ ID NO: 15403 - RNA, 22 nt, Human
cucucugcugucuuucgggaaa

SEQ ID NO: 15404 - RNA, 22 nt, Human
cucucuuuuuuucccuuguuaa

SEQ ID NO: 15405 - RNA, 22 nt, Human
cucugagcucgugcaguacuuc

SEQ ID NO: 15406 - RNA, 22 nt, Human
cucugaguuuacaguauguuuu

SEQ ID NO: 15407 - RNA, 22 nt, Human
cucugcccacaguccccgagga

SEQ ID NO: 15408 - RNA, 22 nt, Human
cucugcguggcugggcccaggg

SEQ ID NO: 15409 - RNA, 22 nt, Human
cucugcuuagacaggcuuuaag

SEQ ID NO: 15410 - RNA, 22 nt, Human
cucugcuuguaucacauuugcu

SEQ ID NO: 15411 - RNA, 18 nt, Human
cucuggacagcaggcauc

SEQ ID NO: 15412 - RNA, 22 nt, Human
cucuggacaucugcggugcuuc

SEQ ID NO: 15413 - RNA, 19 nt, Human
cucuggcuccugggcugcc

SEQ ID NO: 15414 - RNA, 20 nt, Human
cucugggaggcuugucaccu

SEQ ID NO: 15415 - RNA, 17 nt, Human
cucugggucuccugcuu

SEQ ID NO: 15416 - RNA, 22 nt, Human
agcccccaaaauguuugccugc

SEQ ID NO: 15417 - RNA, 22 nt, Human
agcccgggagggcugucuggga

SEQ ID NO: 15418 - RNA, 22 nt, Human
agcccuauacuuagauuuauuc

SEQ ID NO: 15419 - RNA, 22 nt, Human
agcccuuucuuguuuaacugca

SEQ ID NO: 15420 - RNA, 22 nt, Human
agccgcgcagccucauuaagga

SEQ ID NO: 15421 - RNA, 22 nt, Human
agccgcugaauuugaaacaagc

SEQ ID NO: 15422 - RNA, 22 nt, Human
agccuaauuuguaggucugugu

SEQ ID NO: 15423 - RNA, 22 nt, Human
agccuauucaucugaucuugaa

SEQ ID NO: 15424 - RNA, 22 nt, Human
agccucuagcuccccaaagcca

SEQ ID NO: 15425 - RNA, 22 nt, Human
agccucucugaugugacagcua

SEQ ID NO: 15426 - RNA, 22 nt, Human
agccugagucugcacauagaac

SEQ ID NO: 15427 - RNA, 22 nt, Human
agccuggacagcuacggagaac

SEQ ID NO: 15428 - RNA, 22 nt, Human
agccuggagcaggcucugcucu

SEQ ID NO: 15429 - RNA, 22 nt, Human
agccugggucgagagacgagaa

SEQ ID NO: 15430 - RNA, 22 nt, Human
agccuguacuuagagggauuaa

SEQ ID NO: 15431 - RNA, 22 nt, Human
agccugugcuguguuugcucca

SEQ ID NO: 15432 - RNA, 22 nt, Human
agccuguuacuguccugugcca

SEQ ID NO: 15433 - RNA, 22 nt, Human
agccuucccuuucaacaauuug

SEQ ID NO: 15434 - RNA, 22 nt, Human
agccuugcaugauuucauucau

SEQ ID NO: 15435 - RNA, 22 nt, Human
agcgacuguaagagggccccgg

SEQ ID NO: 15436 - RNA, 22 nt, Human
agcgcaguuaccgcgcggggcu

SEQ ID NO: 15437 - RNA, 22 nt, Human
agcgcccguugagucgcgcggu

SEQ ID NO: 15438 - RNA, 22 nt, Human
agcgccgcugugauuggugagg

SEQ ID NO: 15439 - RNA, 22 nt, Human
agcgcgcggggcugcggcaggg

SEQ ID NO: 15440 - RNA, 21 nt, Human
agcgcugcauccaccauggcu

SEQ ID NO: 15441 - RNA, 22 nt, Human
cugacugauuuugcuuuuuaau

SEQ ID NO: 15442 - RNA, 22 nt, Human
cugagaaauacccaagucuggu

SEQ ID NO: 15443 - RNA, 22 nt, Human
cugagcaucaaaugggcaauua

SEQ ID NO: 15444 - RNA, 22 nt, Human
cugagcggugagggcauacagc

SEQ ID NO: 15445 - RNA, 22 nt, Human
cugagcugcucccgcugcagcg

SEQ ID NO: 15446 - RNA, 22 nt, Human
cugaggaguaguucuggaggac

SEQ ID NO: 15447 - RNA, 22 nt, Human
cugaggcuaauagaauuuucug

SEQ ID NO: 15448 - RNA, 22 nt, Human
cugagguagaggaaauguagcu

SEQ ID NO: 15449 - RNA, 22 nt, Human
cugaguuuuucaaaucugaauu

SEQ ID NO: 15450 - RNA, 20 nt, Human
cugauagauucuuccccaga

SEQ ID NO: 15451 - RNA, 22 nt, Human
cugaugcucuggauguagucaa

SEQ ID NO: 15452 - RNA, 21 nt, Human
cugauguaccucaagccuagu

SEQ ID NO: 15453 - RNA, 22 nt, Human
cugaugugcauguggggggaug

SEQ ID NO: 15454 - RNA, 22 nt, Human
cugauguuuaucucaagaguuc

SEQ ID NO: 15455 - RNA, 22 nt, Human
cugcagagaccuaggucagguu

SEQ ID NO: 15456 - RNA, 22 nt, Human
cugcaguguccgcuugcucagc

SEQ ID NO: 15457 - RNA, 22 nt, Human
cugcaucacagcaggaggcaca

SEQ ID NO: 15458 - RNA, 22 nt, Human
cugcccauggcuccuggcugug

SEQ ID NO: 15459 - RNA, 22 nt, Human
cugcccgcaugcaggaaugcug

SEQ ID NO: 15460 - RNA, 22 nt, Human
cugcccugcagcuccacggacu

SEQ ID NO: 15461 - RNA, 22 nt, Human
cugccggcugcugcagagaggu

SEQ ID NO: 15462 - RNA, 22 nt, Human
cugccuggggaaugugaggauu

SEQ ID NO: 15463 - RNA, 22 nt, Human
cugccugugcgccaagugcacg

SEQ ID NO: 15464 - RNA, 22 nt, Human
cugccuucaaaguaauauuuua

SEQ ID NO: 15465 - RNA, 22 nt, Human
cugccuuggcccuaguucaugg

SEQ ID NO: 15466 - RNA, 22 nt, Human
cugcgcagaucugcuguucucu

SEQ ID NO: 15467 - RNA, 22 nt, Human
cugcguugaccagacuccuggg

SEQ ID NO: 15468 - RNA, 22 nt, Human
cugcuacgguguccgguggggc

SEQ ID NO: 15469 - RNA, 22 nt, Human
cugcucugagaggcucuuccua

SEQ ID NO: 15470 - RNA, 22 nt, Human
cugcucuucccaucccuuaaau

SEQ ID NO: 15471 - RNA, 21 nt, Human
cugcugaaggaaccccaugga

SEQ ID NO: 15472 - RNA, 22 nt, Human
cugcugugcagacagacucucu

SEQ ID NO: 15473 - RNA, 22 nt, Human
cugcuguuuucugggcuucuua

SEQ ID NO: 15474 - RNA, 22 nt, Human
cugcuugaugaggaaaggauug

SEQ ID NO: 15475 - RNA, 22 nt, Human
cuggaaagauuuacacggggaa

SEQ ID NO: 15476 - RNA, 22 nt, Human
cuggaaauggcagaguugcauu

SEQ ID NO: 15477 - RNA, 22 nt, Human
cuggaagcgucggaggaagggc

SEQ ID NO: 15478 - RNA, 22 nt, Human
cuggagaacagagcuguuuaga

SEQ ID NO: 15479 - RNA, 22 nt, Human
cuggagaagagguaguauguag

SEQ ID NO: 15480 - RNA, 22 nt, Human
cuggagaucaguuggacaacag

SEQ ID NO: 15481 - RNA, 22 nt, Human
cuggagcucugggcaucucagg

SEQ ID NO: 15482 - RNA, 22 nt, Human
cuggagucagcaaggacgaggc

SEQ ID NO: 15483 - RNA, 22 nt, Human
cuggauagaggaugguaggcac

SEQ ID NO: 15484 - RNA, 22 nt, Human
cuggccaggugggggguagugg

SEQ ID NO: 15485 - RNA, 22 nt, Human
cuggcggcccgaggcagaggag

SEQ ID NO: 15486 - RNA, 22 nt, Human
cuggcuaaugugcugauagcca

SEQ ID NO: 15487 - RNA, 22 nt, Human
cuggcuuucauggcgcaguuga

SEQ ID NO: 15488 - RNA, 21 nt, Human
cugggaacccgaccaaggccu

SEQ ID NO: 15489 - RNA, 22 nt, Human
cugggaggagacaggggauggg

SEQ ID NO: 15490 - RNA, 22 nt, Human
cugggagggguagccaauccua

SEQ ID NO: 15491 - RNA, 22 nt, Human
cugggaguugacgaggcuugua

SEQ ID NO: 15492 - RNA, 22 nt, Human
cugggaugagcuguuuccuggu

SEQ ID NO: 15493 - RNA, 22 nt, Human
cugggcaugggaacuucaaggc

SEQ ID NO: 15494 - RNA, 22 nt, Human
cugggcuuucaggcccuaaggc

SEQ ID NO: 15495 - RNA, 22 nt, Human
cugggggacagagagaggcggu

SEQ ID NO: 15496 - RNA, 22 nt, Human
cugggguaucugccacaacucu

SEQ ID NO: 15497 - RNA, 22 nt, Human
cugggguaucuggugucuuggu

SEQ ID NO: 15498 - RNA, 22 nt, Human
cugggguuggccagggcccuag

SEQ ID NO: 15499 - RNA, 22 nt, Human
cuggguaaggaaacuccuuugu

SEQ ID NO: 15500 - RNA, 22 nt, Human
cugggugggcacccagccuggg

SEQ ID NO: 15501 - RNA, 22 nt, Human
cuggguguggugggugcugccg

SEQ ID NO: 15502 - RNA, 22 nt, Human
cugguacuggaggaguucagag

SEQ ID NO: 15503 - RNA, 22 nt, Human
cuggugaagccuucggagaccc

SEQ ID NO: 15504 - RNA, 22 nt, Human
cuggugagaccgacuuccacuu

SEQ ID NO: 15505 - RNA, 20 nt, Human
cuggugccuucugcgauuua

SEQ ID NO: 15506 - RNA, 22 nt, Human
cuggugcuguagccugauugag

SEQ ID NO: 15507 - RNA, 22 nt, Human
cuggugggucacgugugggugg

SEQ ID NO: 15508 - RNA, 22 nt, Human
cugguuacuucagaucaguagu

SEQ ID NO: 15509 - RNA, 22 nt, Human
cugguuuauuucauaguuuguu

SEQ ID NO: 15510 - RNA, 22 nt, Human
cuguaaguggugaaauuaguuu

SEQ ID NO: 15511 - RNA, 22 nt, Human
cuguacuuguuuuaggaugaug

SEQ ID NO: 15512 - RNA, 22 nt, Human
cuguauggaggaggugcuagcc

SEQ ID NO: 15513 - RNA, 22 nt, Human
cugucacuguuuuaaccaacaa

SEQ ID NO: 15514 - RNA, 22 nt, Human
cugucagcaaaucagugucugg

SEQ ID NO: 15515 - RNA, 19 nt, Human
cuguccacacacucgcuuc

SEQ ID NO: 15516 - RNA, 22 nt, Human
cuguccauuuucgugccuccuu

SEQ ID NO: 15517 - RNA, 22 nt, Human
cuguccccauugcugucccugg

SEQ ID NO: 15518 - RNA, 22 nt, Human
cuguccuguggccugcuccggu

SEQ ID NO: 15519 - RNA, 22 nt, Human
cugucucugucucuguuuaucc

SEQ ID NO: 15520 - RNA, 22 nt, Human
cugugcauaugucuugaggucu

SEQ ID NO: 15521 - RNA, 22 nt, Human
cugugccagucagggggcaagu

SEQ ID NO: 15522 - RNA, 22 nt, Human
cugugcuguuagcgauuuuuaa

SEQ ID NO: 15523 - RNA, 22 nt, Human
cugugcuugcugugcuggggcc

SEQ ID NO: 15524 - RNA, 22 nt, Human
cuguggaaugcaguugcgagca

SEQ ID NO: 15525 - RNA, 22 nt, Human
gaacucuugguggucauuagau

SEQ ID NO: 15526 - RNA, 22 nt, Human
gaagaaggaagaucaugcuuga

SEQ ID NO: 15527 - RNA, 22 nt, Human
gaagaggaagaggagccagagc

SEQ ID NO: 15528 - RNA, 22 nt, Human
gaagaugcugcuuguucacggg

SEQ ID NO: 15529 - RNA, 22 nt, Human
gaagauuauuacucauugcagg

SEQ ID NO: 15530 - RNA, 22 nt, Human
gaagauucugacccugacucag

SEQ ID NO: 15531 - RNA, 22 nt, Human
gaagcaccuggacggugccugg

SEQ ID NO: 15532 - RNA, 22 nt, Human
gaagccaugauaaccagugugg

SEQ ID NO: 15533 - RNA, 22 nt, Human
gaagcccuggaggggcuggagg

SEQ ID NO: 15534 - RNA, 22 nt, Human
gaagcgucaugaaagaaaggcu

SEQ ID NO: 15535 - RNA, 22 nt, Human
gaagcgugcagguccguauacu

SEQ ID NO: 15536 - RNA, 22 nt, Human
gaagcucaguugcuuagaucuc

SEQ ID NO: 15537 - RNA, 21 nt, Human
gaagcugcuaugaagggggac

SEQ ID NO: 15538 - RNA, 22 nt, Human
gaagcuucgaaagagugauuuc

SEQ ID NO: 15539 - RNA, 22 nt, Human
gaagcuucucaacugguggaau

SEQ ID NO: 15540 - RNA, 22 nt, Human
gaaggaaaagacgugcuaagua

SEQ ID NO: 15541 - RNA, 22 nt, Human
gaaggcugaauuauuuguuccu

SEQ ID NO: 15542 - RNA, 22 nt, Human
gaaggcuguggcuggucucagu

SEQ ID NO: 15543 - RNA, 22 nt, Human
gaaggggacuccauggaaugau

SEQ ID NO: 15544 - RNA, 22 nt, Human
gaagggucagggcccaggggcc

SEQ ID NO: 15545 - RNA, 22 nt, Human
gaagguuuacugaagauuuaaa

SEQ ID NO: 15546 - RNA, 22 nt, Human
gaaguaaaacaguaacuuuguu

SEQ ID NO: 15547 - RNA, 21 nt, Human
gaaguagcucugagaaaagug

SEQ ID NO: 15548 - RNA, 22 nt, Human
gaaguauuucugaguugcccag

SEQ ID NO: 15549 - RNA, 22 nt, Human
gaagucugacucuuuguaagcu

SEQ ID NO: 15550 - RNA, 22 nt, Human
gaagugagcauccuaguuaacc

SEQ ID NO: 15551 - RNA, 22 nt, Human
gaaguucuuagucucauuugca

SEQ ID NO: 15552 - RNA, 22 nt, Human
gaauacaagccugccaccugga

SEQ ID NO: 15553 - RNA, 22 nt, Human
gaauccccugucggaacagugg

SEQ ID NO: 15554 - RNA, 22 nt, Human
agcggaggaggcggagcaggga

SEQ ID NO: 15555 - RNA, 22 nt, Human
agcggcaagguguauguggcag

SEQ ID NO: 15556 - RNA, 22 nt, Human
agcggcaggaagcgcgcaagcg

SEQ ID NO: 15557 - RNA, 22 nt, Human
agcggccucgcugccugcucag

SEQ ID NO: 15558 - RNA, 22 nt, Human
agcggcgcgucuccgagcugga

SEQ ID NO: 15559 - RNA, 22 nt, Human
agcguacuugaggcuuggggcc

SEQ ID NO: 15560 - RNA, 22 nt, Human
agcguaugaauauuugaagaga

SEQ ID NO: 15561 - RNA, 22 nt, Human
agcgucaugugaccagcgcgcc

SEQ ID NO: 15562 - RNA, 22 nt, Human
agcuaaauauuuuuccugacac

SEQ ID NO: 15563 - RNA, 22 nt, Human
agcuagugcaguucucaaaugg

SEQ ID NO: 15564 - RNA, 22 nt, Human
agcucacucaaguaccuggggu

SEQ ID NO: 15565 - RNA, 19 nt, Human
agcucaggcccaucguccc

SEQ ID NO: 15566 - RNA, 22 nt, Human
agcuccauauggcacaccauuu

SEQ ID NO: 15567 - RNA, 22 nt, Human
agcuccucagauuuggguggcg

SEQ ID NO: 15568 - RNA, 22 nt, Human
agcuccugcgcacggugcacac

SEQ ID NO: 15569 - RNA, 22 nt, Human
agcucggcuguccugugccccu

SEQ ID NO: 15570 - RNA, 22 nt, Human
agcucuccuacucucuuucuag

SEQ ID NO: 15571 - RNA, 22 nt, Human
agcucugcuucuugggaagaug

SEQ ID NO: 15572 - RNA, 22 nt, Human
agcucuuccuccauucuggcca

SEQ ID NO: 15573 - RNA, 22 nt, Human
agcucuucugacucuaggcuca

SEQ ID NO: 15574 - RNA, 22 nt, Human
agcugaccugauugcuuuucag

SEQ ID NO: 15575 - RNA, 22 nt, Human
agcugaggccccgcagcagggu

SEQ ID NO: 15576 - RNA, 22 nt, Human
agcugauugucuuuuuaaaagu

SEQ ID NO: 15577 - RNA, 22 nt, Human
agcugcuaagcugcauaacuua

SEQ ID NO: 15578 - RNA, 22 nt, Human
agcugcuggcggauguuggacu

SEQ ID NO: 15579 - RNA, 22 nt, Human
agcugcuuuacuggucggcugg

SEQ ID NO: 15580 - RNA, 20 nt, Human
agcuggcccccgguggccug

SEQ ID NO: 15581 - RNA, 22 nt, Human
agcuguugaccuucccuuucag

SEQ ID NO: 15582 - RNA, 22 nt, Human
agcuucccaggagaucuccgcc

SEQ ID NO: 15583 - RNA, 22 nt, Human
agcuucuucugccuugucccug

SEQ ID NO: 15584 - RNA, 22 nt, Human
agcuuggcaagcacuguuugag

SEQ ID NO: 15585 - RNA, 22 nt, Human
agcuuucaagaaauugucacaa

SEQ ID NO: 15586 - RNA, 20 nt, Human
agcuuucaccaguacuucca

SEQ ID NO: 15587 - RNA, 22 nt, Human
agcuuucuauauaugaguugcu

SEQ ID NO: 15588 - RNA, 22 nt, Human
agcuuugcugcuggagaagggu

SEQ ID NO: 15589 - RNA, 22 nt, Human
agcuuugucccaagugcucugg

SEQ ID NO: 15590 - RNA, 22 nt, Human
aggaaaauggaccagaguuguu

SEQ ID NO: 15591 - RNA, 22 nt, Human
aggaaagacgcauuucuguagg

SEQ ID NO: 15592 - RNA, 22 nt, Human
aggaaaggcucugugguuccua

SEQ ID NO: 15593 - RNA, 22 nt, Human
aggaaauaagggcacuucagau

SEQ ID NO: 15594 - RNA, 22 nt, Human
aggaagaagggacagaauuuug

SEQ ID NO: 15595 - RNA, 22 nt, Human
aggaagagcuggaccagaggac

SEQ ID NO: 15596 - RNA, 20 nt, Human
aggaagauccuuucuuuuaa

SEQ ID NO: 15597 - RNA, 22 nt, Human
aggaagccuggaguccugccca

SEQ ID NO: 15598 - RNA, 22 nt, Human
aggaagucucucaaaacuggaa

SEQ ID NO: 15599 - RNA, 23 nt, Human
aggaagucugacacuacagcguu

SEQ ID NO: 15600 - RNA, 22 nt, Human
aggaaguucuggaauuacuagg

SEQ ID NO: 15601 - RNA, 22 nt, Human
aggaauguugagacauggcuaa

SEQ ID NO: 15602 - RNA, 22 nt, Human
aggaauuucacugcguuuuuua

SEQ ID NO: 15603 - RNA, 22 nt, Human
aggaauuugggguuacaugaug

SEQ ID NO: 15604 - RNA, 22 nt, Human
aggacacuuccugaguggacaa

SEQ ID NO: 15605 - RNA, 22 nt, Human
aggacauuugcuuuuuuucuuu

SEQ ID NO: 15606 - RNA, 22 nt, Human
aggacguaacccaggacagccu

SEQ ID NO: 15607 - RNA, 22 nt, Human
aggacucagcgucugucucccg

SEQ ID NO: 15608 - RNA, 22 nt, Human
aggacuggucucuuuucuccaa

SEQ ID NO: 15609 - RNA, 22 nt, Human
aggagacaguuuggacguguag

SEQ ID NO: 15610 - RNA, 22 nt, Human
aggagaccugguugugugugug

SEQ ID NO: 15611 - RNA, 22 nt, Human
aggagagaacaagaguauccug

SEQ ID NO: 15612 - RNA, 16 nt, Human
aggagcagaaagcagu

SEQ ID NO: 15613 - RNA, 22 nt, Human
aggagcauuuugguggguuuug

SEQ ID NO: 15614 - RNA, 17 nt, Human
aggagcuagaaaggaga

SEQ ID NO: 15615 - RNA, 22 nt, Human
aggagcugccggauggggcaug

SEQ ID NO: 15616 - RNA, 22 nt, Human
aggaggaggacucgccaggcca

SEQ ID NO: 15617 - RNA, 22 nt, Human
aggaggcguuugcuaaacgggc

SEQ ID NO: 15618 - RNA, 22 nt, Human
aggaggcucucagguccucccc

SEQ ID NO: 15619 - RNA, 22 nt, Human
aggagggcggggcuaaaaggga

SEQ ID NO: 15620 - RNA, 22 nt, Human
aggagggucauguugaagugua

SEQ ID NO: 15621 - RNA, 22 nt, Human
aggagguaucuggucuccuuuu

SEQ ID NO: 15622 - RNA, 22 nt, Human
aggaguuugaaaacuuaacuaa

SEQ ID NO: 15623 - RNA, 22 nt, Human
aggauagacuucagaaggcaua

SEQ ID NO: 15624 - RNA, 16 nt, Human
aggauauauucucuuc

SEQ ID NO: 15625 - RNA, 22 nt, Human
aggauggauagcaaggaagccg

SEQ ID NO: 15626 - RNA, 22 nt, Human
aggauuagucaccauuauuauu

SEQ ID NO: 15627 - RNA, 20 nt, Human
aggauuauguacauggaugc

SEQ ID NO: 15628 - RNA, 22 nt, Human
aggauugucuccugugaugugc

SEQ ID NO: 15629 - RNA, 22 nt, Human
aggcaauuauacuagguuuugg

SEQ ID NO: 15630 - RNA, 22 nt, Human
aggcaauuuuuaggguuguugu

SEQ ID NO: 15631 - RNA, 20 nt, Human
aggcagacaaggagucuguu

SEQ ID NO: 15632 - RNA, 22 nt, Human
aggcagagaggucuuccuggaa

SEQ ID NO: 15633 - RNA, 23 nt, Human
aggcagaguccuggggcacagcc

SEQ ID NO: 15634 - RNA, 22 nt, Human
gagcacuucagcauaaaucaca

SEQ ID NO: 15635 - RNA, 22 nt, Human
gagcagcaggccagguugcagg

SEQ ID NO: 15636 - RNA, 22 nt, Human
gagcagccugaggauucugcuc

SEQ ID NO: 15637 - RNA, 22 nt, Human
gagcaggcuggcagggccaggg

SEQ ID NO: 15638 - RNA, 22 nt, Human
gagcagguuauuagaaauggaa

SEQ ID NO: 15639 - RNA, 22 nt, Human
gagcagucuuugaaaggcacca

SEQ ID NO: 15640 - RNA, 22 nt, Human
gagcccgugugugugugugugu

SEQ ID NO: 15641 - RNA, 19 nt, Human
gagccgcucccgcagccgg

SEQ ID NO: 15642 - RNA, 22 nt, Human
gagccggggcucccugaggucc

SEQ ID NO: 15643 - RNA, 22 nt, Human
gagccuaccugcugcucuuuca

SEQ ID NO: 15644 - RNA, 22 nt, Human
gagccuaggguucagacuuucc

SEQ ID NO: 15645 - RNA, 22 nt, Human
gagcgcacagaaggaagcagcc

SEQ ID NO: 15646 - RNA, 22 nt, Human
gagcgcgcaaucucuccagcug

SEQ ID NO: 15647 - RNA, 22 nt, Human
gagcggcggugagaaguguggg

SEQ ID NO: 15648 - RNA, 22 nt, Human
gagcguuucccugggggucugc

SEQ ID NO: 15649 - RNA, 22 nt, Human
gagcuaagcccuggagaggucg

SEQ ID NO: 15650 - RNA, 18 nt, Human
gagcucuucccuuuucuc

SEQ ID NO: 15651 - RNA, 22 nt, Human
gagcuggacauacaggaaacca

SEQ ID NO: 15652 - RNA, 22 nt, Human
gagcuggagaaacacauaagaa

SEQ ID NO: 15653 - RNA, 22 nt, Human
gaggacugguugggaaugugaa

SEQ ID NO: 15654 - RNA, 22 nt, Human
gaggacuucaggccuggccagg

SEQ ID NO: 15655 - RNA, 22 nt, Human
gaggagaaacagccgugauagu

SEQ ID NO: 15656 - RNA, 22 nt, Human
gaggagacaguggagccgcuac

SEQ ID NO: 15657 - RNA, 22 nt, Human
gaggagagaaauguuuucugug

SEQ ID NO: 15658 - RNA, 22 nt, Human
gaggagcaggcaggaucugguc

SEQ ID NO: 15659 - RNA, 22 nt, Human
gaggagcugggucagggagaca

SEQ ID NO: 15660 - RNA, 22 nt, Human
gaggaggcuggagaggccagga

SEQ ID NO: 15661 - RNA, 22 nt, Human
gaggaggucaccuggugagcaa

SEQ ID NO: 15662 - RNA, 22 nt, Human
gaggaugacaaagaaggcagac

SEQ ID NO: 15663 - RNA, 22 nt, Human
gaggauggaaaaaccccaaagg

SEQ ID NO: 15664 - RNA, 22 nt, Human
gaggauuugagggucacuccac

SEQ ID NO: 15665 - RNA, 22 nt, Human
gaggcagaggaaacagcucauu

SEQ ID NO: 15666 - RNA, 22 nt, Human
gaggccauguggcccgggcugc

SEQ ID NO: 15667 - RNA, 22 nt, Human
aggcuuuugcucuggcuccucu

SEQ ID NO: 15668 - RNA, 22 nt, Human
agggaaauuaaugugagcaaug

SEQ ID NO: 15669 - RNA, 22 nt, Human
agggaagagaaacaaagauuca

SEQ ID NO: 15670 - RNA, 22 nt, Human
agggaagaggaccagagucucu

SEQ ID NO: 15671 - RNA, 22 nt, Human
agggaagcaggaaguaugggaa

SEQ ID NO: 15672 - RNA, 22 nt, Human
agggaagccggagcgacggggg

SEQ ID NO: 15673 - RNA, 22 nt, Human
agggaaguucuagggagucugg

SEQ ID NO: 15674 - RNA, 22 nt, Human
agggaccacauccccucugugg

SEQ ID NO: 15675 - RNA, 22 nt, Human
agggacccucagcuuggauguc

SEQ ID NO: 15676 - RNA, 22 nt, Human
agggaccgugagcuccuugggg

SEQ ID NO: 15677 - RNA, 19 nt, Human
agggagagucccaagagaa

SEQ ID NO: 15678 - RNA, 22 nt, Human
agggagcagcuagagggggucc

SEQ ID NO: 15679 - RNA, 22 nt, Human
agggagcugcucugcuuccgug

SEQ ID NO: 15680 - RNA, 22 nt, Human
agggaggcccagcagacuggcg

SEQ ID NO: 15681 - RNA, 22 nt, Human
agggaucccaaggggucucugc

SEQ ID NO: 15682 - RNA, 22 nt, Human
agggaugugcagggcuugccau

SEQ ID NO: 15683 - RNA, 20 nt, Human
agggauuugguugguauugu

SEQ ID NO: 15684 - RNA, 23 nt, Human
agggcacugaagcuggaauuggg

SEQ ID NO: 15685 - RNA, 22 nt, Human
agggcaguguggugggacugac

SEQ ID NO: 15686 - RNA, 22 nt, Human
agggcaguuaugaaugucucca

SEQ ID NO: 15687 - RNA, 22 nt, Human
agggcaguuuuacugaaaggug

SEQ ID NO: 15688 - RNA, 22 nt, Human
agggcaugugaaguaaccuagg

SEQ ID NO: 15689 - RNA, 22 nt, Human
agggccaagaaagaguggcuuu

SEQ ID NO: 15690 - RNA, 21 nt, Human
agggccagaucaccaaggagc

SEQ ID NO: 15691 - RNA, 22 nt, Human
agggccagcagcuuggccaacc

SEQ ID NO: 15692 - RNA, 22 nt, Human
agggcccaccuuggugcugagg

SEQ ID NO: 15693 - RNA, 22 nt, Human
agggcccauagaucgucagcuu

SEQ ID NO: 15694 - RNA, 20 nt, Human
agggccuauauaaacugcug

SEQ ID NO: 15695 - RNA, 22 nt, Human
agggcgugguggugcuggagca

SEQ ID NO: 15696 - RNA, 22 nt, Human
agggcucacuacaacccuggga

SEQ ID NO: 15697 - RNA, 22 nt, Human
agggcugcugcuccgggcccag

SEQ ID NO: 15698 - RNA, 22 nt, Human
agggcugggcuuggcaggcugg

SEQ ID NO: 15699 - RNA, 22 nt, Human
agggcuuacaucccacaguuag

SEQ ID NO: 15700 - RNA, 22 nt, Human
agggcuucugcugcagagaccu

SEQ ID NO: 15701 - RNA, 22 nt, Human
agggcuugggggccuugaaggc

SEQ ID NO: 15702 - RNA, 22 nt, Human
aggggagggcuggccuuuggau

SEQ ID NO: 15703 - RNA, 22 nt, Human
aggggaggggaguaucaggauu

SEQ ID NO: 15704 - RNA, 22 nt, Human
aggggauucgggugccccuagu

SEQ ID NO: 15705 - RNA, 22 nt, Human
aggggcaaacuuguucuagggu

SEQ ID NO: 15706 - RNA, 20 nt, Human
aggggcuguaguuagaugac

SEQ ID NO: 15707 - RNA, 22 nt, Human
aggggcugugucauuuguccua

SEQ ID NO: 15708 - RNA, 18 nt, Human
agggggaagccaggagga

SEQ ID NO: 15709 - RNA, 22 nt, Human
agggggaauccugcuuauggau

SEQ ID NO: 15710 - RNA, 22 nt, Human
agggggcaugaaauaaaggaaa

SEQ ID NO: 15711 - RNA, 22 nt, Human
agggggccuauucuuggacugc

SEQ ID NO: 15712 - RNA, 22 nt, Human
agggggcuccugcaggccccca

SEQ ID NO: 15713 - RNA, 22 nt, Human
agggguacuagaggauugagau

SEQ ID NO: 15714 - RNA, 22 nt, Human
agggguagaacagaaaccugcc

SEQ ID NO: 15715 - RNA, 20 nt, Human
agggguucuguuaugaaaua

SEQ ID NO: 15716 - RNA, 22 nt, Human
aggguaccugauuuauggagca

SEQ ID NO: 15717 - RNA, 22 nt, Human
aggguauguuuuuaucuacugu

SEQ ID NO: 15718 - RNA, 20 nt, Human
agggucucuccuggcucugc

SEQ ID NO: 15719 - RNA, 22 nt, Human
aggguggaggacaggccaguga

SEQ ID NO: 15720 - RNA, 22 nt, Human
aggguggcacucugggggcucc

SEQ ID NO: 15721 - RNA, 22 nt, Human
aggguggcuggaguggucuggu

SEQ ID NO: 15722 - RNA, 22 nt, Human
aggguguuugggagcagaggau

SEQ ID NO: 15723 - RNA, 22 nt, Human
aggguuaggaaggagaagagag

SEQ ID NO: 15724 - RNA, 22 nt, Human
aggguuaugcuccuucaucuug

SEQ ID NO: 15725 - RNA, 22 nt, Human
aggguuccugaaaaguauguca

SEQ ID NO: 15726 - RNA, 22 nt, Human
aggguuucucuccaguguggac

SEQ ID NO: 15727 - RNA, 22 nt, Human
aggguuugaauccucuuucuua

SEQ ID NO: 15728 - RNA, 22 nt, Human
agguaagaagugagcaaguuua

SEQ ID NO: 15729 - RNA, 22 nt, Human
agguagaaggaccagaauuuau

SEQ ID NO: 15730 - RNA, 21 nt, Human
agguagauagccccaggaagg

SEQ ID NO: 15731 - RNA, 22 nt, Human
agguagcuggugcugggcuccu

SEQ ID NO: 15732 - RNA, 22 nt, Human
agguagggaggguagaugcucu

SEQ ID NO: 15733 - RNA, 22 nt, Human
agguaguacuuuuuagagugca

SEQ ID NO: 15734 - RNA, 22 nt, Human
agguaguagagaacucugcucu

SEQ ID NO: 15735 - RNA, 22 nt, Human
agguauaguuauuucugcuccc

SEQ ID NO: 15736 - RNA, 22 nt, Human
agguaugucccccgagugcagc

SEQ ID NO: 15737 - RNA, 22 nt, Human
aggucccauguccucccugacc

SEQ ID NO: 15738 - RNA, 22 nt, Human
aggucggcuuuuuuccuuucac

SEQ ID NO: 15739 - RNA, 22 nt, Human
aggucuaaaugcugguuucacc

SEQ ID NO: 15740 - RNA, 23 nt, Human
aggucucggaugaagguaaggag

SEQ ID NO: 15741 - RNA, 22 nt, Human
aggucuugguaggccagagucu

SEQ ID NO: 15742 - RNA, 22 nt, Human
aggucuuuaguggcagagucua

SEQ ID NO: 15743 - RNA, 22 nt, Human
gauauuaguuuuggaaggaggg

SEQ ID NO: 15744 - RNA, 22 nt, Human
gauauucauaggcagguauuua

SEQ ID NO: 15745 - RNA, 22 nt, Human
gauauuuugugaaaaaacaacu

SEQ ID NO: 15746 - RNA, 22 nt, Human
gaucacuuugauuagauguccu

SEQ ID NO: 15747 - RNA, 22 nt, Human
gauccagauauuugggcuggua

SEQ ID NO: 15748 - RNA, 22 nt, Human
gaucccagaggcggggauagga

SEQ ID NO: 15749 - RNA, 22 nt, Human
gauccucagacccuccucuggu

SEQ ID NO: 15750 - RNA, 22 nt, Human
gaucugguuccaggacauugca

SEQ ID NO: 15751 - RNA, 22 nt, Human
gaucuuacucacuucagcuggc

SEQ ID NO: 15752 - RNA, 22 nt, Human
gaugaaguaguccacuggaagg

SEQ ID NO: 15753 - RNA, 22 nt, Human
gaugcauccuuucugucuucuc

SEQ ID NO: 15754 - RNA, 22 nt, Human
gaugccggggucguagccgugg

SEQ ID NO: 15755 - RNA, 22 nt, Human
gaugcuaauuaaugaagaggag

SEQ ID NO: 15756 - RNA, 22 nt, Human
gaugcucuugauuggaccaggg

SEQ ID NO: 15757 - RNA, 22 nt, Human
gauggacgguuuuaccagacag

SEQ ID NO: 15758 - RNA, 22 nt, Human
gauggauuuuuuauuaaaucag

SEQ ID NO: 15759 - RNA, 22 nt, Human
gauggcauucacaaacuuaacu

SEQ ID NO: 15760 - RNA, 22 nt, Human
gaugggaaggugguaaaguuua

SEQ ID NO: 15761 - RNA, 22 nt, Human
gauggggaaaaaauggaucuuu

SEQ ID NO: 15762 - RNA, 22 nt, Human
gaugguagauauagaaagggga

SEQ ID NO: 15763 - RNA, 22 nt, Human
gaugguaucugcuggcuuucag

SEQ ID NO: 15764 - RNA, 22 nt, Human
gauggugauggcccuaagcuga

SEQ ID NO: 15765 - RNA, 22 nt, Human
gaugguggaggaaucgcugaag

SEQ ID NO: 15766 - RNA, 22 nt, Human
gaugucauguuggcagacaguu

SEQ ID NO: 15767 - RNA, 22 nt, Human
gaugucccuggaggggacagga

SEQ ID NO: 15768 - RNA, 22 nt, Human
gaugucuauguccagggccauc

SEQ ID NO: 15769 - RNA, 22 nt, Human
gauguuggugcauucacuucug

SEQ ID NO: 15770 - RNA, 22 nt, Human
gauguuuugaaagaagaauaca

SEQ ID NO: 15771 - RNA, 22 nt, Human
gauuaaaggucuugauuauaag

SEQ ID NO: 15772 - RNA, 22 nt, Human
gauuaagauuacauauuuaagu

SEQ ID NO: 15773 - RNA, 22 nt, Human
gauuaagugaauuggagaaaag

SEQ ID NO: 15774 - RNA, 22 nt, Human
gauuaucaccaaauggccuccu

SEQ ID NO: 15775 - RNA, 22 nt, Human
gauuccugcuauucacagggcu

SEQ ID NO: 15776 - RNA, 22 nt, Human
gauuccuuucgccugccgagcu

SEQ ID NO: 15777 - RNA, 22 nt, Human
gauucugaaauuaacagacugg

SEQ ID NO: 15778 - RNA, 22 nt, Human
gauugcaucaauauuuagagua

SEQ ID NO: 15779 - RNA, 22 nt, Human
gauugcugccagcguguccgug

SEQ ID NO: 15780 - RNA, 22 nt, Human
aguagacuuuuuauuuguuuug

SEQ ID NO: 15781 - RNA, 22 nt, Human
aguaggauguuuagcccuucuu

SEQ ID NO: 15782 - RNA, 22 nt, Human
aguagggugaggaggggaguga

SEQ ID NO: 15783 - RNA, 21 nt, Human
aguagucgauucaggagaagu

SEQ ID NO: 15784 - RNA, 22 nt, Human
aguauaagugaugcuaucuucu

SEQ ID NO: 15785 - RNA, 19 nt, Human
aguauauaucuuuaccuca

SEQ ID NO: 15786 - RNA, 22 nt, Human
aguauaucugcuucuggguccc

SEQ ID NO: 15787 - RNA, 22 nt, Human
aguauccauccugcuguuucua

SEQ ID NO: 15788 - RNA, 22 nt, Human
aguaucgcuuuguaucaugagg

SEQ ID NO: 15789 - RNA, 23 nt, Human
aguaucuugguguggugcagaga

SEQ ID NO: 15790 - RNA, 22 nt, Human
aguaugcuggcaccuuugagug

SEQ ID NO: 15791 - RNA, 22 nt, Human
aguauggaauuuuuaaugacag

SEQ ID NO: 15792 - RNA, 22 nt, Human
aguauuggauauaaucuaggaa

SEQ ID NO: 15793 - RNA, 19 nt, Human
aguauuggcagguccugua

SEQ ID NO: 15794 - RNA, 23 nt, Human
aguauuguucaucuucaagacag

SEQ ID NO: 15795 - RNA, 22 nt, Human
aguauuuaguauucuauauuag

SEQ ID NO: 15796 - RNA, 22 nt, Human
aguauuuuaaaauacauuaucc

SEQ ID NO: 15797 - RNA, 22 nt, Human
agucaagguggaccagaaaaau

SEQ ID NO: 15798 - RNA, 22 nt, Human
agucacacagccugacaaugga

SEQ ID NO: 15799 - RNA, 22 nt, Human
agucaccuacagcucaugcuuc

SEQ ID NO: 15800 - RNA, 22 nt, Human
agucacuguucugucaugucaa

SEQ ID NO: 15801 - RNA, 22 nt, Human
agucacuguuuaaucuagcuaa

SEQ ID NO: 15802 - RNA, 22 nt, Human
agucagaaggugucagaucuug

SEQ ID NO: 15803 - RNA, 22 nt, Human
agucagcuuggaacuuuuuucc

SEQ ID NO: 15804 - RNA, 22 nt, Human
agucagcuugucucuaggguug

SEQ ID NO: 15805 - RNA, 22 nt, Human
agucaggggaucuagacuugaa

SEQ ID NO: 15806 - RNA, 22 nt, Human
agucauaaagccagugggaggc

SEQ ID NO: 15807 - RNA, 18 nt, Human
agucauguuuuagucacu

SEQ ID NO: 15808 - RNA, 22 nt, Human
agucauuugaggcaugauuaug

SEQ ID NO: 15809 - RNA, 22 nt, Human
agucauuugucauuuuuuugag

SEQ ID NO: 15810 - RNA, 22 nt, Human
aguccagggcuuagucagcggg

SEQ ID NO: 15811 - RNA, 22 nt, Human
agucccugauggacuggaugag

SEQ ID NO: 15812 - RNA, 22 nt, Human
aguccucagauauggagaucug

SEQ ID NO: 15813 - RNA, 22 nt, Human
agucggauuucccagguuauug

SEQ ID NO: 15814 - RNA, 22 nt, Human
agucggguugcagacacauccu

SEQ ID NO: 15815 - RNA, 22 nt, Human
agucuagagcuuuuaucaggcc

SEQ ID NO: 15816 - RNA, 22 nt, Human
agucuagcagagauaaagacgu

SEQ ID NO: 15817 - RNA, 22 nt, Human
agucuauacuucccaguugaca

SEQ ID NO: 15818 - RNA, 22 nt, Human
agucuauguuuuuguucuuauu

SEQ ID NO: 15819 - RNA, 22 nt, Human
agucugaguaucucugagccag

SEQ ID NO: 15820 - RNA, 19 nt, Human
agucugugacaaggagugg

SEQ ID NO: 15821 - RNA, 20 nt, Human
agucuucaggugugaggauu

SEQ ID NO: 15822 - RNA, 22 nt, Human
agucuuuguuccugggaccuga

SEQ ID NO: 15823 - RNA, 22 nt, Human
agugaaauaugcccauugcugu

SEQ ID NO: 15824 - RNA, 22 nt, Human
agugaagauagagccaggucug

SEQ ID NO: 15825 - RNA, 23 nt, Human
agugaagcugguuagugaugacc

SEQ ID NO: 15826 - RNA, 22 nt, Human
agugacauuauuuuguguacua

SEQ ID NO: 15827 - RNA, 22 nt, Human
agugacuguccuacuuuguaga

SEQ ID NO: 15828 - RNA, 22 nt, Human
agugagaguauuaaugugaacu

SEQ ID NO: 15829 - RNA, 22 nt, Human
agugagcauuagugcuuauauu

SEQ ID NO: 15830 - RNA, 22 nt, Human
agugagcuuuuaaaauuuacca

SEQ ID NO: 15831 - RNA, 22 nt, Human
agugaggggagaaugaggugga

SEQ ID NO: 15832 - RNA, 20 nt, Human
agugaguuaucagcuacagu

SEQ ID NO: 15833 - RNA, 22 nt, Human
agugaucugcugcagugcucug

SEQ ID NO: 15834 - RNA, 23 nt, Human
agugaucuguguuugaagaaugc

SEQ ID NO: 15835 - RNA, 22 nt, Human
agugaugauccaaaugaauuga

SEQ ID NO: 15836 - RNA, 22 nt, Human
agugaugcuuuggagaagaucc

SEQ ID NO: 15837 - RNA, 20 nt, Human
agugauuuguuaguacauug

SEQ ID NO: 15838 - RNA, 22 nt, Human
agugccauggcugcuagauggc

SEQ ID NO: 15839 - RNA, 22 nt, Human
agugccuucuagaaucucuuaa

SEQ ID NO: 15840 - RNA, 22 nt, Human
agugcgagaugaggacagaagc

SEQ ID NO: 15841 - RNA, 22 nt, Human
agugcucagggaaugccacuga

SEQ ID NO: 15842 - RNA, 22 nt, Human
agugcuuuauguuguugugcaa

SEQ ID NO: 15843 - RNA, 23 nt, Human
aguggaggucgggguggggagac

SEQ ID NO: 15844 - RNA, 22 nt, Human
aguggagguuacagcuguacau

SEQ ID NO: 15845 - RNA, 21 nt, Human
aguggcacuguuucuucccua

SEQ ID NO: 15846 - RNA, 23 nt, Human
aguggccgaucaucucgggcuug

SEQ ID NO: 15847 - RNA, 19 nt, Human
agugggcaaggaagaugac

SEQ ID NO: 15848 - RNA, 22 nt, Human
aguggggaaauaucaauauuug

SEQ ID NO: 15849 - RNA, 22 nt, Human
aguggggcccaagaaucugcau

SEQ ID NO: 15850 - RNA, 22 nt, Human
aguggguaaggacaggugucug

SEQ ID NO: 15851 - RNA, 22 nt, Human
aguguauuugccuauaaaaaug

SEQ ID NO: 15852 - RNA, 23 nt, Human
gcaguggagcgagaacuuccugu

SEQ ID NO: 15853 - RNA, 22 nt, Human
gcagugucacuaguaauagucu

SEQ ID NO: 15854 - RNA, 22 nt, Human
gcaguuaccuauuuuguagaaa

SEQ ID NO: 15855 - RNA, 22 nt, Human
gcaguugugguuucguuuccuu

SEQ ID NO: 15856 - RNA, 22 nt, Human
gcauaacaacagacucuguguu

SEQ ID NO: 15857 - RNA, 22 nt, Human
gcauaauauugagaaauuauua

SEQ ID NO: 15858 - RNA, 22 nt, Human
gcauagacaccuuagagcaaua

SEQ ID NO: 15859 - RNA, 22 nt, Human
gcauaguuuucauagguguuuu

SEQ ID NO: 15860 - RNA, 22 nt, Human
gcauauuuuaaaguguaaccug

SEQ ID NO: 15861 - RNA, 22 nt, Human
gcauccaaggagcagaagugau

SEQ ID NO: 15862 - RNA, 21 nt, Human
gcauccucguacucuucaggu

SEQ ID NO: 15863 - RNA, 23 nt, Human
gcaucgcaggucuaagauuagcu

SEQ ID NO: 15864 - RNA, 22 nt, Human
gcaucuccugagucagauuuug

SEQ ID NO: 15865 - RNA, 22 nt, Human
gcaugaauggaacccccugagu

SEQ ID NO: 15866 - RNA, 22 nt, Human
gcaugcaggaagggcuugggga

SEQ ID NO: 15867 - RNA, 22 nt, Human
gcaugguuagacaucaauguga

SEQ ID NO: 15868 - RNA, 22 nt, Human
gcaugguuuccugcaacguucu

SEQ ID NO: 15869 - RNA, 22 nt, Human
gcauguagucaguguugagaac

SEQ ID NO: 15870 - RNA, 22 nt, Human
gcauuagacuaguacacggcag

SEQ ID NO: 15871 - RNA, 22 nt, Human
gcauuccagaguugcuggaaaa

SEQ ID NO: 15872 - RNA, 22 nt, Human
gcauugcuauuucuguuagugu

SEQ ID NO: 15873 - RNA, 22 nt, Human
gcauuucauaaccagccaugcu

SEQ ID NO: 15874 - RNA, 22 nt, Human
gcauuuuaauuggggcaguuag

SEQ ID NO: 15875 - RNA, 23 nt, Human
gccaaacugcccguucucucugc

SEQ ID NO: 15876 - RNA, 19 nt, Human
gccacccaucauauggagg

SEQ ID NO: 15877 - RNA, 20 nt, Human
gccaccucugcucuuucccg

SEQ ID NO: 15878 - RNA, 22 nt, Human
gccacucaguuuaggggcaagc

SEQ ID NO: 15879 - RNA, 21 nt, Human
gccacugcugcucauucucug

SEQ ID NO: 15880 - RNA, 18 nt, Human
gccagcccuccaaccucc

SEQ ID NO: 15881 - RNA, 22 nt, Human
gccagcuuagaucccccagccc

SEQ ID NO: 15882 - RNA, 22 nt, Human
gccaggagaaaaggcgaaugau

SEQ ID NO: 15883 - RNA, 22 nt, Human
gccaggcagcagcgaggauggu

SEQ ID NO: 15884 - RNA, 22 nt, Human
gccaggcggcccaggagauggc

SEQ ID NO: 15885 - RNA, 22 nt, Human
gccagggcucgagcaggccagc

SEQ ID NO: 15886 - RNA, 22 nt, Human
gccaggugauuucaaaguccuu

SEQ ID NO: 15887 - RNA, 22 nt, Human
gccaguaaaguaucuccuuuug

SEQ ID NO: 15888 - RNA, 22 nt, Human
gccagucgucuuuauuacagcu

SEQ ID NO: 15889 - RNA, 22 nt, Human
gccaguggucagugggagggug

SEQ ID NO: 15890 - RNA, 22 nt, Human
gccaguuuguuuacugaugguu

SEQ ID NO: 15891 - RNA, 22 nt, Human
gccauauucaugcaggugcuaa

SEQ ID NO: 15892 - RNA, 22 nt, Human
gccaucugcuuagauugcuggg

SEQ ID NO: 15893 - RNA, 22 nt, Human
aguuuggaggagaaagugcggg

SEQ ID NO: 15894 - RNA, 22 nt, Human
aguuuuguuuguuuguuuguua

SEQ ID NO: 15895 - RNA, 22 nt, Human
aguuuuuaacgccauguuugaa

SEQ ID NO: 15896 - RNA, 22 nt, Human
aguuuuugagaauucuucugaa

SEQ ID NO: 15897 - RNA, 18 nt, Human
aguuuuuuuggcaaaagg

SEQ ID NO: 15898 - RNA, 22 nt, Human
auaaaaaguggcugcuauugga

SEQ ID NO: 15899 - RNA, 22 nt, Human
auaaaaauguuuuuguguggua

SEQ ID NO: 15900 - RNA, 22 nt, Human
auaaaacagaucaggagaauga

SEQ ID NO: 15901 - RNA, 20 nt, Human
auaaauaggauuuucugaca

SEQ ID NO: 15902 - RNA, 22 nt, Human
auaaaucaagggcaguauuucc

SEQ ID NO: 15903 - RNA, 22 nt, Human
auaacgaaagcaauuauuuuca

SEQ ID NO: 15904 - RNA, 22 nt, Human
auaagcuucucugcaguucagu

SEQ ID NO: 15905 - RNA, 22 nt, Human
auaaggaaagugagugcuuaaa

SEQ ID NO: 15906 - RNA, 22 nt, Human
auaagguuuucuuuuguucccu

SEQ ID NO: 15907 - RNA, 22 nt, Human
auaaucuuuccagucaguuucc

SEQ ID NO: 15908 - RNA, 22 nt, Human
auaaucuuugaguagaguugag

SEQ ID NO: 15909 - RNA, 22 nt, Human
auacaaaaaguggugaguguau

SEQ ID NO: 15910 - RNA, 22 nt, Human
auacaauugcaauggaagauga

SEQ ID NO: 15911 - RNA, 22 nt, Human
auacacauguuauuguggaagc

SEQ ID NO: 15912 - RNA, 22 nt, Human
auacacuucauguuuucaucug

SEQ ID NO: 15913 - RNA, 22 nt, Human
auacagacacuguagguuauuu

SEQ ID NO: 15914 - RNA, 22 nt, Human
auacaggcaguaagauucucag

SEQ ID NO: 15915 - RNA, 21 nt, Human
auacaguucagcuuuuacuau

SEQ ID NO: 15916 - RNA, 22 nt, Human
auacaugacucacacauucugc

SEQ ID NO: 15917 - RNA, 22 nt, Human
auacaugugugugcauacaugu

SEQ ID NO: 15918 - RNA, 22 nt, Human
auaccaaugaaucccugagaau

SEQ ID NO: 15919 - RNA, 22 nt, Human
auaccaaugacaggaguuaggg

SEQ ID NO: 15920 - RNA, 18 nt, Human
auaccaggauagggacaa

SEQ ID NO: 15921 - RNA, 22 nt, Human
auaccaguagaggacugcccaa

SEQ ID NO: 15922 - RNA, 22 nt, Human
auaccuauagcagacugagacu

SEQ ID NO: 15923 - RNA, 22 nt, Human
auacuagauaccucuucuaccu

SEQ ID NO: 15924 - RNA, 22 nt, Human
auacuagguggauauacaaaga

SEQ ID NO: 15925 - RNA, 22 nt, Human
auacuaguuacuuuccuugggg

SEQ ID NO: 15926 - RNA, 22 nt, Human
auacuucaccuaacccaguuuc

SEQ ID NO: 15927 - RNA, 20 nt, Human
auacuuguuuucaggcuuuu

SEQ ID NO: 15928 - RNA, 22 nt, Human
auagaaauagacaaugcaaaga

SEQ ID NO: 15929 - RNA, 22 nt, Human
auagacuuccuguccuagacuu

SEQ ID NO: 15930 - RNA, 22 nt, Human
auagagaggaacagcaagaacu

SEQ ID NO: 15931 - RNA, 22 nt, Human
auagagcuggggaagaagcugg

SEQ ID NO: 15932 - RNA, 20 nt, Human
auagaguggugugucacauu

SEQ ID NO: 15933 - RNA, 22 nt, Human
auagaugacaguuaggaagcug

SEQ ID NO: 15934 - RNA, 22 nt, Human
auagaugaggaaauucaggugc

SEQ ID NO: 15935 - RNA, 22 nt, Human
auagauguauucauuguuuggc

SEQ ID NO: 15936 - RNA, 22 nt, Human
auagauuuuaucagauuuuauc

SEQ ID NO: 15937 - RNA, 22 nt, Human
auagcaucaugcuaucccccuu

SEQ ID NO: 15938 - RNA, 22 nt, Human
auagcuauuauuauuucuguua

SEQ ID NO: 15939 - RNA, 22 nt, Human
auaggcggagccauaucaucca

SEQ ID NO: 15940 - RNA, 23 nt, Human
auagucuuaaaccagacuucacc

SEQ ID NO: 15941 - RNA, 22 nt, Human
auaguguguaaagugcagugau

SEQ ID NO: 15942 - RNA, 22 nt, Human
auaguugcugucauuauuugag

SEQ ID NO: 15943 - RNA, 22 nt, Human
auaguuuuagauacugagaaaa

SEQ ID NO: 15944 - RNA, 22 nt, Human
auauaagauaauaacuuuuuua

SEQ ID NO: 15945 - RNA, 22 nt, Human
auauaagucacauuaaggaggu

SEQ ID NO: 15946 - RNA, 22 nt, Human
auauaaugcaguaggugauuaa

SEQ ID NO: 15947 - RNA, 22 nt, Human
auauaguacauguauauauaua

SEQ ID NO: 15948 - RNA, 22 nt, Human
auauaguuggguuucauucuac

SEQ ID NO: 15949 - RNA, 22 nt, Human
auauauacuuugacacauucug

SEQ ID NO: 15950 - RNA, 22 nt, Human
auauauguauauacacauauau

SEQ ID NO: 15951 - RNA, 22 nt, Human
auauccugguucuaucaaaagg

SEQ ID NO: 15952 - RNA, 22 nt, Human
auaucuaggcugaauguaaaau

SEQ ID NO: 15953 - RNA, 22 nt, Human
auaugaagaaugaucugaagua

SEQ ID NO: 15954 - RNA, 22 nt, Human
auaugagaggaggagcaucagu

SEQ ID NO: 15955 - RNA, 22 nt, Human
auaugcacauguacauguauau

SEQ ID NO: 15956 - RNA, 22 nt, Human
auauggugauuuuaugcaggaa

SEQ ID NO: 15957 - RNA, 22 nt, Human
auauugagagagugagguguag

SEQ ID NO: 15958 - RNA, 22 nt, Human
auauugcuuuauucuugaauau

SEQ ID NO: 15959 - RNA, 21 nt, Human
auauugguaucuuuuuaaauc

SEQ ID NO: 15960 - RNA, 22 nt, Human
auauuguagcaucacugucuug

SEQ ID NO: 15961 - RNA, 22 nt, Human
gcgguguuuuaacacucccucg

SEQ ID NO: 15962 - RNA, 22 nt, Human
gcgguuguucugugugcaugga

SEQ ID NO: 15963 - RNA, 22 nt, Human
gcguaccugaaauuacggcacu

SEQ ID NO: 15964 - RNA, 22 nt, Human
gcguagaagaaagcugcugcua

SEQ ID NO: 15965 - RNA, 22 nt, Human
gcgucucugggcugacccaggu

SEQ ID NO: 15966 - RNA, 22 nt, Human
gcgugcauguguguaugcgugu

SEQ ID NO: 15967 - RNA, 22 nt, Human
gcguggccugcugaaggacuuc

SEQ ID NO: 15968 - RNA, 22 nt, Human
gcguguauuccagaccuuaacg

SEQ ID NO: 15969 - RNA, 22 nt, Human
gcuaagcuuugagucuggacag

SEQ ID NO: 15970 - RNA, 22 nt, Human
gcuacaaaaccagggcaaagga

SEQ ID NO: 15971 - RNA, 22 nt, Human
gcuacaaauaaaaugggugacu

SEQ ID NO: 15972 - RNA, 22 nt, Human
gcuacaacugugucuguggggc

SEQ ID NO: 15973 - RNA, 22 nt, Human
gcuacauuagcuucaauggcua

SEQ ID NO: 15974 - RNA, 22 nt, Human
gcuagaaggaagccccugcuga

SEQ ID NO: 15975 - RNA, 22 nt, Human
gcuagauugucacuugaguguc

SEQ ID NO: 15976 - RNA, 22 nt, Human
gcuaguguuccacgaugugugu

SEQ ID NO: 15977 - RNA, 17 nt, Human
gcuaguuguuuccagua

SEQ ID NO: 15978 - RNA, 22 nt, Human
gcuauacuugccuccucuccac

SEQ ID NO: 15979 - RNA, 22 nt, Human
gcuauuggcuaauuguugcaac

SEQ ID NO: 15980 - RNA, 22 nt, Human
gcucaacucaacgucauuugaa

SEQ ID NO: 15981 - RNA, 22 nt, Human
gcucaacuucuaggacuucagg

SEQ ID NO: 15982 - RNA, 22 nt, Human
gcucaagaccaagggagcgggg

SEQ ID NO: 15983 - RNA, 22 nt, Human
gcucagagaaaacuggggcuug

SEQ ID NO: 15984 - RNA, 22 nt, Human
gcucagccuuuuguucuauuca

SEQ ID NO: 15985 - RNA, 23 nt, Human
gcucauguugcuucuguucuguc

SEQ ID NO: 15986 - RNA, 22 nt, Human
gcucccaauuccuuuuacaauu

SEQ ID NO: 15987 - RNA, 22 nt, Human
gcucccagcuuuuguccacggc

SEQ ID NO: 15988 - RNA, 22 nt, Human
gcucccaguucccaaagugacc

SEQ ID NO: 15989 - RNA, 22 nt, Human
gcuccccaggcccuccacucuc

SEQ ID NO: 15990 - RNA, 19 nt, Human
gcuccugcagcuagagugc

SEQ ID NO: 15991 - RNA, 22 nt, Human
gcucgauugucaguguuaggga

SEQ ID NO: 15992 - RNA, 22 nt, Human
gcucuagcuggcgcugaccugg

SEQ ID NO: 15993 - RNA, 22 nt, Human
gcucucucuucugcaggccuua

SEQ ID NO: 15994 - RNA, 22 nt, Human
gcucucuggccugggaggagga

SEQ ID NO: 15995 - RNA, 23 nt, Human
gcucugauaccagcuacaucuag

SEQ ID NO: 15996 - RNA, 22 nt, Human
gcucugcuccaucuguuuccuc

SEQ ID NO: 15997 - RNA, 22 nt, Human
gcucuggcugccuuaguuuugu

SEQ ID NO: 15998 - RNA, 22 nt, Human
gcucuucuaaguuuacccuucc

SEQ ID NO: 15999 - RNA, 20 nt, Human
gcucuucuccgggucugccu

SEQ ID NO: 16000 - RNA, 18 nt, Human
gcugaaauucuaaacaaa

SEQ ID NO: 16001 - RNA, 23 nt, Human
gcugaagcccacucccugggucu

SEQ ID NO: 16002 - RNA, 22 nt, Human
gcugacuauaaggcugcucugu

SEQ ID NO: 16003 - RNA, 22 nt, Human
gcugacuuauuagaaaaggaca

SEQ ID NO: 16004 - RNA, 23 nt, Human
gcugagcaccagccauaucuuuu

SEQ ID NO: 16005 - RNA, 22 nt, Human
gcugagcagaacaauuagaaau

SEQ ID NO: 16006 - RNA, 22 nt, Human
aucuaaucugccuuccuaaucu

SEQ ID NO: 16007 - RNA, 22 nt, Human
aucuacuaagugccaagcacag

SEQ ID NO: 16008 - RNA, 22 nt, Human
aucuaggguuuagggaccauuu

SEQ ID NO: 16009 - RNA, 22 nt, Human
aucucaaagauaugcugguaaa

SEQ ID NO: 16010 - RNA, 22 nt, Human
aucucaagcucugagggaggcc

SEQ ID NO: 16011 - RNA, 22 nt, Human
aucucagacucuccggguuccg

SEQ ID NO: 16012 - RNA, 22 nt, Human
aucuccaguuagcaguacugau

SEQ ID NO: 16013 - RNA, 22 nt, Human
aucucccaaauuagccucuuga

SEQ ID NO: 16014 - RNA, 22 nt, Human
aucugacaaccuauugacuuga

SEQ ID NO: 16015 - RNA, 23 nt, Human
aucugagccuggucccacccgcu

SEQ ID NO: 16016 - RNA, 22 nt, Human
aucugcugccuaggguuugucu

SEQ ID NO: 16017 - RNA, 22 nt, Human
aucuggaacuucucugcauuga

SEQ ID NO: 16018 - RNA, 22 nt, Human
aucugugguacaugacggcugc

SEQ ID NO: 16019 - RNA, 22 nt, Human
aucuguuccccuaugcucucua

SEQ ID NO: 16020 - RNA, 22 nt, Human
aucuguucuucaaaauauuaca

SEQ ID NO: 16021 - RNA, 22 nt, Human
aucuuaguuauuuggagaaacc

SEQ ID NO: 16022 - RNA, 20 nt, Human
aucuuaucuaucuuuuguuc

SEQ ID NO: 16023 - RNA, 22 nt, Human
aucuucaaagcacaucguuugu

SEQ ID NO: 16024 - RNA, 22 nt, Human
aucuucaaggacgccaagaucc

SEQ ID NO: 16025 - RNA, 22 nt, Human
aucuucucucucaucaggauca

SEQ ID NO: 16026 - RNA, 22 nt, Human
aucuucuuucaucagccccuca

SEQ ID NO: 16027 - RNA, 22 nt, Human
aucuuggauccuuugccagcuu

SEQ ID NO: 16028 - RNA, 19 nt, Human
aucuuucagcagcuccccu

SEQ ID NO: 16029 - RNA, 22 nt, Human
aucuuugccuuuaugccucuag

SEQ ID NO: 16030 - RNA, 22 nt, Human
aucuuuguaaguaaucaaagcu

SEQ ID NO: 16031 - RNA, 22 nt, Human
aucuuuuuucacaauuuauuuu

SEQ ID NO: 16032 - RNA, 22 nt, Human
augaaacuggagcgccuggagg

SEQ ID NO: 16033 - RNA, 19 nt, Human
augaaauagcauuuucuga

SEQ ID NO: 16034 - RNA, 23 nt, Human
augaaaugauacuuuauucacug

SEQ ID NO: 16035 - RNA, 23 nt, Human
augaacgcacugagaucauaauu

SEQ ID NO: 16036 - RNA, 22 nt, Human
augaacuaagagucauuagugu

SEQ ID NO: 16037 - RNA, 22 nt, Human
augaacugcaguauaaacuugg

SEQ ID NO: 16038 - RNA, 22 nt, Human
augaaugccggucucgggggaa

SEQ ID NO: 16039 - RNA, 20 nt, Human
augaaugcuccccacguuuc

SEQ ID NO: 16040 - RNA, 22 nt, Human
augaauuaucugguguuggaaa

SEQ ID NO: 16041 - RNA, 22 nt, Human
augacagcuaaggaauguguag

SEQ ID NO: 16042 - RNA, 22 nt, Human
augacagcucuagcacacagua

SEQ ID NO: 16043 - RNA, 22 nt, Human
augaccuucuuuccuuaaauuu

SEQ ID NO: 16044 - RNA, 22 nt, Human
augagaaauaauuguguacuga

SEQ ID NO: 16045 - RNA, 22 nt, Human
augagaguuagccugcauaguu

SEQ ID NO: 16046 - RNA, 19 nt, Human
augagccccaguucguucc

SEQ ID NO: 16047 - RNA, 22 nt, Human
augaggagucaaggagucggag

SEQ ID NO: 16048 - RNA, 22 nt, Human
augaggauuagcaucugcaaau

SEQ ID NO: 16049 - RNA, 22 nt, Human
augaggccacaguuauagauuu

SEQ ID NO: 16050 - RNA, 22 nt, Human
augaggccuaauacccauuccu

SEQ ID NO: 16051 - RNA, 21 nt, Human
augagguggcuacuaaagagu

SEQ ID NO: 16052 - RNA, 22 nt, Human
augagugugugguucuaaauga

SEQ ID NO: 16053 - RNA, 22 nt, Human
augaguuaaguagcccuucaug

SEQ ID NO: 16054 - RNA, 22 nt, Human
augauaucuuguuuuucaugca

SEQ ID NO: 16055 - RNA, 22 nt, Human
augaucacagugucagucauua

SEQ ID NO: 16056 - RNA, 22 nt, Human
augaugauuauucauuuucugu

SEQ ID NO: 16057 - RNA, 22 nt, Human
augauguuggaauuuuaacuua

SEQ ID NO: 16058 - RNA, 22 nt, Human
augauuacagcaugauguuuca

SEQ ID NO: 16059 - RNA, 22 nt, Human
augauuauuugaaugaagagga

SEQ ID NO: 16060 - RNA, 22 nt, Human
augauucuaccaaugccaucuu

SEQ ID NO: 16061 - RNA, 14 nt, Human
augauuucugggaa

SEQ ID NO: 16062 - RNA, 22 nt, Human
augauuuguuaacagacuuaau

SEQ ID NO: 16063 - RNA, 19 nt, Human
augcaauguuaucaauaac

SEQ ID NO: 16064 - RNA, 22 nt, Human
augcacaagguagauuauuauu

SEQ ID NO: 16065 - RNA, 22 nt, Human
augcaccugucuuuuaaggaua

SEQ ID NO: 16066 - RNA, 19 nt, Human
augcacgugaaaugcauuu

SEQ ID NO: 16067 - RNA, 22 nt, Human
augcacuacuagaugcaaaagu

SEQ ID NO: 16068 - RNA, 22 nt, Human
augcagaaucucuuuccugagg

SEQ ID NO: 16069 - RNA, 22 nt, Human
augcagauguagauucugaaau

SEQ ID NO: 16070 - RNA, 22 nt, Human
ggaaaggacuggagcccagcgc

SEQ ID NO: 16071 - RNA, 22 nt, Human
ggaaaggggaaaauacagagag

SEQ ID NO: 16072 - RNA, 22 nt, Human
ggaaauguguguaagaaaguau

SEQ ID NO: 16073 - RNA, 20 nt, Human
ggaacccuagacuugcgcag

SEQ ID NO: 16074 - RNA, 22 nt, Human
ggaagaagagggagcuguggga

SEQ ID NO: 16075 - RNA, 22 nt, Human
ggaagacuuagaguagcaucag

SEQ ID NO: 16076 - RNA, 22 nt, Human
ggaagccugggcgcaggcaggg

SEQ ID NO: 16077 - RNA, 20 nt, Human
ggaaguauccacaaauuccu

SEQ ID NO: 16078 - RNA, 22 nt, Human
ggaagucuacucuuccgaaaac

SEQ ID NO: 16079 - RNA, 22 nt, Human
ggaagugagcucauuacuuuag

SEQ ID NO: 16080 - RNA, 22 nt, Human
ggaaguuaguucuuggcaaagg

SEQ ID NO: 16081 - RNA, 22 nt, Human
ggaauaaaaggagguggcgaga

SEQ ID NO: 16082 - RNA, 22 nt, Human
ggaauacggguuuauuuagucu

SEQ ID NO: 16083 - RNA, 21 nt, Human
ggaauagcuuaaagugagggg

SEQ ID NO: 16084 - RNA, 22 nt, Human
ggaauccugguguuuucugccu

SEQ ID NO: 16085 - RNA, 22 nt, Human
ggaaucuucagccaugccaaga

SEQ ID NO: 16086 - RNA, 22 nt, Human
ggaaugcuuggcaugagaaccu

SEQ ID NO: 16087 - RNA, 22 nt, Human
ggaauguuuuccagaccuagau

SEQ ID NO: 16088 - RNA, 22 nt, Human
ggaauuaagaggcuggacaggg

SEQ ID NO: 16089 - RNA, 22 nt, Human
ggaauuauuuuaaauagacauu

SEQ ID NO: 16090 - RNA, 22 nt, Human
ggacaauuguacucgauuucaa

SEQ ID NO: 16091 - RNA, 22 nt, Human
ggacagacagcauggaaccaua

SEQ ID NO: 16092 - RNA, 18 nt, Human
ggacaguuguagaggacu

SEQ ID NO: 16093 - RNA, 22 nt, Human
ggacauaccgugccccaaugcg

SEQ ID NO: 16094 - RNA, 22 nt, Human
ggacauaguugcuauggagagu

SEQ ID NO: 16095 - RNA, 22 nt, Human
ggacauggccguaguccccacg

SEQ ID NO: 16096 - RNA, 23 nt, Human
ggacaugucucuggguauuuuga

SEQ ID NO: 16097 - RNA, 22 nt, Human
ggacauuguuguuggauccuug

SEQ ID NO: 16098 - RNA, 22 nt, Human
ggaccagagcuaaugcgcgccc

SEQ ID NO: 16099 - RNA, 22 nt, Human
ggacccagggcuuauucauguu

SEQ ID NO: 16100 - RNA, 21 nt, Human
ggacccuuagauuuuaucuga

SEQ ID NO: 16101 - RNA, 22 nt, Human
ggacggggagcuggaaagggga

SEQ ID NO: 16102 - RNA, 23 nt, Human
ggacgugaggcgcccuuuuuccc

SEQ ID NO: 16103 - RNA, 22 nt, Human
ggacucuaccuggagcagccuc

SEQ ID NO: 16104 - RNA, 22 nt, Human
ggacucucaggcugucggcuuc

SEQ ID NO: 16105 - RNA, 19 nt, Human
ggacuuaggcagacuaauu

SEQ ID NO: 16106 - RNA, 22 nt, Human
ggacuucuggggacuguagauu

SEQ ID NO: 16107 - RNA, 22 nt, Human
ggacuugaaguaguuauggccu

SEQ ID NO: 16108 - RNA, 22 nt, Human
ggacuuggcagugucaaauuua

SEQ ID NO: 16109 - RNA, 22 nt, Human
ggacuuucuccugcacaaagug

SEQ ID NO: 16110 - RNA, 17 nt, Human
ggacuuucugccugucc

SEQ ID NO: 16111 - RNA, 22 nt, Human
ggacuuuggauuuuauucuaaa

SEQ ID NO: 16112 - RNA, 22 nt, Human
ggagaaacuaguuagauccaau

SEQ ID NO: 16113 - RNA, 18 nt, Human
ggagaagaacagaugugg

SEQ ID NO: 16114 - RNA, 22 nt, Human
ggagaagaggagcuggaagccu

SEQ ID NO: 16115 - RNA, 22 nt, Human
ggagacagauggcgucucaguu

SEQ ID NO: 16116 - RNA, 22 nt, Human
ggagacagugacuuagagacug

SEQ ID NO: 16117 - RNA, 22 nt, Human
ggagaccaauuaaugaaggaau

SEQ ID NO: 16118 - RNA, 22 nt, Human
ggagaccagaaggaagcuucga

SEQ ID NO: 16119 - RNA, 22 nt, Human
ggagacuaagaaaauagagucc

SEQ ID NO: 16120 - RNA, 22 nt, Human
ggagagcuagugagcuggaggu

SEQ ID NO: 16121 - RNA, 22 nt, Human
ggagaggaaguuuaaagaauug

SEQ ID NO: 16122 - RNA, 22 nt, Human
ggagauaugugaaaaagacagc

SEQ ID NO: 16123 - RNA, 22 nt, Human
ggagaucucauugauacugaua

SEQ ID NO: 16124 - RNA, 22 nt, Human
ggagaucugggcuguuucuggc

SEQ ID NO: 16125 - RNA, 22 nt, Human
ggagaucuuggacuggccggcc

SEQ ID NO: 16126 - RNA, 22 nt, Human
ggagaugaaugugguaaaacug

SEQ ID NO: 16127 - RNA, 22 nt, Human
ggagaugucugugccacgucuc

SEQ ID NO: 16128 - RNA, 19 nt, Human
ggagcagauaaacauacuu

SEQ ID NO: 16129 - RNA, 22 nt, Human
ggagcaucuaccauuucuagau

SEQ ID NO: 16130 - RNA, 22 nt, Human
ggagccaguuuagaccucaguu

SEQ ID NO: 16131 - RNA, 22 nt, Human
ggagccuuccgagucccagguu

SEQ ID NO: 16132 - RNA, 20 nt, Human
ggagcgggcauuuguguucc

SEQ ID NO: 16133 - RNA, 22 nt, Human
ggagcuaaggauuuuuauaugu

SEQ ID NO: 16134 - RNA, 22 nt, Human
ggagcucacuacgaaauaagcu

SEQ ID NO: 16135 - RNA, 22 nt, Human
ggaggaaauccuuaguaaggca

SEQ ID NO: 16136 - RNA, 22 nt, Human
ggaggagggaguucaggaguau

SEQ ID NO: 16137 - RNA, 22 nt, Human
ggaggaugaggguggugguguu

SEQ ID NO: 16138 - RNA, 22 nt, Human
ggaggcacugaaaguccuacag

SEQ ID NO: 16139 - RNA, 23 nt, Human
ggaggcccagaggucggccccac

SEQ ID NO: 16140 - RNA, 22 nt, Human
ggaggccccccaugcagcucca

SEQ ID NO: 16141 - RNA, 22 nt, Human
ggaggccgugcugugcugccag

SEQ ID NO: 16142 - RNA, 22 nt, Human
ggagggaggggugggagaugga

SEQ ID NO: 16143 - RNA, 22 nt, Human
ggaggguggaggagggaauuga

SEQ ID NO: 16144 - RNA, 19 nt, Human
ggaggguguccucaguguc

SEQ ID NO: 16145 - RNA, 22 nt, Human
ggagguaagaggcccugggccg

SEQ ID NO: 16146 - RNA, 22 nt, Human
ggagucguguuugggaucggag

SEQ ID NO: 16147 - RNA, 22 nt, Human
ggagugaguauguucugaugca

SEQ ID NO: 16148 - RNA, 22 nt, Human
ggagugauuugucuugucuggu

SEQ ID NO: 16149 - RNA, 22 nt, Human
ggaguguaagugacucaccugg

SEQ ID NO: 16150 - RNA, 22 nt, Human
ggaguguuaggaaguuguguuu

SEQ ID NO: 16151 - RNA, 22 nt, Human
ggaguucacagcaauggaacag

SEQ ID NO: 16152 - RNA, 19 nt, Human
ggaguugccaggagaagga

SEQ ID NO: 16153 - RNA, 22 nt, Human
ggauaauguauuuuaaaauggg

SEQ ID NO: 16154 - RNA, 22 nt, Human
ggaucagcgagaagggcugaaa

SEQ ID NO: 16155 - RNA, 22 nt, Human
ggaucccaucgagcuggcuguc

SEQ ID NO: 16156 - RNA, 23 nt, Human
ggauccugacauauaccaucacc

SEQ ID NO: 16157 - RNA, 22 nt, Human
ggauccuuccuggugaagacug

SEQ ID NO: 16158 - RNA, 22 nt, Human
ggaucgauuccaaauguagauc

SEQ ID NO: 16159 - RNA, 22 nt, Human
ggaucguauuucaguuuuuugg

SEQ ID NO: 16160 - RNA, 22 nt, Human
ggauggaugugaucugccuccu

SEQ ID NO: 16161 - RNA, 22 nt, Human
ggauugaagggaaccucagaau

SEQ ID NO: 16162 - RNA, 22 nt, Human
ggauuucuucucauaacugaga

SEQ ID NO: 16163 - RNA, 22 nt, Human
ggcaaagaguacaucguccugg

SEQ ID NO: 16164 - RNA, 22 nt, Human
ggcaagauccagcacaaacaca

SEQ ID NO: 16165 - RNA, 22 nt, Human
ggcaauauuauaagggcauuua

SEQ ID NO: 16166 - RNA, 22 nt, Human
ggcacacugaaguuugagaacc

SEQ ID NO: 16167 - RNA, 22 nt, Human
ggcacaggcugguaccaguuca

SEQ ID NO: 16168 - RNA, 22 nt, Human
ggcacccugcauuggcuugagu

SEQ ID NO: 16169 - RNA, 22 nt, Human
ggcaccuuucaucccaucuaga

SEQ ID NO: 16170 - RNA, 22 nt, Human
ggcacuggguugcagagagaga

SEQ ID NO: 16171 - RNA, 22 nt, Human
ggcagaaaacaauaaccauuuc

SEQ ID NO: 16172 - RNA, 20 nt, Human
ggcagagcuaugucuguugc

SEQ ID NO: 16173 - RNA, 22 nt, Human
ggcagauaaacaauguuguaua

SEQ ID NO: 16174 - RNA, 20 nt, Human
ggcagcaaccauaugcuaca

SEQ ID NO: 16175 - RNA, 22 nt, Human
ggcagcagaaccaacuguggcu

SEQ ID NO: 16176 - RNA, 22 nt, Human
ggcagcagaacuggcccuguau

SEQ ID NO: 16177 - RNA, 22 nt, Human
ggcagcccuggacccuggagaa

SEQ ID NO: 16178 - RNA, 21 nt, Human
ggcagccuggcaggggcacug

SEQ ID NO: 16179 - RNA, 22 nt, Human
auucauucugaccucaagagaa

SEQ ID NO: 16180 - RNA, 18 nt, Human
auucauuugcguuuggcu

SEQ ID NO: 16181 - RNA, 22 nt, Human
auuccagggaaauggggaugga

SEQ ID NO: 16182 - RNA, 22 nt, Human
auuccccagcaggccuuuuguu

SEQ ID NO: 16183 - RNA, 22 nt, Human
auucccucaagagacccacagc

SEQ ID NO: 16184 - RNA, 22 nt, Human
auuccuguggcuggguaaagua

SEQ ID NO: 16185 - RNA, 22 nt, Human
auucgaucacugccgaggaccu

SEQ ID NO: 16186 - RNA, 22 nt, Human
auucguguauauacacauccac

SEQ ID NO: 16187 - RNA, 22 nt, Human
auucuacgcuccgucucuauca

SEQ ID NO: 16188 - RNA, 22 nt, Human
auucuacucuccuacaggucua

SEQ ID NO: 16189 - RNA, 22 nt, Human
auucuagaguuucaauccaagg

SEQ ID NO: 16190 - RNA, 20 nt, Human
auucucaccaugugacaugg

SEQ ID NO: 16191 - RNA, 22 nt, Human
auucucauguuaccaaauucua

SEQ ID NO: 16192 - RNA, 22 nt, Human
auucuccucaaaacaucugcug

SEQ ID NO: 16193 - RNA, 22 nt, Human
auucucuauugguaaauuugac

SEQ ID NO: 16194 - RNA, 22 nt, Human
auucucugaugcagguggaaga

SEQ ID NO: 16195 - RNA, 22 nt, Human
auucugaagcagaaaaggcaga

SEQ ID NO: 16196 - RNA, 21 nt, Human
auucugauguuucuauuguuu

SEQ ID NO: 16197 - RNA, 22 nt, Human
auucugcauuucuaaccagguc

SEQ ID NO: 16198 - RNA, 22 nt, Human
auucugcugccuaguuuaugaa

SEQ ID NO: 16199 - RNA, 22 nt, Human
auucuguaggcuuuuguuaaaa

SEQ ID NO: 16200 - RNA, 20 nt, Human
auucuguguaaauguccugu

SEQ ID NO: 16201 - RNA, 22 nt, Human
auucuguugguuuaauagucaa

SEQ ID NO: 16202 - RNA, 22 nt, Human
auucuuauaaaaaguguugacu

SEQ ID NO: 16203 - RNA, 16 nt, Human
auucuuccaccauuac

SEQ ID NO: 16204 - RNA, 22 nt, Human
auucuugauauagauaguuaau

SEQ ID NO: 16205 - RNA, 20 nt, Human
auucuuguuccauuucccag

SEQ ID NO: 16206 - RNA, 22 nt, Human
auucuuuagaguccuucaaaua

SEQ ID NO: 16207 - RNA, 22 nt, Human
auucuuuauuuucuguacuugc

SEQ ID NO: 16208 - RNA, 22 nt, Human
auugaaauuugcuuccucacug

SEQ ID NO: 16209 - RNA, 22 nt, Human
auugaagcauggagaugaggca

SEQ ID NO: 16210 - RNA, 22 nt, Human
auugaaguguacguuugaucua

SEQ ID NO: 16211 - RNA, 22 nt, Human
auugaauuagauguuguagucc

SEQ ID NO: 16212 - RNA, 22 nt, Human
auugacagaaaauuggauggca

SEQ ID NO: 16213 - RNA, 22 nt, Human
auugacuucccaucaggugagu

SEQ ID NO: 16214 - RNA, 22 nt, Human
auugacuuucccuucuccucau

SEQ ID NO: 16215 - RNA, 22 nt, Human
auugagaaaauucgagcaaguu

SEQ ID NO: 16216 - RNA, 22 nt, Human
auugagacugaaauuacugaag

SEQ ID NO: 16217 - RNA, 22 nt, Human
auugagcuguugaagucccaca

SEQ ID NO: 16218 - RNA, 22 nt, Human
auugaguacuugcugggcucuc

SEQ ID NO: 16219 - RNA, 22 nt, Human
auugaguauuguaaauaaaaca

SEQ ID NO: 16220 - RNA, 22 nt, Human
auugaugaaaauaguuauuuua

SEQ ID NO: 16221 - RNA, 22 nt, Human
auugauuuugugcuuuccuacg

SEQ ID NO: 16222 - RNA, 22 nt, Human
auugcaggucguguggaaguga

SEQ ID NO: 16223 - RNA, 22 nt, Human
auugcauucaugcuccccuuag

SEQ ID NO: 16224 - RNA, 23 nt, Human
auugccuguagaucuucacuuuc

SEQ ID NO: 16225 - RNA, 21 nt, Human
auuggcagaucucuggauugu

SEQ ID NO: 16226 - RNA, 22 nt, Human
auuggcugucagcccggauggg

SEQ ID NO: 16227 - RNA, 22 nt, Human
auuguauugcguuugcgaaugu

SEQ ID NO: 16228 - RNA, 22 nt, Human
auugugaaugccugucagucuu

SEQ ID NO: 16229 - RNA, 22 nt, Human
auuguuacuggguuaauuugga

SEQ ID NO: 16230 - RNA, 22 nt, Human
auuguuuccccggaauuauuca

SEQ ID NO: 16231 - RNA, 22 nt, Human
auuguuuugugaaacauaguga

SEQ ID NO: 16232 - RNA, 22 nt, Human
ggcugcagggaacaggaugggu

SEQ ID NO: 16233 - RNA, 22 nt, Human
ggcugcagugcaacucuuucua

SEQ ID NO: 16234 - RNA, 17 nt, Human
ggcugccaggcaacaua

SEQ ID NO: 16235 - RNA, 22 nt, Human
ggcugcugcccaccccugcaug

SEQ ID NO: 16236 - RNA, 22 nt, Human
ggcugcuggaguugggucucuc

SEQ ID NO: 16237 - RNA, 22 nt, Human
ggcugcuugauagauaugagua

SEQ ID NO: 16238 - RNA, 22 nt, Human
ggcugcuugggcuguuucuuuu

SEQ ID NO: 16239 - RNA, 22 nt, Human
ggcuggaacuucuucuggcauu

SEQ ID NO: 16240 - RNA, 22 nt, Human
ggcuggacuuucugcugggcuc

SEQ ID NO: 16241 - RNA, 22 nt, Human
ggcugggaggcggaggcugaga

SEQ ID NO: 16242 - RNA, 22 nt, Human
ggcugggagguggcgaggaggc

SEQ ID NO: 16243 - RNA, 18 nt, Human
ggcugggcugugccccuu

SEQ ID NO: 16244 - RNA, 22 nt, Human
ggcuggggccuguugaagaugc

SEQ ID NO: 16245 - RNA, 22 nt, Human
ggcugugaaguacguugaaggu

SEQ ID NO: 16246 - RNA, 21 nt, Human
ggcuguuaauagugauuagaa

SEQ ID NO: 16247 - RNA, 22 nt, Human
ggcuuauauguauucccagaga

SEQ ID NO: 16248 - RNA, 22 nt, Human
ggcuucaaaacacaugucaaga

SEQ ID NO: 16249 - RNA, 22 nt, Human
ggcuucucuuggccaugguccc

SEQ ID NO: 16250 - RNA, 22 nt, Human
ggcuuguccuucugguugucuu

SEQ ID NO: 16251 - RNA, 22 nt, Human
ggcuuuuucccuaggguaagag

SEQ ID NO: 16252 - RNA, 22 nt, Human
gggaaaaaggaguuagagauaa

SEQ ID NO: 16253 - RNA, 22 nt, Human
gggaaaauguuucugagacaaa

SEQ ID NO: 16254 - RNA, 22 nt, Human
gggaaauagagcuggaaccuug

SEQ ID NO: 16255 - RNA, 23 nt, Human
gggaaaucaaaagauauuucuuc

SEQ ID NO: 16256 - RNA, 22 nt, Human
gggaaaugugucuuggcauucu

SEQ ID NO: 16257 - RNA, 22 nt, Human
gggaacuguaguuuacgcugcc

SEQ ID NO: 16258 - RNA, 22 nt, Human
gggaacuuggcaggaaaauuau

SEQ ID NO: 16259 - RNA, 22 nt, Human
gggaacuuugugagacuggaga

SEQ ID NO: 16260 - RNA, 18 nt, Human
gggaagaugccacaguga

SEQ ID NO: 16261 - RNA, 22 nt, Human
gggaagccugggugauccuaaa

SEQ ID NO: 16262 - RNA, 20 nt, Human
gggaauggauggauugcucc

SEQ ID NO: 16263 - RNA, 22 nt, Human
gggaauguuaaccuuucuauuu

SEQ ID NO: 16264 - RNA, 22 nt, Human
gggaauuuuaggaugacuccua

SEQ ID NO: 16265 - RNA, 22 nt, Human
gggacagcuggggguaaagcau

SEQ ID NO: 16266 - RNA, 22 nt, Human
gggacaggacuccuggggccug

SEQ ID NO: 16267 - RNA, 22 nt, Human
gggacgggcuagcugccguggc

SEQ ID NO: 16268 - RNA, 22 nt, Human
gggacucugaaucuagauuccu

SEQ ID NO: 16269 - RNA, 22 nt, Human
gggacugguuguguguggugug

SEQ ID NO: 16270 - RNA, 19 nt, Human
gggagaaaaucuuuauccu

SEQ ID NO: 16271 - RNA, 22 nt, Human
gggagaguagcuggaagguucu

SEQ ID NO: 16272 - RNA, 22 nt, Human
gggagauuuguguaggaaaacu

SEQ ID NO: 16273 - RNA, 22 nt, Human
gggagccagcagggcauggagc

SEQ ID NO: 16274 - RNA, 22 nt, Human
gggagccucccacugggggaag

SEQ ID NO: 16275 - RNA, 22 nt, Human
gggagcugagcuggaagagaau

SEQ ID NO: 16276 - RNA, 22 nt, Human
gggaggaagaguaggaauuuga

SEQ ID NO: 16277 - RNA, 22 nt, Human
gggagggaggagccccggccau

SEQ ID NO: 16278 - RNA, 22 nt, Human
gggagggcuuggacccagaugu

SEQ ID NO: 16279 - RNA, 22 nt, Human
gggagggggauucuggcgagaa

SEQ ID NO: 16280 - RNA, 22 nt, Human
gggagggucugagagcugcacc

SEQ ID NO: 16281 - RNA, 22 nt, Human
gggaguauguccgggcucuaga

SEQ ID NO: 16282 - RNA, 21 nt, Human
gggagugaguaaugauggggg

SEQ ID NO: 16283 - RNA, 21 nt, Human
gggagugucuguugcaaggug

SEQ ID NO: 16284 - RNA, 22 nt, Human
gggauggggagcuggaaagggg

SEQ ID NO: 16285 - RNA, 22 nt, Human
gggauguauguuuguguggaga

SEQ ID NO: 16286 - RNA, 22 nt, Human
gggauguuuugcaggcaaagaa

SEQ ID NO: 16287 - RNA, 22 nt, Human
gggauuuaaugggaaaaauaug

SEQ ID NO: 16288 - RNA, 20 nt, Human
ggucuguuucuucuuuucau

SEQ ID NO: 16289 - RNA, 22 nt, Human
ggugacuucugaaccuggagug

SEQ ID NO: 16290 - RNA, 22 nt, Human
ggugaggagaaacucugccccu

SEQ ID NO: 16291 - RNA, 18 nt, Human
ggugagggagcuggaagc

SEQ ID NO: 16292 - RNA, 22 nt, Human
ggugaggggauccuguuaccau

SEQ ID NO: 16293 - RNA, 22 nt, Human
ggugaguaguggaaaugaauga

SEQ ID NO: 16294 - RNA, 22 nt, Human
ggugaucucuggcucugcuugu

SEQ ID NO: 16295 - RNA, 22 nt, Human
ggugcagucuggggcacauuau

SEQ ID NO: 16296 - RNA, 22 nt, Human
ggugcuggggaaauuaggguag

SEQ ID NO: 16297 - RNA, 22 nt, Human
ggugcuuuucacaagcauggga

SEQ ID NO: 16298 - RNA, 22 nt, Human
gguggagacucagauuuguugc

SEQ ID NO: 16299 - RNA, 22 nt, Human
gguggcagaggaggcgggagag

SEQ ID NO: 16300 - RNA, 22 nt, Human
gguggcauguaccucacagacu

SEQ ID NO: 16301 - RNA, 22 nt, Human
gguggcauucaguaaguauaua

SEQ ID NO: 16302 - RNA, 22 nt, Human
gguggccuaacaaugguggcaa

SEQ ID NO: 16303 - RNA, 22 nt, Human
gguggcuugcugguaggugugc

SEQ ID NO: 16304 - RNA, 22 nt, Human
ggugggaauccaggccuucauc

SEQ ID NO: 16305 - RNA, 22 nt, Human
gguggggacuuggggucagcgg

SEQ ID NO: 16306 - RNA, 22 nt, Human
gguggucaggagcgcccguugg

SEQ ID NO: 16307 - RNA, 22 nt, Human
ggugguucagugguuagggcca

SEQ ID NO: 16308 - RNA, 22 nt, Human
gguguacuucacucuuaccuag

SEQ ID NO: 16309 - RNA, 22 nt, Human
gguguagagaaaauaguuguau

SEQ ID NO: 16310 - RNA, 22 nt, Human
gguguagggaaacuugacuaau

SEQ ID NO: 16311 - RNA, 22 nt, Human
gguguauucuccaguuuuagca

SEQ ID NO: 16312 - RNA, 22 nt, Human
ggugucagccacuuugucggag

SEQ ID NO: 16313 - RNA, 22 nt, Human
ggugucaucugggcuggagaua

SEQ ID NO: 16314 - RNA, 22 nt, Human
ggugucuuugauguugggcuga

SEQ ID NO: 16315 - RNA, 22 nt, Human
ggugugaauagagccuggagca

SEQ ID NO: 16316 - RNA, 22 nt, Human
gguguggcaguggaccugugaa

SEQ ID NO: 16317 - RNA, 22 nt, Human
ggugugggcagaugcccuacuu

SEQ ID NO: 16318 - RNA, 22 nt, Human
gguguggguguuaguuugcuua

SEQ ID NO: 16319 - RNA, 22 nt, Human
gguguguaggugaaggccaaga

SEQ ID NO: 16320 - RNA, 22 nt, Human
gguguuccgguucugcucuggg

SEQ ID NO: 16321 - RNA, 22 nt, Human
gguuauuucugauuauaugaua

SEQ ID NO: 16322 - RNA, 22 nt, Human
gguucaaagccugaugggguug

SEQ ID NO: 16323 - RNA, 22 nt, Human
gguucuggaaaagaaagcaaag

SEQ ID NO: 16324 - RNA, 22 nt, Human
gguugauuuuuaugaagccaug

SEQ ID NO: 16325 - RNA, 22 nt, Human
gguugccuguggcucccuguua

SEQ ID NO: 16326 - RNA, 22 nt, Human
gguugcggaccagcugggcugc

SEQ ID NO: 16327 - RNA, 23 nt, Human
gguuggcuguacccaggcucccu

SEQ ID NO: 16328 - RNA, 22 nt, Human
gguugggauuauccaaggcaga

SEQ ID NO: 16329 - RNA, 21 nt, Human
gguuucugcaaaccuuguaca

SEQ ID NO: 16330 - RNA, 22 nt, Human
gguuucuuuccucucugugccu

SEQ ID NO: 16331 - RNA, 22 nt, Human
gguuugggaagaacuauucccu

SEQ ID NO: 16332 - RNA, 22 nt, Human
gguuuucacgauccucccuuuu

SEQ ID NO: 16333 - RNA, 22 nt, Human
gguuuucuuguucauuuuuuaa

SEQ ID NO: 16334 - RNA, 22 nt, Human
guaaauacuaugagauaaugaa

SEQ ID NO: 16335 - RNA, 22 nt, Human
guaaaucccucucuuuguagau

SEQ ID NO: 16336 - RNA, 22 nt, Human
guaacuuuuuccucauuggcua

SEQ ID NO: 16337 - RNA, 22 nt, Human
guaaggcaggagucuuaaaccu

SEQ ID NO: 16338 - RNA, 22 nt, Human
guaagguuggaugcaaucaacu

SEQ ID NO: 16339 - RNA, 22 nt, Human
guaauaggagggagucugcuuu

SEQ ID NO: 16340 - RNA, 22 nt, Human
guaauugcucauauggcaccug

SEQ ID NO: 16341 - RNA, 22 nt, Human
guacaaagucaaggugaaaaua

SEQ ID NO: 16342 - RNA, 22 nt, Human
guacauauccuuuacguuuugu

SEQ ID NO: 16343 - RNA, 22 nt, Human
guaccuuucuaucuagaaggua

SEQ ID NO: 16344 - RNA, 22 nt, Human
guacuacagguuugguaguggg

SEQ ID NO: 16345 - RNA, 17 nt, Human
auuguuuuuaauuugca

SEQ ID NO: 16346 - RNA, 22 nt, Human
auuuaagugagucuuuaaaaua

SEQ ID NO: 16347 - RNA, 22 nt, Human
auuuacugagguaaauaaacug

SEQ ID NO: 16348 - RNA, 22 nt, Human
auuuagagaaguagcaaggucc

SEQ ID NO: 16349 - RNA, 22 nt, Human
auuuaggacagugucugaauug

SEQ ID NO: 16350 - RNA, 22 nt, Human
auuuauauauuuuguucuggua

SEQ ID NO: 16351 - RNA, 22 nt, Human
auuuauccuugggguagagcca

SEQ ID NO: 16352 - RNA, 22 nt, Human
auuuaucugcucuucgcguuga

SEQ ID NO: 16353 - RNA, 22 nt, Human
auuuauuugaagagccauugca

SEQ ID NO: 16354 - RNA, 22 nt, Human
auuuauuuucccucaaguaccu

SEQ ID NO: 16355 - RNA, 22 nt, Human
auuucacucuuaauugcuuccu

SEQ ID NO: 16356 - RNA, 22 nt, Human
auuucagaaugaaaggaaaaau

SEQ ID NO: 16357 - RNA, 22 nt, Human
auuucaguuugcaguuucucuc

SEQ ID NO: 16358 - RNA, 22 nt, Human
auuucauaaaaacuuuaccuga

SEQ ID NO: 16359 - RNA, 22 nt, Human
auuucauccauuaagaguacuc

SEQ ID NO: 16360 - RNA, 22 nt, Human
auuuccagcagcauauuugucu

SEQ ID NO: 16361 - RNA, 22 nt, Human
auuucccugcagugcuuaggaa

SEQ ID NO: 16362 - RNA, 17 nt, Human
auuuccgaguuucuuuc

SEQ ID NO: 16363 - RNA, 19 nt, Human
auuuccuggcauauaucac

SEQ ID NO: 16364 - RNA, 22 nt, Human
auuucuguaauucugaggagug

SEQ ID NO: 16365 - RNA, 22 nt, Human
auuugaaaaucuaugaugugca

SEQ ID NO: 16366 - RNA, 22 nt, Human
auuugcauguuuauuucuuaga

SEQ ID NO: 16367 - RNA, 22 nt, Human
auuugccaguuacucacaccac

SEQ ID NO: 16368 - RNA, 22 nt, Human
auuugcuuguucaccaguacuu

SEQ ID NO: 16369 - RNA, 22 nt, Human
auuuggaaacaugcugaccaug

SEQ ID NO: 16370 - RNA, 21 nt, Human
auuuggucaaugucugcguga

SEQ ID NO: 16371 - RNA, 22 nt, Human
auuuggucuacauuuuccaaau

SEQ ID NO: 16372 - RNA, 22 nt, Human
auuuggucuguaauuacaugga

SEQ ID NO: 16373 - RNA, 18 nt, Human
auuuguggggguuauaga

SEQ ID NO: 16374 - RNA, 21 nt, Human
auuuguggugcaauuguggua

SEQ ID NO: 16375 - RNA, 22 nt, Human
auuuuaccauuaguuuguaaua

SEQ ID NO: 16376 - RNA, 22 nt, Human
auuuuacuaugauaguugagaa

SEQ ID NO: 16377 - RNA, 22 nt, Human
auuuuauuuugggaucuuuuua

SEQ ID NO: 16378 - RNA, 22 nt, Human
auuuucauauggguuauuugua

SEQ ID NO: 16379 - RNA, 22 nt, Human
auuuucuucauuuugauuguau

SEQ ID NO: 16380 - RNA, 22 nt, Human
auuuugcaguuuauugccaauc

SEQ ID NO: 16381 - RNA, 22 nt, Human
auuuugcuuuucuaguggguuu

SEQ ID NO: 16382 - RNA, 22 nt, Human
auuuuguugaaacccuuguugu

SEQ ID NO: 16383 - RNA, 22 nt, Human
auuuuuagucuugcugcaauca

SEQ ID NO: 16384 - RNA, 22 nt, Human
auuuuuaucuaaaauccacuuu

SEQ ID NO: 16385 - RNA, 21 nt, Human
auuuuucagaaggaugugaua

SEQ ID NO: 16386 - RNA, 22 nt, Human
auuuuucuuucacauuuucuua

SEQ ID NO: 16387 - RNA, 22 nt, Human
auuuuugguuauaaaauaguuu

SEQ ID NO: 16388 - RNA, 22 nt, Human
auuuuugugcuuuauuggggua

SEQ ID NO: 16389 - RNA, 22 nt, Human
auuuuugugucacaucuaggaa

SEQ ID NO: 16390 - RNA, 22 nt, Human
auuuuuucaugugugguugaga

SEQ ID NO: 16391 - RNA, 22 nt, Human
auuuuuuuaggcugucagccgc

SEQ ID NO: 16392 - RNA, 22 nt, Human
auuuuuuuggucauaugagaua

SEQ ID NO: 16393 - RNA, 22 nt, Human
auuuuuuuuccugucucuuuca

SEQ ID NO: 16394 - RNA, 22 nt, Human
caaaacauucagagagcucacu

SEQ ID NO: 16395 - RNA, 22 nt, Human
caaaacccaagugcuauugcaa

SEQ ID NO: 16396 - RNA, 22 nt, Human
caaaagcaaagaucuuugauug

SEQ ID NO: 16397 - RNA, 22 nt, Human
cagacugugagcuccuugaggg

SEQ ID NO: 16398 - RNA, 23 nt, Human
cagagaaaauagaauaugcugug

SEQ ID NO: 16399 - RNA, 22 nt, Human
cagagacuuuugcuccgauucu

SEQ ID NO: 16400 - RNA, 22 nt, Human
cagagaugaggcuggcgugguu

SEQ ID NO: 16401 - RNA, 22 nt, Human
cagagccagcuguccuuggcau

SEQ ID NO: 16402 - RNA, 22 nt, Human
cagagcugucauuugccaguga

SEQ ID NO: 16403 - RNA, 22 nt, Human
cagaggagcgaguuggacgcca

SEQ ID NO: 16404 - RNA, 22 nt, Human
cagaggaugucuacaccuugag

SEQ ID NO: 16405 - RNA, 22 nt, Human
cagaggcugagcugcgggauga

SEQ ID NO: 16406 - RNA, 22 nt, Human
cagagggagcuaaccagcagcc

SEQ ID NO: 16407 - RNA, 22 nt, Human
cagaguaaugugauuuccaugu

SEQ ID NO: 16408 - RNA, 22 nt, Human
cagauagccugguccuaacaug

SEQ ID NO: 16409 - RNA, 22 nt, Human
cagauggaguuaguuucuaaca

SEQ ID NO: 16410 - RNA, 22 nt, Human
cagauguuugaaugcuuaccac

SEQ ID NO: 16411 - RNA, 22 nt, Human
cagcacaggugugaggccugau

SEQ ID NO: 16412 - RNA, 22 nt, Human
cagcacugcccuaccccuccac

SEQ ID NO: 16413 - RNA, 22 nt, Human
cagcacuuccuccgugagcccc

SEQ ID NO: 16414 - RNA, 22 nt, Human
cagcagaugacuauuggagcug

SEQ ID NO: 16415 - RNA, 21 nt, Human
cagcagaugccagggucucug

SEQ ID NO: 16416 - RNA, 22 nt, Human
cagcaugcaaguccagaugugg

SEQ ID NO: 16417 - RNA, 18 nt, Human
cagcauuagcagcuucca

SEQ ID NO: 16418 - RNA, 22 nt, Human
cagcauucuacuuugugaacug

SEQ ID NO: 16419 - RNA, 22 nt, Human
cagcauugagcacagaaggaaa

SEQ ID NO: 16420 - RNA, 22 nt, Human
cagccauucuaacacugccagu

SEQ ID NO: 16421 - RNA, 22 nt, Human
cagcccaucaaggggauccuga

SEQ ID NO: 16422 - RNA, 22 nt, Human
cagccccagcacuuagcugagu

SEQ ID NO: 16423 - RNA, 22 nt, Human
cagccccaguuuucauaagacu

SEQ ID NO: 16424 - RNA, 22 nt, Human
cagccccgcuggccucgccucc

SEQ ID NO: 16425 - RNA, 22 nt, Human
cagcccugagagaaccaucuau

SEQ ID NO: 16426 - RNA, 22 nt, Human
cagccuacaucagaauaccaau

SEQ ID NO: 16427 - RNA, 22 nt, Human
cagccuggccucuggauauuug

SEQ ID NO: 16428 - RNA, 22 nt, Human
cagccuuuucuuaaaaugcaag

SEQ ID NO: 16429 - RNA, 22 nt, Human
cagcgguggcaaggugacugug

SEQ ID NO: 16430 - RNA, 22 nt, Human
cagcuauuguucuguauaauga

SEQ ID NO: 16431 - RNA, 22 nt, Human
cagcuccagcccaggcagcucc

SEQ ID NO: 16432 - RNA, 22 nt, Human
cagcuccaucuugcuuauacca

SEQ ID NO: 16433 - RNA, 22 nt, Human
cagcucgaauaauggagaacug

SEQ ID NO: 16434 - RNA, 22 nt, Human
cagcucuccacccuccugguuc

SEQ ID NO: 16435 - RNA, 22 nt, Human
cagcucuggcuauugaggacca

SEQ ID NO: 16436 - RNA, 22 nt, Human
cagcugacaagaguccuuggag

SEQ ID NO: 16437 - RNA, 22 nt, Human
cagcugcgcagcgccgggccug

SEQ ID NO: 16438 - RNA, 22 nt, Human
cagcugcugguguaucgggucc

SEQ ID NO: 16439 - RNA, 22 nt, Human
cagcuggggagagacauggcag

SEQ ID NO: 16440 - RNA, 22 nt, Human
cagcuguacgugaucuacaugg

SEQ ID NO: 16441 - RNA, 22 nt, Human
cagcuucaaaggcccugauggu

SEQ ID NO: 16442 - RNA, 22 nt, Human
cagcuucacuuaaaacaugcaa

SEQ ID NO: 16443 - RNA, 22 nt, Human
cagcuucaugacaaacaguuuu

SEQ ID NO: 16444 - RNA, 22 nt, Human
cagcuucuccauucuucuggcu

SEQ ID NO: 16445 - RNA, 22 nt, Human
cagcuuguucugaccugugauu

SEQ ID NO: 16446 - RNA, 22 nt, Human
cagcuuuugcagacuucuugcc

SEQ ID NO: 16447 - RNA, 22 nt, Human
caggaacagcaccaggagcuag

SEQ ID NO: 16448 - RNA, 22 nt, Human
caggaacucuucugggugcuug

SEQ ID NO: 16449 - RNA, 22 nt, Human
caggaagagaacugcucagccu

SEQ ID NO: 16450 - RNA, 22 nt, Human
caggacacagacacuaaauaua

SEQ ID NO: 16451 - RNA, 22 nt, Human
caggacccaaccucccugcucu

SEQ ID NO: 16452 - RNA, 22 nt, Human
caggacccaacggugcaauguc

SEQ ID NO: 16453 - RNA, 22 nt, Human
caggacuuccucuaugguggcg

SEQ ID NO: 16454 - RNA, 22 nt, Human
caggaggaaaguuccacucaac

SEQ ID NO: 16455 - RNA, 22 nt, Human
caggaggugugucccaccgggu

SEQ ID NO: 16456 - RNA, 22 nt, Human
caggaguggugagguuagcaga

SEQ ID NO: 16457 - RNA, 22 nt, Human
caggauauguucaagguuuucu

SEQ ID NO: 16458 - RNA, 22 nt, Human
caggaucccuggccuccgccca

SEQ ID NO: 16459 - RNA, 22 nt, Human
caggcacaaugagcgccaucuu

SEQ ID NO: 16460 - RNA, 22 nt, Human
gugcagcugggcgcugaccuuc

SEQ ID NO: 16461 - RNA, 22 nt, Human
gugcaucuguaauuacaauggu

SEQ ID NO: 16462 - RNA, 22 nt, Human
gugccaaauagcuugauuaaga

SEQ ID NO: 16463 - RNA, 22 nt, Human
gugccaccagaugcuguugcua

SEQ ID NO: 16464 - RNA, 22 nt, Human
gugcccaguugaggccaggacu

SEQ ID NO: 16465 - RNA, 22 nt, Human
gugccgaugaggccuggcauuc

SEQ ID NO: 16466 - RNA, 22 nt, Human
gugccuggaaucuuuucuucac

SEQ ID NO: 16467 - RNA, 22 nt, Human
gugcgaaagaagcgacuccagu

SEQ ID NO: 16468 - RNA, 20 nt, Human
gugcggcucuaccacucggu

SEQ ID NO: 16469 - RNA, 22 nt, Human
gugcuaugugcugaacucaggu

SEQ ID NO: 16470 - RNA, 22 nt, Human
gugcucaagacauuaggaauau

SEQ ID NO: 16471 - RNA, 22 nt, Human
gugcucaucuucuguaacuguu

SEQ ID NO: 16472 - RNA, 22 nt, Human
gugcucgagcugugcgcgcugc

SEQ ID NO: 16473 - RNA, 22 nt, Human
gugcucuauguugauuccuuga

SEQ ID NO: 16474 - RNA, 22 nt, Human
gugcuggcaaagagaacaucuu

SEQ ID NO: 16475 - RNA, 22 nt, Human
gugcugggaggcccaggaugga

SEQ ID NO: 16476 - RNA, 22 nt, Human
gugcugucguggaacugggcug

SEQ ID NO: 16477 - RNA, 22 nt, Human
gugcuugaguaaaaauagucuu

SEQ ID NO: 16478 - RNA, 22 nt, Human
guggaagggaaaccgcacuggc

SEQ ID NO: 16479 - RNA, 22 nt, Human
guggacuuuggucugugccauc

SEQ ID NO: 16480 - RNA, 22 nt, Human
guggagaugagauauaccccuu

SEQ ID NO: 16481 - RNA, 22 nt, Human
guggaguggguuguacucaggg

SEQ ID NO: 16482 - RNA, 22 nt, Human
guggauuucaggcuccccucag

SEQ ID NO: 16483 - RNA, 22 nt, Human
guggcagagagcaagugucuga

SEQ ID NO: 16484 - RNA, 22 nt, Human
guggcagguguacagcucagcu

SEQ ID NO: 16485 - RNA, 22 nt, Human
guggcaguaaagcuggaaaagu

SEQ ID NO: 16486 - RNA, 20 nt, Human
guggcagugguggcagcagu

SEQ ID NO: 16487 - RNA, 22 nt, Human
guggcauggggagcagcuagaa

SEQ ID NO: 16488 - RNA, 22 nt, Human
guggccaaggcagagaaagagc

SEQ ID NO: 16489 - RNA, 18 nt, Human
guggccauugaccagcuu

SEQ ID NO: 16490 - RNA, 22 nt, Human
guggccugacagaucggaacag

SEQ ID NO: 16491 - RNA, 22 nt, Human
guggcgucgaugauggugucau

SEQ ID NO: 16492 - RNA, 22 nt, Human
guggcuggguggaacugagucu

SEQ ID NO: 16493 - RNA, 22 nt, Human
guggcuuaauauuuauagcaga

SEQ ID NO: 16494 - RNA, 22 nt, Human
guggcuuauguccagcagauau

SEQ ID NO: 16495 - RNA, 22 nt, Human
guggcuuucuaccauuaaauug

SEQ ID NO: 16496 - RNA, 22 nt, Human
guggcuuuguuuccaaaugaaa

SEQ ID NO: 16497 - RNA, 22 nt, Human
gugggaaacagccuugcuucua

SEQ ID NO: 16498 - RNA, 22 nt, Human
gugggagaaugggaggaguaau

SEQ ID NO: 16499 - RNA, 22 nt, Human
gugggaggaguguugaguaagu

SEQ ID NO: 16500 - RNA, 22 nt, Human
gugggagggaguccugggagca

SEQ ID NO: 16501 - RNA, 22 nt, Human
gugggaguggagcucagcaugu

SEQ ID NO: 16502 - RNA, 18 nt, Human
gugggcacacacucuguu

SEQ ID NO: 16503 - RNA, 22 nt, Human
gugggcacguccuacugucacu

SEQ ID NO: 16504 - RNA, 22 nt, Human
gugggccaguuccucacaggua

SEQ ID NO: 16505 - RNA, 22 nt, Human
gugggcccaagcagcggcggcc

SEQ ID NO: 16506 - RNA, 22 nt, Human
caguuuuauacacugcagcucc

SEQ ID NO: 16507 - RNA, 22 nt, Human
caguuuuucaaaauuacaugau

SEQ ID NO: 16508 - RNA, 22 nt, Human
cauaaauuuuaccuuguaagug

SEQ ID NO: 16509 - RNA, 22 nt, Human
cauaagaauauuuaguggcagc

SEQ ID NO: 16510 - RNA, 22 nt, Human
cauaaucaagggguugugaugu

SEQ ID NO: 16511 - RNA, 22 nt, Human
cauacauguuagcaguagccuu

SEQ ID NO: 16512 - RNA, 22 nt, Human
cauagcauguguuuauuuucuu

SEQ ID NO: 16513 - RNA, 22 nt, Human
cauagcguuuacauguggauua

SEQ ID NO: 16514 - RNA, 22 nt, Human
cauagcuagcaccuucuuuucu

SEQ ID NO: 16515 - RNA, 22 nt, Human
cauaggugguagaauggggaga

SEQ ID NO: 16516 - RNA, 22 nt, Human
cauaguuuguucuuuuuuauug

SEQ ID NO: 16517 - RNA, 22 nt, Human
cauaucuuaaacaucaucucug

SEQ ID NO: 16518 - RNA, 23 nt, Human
cauauucagaaacaccuaguggu

SEQ ID NO: 16519 - RNA, 22 nt, Human
caucaacagucuacuuuuugcc

SEQ ID NO: 16520 - RNA, 22 nt, Human
caucaauagguauuugagagac

SEQ ID NO: 16521 - RNA, 22 nt, Human
caucaggcugggaacacagauc

SEQ ID NO: 16522 - RNA, 22 nt, Human
caucagucugaaagccagggag

SEQ ID NO: 16523 - RNA, 22 nt, Human
caucauuuggcuuuagggccug

SEQ ID NO: 16524 - RNA, 22 nt, Human
cauccagagcugccugaccccg

SEQ ID NO: 16525 - RNA, 22 nt, Human
cauccagcuccugggggccacc

SEQ ID NO: 16526 - RNA, 22 nt, Human
cauccagggguacccuggagcc

SEQ ID NO: 16527 - RNA, 22 nt, Human
caucuccaagucuguaagcagu

SEQ ID NO: 16528 - RNA, 22 nt, Human
caugaagugaaaagguuaauuu

SEQ ID NO: 16529 - RNA, 22 nt, Human
caugaccauuuggguuugugcg

SEQ ID NO: 16530 - RNA, 22 nt, Human
caugagaguaaccuagagaaga

SEQ ID NO: 16531 - RNA, 22 nt, Human
caugaggauccuccaggggaaa

SEQ ID NO: 16532 - RNA, 22 nt, Human
caugauaacacuucuguuuaau

SEQ ID NO: 16533 - RNA, 22 nt, Human
caugauguuaucaagcacaaag

SEQ ID NO: 16534 - RNA, 22 nt, Human
caugauucccacauugcgauca

SEQ ID NO: 16535 - RNA, 22 nt, Human
caugcagauugccaggcucccu

SEQ ID NO: 16536 - RNA, 22 nt, Human
caugcagcagaauaaugacuau

SEQ ID NO: 16537 - RNA, 22 nt, Human
caugccugaucagcggccagca

SEQ ID NO: 16538 - RNA, 22 nt, Human
caugcuucccacauuccgauuu

SEQ ID NO: 16539 - RNA, 22 nt, Human
cauggccaaagaauuauauuuu

SEQ ID NO: 16540 - RNA, 22 nt, Human
cauggcggcgcucucccugccu

SEQ ID NO: 16541 - RNA, 19 nt, Human
cauggcgguaaagaggcug

SEQ ID NO: 16542 - RNA, 22 nt, Human
caugggaaauauaagaauuuuc

SEQ ID NO: 16543 - RNA, 22 nt, Human
caugggcucuucuggacugcac

SEQ ID NO: 16544 - RNA, 21 nt, Human
caugguaaguacaaagaugac

SEQ ID NO: 16545 - RNA, 22 nt, Human
caugguaccuagccucauggau

SEQ ID NO: 16546 - RNA, 22 nt, Human
cauguaaguucacagucgaugu

SEQ ID NO: 16547 - RNA, 22 nt, Human
caugucaagacugaagauccag

SEQ ID NO: 16548 - RNA, 22 nt, Human
caugugcaucagccaauuggag

SEQ ID NO: 16549 - RNA, 22 nt, Human
caugugguauugugagauccac

SEQ ID NO: 16550 - RNA, 22 nt, Human
cauguguauuauucuuguggaa

SEQ ID NO: 16551 - RNA, 22 nt, Human
cauuacaagaaauagcauaaug

SEQ ID NO: 16552 - RNA, 22 nt, Human
cauuaccuggggagaggauacc

SEQ ID NO: 16553 - RNA, 22 nt, Human
cauuagggucuuuagacagcuc

SEQ ID NO: 16554 - RNA, 22 nt, Human
cauuauacaugaagacucaccc

SEQ ID NO: 16555 - RNA, 22 nt, Human
cauuauucaggcuuuggaauuu

SEQ ID NO: 16556 - RNA, 22 nt, Human
cauucauaagacuuugcucuug

SEQ ID NO: 16557 - RNA, 22 nt, Human
cauucauagaaucaguuuggga

SEQ ID NO: 16558 - RNA, 22 nt, Human
cauuccaagaaguaguucugca

SEQ ID NO: 16559 - RNA, 22 nt, Human
cauuccccaacucaacagggcu

SEQ ID NO: 16560 - RNA, 20 nt, Human
cauuccugaggaauucaugu

SEQ ID NO: 16561 - RNA, 22 nt, Human
cauuccuucucagguacuggca

SEQ ID NO: 16562 - RNA, 22 nt, Human
cauugcaaccccaaaaagaaca

SEQ ID NO: 16563 - RNA, 22 nt, Human
cauugcaucuuuuauggguaag

SEQ ID NO: 16564 - RNA, 22 nt, Human
cauugcugccaaggugagcugg

SEQ ID NO: 16565 - RNA, 22 nt, Human
cauugcugugggcauuugcugc

SEQ ID NO: 16566 - RNA, 22 nt, Human
cauugcuguuaauugucucuag

SEQ ID NO: 16567 - RNA, 22 nt, Human
cauugucaaguggccgggucuu

SEQ ID NO: 16568 - RNA, 22 nt, Human
cauuuacauaacaguaacgcug

SEQ ID NO: 16569 - RNA, 22 nt, Human
cauuuagagaagauuacaagga

SEQ ID NO: 16570 - RNA, 22 nt, Human
cauuuaucacuugcuaaacaua

SEQ ID NO: 16571 - RNA, 22 nt, Human
cauuuuaucagcacacgucacu

SEQ ID NO: 16572 - RNA, 22 nt, Human
cauuuuccucugcugguguuca

SEQ ID NO: 16573 - RNA, 22 nt, Human
guucuacaugacacucaacauu

SEQ ID NO: 16574 - RNA, 22 nt, Human
guucuaguauuugccuuaggau

SEQ ID NO: 16575 - RNA, 17 nt, Human
guucucaaacugacuga

SEQ ID NO: 16576 - RNA, 22 nt, Human
guucucauugugaugcuuaguu

SEQ ID NO: 16577 - RNA, 22 nt, Human
guucuguucuucacagguuugu

SEQ ID NO: 16578 - RNA, 22 nt, Human
guucuuagcacuucugcccauu

SEQ ID NO: 16579 - RNA, 22 nt, Human
guucuucucuuguaauggaauc

SEQ ID NO: 16580 - RNA, 22 nt, Human
guugagaaucucuagcuuagga

SEQ ID NO: 16581 - RNA, 22 nt, Human
guugagacguguauuggaaucu

SEQ ID NO: 16582 - RNA, 22 nt, Human
guugauauggaaacucuagguu

SEQ ID NO: 16583 - RNA, 22 nt, Human
guugcuaugaaauuaaaauuua

SEQ ID NO: 16584 - RNA, 21 nt, Human
guugcuccuucuuuuucuugc

SEQ ID NO: 16585 - RNA, 22 nt, Human
guugcuucuuggcuuuuccaac

SEQ ID NO: 16586 - RNA, 20 nt, Human
guugggagaagugucagcug

SEQ ID NO: 16587 - RNA, 22 nt, Human
guugggcugaagugugugcuua

SEQ ID NO: 16588 - RNA, 22 nt, Human
guuggggccuggagucucuugg

SEQ ID NO: 16589 - RNA, 22 nt, Human
guugggguuucaguggcaguca

SEQ ID NO: 16590 - RNA, 22 nt, Human
guuggguaauuaagcacagaaa

SEQ ID NO: 16591 - RNA, 22 nt, Human
guugucuggcucugaccauucu

SEQ ID NO: 16592 - RNA, 22 nt, Human
guugugcaaaacaggaaggucu

SEQ ID NO: 16593 - RNA, 19 nt, Human
guuguguuugguucuuuug

SEQ ID NO: 16594 - RNA, 22 nt, Human
guuguuaagugcugguuguuag

SEQ ID NO: 16595 - RNA, 22 nt, Human
guuguuagccucacauuuagga

SEQ ID NO: 16596 - RNA, 22 nt, Human
guuguuuucagcccagcauuag

SEQ ID NO: 16597 - RNA, 22 nt, Human
guuguuuuuguuaaaacaguga

SEQ ID NO: 16598 - RNA, 22 nt, Human
guuuaaaagcaaccaacaggcu

SEQ ID NO: 16599 - RNA, 22 nt, Human
guuuaaguuaaaauuuaccugc

SEQ ID NO: 16600 - RNA, 22 nt, Human
guuuacaacaucuuguccuuca

SEQ ID NO: 16601 - RNA, 22 nt, Human
guuuagauguagauucucuggu

SEQ ID NO: 16602 - RNA, 22 nt, Human
guuuauucuuuuauuugugaga

SEQ ID NO: 16603 - RNA, 22 nt, Human
guuuauuucuuaucaucacuau

SEQ ID NO: 16604 - RNA, 22 nt, Human
guuuccaggcuuugguaugguu

SEQ ID NO: 16605 - RNA, 22 nt, Human
guuuccuuuugugguuuuucua

SEQ ID NO: 16606 - RNA, 22 nt, Human
guuugagcaaucccucuauccc

SEQ ID NO: 16607 - RNA, 22 nt, Human
guuugcagacuauguaaacuuc

SEQ ID NO: 16608 - RNA, 22 nt, Human
guuuggguggcuagagaaagaa

SEQ ID NO: 16609 - RNA, 22 nt, Human
guuuguuugccagcuuaguaaa

SEQ ID NO: 16610 - RNA, 22 nt, Human
guuuuaaucuccuuauuccuaa

SEQ ID NO: 16611 - RNA, 22 nt, Human
guuuuagugauaagaacaccaa

SEQ ID NO: 16612 - RNA, 22 nt, Human
guuuuauaacuauagugagaau

SEQ ID NO: 16613 - RNA, 22 nt, Human
guuuuauguuuuauagacacaa

SEQ ID NO: 16614 - RNA, 22 nt, Human
guuuugaagagaagcaagucug

SEQ ID NO: 16615 - RNA, 22 nt, Human
uagaagagcuuccaccuggggc

SEQ ID NO: 16616 - RNA, 22 nt, Human
uagaagaugccuuaaaguugaa

SEQ ID NO: 16617 - RNA, 22 nt, Human
uagaaugggaggggaaucaucc

SEQ ID NO: 16618 - RNA, 22 nt, Human
uagacauuuacuuugaaaaaau

SEQ ID NO: 16619 - RNA, 21 nt, Human
uagaccagcugugcuccucgg

SEQ ID NO: 16620 - RNA, 22 nt, Human
uagaccuaguacacguccuuua

SEQ ID NO: 16621 - RNA, 22 nt, Human
uagaccuccagcggaggagauu

SEQ ID NO: 16622 - RNA, 22 nt, Human
uagaccugugggggcagcgggc

SEQ ID NO: 16623 - RNA, 19 nt, Human
uagacuaauucauccccuu

SEQ ID NO: 16624 - RNA, 22 nt, Human
uagacugagcuccuugaggaca

SEQ ID NO: 16625 - RNA, 22 nt, Human
uagacuggaagcuccuugaggc

SEQ ID NO: 16626 - RNA, 22 nt, Human
uagagaaauauuuguagugcug

SEQ ID NO: 16627 - RNA, 22 nt, Human
uagagaaauuacagcuuucuuu

SEQ ID NO: 16628 - RNA, 22 nt, Human
uagagagaaaccaggguuuggg

SEQ ID NO: 16629 - RNA, 19 nt, Human
uagagcagcuucagauucc

SEQ ID NO: 16630 - RNA, 22 nt, Human
uagagcccucuggccacguugc

SEQ ID NO: 16631 - RNA, 22 nt, Human
uagagcucaagaagcaaaagcu

SEQ ID NO: 16632 - RNA, 19 nt, Human
uagaggagaauggcaaaga

SEQ ID NO: 16633 - RNA, 22 nt, Human
uagaggauucuaaaggaagcug

SEQ ID NO: 16634 - RNA, 22 nt, Human
uagaggccguagguggcugguu

SEQ ID NO: 16635 - RNA, 22 nt, Human
uagaggcuagugguuaugaccu

SEQ ID NO: 16636 - RNA, 22 nt, Human
uagaguaagugugugcugagcu

SEQ ID NO: 16637 - RNA, 22 nt, Human
uagaguauuuguuuacuaaguu

SEQ ID NO: 16638 - RNA, 22 nt, Human
uagaucccauugguugguuggu

SEQ ID NO: 16639 - RNA, 22 nt, Human
uagaugcugagcuuaagagaau

SEQ ID NO: 16640 - RNA, 22 nt, Human
uagaugguguccagaaagagaa

SEQ ID NO: 16641 - RNA, 19 nt, Human
uagauuagagcauaggguu

SEQ ID NO: 16642 - RNA, 22 nt, Human
uagauuccaaaauaguuugguu

SEQ ID NO: 16643 - RNA, 22 nt, Human
uagauuguaagcuccuugaggg

SEQ ID NO: 16644 - RNA, 22 nt, Human
uagcaaugugggugggcuccaa

SEQ ID NO: 16645 - RNA, 22 nt, Human
uagcacauaguaggcacaggcu

SEQ ID NO: 16646 - RNA, 22 nt, Human
uagcaccuagaguauuuuauca

SEQ ID NO: 16647 - RNA, 20 nt, Human
uagcacuguauccucuucau

SEQ ID NO: 16648 - RNA, 22 nt, Human
uagcagcacuauuuguuguagu

SEQ ID NO: 16649 - RNA, 22 nt, Human
uagcaggaggcaguuccucgcu

SEQ ID NO: 16650 - RNA, 22 nt, Human
uagcauaaaguuucuguguggu

SEQ ID NO: 16651 - RNA, 22 nt, Human
uagcauccugugugaauguauu

SEQ ID NO: 16652 - RNA, 22 nt, Human
uagcauuuagaacaccuugaga

SEQ ID NO: 16653 - RNA, 22 nt, Human
uagccacagaauucugaguaga

SEQ ID NO: 16654 - RNA, 17 nt, Human
uagccagcuugugauuu

SEQ ID NO: 16655 - RNA, 22 nt, Human
uagcccgugaggaggggcugug

SEQ ID NO: 16656 - RNA, 22 nt, Human
uagccguugggguaacuggaca

SEQ ID NO: 16657 - RNA, 22 nt, Human
uagccucaagagauucagggac

SEQ ID NO: 16658 - RNA, 22 nt, Human
uagcguaugcugugugaugaau

SEQ ID NO: 16659 - RNA, 22 nt, Human
uagcguucuugcaugcuaaccu

SEQ ID NO: 16660 - RNA, 22 nt, Human
uagcuagacacucagggccuca

SEQ ID NO: 16661 - RNA, 22 nt, Human
uagcuaggugagcggcuccggc

SEQ ID NO: 16662 - RNA, 22 nt, Human
uagcuaguugguucuucucugu

SEQ ID NO: 16663 - RNA, 22 nt, Human
uagcugacagcagaagaguauu

SEQ ID NO: 16664 - RNA, 22 nt, Human
uagcugucauuggaucagaagg

SEQ ID NO: 16665 - RNA, 20 nt, Human
uagcuucaccuagagauagc

SEQ ID NO: 16666 - RNA, 22 nt, Human
uagcuucccagcuaaccauguc

SEQ ID NO: 16667 - RNA, 21 nt, Human
uagcuugaucauuuuauuucc

SEQ ID NO: 16668 - RNA, 21 nt, Human
uaggaacuguucugagugguc

SEQ ID NO: 16669 - RNA, 22 nt, Human
uaggaagagauuuucacauggc

SEQ ID NO: 16670 - RNA, 22 nt, Human
uaggaaugcagaugcauaauaa

SEQ ID NO: 16671 - RNA, 22 nt, Human
uaggagcagauggcagcaggug

SEQ ID NO: 16672 - RNA, 22 nt, Human
uaggauaacaauuuguaguuuc

SEQ ID NO: 16673 - RNA, 22 nt, Human
uaggauugguguauguagguuu

SEQ ID NO: 16674 - RNA, 22 nt, Human
uaggcaaguggaccagagguuu

SEQ ID NO: 16675 - RNA, 19 nt, Human
uaggcccugcgaauggcuu

SEQ ID NO: 16676 - RNA, 22 nt, Human
uaggccugcugaagagcaagcu

SEQ ID NO: 16677 - RNA, 22 nt, Human
uagggggagugugcugaagcca

SEQ ID NO: 16678 - RNA, 22 nt, Human
uaggggugaaggaucuaggaug

SEQ ID NO: 16679 - RNA, 21 nt, Human
uaggguacacuggcagagagc

SEQ ID NO: 16680 - RNA, 22 nt, Human
uagggucucccuuuaaucuaac

SEQ ID NO: 16681 - RNA, 22 nt, Human
uagguaguuuccuguuguuggg

SEQ ID NO: 16682 - RNA, 22 nt, Human
uagguauguuaacugugcaauu

SEQ ID NO: 16683 - RNA, 23 nt, Human
uaggucacacauugggugguugc

SEQ ID NO: 16684 - RNA, 22 nt, Human
uaggucugaggcugcaucuugg

SEQ ID NO: 16685 - RNA, 22 nt, Human
uaggugucuggacaacuuugua

SEQ ID NO: 16686 - RNA, 22 nt, Human
cauuuugguaauguucguuugc

SEQ ID NO: 16687 - RNA, 22 nt, Human
cauuuuuccucaggcaauuuga

SEQ ID NO: 16688 - RNA, 22 nt, Human
cauuuuuuuuccccuccuggua

SEQ ID NO: 16689 - RNA, 22 nt, Human
ccaaacauuucaaauuuagaga

SEQ ID NO: 16690 - RNA, 22 nt, Human
ccaaagaagcaaugagaauagu

SEQ ID NO: 16691 - RNA, 22 nt, Human
ccaaauuguuguuguuguuguu

SEQ ID NO: 16692 - RNA, 22 nt, Human
ccaaccaaagggccuaaggucu

SEQ ID NO: 16693 - RNA, 22 nt, Human
ccaaccaguuaucuccuaaggu

SEQ ID NO: 16694 - RNA, 22 nt, Human
ccaagagcuucccauagcuucu

SEQ ID NO: 16695 - RNA, 22 nt, Human
ccaagcguguuuaggaaaugcu

SEQ ID NO: 16696 - RNA, 22 nt, Human
ccaaggcuguggggcugugcag

SEQ ID NO: 16697 - RNA, 22 nt, Human
ccaaggugcagcccauggugaa

SEQ ID NO: 16698 - RNA, 22 nt, Human
ccaaucaacuguguggcuuucu

SEQ ID NO: 16699 - RNA, 21 nt, Human
ccacaauucuaguuacauaug

SEQ ID NO: 16700 - RNA, 22 nt, Human
ccacagugauucacuuuugaag

SEQ ID NO: 16701 - RNA, 21 nt, Human
ccacaucaugucaccuccuag

SEQ ID NO: 16702 - RNA, 22 nt, Human
ccacccacuucucugcccucca

SEQ ID NO: 16703 - RNA, 22 nt, Human
ccacccuuccauucuuccucuu

SEQ ID NO: 16704 - RNA, 22 nt, Human
ccaccucuaccuggccggccuu

SEQ ID NO: 16705 - RNA, 22 nt, Human
ccacuacauugagugcuuucuc

SEQ ID NO: 16706 - RNA, 17 nt, Human
ccacuagauagguugug

SEQ ID NO: 16707 - RNA, 22 nt, Human
ccacuauaucaaggauuuuguu

SEQ ID NO: 16708 - RNA, 22 nt, Human
ccacucucucccucuguagggg

SEQ ID NO: 16709 - RNA, 20 nt, Human
ccacuucucugcucugccca

SEQ ID NO: 16710 - RNA, 19 nt, Human
ccacuucuuugugugugag

SEQ ID NO: 16711 - RNA, 22 nt, Human
ccagaacgacgggcagaggcgc

SEQ ID NO: 16712 - RNA, 22 nt, Human
ccagaacguuugugcgaggcag

SEQ ID NO: 16713 - RNA, 19 nt, Human
ccagaagggcaagcaaagg

SEQ ID NO: 16714 - RNA, 22 nt, Human
ccagacuggggcuccuugaggg

SEQ ID NO: 16715 - RNA, 22 nt, Human
ccagagcacaccguuugccuuc

SEQ ID NO: 16716 - RNA, 22 nt, Human
ccagagcaccgaaacgagcuuu

SEQ ID NO: 16717 - RNA, 22 nt, Human
ccagauaaacauuccuuggccu

SEQ ID NO: 16718 - RNA, 22 nt, Human
ccagcaagacucgcagugggau

SEQ ID NO: 16719 - RNA, 22 nt, Human
ccagcaaguaagucagugucag

SEQ ID NO: 16720 - RNA, 22 nt, Human
ccagcaggagacuagcaacaua

SEQ ID NO: 16721 - RNA, 22 nt, Human
ccagcaucagcucuuggcuggc

SEQ ID NO: 16722 - RNA, 22 nt, Human
ccagcaugcucagucuaaauug

SEQ ID NO: 16723 - RNA, 22 nt, Human
ccagccugagcuugcugcccuc

SEQ ID NO: 16724 - RNA, 22 nt, Human
uauauauaugcaccacaugugu

SEQ ID NO: 16725 - RNA, 22 nt, Human
uauaugaggauauuuuaaagcu

SEQ ID NO: 16726 - RNA, 22 nt, Human
uauaugcagauuuucaucaucg

SEQ ID NO: 16727 - RNA, 22 nt, Human
uauauuuguccuagcuccuagc

SEQ ID NO: 16728 - RNA, 22 nt, Human
uaucacauaaaugaggaauauu

SEQ ID NO: 16729 - RNA, 22 nt, Human
uaucaguagaacaauggacauu

SEQ ID NO: 16730 - RNA, 22 nt, Human
uaucaguccaggguuuugugac

SEQ ID NO: 16731 - RNA, 22 nt, Human
uauccaaaggaacaaucacagc

SEQ ID NO: 16732 - RNA, 22 nt, Human
uauccauaccuucaaguuugcu

SEQ ID NO: 16733 - RNA, 22 nt, Human
uauccaucuucuuugagaaugg

SEQ ID NO: 16734 - RNA, 23 nt, Human
uaucccauacagagagugguaca

SEQ ID NO: 16735 - RNA, 19 nt, Human
uaucccccauagcagugcg

SEQ ID NO: 16736 - RNA, 22 nt, Human
uauccuaagguaguuuuaguuu

SEQ ID NO: 16737 - RNA, 22 nt, Human
uaucuagguacacaucuccucu

SEQ ID NO: 16738 - RNA, 22 nt, Human
uaucugaugcaggcucccagga

SEQ ID NO: 16739 - RNA, 22 nt, Human
uaucugcuggagguaauuacuc

SEQ ID NO: 16740 - RNA, 22 nt, Human
uaucuguauuguagaacuguug

SEQ ID NO: 16741 - RNA, 22 nt, Human
uaucuucaauagcccagaugug

SEQ ID NO: 16742 - RNA, 22 nt, Human
uaucuuugccuuggguuuuguu

SEQ ID NO: 16743 - RNA, 22 nt, Human
uaugaaggauacaccucugauu

SEQ ID NO: 16744 - RNA, 22 nt, Human
uaugaauauaccacaauuuagg

SEQ ID NO: 16745 - RNA, 19 nt, Human
uaugacaaguacuaguucu

SEQ ID NO: 16746 - RNA, 22 nt, Human
uaugaccuuaggaagcaagaag

SEQ ID NO: 16747 - RNA, 22 nt, Human
uaugaggagaacauuccugaac

SEQ ID NO: 16748 - RNA, 22 nt, Human
uaugagugccaaguuaccuggg

SEQ ID NO: 16749 - RNA, 22 nt, Human
uaugaucuuaggauggaacuuc

SEQ ID NO: 16750 - RNA, 22 nt, Human
uaugauuuucaugguagaguua

SEQ ID NO: 16751 - RNA, 22 nt, Human
uaugcacacguguccaugugca

SEQ ID NO: 16752 - RNA, 22 nt, Human
uaugcagauaguuugccauuca

SEQ ID NO: 16753 - RNA, 22 nt, Human
uaugcauaauuggauaaguaga

SEQ ID NO: 16754 - RNA, 22 nt, Human
uaugcaucaguaugguuggaaa

SEQ ID NO: 16755 - RNA, 22 nt, Human
uaugccaccagucuggaacucu

SEQ ID NO: 16756 - RNA, 22 nt, Human
uaugccuaccuccaaaauauau

SEQ ID NO: 16757 - RNA, 20 nt, Human
uaugcgaagccuuucuggac

SEQ ID NO: 16758 - RNA, 22 nt, Human
uaugcgguccaucaggggcacu

SEQ ID NO: 16759 - RNA, 22 nt, Human
uaugcuguauucuguauguuag

SEQ ID NO: 16760 - RNA, 22 nt, Human
uauggcuaguguguuuguaaca

SEQ ID NO: 16761 - RNA, 22 nt, Human
uauggcucacaaauaauaaauu

SEQ ID NO: 16762 - RNA, 22 nt, Human
uauggcuucucagucaugaaaa

SEQ ID NO: 16763 - RNA, 22 nt, Human
uaugggaaggauuugucuuuca

SEQ ID NO: 16764 - RNA, 22 nt, Human
uaugguuucuccugcagauuug

SEQ ID NO: 16765 - RNA, 22 nt, Human
uauguaacaccauuuacaaagu

SEQ ID NO: 16766 - RNA, 22 nt, Human
uauguauguauguauguauaug

SEQ ID NO: 16767 - RNA, 22 nt, Human
uauguggcaggugggagaucag

SEQ ID NO: 16768 - RNA, 22 nt, Human
uaugugguuugucauuuaauau

SEQ ID NO: 16769 - RNA, 22 nt, Human
uauguguaauuaaauacuauag

SEQ ID NO: 16770 - RNA, 22 nt, Human
uauguuaaauguuugauguuua

SEQ ID NO: 16771 - RNA, 22 nt, Human
uauguugucuuguucagccaua

SEQ ID NO: 16772 - RNA, 22 nt, Human
uauuaaaagagaaaaagccacc

SEQ ID NO: 16773 - RNA, 22 nt, Human
uauuaauugugguuauuguauu

SEQ ID NO: 16774 - RNA, 22 nt, Human
uauuacugccacaucauuaggu

SEQ ID NO: 16775 - RNA, 18 nt, Human
uauuccucuuccucuauc

SEQ ID NO: 16776 - RNA, 22 nt, Human
uauugauuuuguugcuaccugg

SEQ ID NO: 16777 - RNA, 22 nt, Human
uauuggguagguccuuuggagu

SEQ ID NO: 16778 - RNA, 22 nt, Human
uauugguagauggagagagaca

SEQ ID NO: 16779 - RNA, 22 nt, Human
uauuguauuagcucuuggagau

SEQ ID NO: 16780 - RNA, 22 nt, Human
uauugucuuuuucuuccaccug

SEQ ID NO: 16781 - RNA, 22 nt, Human
uauugugaaggccaugugcuaa

SEQ ID NO: 16782 - RNA, 18 nt, Human
uauuuacuguguguuacc

SEQ ID NO: 16783 - RNA, 22 nt, Human
uauuuacuuugaggaaguuguu

SEQ ID NO: 16784 - RNA, 22 nt, Human
uauuucaguuaagaugagguca

SEQ ID NO: 16785 - RNA, 22 nt, Human
uauuuccugcguuucugugagc

SEQ ID NO: 16786 - RNA, 22 nt, Human
uauuucuagggcaugaaaauaa

SEQ ID NO: 16787 - RNA, 22 nt, Human
uauuuguauugucuuaucacuu

SEQ ID NO: 16788 - RNA, 18 nt, Human
uauuugugugugugugug

SEQ ID NO: 16789 - RNA, 22 nt, Human
uauuuguuuuuaaugcugggug

SEQ ID NO: 16790 - RNA, 22 nt, Human
uauuuuaaaagcauuaauucuu

SEQ ID NO: 16791 - RNA, 22 nt, Human
uauuuuauuuagguuuaguugu

SEQ ID NO: 16792 - RNA, 22 nt, Human
uauuuucucugccacacuucca

SEQ ID NO: 16793 - RNA, 22 nt, Human
uauuuuggaugcauugagaugc

SEQ ID NO: 16794 - RNA, 22 nt, Human
uauuuuggcuccugagcucuga

SEQ ID NO: 16795 - RNA, 22 nt, Human
uauuuuuaccuaauuuaugaga

SEQ ID NO: 16796 - RNA, 22 nt, Human
uauuuuucacagauuggugcuu

SEQ ID NO: 16797 - RNA, 22 nt, Human
ucaaaggcuugugguucuggga

SEQ ID NO: 16798 - RNA, 22 nt, Human
ucaacagaagugauagcuauua

SEQ ID NO: 16799 - RNA, 22 nt, Human
ucaacauguuuuuuaaaagaaa

SEQ ID NO: 16800 - RNA, 21 nt, Human
ucaaccagguguugaaggcac

SEQ ID NO: 16801 - RNA, 22 nt, Human
ucaaccucccugcucaccccuc

SEQ ID NO: 16802 - RNA, 22 nt, Human
ucaagaagauaaugucuagggu

SEQ ID NO: 16803 - RNA, 22 nt, Human
ucaagagauauaugcugguuua

SEQ ID NO: 16804 - RNA, 22 nt, Human
ucaagcaaggaauccuuuugua

SEQ ID NO: 16805 - RNA, 22 nt, Human
ucaagcacugugcaaugagcuu

SEQ ID NO: 16806 - RNA, 22 nt, Human
ucaagcuggaaaugaagaaucu

SEQ ID NO: 16807 - RNA, 22 nt, Human
ucaaggaagggguaggaauaau

SEQ ID NO: 16808 - RNA, 22 nt, Human
ucaagucaauagguuaguaggu

SEQ ID NO: 16809 - RNA, 21 nt, Human
ucaaguccuggcuuugcucuu

SEQ ID NO: 16810 - RNA, 22 nt, Human
ucaaguccuuggcauaggauaa

SEQ ID NO: 16811 - RNA, 23 nt, Human
ucacaaggcuauguuauauguac

SEQ ID NO: 16812 - RNA, 22 nt, Human
ucacacaucucagguguuuaau

SEQ ID NO: 16813 - RNA, 22 nt, Human
ucacagauguuauccugaggau

SEQ ID NO: 16814 - RNA, 21 nt, Human
ucacagggucacucuuaccac

SEQ ID NO: 16815 - RNA, 22 nt, Human
ucacagguuuaguccagcaguc

SEQ ID NO: 16816 - RNA, 22 nt, Human
ucacaucugugugauugucauu

SEQ ID NO: 16817 - RNA, 22 nt, Human
ucaccauguuuucauaggaaca

SEQ ID NO: 16818 - RNA, 22 nt, Human
ucacccagacugucugacucuu

SEQ ID NO: 16819 - RNA, 22 nt, Human
ucacccuguggcuauaaggcaa

SEQ ID NO: 16820 - RNA, 22 nt, Human
ucaccugccuggguggucaccu

SEQ ID NO: 16821 - RNA, 22 nt, Human
ucaccuguucaacagcaauaau

SEQ ID NO: 16822 - RNA, 22 nt, Human
ucaccuuuugaauugcuguugu

SEQ ID NO: 16823 - RNA, 22 nt, Human
ucacuagcaucugaauauuguu

SEQ ID NO: 16824 - RNA, 22 nt, Human
ucacugaacucucauagagaaa

SEQ ID NO: 16825 - RNA, 22 nt, Human
ucacugaauuucaagcuagugg

SEQ ID NO: 16826 - RNA, 22 nt, Human
ucacuggaaaacaaauguuuua

SEQ ID NO: 16827 - RNA, 22 nt, Human
ucacuggauucauguuucuuua

SEQ ID NO: 16828 - RNA, 22 nt, Human
ucacuguaggaaucucuaaauu

SEQ ID NO: 16829 - RNA, 22 nt, Human
ucacuucuaugaucugucucuu

SEQ ID NO: 16830 - RNA, 23 nt, Human
ucacuucucuuacccucucucug

SEQ ID NO: 16831 - RNA, 22 nt, Human
ucacuucugcuccuuggaugcc

SEQ ID NO: 16832 - RNA, 22 nt, Human
ucacuuuacaucuguaaaagga

SEQ ID NO: 16833 - RNA, 22 nt, Human
uccaggcagcugcuugaugaua

SEQ ID NO: 16834 - RNA, 22 nt, Human
uccagggaggggcggcaggggu

SEQ ID NO: 16835 - RNA, 22 nt, Human
uccaggucauucucuccgaccg

SEQ ID NO: 16836 - RNA, 22 nt, Human
uccaggucgggggugggccggc

SEQ ID NO: 16837 - RNA, 22 nt, Human
uccagguggcuuuccuggggga

SEQ ID NO: 16838 - RNA, 23 nt, Human
uccaguagcuacgcaggguggag

SEQ ID NO: 16839 - RNA, 22 nt, Human
uccagugccagcuguuaaaguu

SEQ ID NO: 16840 - RNA, 22 nt, Human
uccaguggcaccuuggcccuca

SEQ ID NO: 16841 - RNA, 22 nt, Human
uccagugguggcucccggaccu

SEQ ID NO: 16842 - RNA, 20 nt, Human
uccaguuuuggagacauucu

SEQ ID NO: 16843 - RNA, 22 nt, Human
uccauaugaucuguuguauggu

SEQ ID NO: 16844 - RNA, 22 nt, Human
uccaucauucagaaauuuuuga

SEQ ID NO: 16845 - RNA, 18 nt, Human
uccauccucugcucuuca

SEQ ID NO: 16846 - RNA, 22 nt, Human
uccaucuacgagauuuuccaga

SEQ ID NO: 16847 - RNA, 22 nt, Human
uccaugaguuuuuuaguuucac

SEQ ID NO: 16848 - RNA, 22 nt, Human
uccaugauauauaugugcacau

SEQ ID NO: 16849 - RNA, 22 nt, Human
uccauguauugcuaacaaauag

SEQ ID NO: 16850 - RNA, 21 nt, Human
uccauucuuggugguucugca

SEQ ID NO: 16851 - RNA, 23 nt, Human
ucccaacuuugaaauauuccaca

SEQ ID NO: 16852 - RNA, 22 nt, Human
ucccacacucaacacacaugua

SEQ ID NO: 16853 - RNA, 22 nt, Human
ucccacagcuuccuagccacag

SEQ ID NO: 16854 - RNA, 23 nt, Human
ucccacauuucacagcacuuucc

SEQ ID NO: 16855 - RNA, 22 nt, Human
ucccaccugcuaagauguaucc

SEQ ID NO: 16856 - RNA, 22 nt, Human
ucccacgugccaucugcucugu

SEQ ID NO: 16857 - RNA, 17 nt, Human
ucccacuucauuuucca

SEQ ID NO: 16858 - RNA, 22 nt, Human
ucccagaaauccaggcuuaaau

SEQ ID NO: 16859 - RNA, 22 nt, Human
ucccagaaccuuuuagcuucac

SEQ ID NO: 16860 - RNA, 22 nt, Human
ucccagaacggguucuucccag

SEQ ID NO: 16861 - RNA, 22 nt, Human
ucccagcaggcaccgcuucugc

SEQ ID NO: 16862 - RNA, 22 nt, Human
ucccagguugaggccuugccug

SEQ ID NO: 16863 - RNA, 22 nt, Human
ucccagucuagagccggauugg

SEQ ID NO: 16864 - RNA, 22 nt, Human
ucccauauuauggggaaaaacu

SEQ ID NO: 16865 - RNA, 22 nt, Human
ucccaugaguuugguguagucu

SEQ ID NO: 16866 - RNA, 22 nt, Human
uccccaccuaagauacccaucu

SEQ ID NO: 16867 - RNA, 23 nt, Human
uccccagcugcccgugucccggg

SEQ ID NO: 16868 - RNA, 22 nt, Human
uccccaugaacuuguggcugcu

SEQ ID NO: 16869 - RNA, 22 nt, Human
uccccgcuccguagagaaagag

SEQ ID NO: 16870 - RNA, 22 nt, Human
uccccugccccccauccucugg

SEQ ID NO: 16871 - RNA, 22 nt, Human
ucccgcccugcguucucccaug

SEQ ID NO: 16872 - RNA, 22 nt, Human
ucccggcaccgggagccccugc

SEQ ID NO: 16873 - RNA, 22 nt, Human
ucccucacacagcugggagaac

SEQ ID NO: 16874 - RNA, 22 nt, Human
ucccucuaggggcgggaggcug

SEQ ID NO: 16875 - RNA, 22 nt, Human
ucccucuuccuacccucccuuu

SEQ ID NO: 16876 - RNA, 22 nt, Human
ucccugagagacuucuuuggcu

SEQ ID NO: 16877 - RNA, 22 nt, Human
ucccugagcucacauggcagga

SEQ ID NO: 16878 - RNA, 21 nt, Human
ucccugcagccccaggccccc

SEQ ID NO: 16879 - RNA, 22 nt, Human
ucccugcagggccauugugcag

SEQ ID NO: 16880 - RNA, 22 nt, Human
ucccugccuuauuuucauaugc

SEQ ID NO: 16881 - RNA, 22 nt, Human
ucccugcugggcgaucuucucu

SEQ ID NO: 16882 - RNA, 22 nt, Human
ucccuuaacucaaguggugcuc

SEQ ID NO: 16883 - RNA, 22 nt, Human
ucccuucagcuccagcucugcu

SEQ ID NO: 16884 - RNA, 22 nt, Human
ucccuugagcccugaggucccu

SEQ ID NO: 16885 - RNA, 22 nt, Human
ucccuugauauccuuuuaaugg

SEQ ID NO: 16886 - RNA, 22 nt, Human
ucccuuucuucuugguccaccu

SEQ ID NO: 16887 - RNA, 22 nt, Human
ucccuuuggagguguccagcac

SEQ ID NO: 16888 - RNA, 23 nt, Human
ucccuuuguucuugcuaggaugu

SEQ ID NO: 16889 - RNA, 22 nt, Human
ucccuuuuuaauugugucccug

SEQ ID NO: 16890 - RNA, 20 nt, Human
uccgaaucaugacuuugcac

SEQ ID NO: 16891 - RNA, 22 nt, Human
uccgacacacgugcucgcagcg

SEQ ID NO: 16892 - RNA, 22 nt, Human
uccgaccuuuacuucuugucuc

SEQ ID NO: 16893 - RNA, 22 nt, Human
uccgagggugacuaccgcuucc

SEQ ID NO: 16894 - RNA, 18 nt, Human
uccggaggucagaguaaa

SEQ ID NO: 16895 - RNA, 22 nt, Human
uccgggcagcuccuggagcugu

SEQ ID NO: 16896 - RNA, 22 nt, Human
uccguccacacuuagagaguuu

SEQ ID NO: 16897 - RNA, 22 nt, Human
uccgucucucccuccccaucac

SEQ ID NO: 16898 - RNA, 22 nt, Human
uccgugggucuugaagugucac

SEQ ID NO: 16899 - RNA, 22 nt, Human
uccuaaauuuguacuagcauuu

SEQ ID NO: 16900 - RNA, 22 nt, Human
uccuaagaaacagacugaaaag

SEQ ID NO: 16901 - RNA, 17 nt, Human
uccuacaggugugcuga

SEQ ID NO: 16902 - RNA, 19 nt, Human
uccuacaugagacagagag

SEQ ID NO: 16903 - RNA, 22 nt, Human
uccuagucaccugaaucaugca

SEQ ID NO: 16904 - RNA, 22 nt, Human
uccuaguucugaccucgcucac

SEQ ID NO: 16905 - RNA, 20 nt, Human
uccuaugagcuguuaaauug

SEQ ID NO: 16906 - RNA, 22 nt, Human
uccucagagacaaguugagagg

SEQ ID NO: 16907 - RNA, 22 nt, Human
uccucagcaaacacuucacucu

SEQ ID NO: 16908 - RNA, 22 nt, Human
uccuccauguugugcacuugaa

SEQ ID NO: 16909 - RNA, 21 nt, Human
uccuccucuccaaacgcccuc

SEQ ID NO: 16910 - RNA, 22 nt, Human
uccuccuggagacuuucucucu

SEQ ID NO: 16911 - RNA, 22 nt, Human
uccuccuuuccccgcuggagcc

SEQ ID NO: 16912 - RNA, 22 nt, Human
uccucugagguccucucggcca

SEQ ID NO: 16913 - RNA, 22 nt, Human
cccuuuuccugaggcccccugc

SEQ ID NO: 16914 - RNA, 22 nt, Human
cccuuuucuaauuuagccuguu

SEQ ID NO: 16915 - RNA, 22 nt, Human
cccuuuuuuauggaguuggcca

SEQ ID NO: 16916 - RNA, 22 nt, Human
ccgaaaaacagaaucuuggaac

SEQ ID NO: 16917 - RNA, 21 nt, Human
ccgacggcgcagaugccggcc

SEQ ID NO: 16918 - RNA, 22 nt, Human
ccgagcagggcgcccugcccca

SEQ ID NO: 16919 - RNA, 22 nt, Human
ccgaggaguagggugucuacgg

SEQ ID NO: 16920 - RNA, 21 nt, Human
ccgaggagugcggggagcccc

SEQ ID NO: 16921 - RNA, 22 nt, Human
ccgauuuauucugacaguuuau

SEQ ID NO: 16922 - RNA, 22 nt, Human
ccgcaccgucugccauacacgc

SEQ ID NO: 16923 - RNA, 22 nt, Human
ccgcagggcccggcgggcucag

SEQ ID NO: 16924 - RNA, 22 nt, Human
ccgcggcuguaguggaggugga

SEQ ID NO: 16925 - RNA, 22 nt, Human
ccgcgggcagggcuucaccuuu

SEQ ID NO: 16926 - RNA, 22 nt, Human
ccgcucuuugagacucucccga

SEQ ID NO: 16927 - RNA, 22 nt, Human
ccgcuggccgacuuccgagagc

SEQ ID NO: 16928 - RNA, 22 nt, Human
ccggauuugggagccaccaggg

SEQ ID NO: 16929 - RNA, 22 nt, Human
ccggcggaaacauggcggcgcc

SEQ ID NO: 16930 - RNA, 22 nt, Human
ccggcugagccucgccgcggcc

SEQ ID NO: 16931 - RNA, 22 nt, Human
ccggcugcugaggcggccccgg

SEQ ID NO: 16932 - RNA, 22 nt, Human
ccgggcggcauccagccguucc

SEQ ID NO: 16933 - RNA, 22 nt, Human
ccggguccagugggcacugggc

SEQ ID NO: 16934 - RNA, 22 nt, Human
ccggguucuuguucuaggaugu

SEQ ID NO: 16935 - RNA, 19 nt, Human
ccggucaugcauuccuuug

SEQ ID NO: 16936 - RNA, 22 nt, Human
ccguaugacuuuuuguuguugu

SEQ ID NO: 16937 - RNA, 22 nt, Human
ccgugcaguuucucacacacau

SEQ ID NO: 16938 - RNA, 22 nt, Human
ccguuugugcugcaggagaucg

SEQ ID NO: 16939 - RNA, 22 nt, Human
ccuaauuuuagacccacuccua

SEQ ID NO: 16940 - RNA, 22 nt, Human
ccuacccucaagggccuggggg

SEQ ID NO: 16941 - RNA, 22 nt, Human
ccuacguauuuugauauagaga

SEQ ID NO: 16942 - RNA, 22 nt, Human
ucgacguuguuuuuucucuguc

SEQ ID NO: 16943 - RNA, 22 nt, Human
ucgagaccagcuagaaggaagu

SEQ ID NO: 16944 - RNA, 22 nt, Human
ucgagauguuuguuguggugau

SEQ ID NO: 16945 - RNA, 22 nt, Human
ucgagcacaccagacuugcaga

SEQ ID NO: 16946 - RNA, 22 nt, Human
ucgagcgcucccugugcucucg

SEQ ID NO: 16947 - RNA, 22 nt, Human
ucgaugcuggcgcagguuucac

SEQ ID NO: 16948 - RNA, 22 nt, Human
ucgccauguacaugaagggcgg

SEQ ID NO: 16949 - RNA, 22 nt, Human
ucgccccccgccucacccucgg

SEQ ID NO: 16950 - RNA, 22 nt, Human
ucgccuccucccagaucaacaa

SEQ ID NO: 16951 - RNA, 22 nt, Human
ucgcgcgugccacgcgccgcgg

SEQ ID NO: 16952 - RNA, 22 nt, Human
ucgcucgcuggcuccugcccgc

SEQ ID NO: 16953 - RNA, 22 nt, Human
ucgcuguguccuuuucacuuau

SEQ ID NO: 16954 - RNA, 22 nt, Human
ucgcuucugaguuggugacccc

SEQ ID NO: 16955 - RNA, 19 nt, Human
ucggaaugugggaagcaug

SEQ ID NO: 16956 - RNA, 22 nt, Human
ucggauuggggaugggugggag

SEQ ID NO: 16957 - RNA, 22 nt, Human
ucggcgaccugucauggaccaa

SEQ ID NO: 16958 - RNA, 22 nt, Human
ucgggcccggcucccgacgccc

SEQ ID NO: 16959 - RNA, 21 nt, Human
ucgggcggcggcugaggcggc

SEQ ID NO: 16960 - RNA, 22 nt, Human
ucggguguguguguuggguaug

SEQ ID NO: 16961 - RNA, 23 nt, Human
ucgucgucagccacuaccucccc

SEQ ID NO: 16962 - RNA, 22 nt, Human
ucgugacuggacaaacuugggu

SEQ ID NO: 16963 - RNA, 22 nt, Human
ucuaaagcuccuuccacuaaaa

SEQ ID NO: 16964 - RNA, 22 nt, Human
ucuaaggacauuggcuuuggag

SEQ ID NO: 16965 - RNA, 22 nt, Human
ucuaauagauuuggaguggaaa

SEQ ID NO: 16966 - RNA, 22 nt, Human
ucuaaucacccgccgccccccg

SEQ ID NO: 16967 - RNA, 22 nt, Human
ucuaaucuuugaaaucaggguc

SEQ ID NO: 16968 - RNA, 20 nt, Human
ucuaaugaagugagcuuagc

SEQ ID NO: 16969 - RNA, 22 nt, Human
ucuaaugcuuccucucauccca

SEQ ID NO: 16970 - RNA, 22 nt, Human
ucuaccuucagaaugugggguu

SEQ ID NO: 16971 - RNA, 22 nt, Human
ucuacgugacagaacagacuga

SEQ ID NO: 16972 - RNA, 22 nt, Human
ucuacugagugcugagauuuug

SEQ ID NO: 16973 - RNA, 22 nt, Human
ucuagagaauuuggaaauuaag

SEQ ID NO: 16974 - RNA, 21 nt, Human
ucuagaugggaugaaaggugc

SEQ ID NO: 16975 - RNA, 23 nt, Human
ucuagcccuaaaaagagagcaga

SEQ ID NO: 16976 - RNA, 20 nt, Human
ucuaggacaggcaaaguaca

SEQ ID NO: 16977 - RNA, 22 nt, Human
ucuagggcaguacaaauucaag

SEQ ID NO: 16978 - RNA, 20 nt, Human
ucuaggguuugguuaucauc

SEQ ID NO: 16979 - RNA, 22 nt, Human
ucuagguuguaauuuguaguaa

SEQ ID NO: 16980 - RNA, 16 nt, Human
ucuauacaaauguccu

SEQ ID NO: 16981 - RNA, 21 nt, Human
ucuauccuggcuuuccacuug

SEQ ID NO: 16982 - RNA, 22 nt, Human
ucuaugcuacguuccucugaaa

SEQ ID NO: 16983 - RNA, 22 nt, Human
ucuauuauauuuacacgagagu

SEQ ID NO: 16984 - RNA, 22 nt, Human
ucuauuguuauccuuuccauuu

SEQ ID NO: 16985 - RNA, 22 nt, Human
ucucaaacuauauaugggguuc

SEQ ID NO: 16986 - RNA, 22 nt, Human
ucucaaagagcuacuggucuau

SEQ ID NO: 16987 - RNA, 22 nt, Human
ucucaaagguuuuccucuuuuu

SEQ ID NO: 16988 - RNA, 21 nt, Human
ucucaagguaacauuuaagau

SEQ ID NO: 16989 - RNA, 22 nt, Human
ucucaccuagucuuggaggucu

SEQ ID NO: 16990 - RNA, 22 nt, Human
ucucacucuuccccaugucaga

SEQ ID NO: 16991 - RNA, 22 nt, Human
ucucacuuuucaauccccagca

SEQ ID NO: 16992 - RNA, 22 nt, Human
ucucagcuggcugggagcccug

SEQ ID NO: 16993 - RNA, 22 nt, Human
ucucaggcuuccuggugcugug

SEQ ID NO: 16994 - RNA, 21 nt, Human
ucucauacauaguaggaacca

SEQ ID NO: 16995 - RNA, 22 nt, Human
ucuccaccccugggaggcagaa

SEQ ID NO: 16996 - RNA, 22 nt, Human
ucuccaggaaagacacuggacu

SEQ ID NO: 16997 - RNA, 23 nt, Human
ucucccagaaguucucggggacu

SEQ ID NO: 16998 - RNA, 19 nt, Human
ucucccaugccugugucua

SEQ ID NO: 16999 - RNA, 23 nt, Human
ucuccccuccagcccucccuccu

SEQ ID NO: 17000 - RNA, 16 nt, Human
ucucccuguucuccaa

SEQ ID NO: 17001 - RNA, 18 nt, Human
ucuccgaccccgcggucc

SEQ ID NO: 17002 - RNA, 22 nt, Human
ucuccuaauuacauacuugauu

SEQ ID NO: 17003 - RNA, 22 nt, Human
ucuccucucugaucuugcuccg

SEQ ID NO: 17004 - RNA, 22 nt, Human
ucuccucuuaaugcacguuucc

SEQ ID NO: 17005 - RNA, 17 nt, Human
ucuccuggcucuaucag

SEQ ID NO: 17006 - RNA, 22 nt, Human
ucuccuuuggggccucaggguu

SEQ ID NO: 17007 - RNA, 22 nt, Human
ucucgcuguuccugcuucaggu

SEQ ID NO: 17008 - RNA, 20 nt, Human
ucucuaacaugaaugcuauc

SEQ ID NO: 17009 - RNA, 22 nt, Human
ucucuacugcuucugugaguga

SEQ ID NO: 17010 - RNA, 20 nt, Human
ucucucacccuugcugugca

SEQ ID NO: 17011 - RNA, 22 nt, Human
ucucucagauuguuuccauuuu

SEQ ID NO: 17012 - RNA, 22 nt, Human
ucucucggagcuaccggaaguu

SEQ ID NO: 17013 - RNA, 22 nt, Human
ucucucgguacagcuggcugga

SEQ ID NO: 17014 - RNA, 22 nt, Human
ucucucucucuuccagcauguu

SEQ ID NO: 17015 - RNA, 22 nt, Human
ucucucugcuguccagcguuau

SEQ ID NO: 17016 - RNA, 22 nt, Human
ucucugagggugaucaugagaa

SEQ ID NO: 17017 - RNA, 20 nt, Human
ucucugccaaccaccuccuc

SEQ ID NO: 17018 - RNA, 22 nt, Human
ucucugcguucaucccaucaca

SEQ ID NO: 17019 - RNA, 22 nt, Human
ucucuggacggacauuuaaggu

SEQ ID NO: 17020 - RNA, 22 nt, Human
ucucuggcuuuuuuuccauuuu

SEQ ID NO: 17021 - RNA, 22 nt, Human
ucucuguaguugggcagcugcu

SEQ ID NO: 17022 - RNA, 22 nt, Human
ucucugucucccguguguccgg

SEQ ID NO: 17023 - RNA, 22 nt, Human
ucucuucacuuguaugcuauca

SEQ ID NO: 17024 - RNA, 22 nt, Human
ucucuucggagagaccuuugga

SEQ ID NO: 17025 - RNA, 22 nt, Human
ucucuugcuauugcgaacaggu

SEQ ID NO: 17026 - RNA, 22 nt, Human
ucucuuuuuuuaaaacucuaug

SEQ ID NO: 17027 - RNA, 22 nt, Human
ucugaaauuuuaguuauagaaa

SEQ ID NO: 17028 - RNA, 18 nt, Human
ucugaaggaaugauucca

SEQ ID NO: 17029 - RNA, 22 nt, Human
ucugaccccccuugccuccacu

SEQ ID NO: 17030 - RNA, 22 nt, Human
ucugacguugguucugcccuuu

SEQ ID NO: 17031 - RNA, 22 nt, Human
ucugacugucccguagaggaac

SEQ ID NO: 17032 - RNA, 22 nt, Human
ucugacuucuuuuauuaucauu

SEQ ID NO: 17033 - RNA, 22 nt, Human
ucugagagcuguagaagccuau

SEQ ID NO: 17034 - RNA, 22 nt, Human
ucugagcaggaaagagcagaga

SEQ ID NO: 17035 - RNA, 22 nt, Human
ucugaggaauaagaugucuaaa

SEQ ID NO: 17036 - RNA, 21 nt, Human
ucugaggagaaacucuuggug

SEQ ID NO: 17037 - RNA, 22 nt, Human
ucugaguaauacucuugccuug

SEQ ID NO: 17038 - RNA, 22 nt, Human
ucugaguagaaucauucauaaa

SEQ ID NO: 17039 - RNA, 22 nt, Human
ucugagucgcucccuggaucca

SEQ ID NO: 17040 - RNA, 22 nt, Human
ucugagugggaacucucaugac

SEQ ID NO: 17041 - RNA, 22 nt, Human
ucugaguuaaaauuccagaggu

SEQ ID NO: 17042 - RNA, 22 nt, Human
ucugauaaggaaggauuaaaag

SEQ ID NO: 17043 - RNA, 21 nt, Human
ucugccaguuucucuuacuuu

SEQ ID NO: 17044 - RNA, 22 nt, Human
ucugcccaggaggucccauggg

SEQ ID NO: 17045 - RNA, 23 nt, Human
ucugccuccuaauuguugguguc

SEQ ID NO: 17046 - RNA, 22 nt, Human
ucugccuucaggagcagacucu

SEQ ID NO: 17047 - RNA, 22 nt, Human
ucugcggccggaauucccuuca

SEQ ID NO: 17048 - RNA, 22 nt, Human
ucugcuggugucauuuuugcua

SEQ ID NO: 17049 - RNA, 22 nt, Human
ucugcuguugaucaugacuagc

SEQ ID NO: 17050 - RNA, 22 nt, Human
ucugcuuuucuuaaggggauca

SEQ ID NO: 17051 - RNA, 22 nt, Human
ugacagugugcccggagguuag

SEQ ID NO: 17052 - RNA, 22 nt, Human
ugacaucagacugugagaagag

SEQ ID NO: 17053 - RNA, 22 nt, Human
ugacauccuacaccccuggguc

SEQ ID NO: 17054 - RNA, 22 nt, Human
ugacaucuagauaaaugggaca

SEQ ID NO: 17055 - RNA, 22 nt, Human
ugacauuugagagagauauaca

SEQ ID NO: 17056 - RNA, 23 nt, Human
ugaccauauauccaucagauaua

SEQ ID NO: 17057 - RNA, 22 nt, Human
ugaccgucagcugucuuccauu

SEQ ID NO: 17058 - RNA, 22 nt, Human
ugaccucugagcaaggcagagg

SEQ ID NO: 17059 - RNA, 22 nt, Human
ugaccuuaguuuuuucaaugag

SEQ ID NO: 17060 - RNA, 22 nt, Human
ugacgggacacaggugccaaca

SEQ ID NO: 17061 - RNA, 22 nt, Human
ugacuaauacagaaacuacaag

SEQ ID NO: 17062 - RNA, 22 nt, Human
ugacucugaugcaguguguuua

SEQ ID NO: 17063 - RNA, 22 nt, Human
ugacugaggaaggugggguggg

SEQ ID NO: 17064 - RNA, 22 nt, Human
ugagaaauauacaccagacaca

SEQ ID NO: 17065 - RNA, 22 nt, Human
ugagaacuguuuugguuugggu

SEQ ID NO: 17066 - RNA, 22 nt, Human
ugagaagaggucuuuugggaug

SEQ ID NO: 17067 - RNA, 22 nt, Human
ugagacaaaguuguuggauguu

SEQ ID NO: 17068 - RNA, 23 nt, Human
ugagacacuggaaggcaagaaaa

SEQ ID NO: 17069 - RNA, 22 nt, Human
ugagaccuaaaccgucuguccu

SEQ ID NO: 17070 - RNA, 22 nt, Human
ugagagacggagccccggcucg

SEQ ID NO: 17071 - RNA, 22 nt, Human
ugagagcuccacaccuugcccu

SEQ ID NO: 17072 - RNA, 22 nt, Human
ugagagguagaacuuguagugu

SEQ ID NO: 17073 - RNA, 21 nt, Human
ugagagucuguguauuuuuag

SEQ ID NO: 17074 - RNA, 22 nt, Human
ugagauguaauguaguacuuug

SEQ ID NO: 17075 - RNA, 22 nt, Human
ugagauucuguucagaaaaaug

SEQ ID NO: 17076 - RNA, 19 nt, Human
ugagauuguaugaggagau

SEQ ID NO: 17077 - RNA, 22 nt, Human
ugagcaaacacagauaggcuua

SEQ ID NO: 17078 - RNA, 22 nt, Human
ugagcaccaggcaccacagcuc

SEQ ID NO: 17079 - RNA, 22 nt, Human
ugagccauguucaugagguuca

SEQ ID NO: 17080 - RNA, 21 nt, Human
ugagcccaaagcuguauuggu

SEQ ID NO: 17081 - RNA, 22 nt, Human
ugagcuuugguaccuucauuug

SEQ ID NO: 17082 - RNA, 22 nt, Human
ugaggaacaugggagaaauguc

SEQ ID NO: 17083 - RNA, 22 nt, Human
ugaggaagugguuguaugguuu

SEQ ID NO: 17084 - RNA, 22 nt, Human
ugaggaaugugacaaaaccaag

SEQ ID NO: 17085 - RNA, 22 nt, Human
ugaggagggcuagagucuccug

SEQ ID NO: 17086 - RNA, 22 nt, Human
ugaggaggugggcacacagagu

SEQ ID NO: 17087 - RNA, 22 nt, Human
ugaggaugaggaagaagaagaa

SEQ ID NO: 17088 - RNA, 19 nt, Human
ugaggauugagguccagua

SEQ ID NO: 17089 - RNA, 22 nt, Human
ugaggccaagccuccucugcca

SEQ ID NO: 17090 - RNA, 22 nt, Human
ugaggcuuucacuuggcaaaga

SEQ ID NO: 17091 - RNA, 22 nt, Human
ugagggauuucuggccuuaacu

SEQ ID NO: 17092 - RNA, 22 nt, Human
ugagggucgcaagcaccaggcc

SEQ ID NO: 17093 - RNA, 22 nt, Human
ugagguguuugugcaccaucug

SEQ ID NO: 17094 - RNA, 22 nt, Human
ugagguugggaggacugccuaa

SEQ ID NO: 17095 - RNA, 22 nt, Human
ugagucaccucucagaagccac

SEQ ID NO: 17096 - RNA, 20 nt, Human
ugagucagcugcaugggugg

SEQ ID NO: 17097 - RNA, 22 nt, Human
ugaguccagaugggccagcagg

SEQ ID NO: 17098 - RNA, 22 nt, Human
ugagugcacaggccacucuuca

SEQ ID NO: 17099 - RNA, 22 nt, Human
ugagugcuuuucgguguaccgu

SEQ ID NO: 17100 - RNA, 22 nt, Human
ugagugugugcugcuuacauuc

SEQ ID NO: 17101 - RNA, 22 nt, Human
ugagugugugucuuggguaccg

SEQ ID NO: 17102 - RNA, 22 nt, Human
ugaguguuguaaccauaugauu

SEQ ID NO: 17103 - RNA, 22 nt, Human
ugaguuagcucuauucuuuugg

SEQ ID NO: 17104 - RNA, 22 nt, Human
ugaguucugacugagcaugggg

SEQ ID NO: 17105 - RNA, 22 nt, Human
ugaguuuaggccaggauauggu

SEQ ID NO: 17106 - RNA, 22 nt, Human
ugaguuucuuacucaggagcug

SEQ ID NO: 17107 - RNA, 22 nt, Human
ugaguuuuggaagauguuacag

SEQ ID NO: 17108 - RNA, 22 nt, Human
ugauaccugagucuuccccguu

SEQ ID NO: 17109 - RNA, 22 nt, Human
ugauagcaugcucucaguaaaa

SEQ ID NO: 17110 - RNA, 20 nt, Human
ugauaggcauugacauaagg

SEQ ID NO: 17111 - RNA, 22 nt, Human
ugauauaaaagauucuuauuga

SEQ ID NO: 17112 - RNA, 20 nt, Human
ugauaugcgguacagagagg

SEQ ID NO: 17113 - RNA, 22 nt, Human
ugauaugguaauaagauauucu

SEQ ID NO: 17114 - RNA, 22 nt, Human
ugaucaacagggcuggaaagag

SEQ ID NO: 17115 - RNA, 22 nt, Human
ugaucauugaacaucgaguuaa

SEQ ID NO: 17116 - RNA, 22 nt, Human
ugaucuuugcuuuuggcuuagu

SEQ ID NO: 17117 - RNA, 22 nt, Human
ugaugaugaagaaauauuauca

SEQ ID NO: 17118 - RNA, 22 nt, Human
ugaugaugccaaaauuuggcau

SEQ ID NO: 17119 - RNA, 22 nt, Human
ugaugccauaguaaaauuugcu

SEQ ID NO: 17120 - RNA, 22 nt, Human
ugaugcuagaacuuccaagaua

SEQ ID NO: 17121 - RNA, 22 nt, Human
ugauggaguauaauaaaaugac

SEQ ID NO: 17122 - RNA, 22 nt, Human
ugauguaaaauaggaaguucua

SEQ ID NO: 17123 - RNA, 22 nt, Human
ugaugugugaauucuuaaaugu

SEQ ID NO: 17124 - RNA, 22 nt, Human
ugauuagauacuucagaugaca

SEQ ID NO: 17125 - RNA, 22 nt, Human
ugauuagccguccuuuuauuaa

SEQ ID NO: 17126 - RNA, 22 nt, Human
ugauucacgcuucucuuuaaac

SEQ ID NO: 17127 - RNA, 22 nt, Human
ugauucaguacuuucucuaacu

SEQ ID NO: 17128 - RNA, 22 nt, Human
ugauucuuugaccaaaaaauug

SEQ ID NO: 17129 - RNA, 22 nt, Human
ugauugcucagcuagccucuuu

SEQ ID NO: 17130 - RNA, 22 nt, Human
ugauugcucgacacucugcuug

SEQ ID NO: 17131 - RNA, 22 nt, Human
ugauugggacauuuuguuuucu

SEQ ID NO: 17132 - RNA, 22 nt, Human
ugauuuagguauuuucuuuugu

SEQ ID NO: 17133 - RNA, 22 nt, Human
ugauuugaaaccuuuggcaaga

SEQ ID NO: 17134 - RNA, 22 nt, Human
ugauuugauuuguuuaugccug

SEQ ID NO: 17135 - RNA, 22 nt, Human
ugauuugguauccaggauuuaa

SEQ ID NO: 17136 - RNA, 22 nt, Human
ugcaaaaguuuuauacacagau

SEQ ID NO: 17137 - RNA, 23 nt, Human
ugcaaaauuugcagaguucgaug

SEQ ID NO: 17138 - RNA, 22 nt, Human
ugcaacuacccccaggauuuua

SEQ ID NO: 17139 - RNA, 21 nt, Human
ugcaacugaaaggaauauggu

SEQ ID NO: 17140 - RNA, 19 nt, Human
ugcaagcuuuuucuuguua

SEQ ID NO: 17141 - RNA, 22 nt, Human
cgagugauuauucuggcugaga

SEQ ID NO: 17142 - RNA, 18 nt, Human
cgauguguaugugauuug

SEQ ID NO: 17143 - RNA, 22 nt, Human
cgcacacaaaugcauacgccag

SEQ ID NO: 17144 - RNA, 22 nt, Human
cgcacuggagcuggaacgaguc

SEQ ID NO: 17145 - RNA, 22 nt, Human
cgcacuugugagcgacagggcu

SEQ ID NO: 17146 - RNA, 22 nt, Human
cgcauugcaauucaggggauaa

SEQ ID NO: 17147 - RNA, 22 nt, Human
cgccaaccaggcuguccuccca

SEQ ID NO: 17148 - RNA, 22 nt, Human
cgccaguggcagcuggaacagg

SEQ ID NO: 17149 - RNA, 22 nt, Human
cgcccggcugagacgcucgccc

SEQ ID NO: 17150 - RNA, 22 nt, Human
cgcccguacuuugccggcauga

SEQ ID NO: 17151 - RNA, 22 nt, Human
cgccgccgccugcccgcgcccc

SEQ ID NO: 17152 - RNA, 22 nt, Human
cgccgugcagucagcccagaag

SEQ ID NO: 17153 - RNA, 22 nt, Human
cgccgugucuggucuguacguc

SEQ ID NO: 17154 - RNA, 22 nt, Human
cgccuggccccgcagcgcuugu

SEQ ID NO: 17155 - RNA, 22 nt, Human
cgcuagggagcacuuggcagug

SEQ ID NO: 17156 - RNA, 22 nt, Human
cgcucggugagccaguggcgga

SEQ ID NO: 17157 - RNA, 22 nt, Human
cgcucugccugcccuaacuucc

SEQ ID NO: 17158 - RNA, 22 nt, Human
cgcugcagcggcugagucccgc

SEQ ID NO: 17159 - RNA, 19 nt, Human
cgcugcucccgcuguggcu

SEQ ID NO: 17160 - RNA, 22 nt, Human
ugcagguuuucagauguguguu

SEQ ID NO: 17161 - RNA, 22 nt, Human
ugcagugaugcuucuggcucag

SEQ ID NO: 17162 - RNA, 22 nt, Human
ugcagugcagcuggaaguuggc

SEQ ID NO: 17163 - RNA, 22 nt, Human
ugcauaaauauuguugggagua

SEQ ID NO: 17164 - RNA, 22 nt, Human
ugcauaagguuaaauuagcaga

SEQ ID NO: 17165 - RNA, 22 nt, Human
ugcauaugcauguaccuguguu

SEQ ID NO: 17166 - RNA, 22 nt, Human
ugcaucauuaagguacaguugg

SEQ ID NO: 17167 - RNA, 22 nt, Human
ugcaucccaaacaugguuuccu

SEQ ID NO: 17168 - RNA, 22 nt, Human
ugcaugacaauugccgucaagu

SEQ ID NO: 17169 - RNA, 22 nt, Human
ugcauguuucuguauguuaaug

SEQ ID NO: 17170 - RNA, 22 nt, Human
ugcauguuuuaagugaagcuga

SEQ ID NO: 17171 - RNA, 22 nt, Human
ugcauuauaacaauaaggcuua

SEQ ID NO: 17172 - RNA, 22 nt, Human
ugcauucugggucgcagagugg

SEQ ID NO: 17173 - RNA, 22 nt, Human
ugcauugccauagcagggggau

SEQ ID NO: 17174 - RNA, 22 nt, Human
ugcauugccucuauucauuaua

SEQ ID NO: 17175 - RNA, 22 nt, Human
ugcauuguuuauggaauaaaau

SEQ ID NO: 17176 - RNA, 22 nt, Human
ugcauuuugaaggaaaaaaaug

SEQ ID NO: 17177 - RNA, 22 nt, Human
ugccaaagauagagguuugagu

SEQ ID NO: 17178 - RNA, 22 nt, Human
ugccaacaggcuugccugaugu

SEQ ID NO: 17179 - RNA, 16 nt, Human
ugccaagggguuaaug

SEQ ID NO: 17180 - RNA, 22 nt, Human
ugccaaugauuccacaauggaa

SEQ ID NO: 17181 - RNA, 22 nt, Human
ugccaauuaccuauuucugaga

SEQ ID NO: 17182 - RNA, 22 nt, Human
ugccagcuccgaggagcugcag

SEQ ID NO: 17183 - RNA, 23 nt, Human
ugccaggaagaaugaccucugcu

SEQ ID NO: 17184 - RNA, 22 nt, Human
ugccagucggcacuuuaucugg

SEQ ID NO: 17185 - RNA, 22 nt, Human
ugccaugguuguacaguagcag

SEQ ID NO: 17186 - RNA, 22 nt, Human
ugcccacaggaagacaccagcg

SEQ ID NO: 17187 - RNA, 22 nt, Human
ugcccagagccucuuaccucca

SEQ ID NO: 17188 - RNA, 22 nt, Human
ugcccagcagggagcuaccugg

SEQ ID NO: 17189 - RNA, 19 nt, Human
ugccccacccucuauccag

SEQ ID NO: 17190 - RNA, 22 nt, Human
ugccccagcacauuuacuaucc

SEQ ID NO: 17191 - RNA, 22 nt, Human
ugccccuagaggcguugcagcu

SEQ ID NO: 17192 - RNA, 21 nt, Human
ugccccucuuuucuuuccuuc

SEQ ID NO: 17193 - RNA, 22 nt, Human
ugccccuugccaggccucugcc

SEQ ID NO: 17194 - RNA, 22 nt, Human
ugcccuagaucacauuacaggu

SEQ ID NO: 17195 - RNA, 22 nt, Human
ugcccugaagcugucaauuuug

SEQ ID NO: 17196 - RNA, 22 nt, Human
ugcccugcagacccugcagugu

SEQ ID NO: 17197 - RNA, 22 nt, Human
ugccgccccggggcccccagcc

SEQ ID NO: 17198 - RNA, 22 nt, Human
ugccgccgugggucccgacgcg

SEQ ID NO: 17199 - RNA, 22 nt, Human
ugccgcuuucuggcccucaguc

SEQ ID NO: 17200 - RNA, 23 nt, Human
ugccggaucuacuuuggguucuc

SEQ ID NO: 17201 - RNA, 19 nt, Human
ugccggccgcgggguuccu

SEQ ID NO: 17202 - RNA, 22 nt, Human
ugccgggcugagcaagugcugc

SEQ ID NO: 17203 - RNA, 22 nt, Human
ugccuaaaccauuccccuuccu

SEQ ID NO: 17204 - RNA, 22 nt, Human
ugccuacuuuaguacuuuaaag

SEQ ID NO: 17205 - RNA, 22 nt, Human
ugccuaguuucagagcccccga

SEQ ID NO: 17206 - RNA, 22 nt, Human
ugccuccucccuccuccuaggu

SEQ ID NO: 17207 - RNA, 22 nt, Human
ugccucucucugucauuaugcu

SEQ ID NO: 17208 - RNA, 22 nt, Human
ugccucucuggaucugcuguga

SEQ ID NO: 17209 - RNA, 22 nt, Human
ugccugaagccugccccugggu

SEQ ID NO: 17210 - RNA, 19 nt, Human
ugccuggcaccagcuccac

SEQ ID NO: 17211 - RNA, 22 nt, Human
ugccuggugcggagugaguggc

SEQ ID NO: 17212 - RNA, 22 nt, Human
ugccuguguauuuccggccugc

SEQ ID NO: 17213 - RNA, 22 nt, Human
ugccuguguuugggguggggaa

SEQ ID NO: 17214 - RNA, 20 nt, Human
ugccuuccgccccgggcacc

SEQ ID NO: 17215 - RNA, 22 nt, Human
ugccuuccuucuccccuccuuc

SEQ ID NO: 17216 - RNA, 17 nt, Human
ugccuucgucuucaguu

SEQ ID NO: 17217 - RNA, 22 nt, Human
ugccuucugccaaggacggugc

SEQ ID NO: 17218 - RNA, 22 nt, Human
ugccuuguagccaccgggucac

SEQ ID NO: 17219 - RNA, 22 nt, Human
ugccuuuggcuguucugugacc

SEQ ID NO: 17220 - RNA, 22 nt, Human
ugccuuuuguguuuggcuaauc

SEQ ID NO: 17221 - RNA, 22 nt, Human
ugcgccccgcgggccuucgggc

SEQ ID NO: 17222 - RNA, 22 nt, Human
ugcgccuccugcugccugcccu

SEQ ID NO: 17223 - RNA, 22 nt, Human
ugcgccucugucacucagcauc

SEQ ID NO: 17224 - RNA, 22 nt, Human
ugcgcgcaccugcauauauaug

SEQ ID NO: 17225 - RNA, 22 nt, Human
ugcggaaggcagcgcagggugg

SEQ ID NO: 17226 - RNA, 22 nt, Human
ugcggagggagcagucggcugu

SEQ ID NO: 17227 - RNA, 19 nt, Human
ugcgggcugcggucagggc

SEQ ID NO: 17228 - RNA, 22 nt, Human
ugcggugcagcccugcccucuc

SEQ ID NO: 17229 - RNA, 21 nt, Human
ugcguaugucuuguauuacuc

SEQ ID NO: 17230 - RNA, 22 nt, Human
ugcguggauuuaggagugaggg

SEQ ID NO: 17231 - RNA, 22 nt, Human
ugcuacaucuacugguaagggu

SEQ ID NO: 17232 - RNA, 22 nt, Human
ugcuaguuuuugauacuuuugc

SEQ ID NO: 17233 - RNA, 22 nt, Human
ugcuaucuagaaauacuggguu

SEQ ID NO: 17234 - RNA, 22 nt, Human
ugcuauucuuggagcugaugga

SEQ ID NO: 17235 - RNA, 22 nt, Human
ugcuauuuuguuuucaguccau

SEQ ID NO: 17236 - RNA, 22 nt, Human
ugcucagaagacuuacugguua

SEQ ID NO: 17237 - RNA, 22 nt, Human
ugcuccguucuucugcuucuug

SEQ ID NO: 17238 - RNA, 22 nt, Human
ugcuccugaacacagcccuaug

SEQ ID NO: 17239 - RNA, 22 nt, Human
ugcucugcuaggagaagaauga

SEQ ID NO: 17240 - RNA, 22 nt, Human
ugcucugguccucccucggcgc

SEQ ID NO: 17241 - RNA, 22 nt, Human
ugcucuguuuuaacucuuucaa

SEQ ID NO: 17242 - RNA, 22 nt, Human
ugcucuuguauccaaaagugau

SEQ ID NO: 17243 - RNA, 22 nt, Human
ugcucuuuguagcugcuuugcu

SEQ ID NO: 17244 - RNA, 22 nt, Human
ugcugacuauacauuuagcauu

SEQ ID NO: 17245 - RNA, 22 nt, Human
ugcugcggcgcaggcacuccag

SEQ ID NO: 17246 - RNA, 23 nt, Human
ugcugcgggacccgagcgcgcgc

SEQ ID NO: 17247 - RNA, 22 nt, Human
ugcugcucaagcugcagcaaaa

SEQ ID NO: 17248 - RNA, 22 nt, Human
ugcugcuguuaucauuuuacca

SEQ ID NO: 17249 - RNA, 22 nt, Human
ugcugcuguuuccuacaucuca

SEQ ID NO: 17250 - RNA, 22 nt, Human
ugcuggaaggguaguauuaacu

SEQ ID NO: 17251 - RNA, 22 nt, Human
ugcugggagcugggccucgaca

SEQ ID NO: 17252 - RNA, 20 nt, Human
ugcugggccaucuugcaugc

SEQ ID NO: 17253 - RNA, 22 nt, Human
ugcugguuucugaguaaccaca

SEQ ID NO: 17254 - RNA, 22 nt, Human
cucagaugaugucuucagggaa

SEQ ID NO: 17255 - RNA, 22 nt, Human
cucagaugcacacaggugaggg

SEQ ID NO: 17256 - RNA, 22 nt, Human
cucagcgagggaaagaggccgc

SEQ ID NO: 17257 - RNA, 22 nt, Human
cucagcgggagucuggccgaac

SEQ ID NO: 17258 - RNA, 22 nt, Human
cucagcugauuaauuucauguu

SEQ ID NO: 17259 - RNA, 22 nt, Human
cucaggaaaauauugaagaagu

SEQ ID NO: 17260 - RNA, 22 nt, Human
cucauagguuuggaaccaggua

SEQ ID NO: 17261 - RNA, 22 nt, Human
cucaucuucuuccuucuuuucc

SEQ ID NO: 17262 - RNA, 22 nt, Human
cucaugcugcaaauggcuguuu

SEQ ID NO: 17263 - RNA, 22 nt, Human
cucauguucuaagcuuucuuca

SEQ ID NO: 17264 - RNA, 22 nt, Human
cucauugacagagcagcucuac

SEQ ID NO: 17265 - RNA, 22 nt, Human
cuccaacugccacuguacugga

SEQ ID NO: 17266 - RNA, 22 nt, Human
cuccagagagaaaggaggccgc

SEQ ID NO: 17267 - RNA, 22 nt, Human
cuccagauuugggggauauacu

SEQ ID NO: 17268 - RNA, 22 nt, Human
cuccagcucgcgagcucugcuc

SEQ ID NO: 17269 - RNA, 22 nt, Human
ugcuugaacccaggaaguggag

SEQ ID NO: 17270 - RNA, 22 nt, Human
ugcuugugcacacacauguuau

SEQ ID NO: 17271 - RNA, 22 nt, Human
ugcuuguuuguuuucuuccauu

SEQ ID NO: 17272 - RNA, 22 nt, Human
ugcuuguuuuguggcuucagcu

SEQ ID NO: 17273 - RNA, 22 nt, Human
ugcuuucaaugaauuguauacu

SEQ ID NO: 17274 - RNA, 22 nt, Human
ugcuuucagauaucuguuucaa

SEQ ID NO: 17275 - RNA, 21 nt, Human
ugcuuucugugcuuuuucugc

SEQ ID NO: 17276 - RNA, 22 nt, Human
ugcuuuggcccaacauugaugc

SEQ ID NO: 17277 - RNA, 22 nt, Human
ugcuuuuggcagcaguguuuau

SEQ ID NO: 17278 - RNA, 22 nt, Human
uggaaaauuuagaaagauuuau

SEQ ID NO: 17279 - RNA, 22 nt, Human
uggaaagaagacugugguugag

SEQ ID NO: 17280 - RNA, 22 nt, Human
uggaaagcagcccugcucccca

SEQ ID NO: 17281 - RNA, 22 nt, Human
uggaaaguuggaagucucagga

SEQ ID NO: 17282 - RNA, 22 nt, Human
uggaaauacaagaaguauguca

SEQ ID NO: 17283 - RNA, 22 nt, Human
uggaaauagauguaggaaauug

SEQ ID NO: 17284 - RNA, 22 nt, Human
uggaaaugcuuagaggugaucu

SEQ ID NO: 17285 - RNA, 22 nt, Human
uggaacuagugucugagauggg

SEQ ID NO: 17286 - RNA, 22 nt, Human
uggaacugauuaaaagggcaga

SEQ ID NO: 17287 - RNA, 22 nt, Human
uggaacugguuugcuucagacu

SEQ ID NO: 17288 - RNA, 22 nt, Human
uggaacuuccucacuuucccuc

SEQ ID NO: 17289 - RNA, 22 nt, Human
uggaagaaaugguugagccaug

SEQ ID NO: 17290 - RNA, 22 nt, Human
uggaagaagcuacaagcgguga

SEQ ID NO: 17291 - RNA, 22 nt, Human
uggaagaucugguguagcuccu

SEQ ID NO: 17292 - RNA, 22 nt, Human
uggaagcccagaaggaagcaga

SEQ ID NO: 17293 - RNA, 20 nt, Human
uggaaggaaagguguaucuu

SEQ ID NO: 17294 - RNA, 22 nt, Human
uggaaggaaauguguaucauaa

SEQ ID NO: 17295 - RNA, 22 nt, Human
uggaagggagcuggaauuugga

SEQ ID NO: 17296 - RNA, 22 nt, Human
uggaaggggagcuggaaagggg

SEQ ID NO: 17297 - RNA, 22 nt, Human
uggaaggggccaggcgcggagu

SEQ ID NO: 17298 - RNA, 19 nt, Human
uggaagugauaguauagua

SEQ ID NO: 17299 - RNA, 22 nt, Human
uggaagugggcaucaccaucca

SEQ ID NO: 17300 - RNA, 23 nt, Human
uggaaguugagagucugcuuugu

SEQ ID NO: 17301 - RNA, 22 nt, Human
uggaaugccgggccaggcuccg

SEQ ID NO: 17302 - RNA, 22 nt, Human
uggaauuaucugaagugauuug

SEQ ID NO: 17303 - RNA, 22 nt, Human
uggacacugguggauauggaau

SEQ ID NO: 17304 - RNA, 22 nt, Human
uggacccaccccagggccugcu

SEQ ID NO: 17305 - RNA, 22 nt, Human
uggagagcaggugaaggaaaga

SEQ ID NO: 17306 - RNA, 22 nt, Human
uggagccagcaggacucagagg

SEQ ID NO: 17307 - RNA, 22 nt, Human
uggagccuugugagaccacaau

SEQ ID NO: 17308 - RNA, 22 nt, Human
uggagcuuuguguauuuuuaau

SEQ ID NO: 17309 - RNA, 22 nt, Human
uggaggaggagaacuuggcacu

SEQ ID NO: 17310 - RNA, 22 nt, Human
uggaggauggaaggaaagcugg

SEQ ID NO: 17311 - RNA, 19 nt, Human
uggaggcacuaacaaacuc

SEQ ID NO: 17312 - RNA, 19 nt, Human
uggaggcggguggcccaga

SEQ ID NO: 17313 - RNA, 21 nt, Human
uggaggcguaaucacuguuga

SEQ ID NO: 17314 - RNA, 22 nt, Human
uggagggaagcaaacacuagau

SEQ ID NO: 17315 - RNA, 22 nt, Human
uggagguagcugacuccagccc

SEQ ID NO: 17316 - RNA, 22 nt, Human
uggagucuugcuuugggagugc

SEQ ID NO: 17317 - RNA, 22 nt, Human
uggaguguuggucccacugagg

SEQ ID NO: 17318 - RNA, 22 nt, Human
uggaguucauauuggacauaag

SEQ ID NO: 17319 - RNA, 21 nt, Human
uggauauugaguaguuucuga

SEQ ID NO: 17320 - RNA, 22 nt, Human
uggauauuuuguaugugcguuu

SEQ ID NO: 17321 - RNA, 20 nt, Human
uggaucgaccucacuuccau

SEQ ID NO: 17322 - RNA, 22 nt, Human
uggaucuugaugcuccaagagu

SEQ ID NO: 17323 - RNA, 22 nt, Human
uggaugacaaccauuggaagag

SEQ ID NO: 17324 - RNA, 22 nt, Human
uggaugccauuugauuaaggcu

SEQ ID NO: 17325 - RNA, 22 nt, Human
uggaugccuugggggaggagga

SEQ ID NO: 17326 - RNA, 22 nt, Human
uggaugcuccaaguagaccuua

SEQ ID NO: 17327 - RNA, 22 nt, Human
uggauuagugcugaaaugaugg

SEQ ID NO: 17328 - RNA, 22 nt, Human
uggcaaacacaauauggguaca

SEQ ID NO: 17329 - RNA, 22 nt, Human
uggcaacucaauuucuacaaga

SEQ ID NO: 17330 - RNA, 22 nt, Human
uggcaaggccacaggugcaguu

SEQ ID NO: 17331 - RNA, 18 nt, Human
uggcaaugccaaaggcuu

SEQ ID NO: 17332 - RNA, 22 nt, Human
uggcacagcuugucauaaacuc

SEQ ID NO: 17333 - RNA, 22 nt, Human
uggcacaggcagaaggugccgc

SEQ ID NO: 17334 - RNA, 22 nt, Human
uggcacaguuaaaguuguagaa

SEQ ID NO: 17335 - RNA, 22 nt, Human
uggcacguuggauugggaguuc

SEQ ID NO: 17336 - RNA, 22 nt, Human
uggcacugaagcuggaaagccu

SEQ ID NO: 17337 - RNA, 22 nt, Human
uggcacugcccugucucggugg

SEQ ID NO: 17338 - RNA, 22 nt, Human
uggcagcauuuuuuccagaaca

SEQ ID NO: 17339 - RNA, 21 nt, Human
uggcaggcagcuggaagcuug

SEQ ID NO: 17340 - RNA, 22 nt, Human
uggcaguagagcuggaacuuga

SEQ ID NO: 17341 - RNA, 22 nt, Human
uggcagugagauuucucuucug

SEQ ID NO: 17342 - RNA, 22 nt, Human
uggcaguugcaguaacuuguau

SEQ ID NO: 17343 - RNA, 21 nt, Human
uggcauacugcuaaaaagugu

SEQ ID NO: 17344 - RNA, 22 nt, Human
uggcaucacagacaaggcagca

SEQ ID NO: 17345 - RNA, 22 nt, Human
uggcaucuggugauauggacua

SEQ ID NO: 17346 - RNA, 22 nt, Human
uggcauuugagcuggaaggaug

SEQ ID NO: 17347 - RNA, 22 nt, Human
uggcauuuuguagcuguguauc

SEQ ID NO: 17348 - RNA, 22 nt, Human
uggccaaauuggccugauguau

SEQ ID NO: 17349 - RNA, 22 nt, Human
uggccaaucagcugugaccugc

SEQ ID NO: 17350 - RNA, 22 nt, Human
uggcccaucagggcaccugaga

SEQ ID NO: 17351 - RNA, 22 nt, Human
uggcccauccggcuccuccuug

SEQ ID NO: 17352 - RNA, 22 nt, Human
uggccccauuuuucuggagccu

SEQ ID NO: 17353 - RNA, 20 nt, Human
uggcccgcgcuccuccugcu

SEQ ID NO: 17354 - RNA, 22 nt, Human
uggccucauggccuuaucuggg

SEQ ID NO: 17355 - RNA, 22 nt, Human
uggcgcgcucgcucucgcugag

SEQ ID NO: 17356 - RNA, 22 nt, Human
uggcgcucacccugcggcccug

SEQ ID NO: 17357 - RNA, 22 nt, Human
uggcggagacauggacuucaga

SEQ ID NO: 17358 - RNA, 22 nt, Human
uggcgugaagcuggaaggcgga

SEQ ID NO: 17359 - RNA, 22 nt, Human
uggcuacauuuauacucucauu

SEQ ID NO: 17360 - RNA, 22 nt, Human
uggcuacguacaauggaacuuu

SEQ ID NO: 17361 - RNA, 22 nt, Human
uggcucacaggaggcagaggug

SEQ ID NO: 17362 - RNA, 22 nt, Human
uggcucacuuccguggagaggu

SEQ ID NO: 17363 - RNA, 22 nt, Human
uggcucagcgcggccuggucuu

SEQ ID NO: 17364 - RNA, 22 nt, Human
uggcucaggccuacgacgccuu

SEQ ID NO: 17365 - RNA, 23 nt, Human
uggcucugagcuuccugguggcc

SEQ ID NO: 17366 - RNA, 22 nt, Human
uggcugagcugcagcguggcuu

SEQ ID NO: 17367 - RNA, 22 nt, Human
uggcugagugaacauguccauu

SEQ ID NO: 17368 - RNA, 22 nt, Human
uggcugaugucuguucuguuau

SEQ ID NO: 17369 - RNA, 22 nt, Human
uggcugggagcuggaacugggc

SEQ ID NO: 17370 - RNA, 22 nt, Human
uggcuuauggguccucccucuu

SEQ ID NO: 17371 - RNA, 22 nt, Human
uggcuucugguuuauccuuaua

SEQ ID NO: 17372 - RNA, 22 nt, Human
uggcuugacaucaauacuuauu

SEQ ID NO: 17373 - RNA, 22 nt, Human
uggcuugagcugggcccaccug

SEQ ID NO: 17374 - RNA, 22 nt, Human
uggcuuuucaccugcuccucug

SEQ ID NO: 17375 - RNA, 22 nt, Human
uggcuuuuuauuccuaugugau

SEQ ID NO: 17376 - RNA, 22 nt, Human
uggcuuuuuucuccccuuggau

SEQ ID NO: 17377 - RNA, 22 nt, Human
ugggaaacucuaaacuugagua

SEQ ID NO: 17378 - RNA, 22 nt, Human
cugcuuguguugcucagaguca

SEQ ID NO: 17379 - RNA, 22 nt, Human
cugcuuuggaucucucucugcc

SEQ ID NO: 17380 - RNA, 22 nt, Human
cuggaaaaauggauccugucuu

SEQ ID NO: 17381 - RNA, 22 nt, Human
cuggaauugcuugagcuaggaa

SEQ ID NO: 17382 - RNA, 23 nt, Human
cuggacauucgcaaaguucaucu

SEQ ID NO: 17383 - RNA, 22 nt, Human
cuggacucuuuguuuaguucug

SEQ ID NO: 17384 - RNA, 22 nt, Human
cuggagaacucugugcuucacu

SEQ ID NO: 17385 - RNA, 22 nt, Human
cuggagcuucaggguucucggg

SEQ ID NO: 17386 - RNA, 20 nt, Human
cuggaguguagcaguggcug

SEQ ID NO: 17387 - RNA, 22 nt, Human
cuggauagaccccuuauugcau

SEQ ID NO: 17388 - RNA, 22 nt, Human
cuggaucgccccgaugugcccc

SEQ ID NO: 17389 - RNA, 22 nt, Human
cuggaugagcuucgugcgcacg

SEQ ID NO: 17390 - RNA, 22 nt, Human
cuggaugucugggaggcuuccc

SEQ ID NO: 17391 - RNA, 22 nt, Human
cuggauuaaacaguuugauacu

SEQ ID NO: 17392 - RNA, 22 nt, Human
cuggcagcucugagucccuucu

SEQ ID NO: 17393 - RNA, 22 nt, Human
cuggcaguguccagcucgugau

SEQ ID NO: 17394 - RNA, 22 nt, Human
cuggccagccucccagguaccc

SEQ ID NO: 17395 - RNA, 22 nt, Human
cuggcccugucagcacagaauc

SEQ ID NO: 17396 - RNA, 22 nt, Human
cuggccugugggcugucuccgg

SEQ ID NO: 17397 - RNA, 22 nt, Human
cuggccuuaucacaaagcuaga

SEQ ID NO: 17398 - RNA, 22 nt, Human
cuggcgagcugggccuggggga

SEQ ID NO: 17399 - RNA, 22 nt, Human
cuggcgauugcgagagucgccu

SEQ ID NO: 17400 - RNA, 22 nt, Human
cuggcggugaucccgauggugu

SEQ ID NO: 17401 - RNA, 21 nt, Human
cuggcucgccaugguucuuuu

SEQ ID NO: 17402 - RNA, 22 nt, Human
cuggcuguguguuugugcaucu

SEQ ID NO: 17403 - RNA, 22 nt, Human
cugggaaggaagggaaaaacag

SEQ ID NO: 17404 - RNA, 22 nt, Human
cugggaaucuagagggcucauu

SEQ ID NO: 17405 - RNA, 19 nt, Human
cugggacaaugaaagcauc

SEQ ID NO: 17406 - RNA, 22 nt, Human
cugggacacguugugcuuuaac

SEQ ID NO: 17407 - RNA, 22 nt, Human
cugggacccagcccaagucuuu

SEQ ID NO: 17408 - RNA, 22 nt, Human
cugggaccugugugccugggcc

SEQ ID NO: 17409 - RNA, 22 nt, Human
cugggagaggaaccucgagggu

SEQ ID NO: 17410 - RNA, 22 nt, Human
cugggagaugacucagagcagg

SEQ ID NO: 17411 - RNA, 22 nt, Human
cugggcucccucucccgccucg

SEQ ID NO: 17412 - RNA, 22 nt, Human
cuggggccccagcucggccccu

SEQ ID NO: 17413 - RNA, 22 nt, Human
cugggguggugcaggccucaug

SEQ ID NO: 17414 - RNA, 22 nt, Human
cuggguaaauauguauuccuga

SEQ ID NO: 17415 - RNA, 22 nt, Human
cugggugagcuggccagagggu

SEQ ID NO: 17416 - RNA, 22 nt, Human
cugggugugugugaacagagau

SEQ ID NO: 17417 - RNA, 22 nt, Human
cuggguguuccuuucauuuuaa

SEQ ID NO: 17418 - RNA, 22 nt, Human
cuggguuuggcugugcuugaau

SEQ ID NO: 17419 - RNA, 22 nt, Human
cuggucaauaaucauguaguac

SEQ ID NO: 17420 - RNA, 22 nt, Human
cuggucuugguauucgcagaag

SEQ ID NO: 17421 - RNA, 22 nt, Human
cugguuuuccaauguuuugacu

SEQ ID NO: 17422 - RNA, 22 nt, Human
cuguagaugucagguuaaugag

SEQ ID NO: 17423 - RNA, 22 nt, Human
cuguccugauggugccacuggu

SEQ ID NO: 17424 - RNA, 22 nt, Human
cugucucugauaagcucgaggg

SEQ ID NO: 17425 - RNA, 22 nt, Human
cugugaaugguggccacgcguu

SEQ ID NO: 17426 - RNA, 22 nt, Human
cugugcauguucucuagcugau

SEQ ID NO: 17427 - RNA, 22 nt, Human
cugugcuguuaagaaauuuagu

SEQ ID NO: 17428 - RNA, 22 nt, Human
cugugcuucgagggcuccccgc

SEQ ID NO: 17429 - RNA, 22 nt, Human
cuguggcugcgcccugggggag

SEQ ID NO: 17430 - RNA, 22 nt, Human
cugugggcucucaugggaccug

SEQ ID NO: 17431 - RNA, 22 nt, Human
cuguggguggcugugccccagg

SEQ ID NO: 17432 - RNA, 22 nt, Human
cugugguuuuauuuauuugaag

SEQ ID NO: 17433 - RNA, 22 nt, Human
cuguguggccuaaguggagaca

SEQ ID NO: 17434 - RNA, 22 nt, Human
cuguguguauaauguuugauaa

SEQ ID NO: 17435 - RNA, 22 nt, Human
cugugugugcacacguguaugg

SEQ ID NO: 17436 - RNA, 22 nt, Human
cuguguugggauggugcgcgca

SEQ ID NO: 17437 - RNA, 22 nt, Human
cuguuaucaggaguuuucacgg

SEQ ID NO: 17438 - RNA, 22 nt, Human
cuguucuccacuccugacuucu

SEQ ID NO: 17439 - RNA, 22 nt, Human
cuguuguauuuauuucccuuuc

SEQ ID NO: 17440 - RNA, 22 nt, Human
cuguuguguuauuugcagugca

SEQ ID NO: 17441 - RNA, 22 nt, Human
cuguuucucugccugcacacau

SEQ ID NO: 17442 - RNA, 22 nt, Human
cuguuucuuugcugucagagag

SEQ ID NO: 17443 - RNA, 20 nt, Human
cuguuugcuaucaugagcug

SEQ ID NO: 17444 - RNA, 22 nt, Human
cuguuuggaugccauggucaag

SEQ ID NO: 17445 - RNA, 22 nt, Human
cuguuuggcuuccacugcuucu

SEQ ID NO: 17446 - RNA, 22 nt, Human
cuuaagacaggcucaaagauua

SEQ ID NO: 17447 - RNA, 22 nt, Human
cuuacaauuuucuuggacuuuu

SEQ ID NO: 17448 - RNA, 22 nt, Human
cuuaggaaauccuguacucccc

SEQ ID NO: 17449 - RNA, 22 nt, Human
cuuaggcgugugcgggugaggc

SEQ ID NO: 17450 - RNA, 23 nt, Human
cuuauauaaucauuagaaaccau

SEQ ID NO: 17451 - RNA, 22 nt, Human
cuuauucuucuggacuuggagu

SEQ ID NO: 17452 - RNA, 22 nt, Human
cuuauuugcccauguuucuuua

SEQ ID NO: 17453 - RNA, 22 nt, Human
cuucacaaaauauuucauuaua

SEQ ID NO: 17454 - RNA, 22 nt, Human
cuucacuaccuacacugccgcu

SEQ ID NO: 17455 - RNA, 23 nt, Human
cuucagaccucagaaggucuguu

SEQ ID NO: 17456 - RNA, 22 nt, Human
cuucagagugacucagcaucuu

SEQ ID NO: 17457 - RNA, 22 nt, Human
cuucaggaccugaagcccaucu

SEQ ID NO: 17458 - RNA, 19 nt, Human
cuucaguguucaccuggcc

SEQ ID NO: 17459 - RNA, 22 nt, Human
cuucaguuaguuucaugugagc

SEQ ID NO: 17460 - RNA, 22 nt, Human
cuucaugucacugucuuaggua

SEQ ID NO: 17461 - RNA, 22 nt, Human
cuucauguucaugcuaacauuu

SEQ ID NO: 17462 - RNA, 22 nt, Human
cuucauuacagcaaccauuuga

SEQ ID NO: 17463 - RNA, 22 nt, Human
cuuccauucugauggcuaauua

SEQ ID NO: 17464 - RNA, 22 nt, Human
cuucccaucaagcuggaggaug

SEQ ID NO: 17465 - RNA, 22 nt, Human
cuucccuacuucagugcucccu

SEQ ID NO: 17466 - RNA, 22 nt, Human
cuuccuaaucuuggguuauuuu

SEQ ID NO: 17467 - RNA, 22 nt, Human
cuuccugcaacaccuguguugc

SEQ ID NO: 17468 - RNA, 22 nt, Human
cuuccuuucagaggaaggccug

SEQ ID NO: 17469 - RNA, 22 nt, Human
cuucucugcugccugccucuuu

SEQ ID NO: 17470 - RNA, 22 nt, Human
cuucucuuccuucucauccuca

SEQ ID NO: 17471 - RNA, 22 nt, Human
cuucucuuggguguggugucuu

SEQ ID NO: 17472 - RNA, 22 nt, Human
cuucucuuugacaguugggugu

SEQ ID NO: 17473 - RNA, 22 nt, Human
cuucugaugugugcucuuaguu

SEQ ID NO: 17474 - RNA, 22 nt, Human
cuucuguggaauagguuugaca

SEQ ID NO: 17475 - RNA, 22 nt, Human
cuucuguguggauacagucccu

SEQ ID NO: 17476 - RNA, 22 nt, Human
cuucuuaaaguugucacagcug

SEQ ID NO: 17477 - RNA, 22 nt, Human
cuucuuagugauuuaacaugua

SEQ ID NO: 17478 - RNA, 22 nt, Human
cuucuucaucuuuuggaggaac

SEQ ID NO: 17479 - RNA, 22 nt, Human
cuucuugggaggggcggagcuc

SEQ ID NO: 17480 - RNA, 22 nt, Human
uguaguguauagaauuccagca

SEQ ID NO: 17481 - RNA, 21 nt, Human
uguauacacacauuguaccaa

SEQ ID NO: 17482 - RNA, 22 nt, Human
uguauaugucugugagcuauua

SEQ ID NO: 17483 - RNA, 22 nt, Human
uguauauguguguagcauguua

SEQ ID NO: 17484 - RNA, 22 nt, Human
uguaucuguguguauguguuua

SEQ ID NO: 17485 - RNA, 22 nt, Human
uguauggguaggaaacagcugg

SEQ ID NO: 17486 - RNA, 22 nt, Human
uguauugugggugucagagugc

SEQ ID NO: 17487 - RNA, 20 nt, Human
cuugaguucagagcugucau

SEQ ID NO: 17488 - RNA, 22 nt, Human
cuugauucauuuaagguuggag

SEQ ID NO: 17489 - RNA, 22 nt, Human
cuugcagagcccauggauguca

SEQ ID NO: 17490 - RNA, 22 nt, Human
cuugccaguguugcagaagcuc

SEQ ID NO: 17491 - RNA, 22 nt, Human
cuugccucucccucuagggggu

SEQ ID NO: 17492 - RNA, 22 nt, Human
cuugcucugggaauaugaguuu

SEQ ID NO: 17493 - RNA, 22 nt, Human
cuugcuuuaucugguuucucau

SEQ ID NO: 17494 - RNA, 21 nt, Human
cuuggagacucuuggccacau

SEQ ID NO: 17495 - RNA, 22 nt, Human
cuuggcaaaguggcaaaauuag

SEQ ID NO: 17496 - RNA, 22 nt, Human
cuuggcacccaucuuuccaccu

SEQ ID NO: 17497 - RNA, 22 nt, Human
cuuggcauguucaucugcuugg

SEQ ID NO: 17498 - RNA, 23 nt, Human
cuuggcuagccacuuccacgcuc

SEQ ID NO: 17499 - RNA, 22 nt, Human
cuuggggauuuuaaagaccucu

SEQ ID NO: 17500 - RNA, 22 nt, Human
cuuggugagcuccuggcgcagc

SEQ ID NO: 17501 - RNA, 22 nt, Human
cuuguaccuuuguguuuauuuu

SEQ ID NO: 17502 - RNA, 22 nt, Human
cuugucuaguuccuggugaugu

SEQ ID NO: 17503 - RNA, 23 nt, Human
cuugugacagcaauuauagcaag

SEQ ID NO: 17504 - RNA, 22 nt, Human
cuugugagaagaccuuccgcau

SEQ ID NO: 17505 - RNA, 19 nt, Human
cuuguggcuaugcagauac

SEQ ID NO: 17506 - RNA, 22 nt, Human
cuugugggaucuggagacaccg

SEQ ID NO: 17507 - RNA, 22 nt, Human
cuuguuaaaagugacccuaaug

SEQ ID NO: 17508 - RNA, 22 nt, Human
cuuguuuggccauaggugcugg

SEQ ID NO: 17509 - RNA, 22 nt, Human
cuuguuuuaaacuguuguggcu

SEQ ID NO: 17510 - RNA, 22 nt, Human
cuuuaaaaauguauuuuugugg

SEQ ID NO: 17511 - RNA, 22 nt, Human
cuuuaagugaaaggggauuaaa

SEQ ID NO: 17512 - RNA, 18 nt, Human
cuuuagcugucaucuuug

SEQ ID NO: 17513 - RNA, 22 nt, Human
cuuuagugaguguggagcuaga

SEQ ID NO: 17514 - RNA, 22 nt, Human
cuuucauuuuugggcaucugag

SEQ ID NO: 17515 - RNA, 22 nt, Human
cuuuccugaaaucucuucugca

SEQ ID NO: 17516 - RNA, 22 nt, Human
cuuucugauguaaggaacuagg

SEQ ID NO: 17517 - RNA, 22 nt, Human
cuuucuuucaaguucugcuuua

SEQ ID NO: 17518 - RNA, 22 nt, Human
cuuucuuuuugguuucccccca

SEQ ID NO: 17519 - RNA, 22 nt, Human
cuuugcaaagagagaaaguggg

SEQ ID NO: 17520 - RNA, 22 nt, Human
cuuuggacaacugagugacguu

SEQ ID NO: 17521 - RNA, 21 nt, Human
cuuuggcaagggagaagucac

SEQ ID NO: 17522 - RNA, 22 nt, Human
cuuuggggcugaggaggagguu

SEQ ID NO: 17523 - RNA, 22 nt, Human
cuuuguaaucaauaagucuuuu

SEQ ID NO: 17524 - RNA, 22 nt, Human
cuuuuaaucuaauuuuuauauu

SEQ ID NO: 17525 - RNA, 19 nt, Human
cuuuuagagggagaggacu

SEQ ID NO: 17526 - RNA, 22 nt, Human
cuuuucaaacaggacagguccu

SEQ ID NO: 17527 - RNA, 22 nt, Human
cuuuuuaaaguaaauggcuaga

SEQ ID NO: 17528 - RNA, 22 nt, Human
cuuuuucuugugguuaauaucu

SEQ ID NO: 17529 - RNA, 22 nt, Human
cuuuuugcccuugggcuuccug

SEQ ID NO: 17530 - RNA, 22 nt, Human
cuuuuuuucuccauauuucugg

SEQ ID NO: 17531 - RNA, 22 nt, Human
gaaaaaccacaauugguauuuu

SEQ ID NO: 17532 - RNA, 22 nt, Human
gaaaaagagaaggaguucagua

SEQ ID NO: 17533 - RNA, 22 nt, Human
gaaaaagucuuaaaguaaggca

SEQ ID NO: 17534 - RNA, 22 nt, Human
gaaaaauggguuguuugaagau

SEQ ID NO: 17535 - RNA, 22 nt, Human
gaaaagaaaggaugguaugugu

SEQ ID NO: 17536 - RNA, 22 nt, Human
gaaaagcucuuuagaagagguu

SEQ ID NO: 17537 - RNA, 22 nt, Human
gaaaaguauuaugugaggguuc

SEQ ID NO: 17538 - RNA, 22 nt, Human
gaaaaucaugaaaguguguugu

SEQ ID NO: 17539 - RNA, 22 nt, Human
gaaacauuuguugaguacuugc

SEQ ID NO: 17540 - RNA, 22 nt, Human
gaaaccauggcaaccagguccu

SEQ ID NO: 17541 - RNA, 22 nt, Human
gaaagaggcugucagggaaugg

SEQ ID NO: 17542 - RNA, 22 nt, Human
gaaagcuuggaaacgacuuuau

SEQ ID NO: 17543 - RNA, 22 nt, Human
gaaaggagacugcacuggagcc

SEQ ID NO: 17544 - RNA, 22 nt, Human
gaaauaggcccuuacauggaaa

SEQ ID NO: 17545 - RNA, 22 nt, Human
gaaaugggggcaugcguuacau

SEQ ID NO: 17546 - RNA, 22 nt, Human
gaacaaaagauagcccaaacau

SEQ ID NO: 17547 - RNA, 22 nt, Human
gaacaaggauucccaaagaaga

SEQ ID NO: 17548 - RNA, 22 nt, Human
gaacaguuucccuguagaaaau

SEQ ID NO: 17549 - RNA, 22 nt, Human
gaacauauuuagcaccuaauau

SEQ ID NO: 17550 - RNA, 22 nt, Human
gaacaugaguuuuaugguauuu

SEQ ID NO: 17551 - RNA, 19 nt, Human
gaacuaaggggagcucugg

SEQ ID NO: 17552 - RNA, 22 nt, Human
gaacugaauguguaauguuggc

SEQ ID NO: 17553 - RNA, 22 nt, Human
gaacugggguagggguagcuuu

SEQ ID NO: 17554 - RNA, 22 nt, Human
gaacuuaauauacaaucaguuc

SEQ ID NO: 17555 - RNA, 22 nt, Human
gaacuugagugugcuauuucuu

SEQ ID NO: 17556 - RNA, 22 nt, Human
gaacuuuaauuagcuuuugucu

SEQ ID NO: 17557 - RNA, 22 nt, Human
gaagaagagauaauggggagca

SEQ ID NO: 17558 - RNA, 22 nt, Human
gaagaugacaucggaucugucu

SEQ ID NO: 17559 - RNA, 18 nt, Human
gaagcaacaguucugagu

SEQ ID NO: 17560 - RNA, 22 nt, Human
gaagcaagagggaucaggaucu

SEQ ID NO: 17561 - RNA, 22 nt, Human
gaagcagguucuucaggaugaa

SEQ ID NO: 17562 - RNA, 22 nt, Human
gaagccaacacgugggagggag

SEQ ID NO: 17563 - RNA, 22 nt, Human
gaagcggguucacuggauggcu

SEQ ID NO: 17564 - RNA, 22 nt, Human
gaagcuccaggaugccugcacu

SEQ ID NO: 17565 - RNA, 22 nt, Human
gaaggaagcugucuggaugugu

SEQ ID NO: 17566 - RNA, 22 nt, Human
gaaggagaggauugugaggcug

SEQ ID NO: 17567 - RNA, 22 nt, Human
gaaggauaauuuugcuggaugu

SEQ ID NO: 17568 - RNA, 22 nt, Human
gaaggcaguaaauggcuguuuu

SEQ ID NO: 17569 - RNA, 22 nt, Human
gaaggcagucuggggagcagcc

SEQ ID NO: 17570 - RNA, 22 nt, Human
gaagggccaggggcaggcugga

SEQ ID NO: 17571 - RNA, 22 nt, Human
gaaggggccuggggcaaggcua

SEQ ID NO: 17572 - RNA, 22 nt, Human
gaaggugcugaaacagaaauuu

SEQ ID NO: 17573 - RNA, 22 nt, Human
gaagguuuuguuugcaaaucau

SEQ ID NO: 17574 - RNA, 22 nt, Human
gaaguaaugugauugcucaggg

SEQ ID NO: 17575 - RNA, 22 nt, Human
gaagucagaucuuuugacuccc

SEQ ID NO: 17576 - RNA, 22 nt, Human
gaagucaggaaggagauugaag

SEQ ID NO: 17577 - RNA, 22 nt, Human
gaagucuuuucuuccacccaaa

SEQ ID NO: 17578 - RNA, 22 nt, Human
gaaguggggaggagaagacuga

SEQ ID NO: 17579 - RNA, 22 nt, Human
gaauaagaauccacuucuggca

SEQ ID NO: 17580 - RNA, 22 nt, Human
gaauaauuuugaucagaaggga

SEQ ID NO: 17581 - RNA, 22 nt, Human
gaauacaaauaauaccaaggug

SEQ ID NO: 17582 - RNA, 22 nt, Human
gaauaccauuuacauuugaaaa

SEQ ID NO: 17583 - RNA, 22 nt, Human
gaauagauuagaaagaguaugu

SEQ ID NO: 17584 - RNA, 22 nt, Human
gaauauuuaucucagcugcaga

SEQ ID NO: 17585 - RNA, 22 nt, Human
gaaucucuuugucccugaguuu

SEQ ID NO: 17586 - RNA, 20 nt, Human
gaaucuggucaaaugucuau

SEQ ID NO: 17587 - RNA, 22 nt, Human
gaaugcacacgugugugcaugc

SEQ ID NO: 17588 - RNA, 22 nt, Human
gaaugccugggguucuucgauc

SEQ ID NO: 17589 - RNA, 22 nt, Human
gaauggagaacccuggacacug

SEQ ID NO: 17590 - RNA, 22 nt, Human
gaauggaugcuggucaguuugg

SEQ ID NO: 17591 - RNA, 22 nt, Human
gaauggcagaaugaagcagugu

SEQ ID NO: 17592 - RNA, 22 nt, Human
gaaugguuagugaacaaauuug

SEQ ID NO: 17593 - RNA, 22 nt, Human
uguuuagcucugacuaugugau

SEQ ID NO: 17594 - RNA, 22 nt, Human
uguuucaugcagcccccuguca

SEQ ID NO: 17595 - RNA, 22 nt, Human
uguuuccuaagugucucugaag

SEQ ID NO: 17596 - RNA, 22 nt, Human
uucaauggaauucuuagguuuc

SEQ ID NO: 17597 - RNA, 20 nt, Human
uucacagaggacucagguca

SEQ ID NO: 17598 - RNA, 20 nt, Human
uucacagaucucuaacugag

SEQ ID NO: 17599 - RNA, 22 nt, Human
uucacagugguaaggguuguga

SEQ ID NO: 17600 - RNA, 22 nt, Human
uucaccucuuuuuggggacauc

SEQ ID NO: 17601 - RNA, 20 nt, Human
uucacggaggccgcgccccc

SEQ ID NO: 17602 - RNA, 22 nt, Human
uucacuguucuuagagaagacc

SEQ ID NO: 17603 - RNA, 22 nt, Human
uucacuuuuucucugcuugaga

SEQ ID NO: 17604 - RNA, 22 nt, Human
uucagaaagugaaucuuguuau

SEQ ID NO: 17605 - RNA, 22 nt, Human
uucagaauuaucauaauuuuga

SEQ ID NO: 17606 - RNA, 22 nt, Human
uucagaccucaaauccacaugc

SEQ ID NO: 17607 - RNA, 22 nt, Human
uucagaugcuugauuauggcaa

SEQ ID NO: 17608 - RNA, 22 nt, Human
uucagauuuguuuuuguuucug

SEQ ID NO: 17609 - RNA, 22 nt, Human
uucagcacuggacagcgagucu

SEQ ID NO: 17610 - RNA, 22 nt, Human
uucagcauaggcugcucuucaa

SEQ ID NO: 17611 - RNA, 23 nt, Human
uucagcucuccugaagcaucugu

SEQ ID NO: 17612 - RNA, 22 nt, Human
uucaggacacauuauuuaugaa

SEQ ID NO: 17613 - RNA, 20 nt, Human
uucaggaccuuccaguccau

SEQ ID NO: 17614 - RNA, 22 nt, Human
uucaggacuauccaguggucuc

SEQ ID NO: 17615 - RNA, 22 nt, Human
uucaggaucuaggaguauuuuu

SEQ ID NO: 17616 - RNA, 22 nt, Human
uucaggggcaaauacauuuuga

SEQ ID NO: 17617 - RNA, 22 nt, Human
uucaggucauuuuuagcccuag

SEQ ID NO: 17618 - RNA, 22 nt, Human
uucagguuauugaagagcuuuc

SEQ ID NO: 17619 - RNA, 22 nt, Human
uucagguuuuaugguaaugcuu

SEQ ID NO: 17620 - RNA, 22 nt, Human
uucagguuuuuaaguucugccu

SEQ ID NO: 17621 - RNA, 22 nt, Human
uucaguagagguggaaauaaca

SEQ ID NO: 17622 - RNA, 22 nt, Human
uucaguaugcugaaugauuuuu

SEQ ID NO: 17623 - RNA, 22 nt, Human
uucagugggggcuuuccuucug

SEQ ID NO: 17624 - RNA, 22 nt, Human
uucaguuccucuuuugggcucu

SEQ ID NO: 17625 - RNA, 22 nt, Human
uucaguuugaauucuguagaac

SEQ ID NO: 17626 - RNA, 22 nt, Human
uucaguuuugcuuuuaaucaug

SEQ ID NO: 17627 - RNA, 22 nt, Human
uucauacuguuuaaguucuguu

SEQ ID NO: 17628 - RNA, 22 nt, Human
uucauagaagggaguuuuuccu

SEQ ID NO: 17629 - RNA, 22 nt, Human
uucauaugaauuggguuuuuuu

SEQ ID NO: 17630 - RNA, 22 nt, Human
uucauauuuaauuggucaucaa

SEQ ID NO: 17631 - RNA, 22 nt, Human
uucaucauuuuccauuccucuu

SEQ ID NO: 17632 - RNA, 22 nt, Human
uucauccucuuuaucuaccugu

SEQ ID NO: 17633 - RNA, 22 nt, Human
uucaugcgcuuuucaggagugu

SEQ ID NO: 17634 - RNA, 22 nt, Human
uucauggauuugugaaauuuag

SEQ ID NO: 17635 - RNA, 22 nt, Human
uucauuauuaauaauagcagcu

SEQ ID NO: 17636 - RNA, 21 nt, Human
uucauucauggcauaauauag

SEQ ID NO: 17637 - RNA, 22 nt, Human
uucauugauuuccuuggaauaa

SEQ ID NO: 17638 - RNA, 22 nt, Human
uucauugcagaauuuggccuca

SEQ ID NO: 17639 - RNA, 22 nt, Human
uuccaacaugugcuuguguuga

SEQ ID NO: 17640 - RNA, 22 nt, Human
uuccaagcaccaugaaggccuc

SEQ ID NO: 17641 - RNA, 22 nt, Human
uuccaaggcugcuauuuguuuc

SEQ ID NO: 17642 - RNA, 22 nt, Human
uuccacaugaucauuguaauaa

SEQ ID NO: 17643 - RNA, 19 nt, Human
uuccacugcuuagcauugc

SEQ ID NO: 17644 - RNA, 22 nt, Human
uuccacuguucaguucugguca

SEQ ID NO: 17645 - RNA, 22 nt, Human
uuccagaacaauguggacguau

SEQ ID NO: 17646 - RNA, 22 nt, Human
uuccagauguuuaaguucugcu

SEQ ID NO: 17647 - RNA, 22 nt, Human
uuccagcaaagguaguguguua

SEQ ID NO: 17648 - RNA, 22 nt, Human
uuccagucugggcucuucacug

SEQ ID NO: 17649 - RNA, 21 nt, Human
uuccauggacccugucagugu

SEQ ID NO: 17650 - RNA, 22 nt, Human
uuccauuccauaucagguacag

SEQ ID NO: 17651 - RNA, 22 nt, Human
uucccauuccagcucgaucaau

SEQ ID NO: 17652 - RNA, 22 nt, Human
uuccccagaaaaguaaacaagg

SEQ ID NO: 17653 - RNA, 22 nt, Human
uuccccaugugaugcuauugcu

SEQ ID NO: 17654 - RNA, 22 nt, Human
uuccccuucuaauacucaauuu

SEQ ID NO: 17655 - RNA, 22 nt, Human
uucccggccgccccccgcucgg

SEQ ID NO: 17656 - RNA, 22 nt, Human
uucccuacuagccuuaauguuu

SEQ ID NO: 17657 - RNA, 22 nt, Human
uucccuagagagauuuuuauuc

SEQ ID NO: 17658 - RNA, 22 nt, Human
uucccuuggcuuugauuguguu

SEQ ID NO: 17659 - RNA, 21 nt, Human
uuccuaaaaugcuuuugugcc

SEQ ID NO: 17660 - RNA, 22 nt, Human
uuccuaauguccaccuaguccu

SEQ ID NO: 17661 - RNA, 22 nt, Human
uuccucauuuauaggaaagaga

SEQ ID NO: 17662 - RNA, 22 nt, Human
uuccucauuuggcacaucugag

SEQ ID NO: 17663 - RNA, 21 nt, Human
uuccuccucuggagaagaaga

SEQ ID NO: 17664 - RNA, 22 nt, Human
uuccugacacuggcaggcuucu

SEQ ID NO: 17665 - RNA, 22 nt, Human
uuccugaucuuuucccagaguu

SEQ ID NO: 17666 - RNA, 22 nt, Human
uuccuguggggugucaucauag

SEQ ID NO: 17667 - RNA, 22 nt, Human
uuccuuaagauuucccaaguca

SEQ ID NO: 17668 - RNA, 20 nt, Human
uuccuuaucuguaaagugga

SEQ ID NO: 17669 - RNA, 22 nt, Human
uuccuuuaaccaagagcaguac

SEQ ID NO: 17670 - RNA, 19 nt, Human
uuccuuucuauccugggua

SEQ ID NO: 17671 - RNA, 20 nt, Human
uuccuuucuuucuuuuuuuu

SEQ ID NO: 17672 - RNA, 22 nt, Human
uuccuuuucuucuaccacaugu

SEQ ID NO: 17673 - RNA, 21 nt, Human
uucgaaugggucguugcugcc

SEQ ID NO: 17674 - RNA, 22 nt, Human
uucgcucuucacacagugcuga

SEQ ID NO: 17675 - RNA, 22 nt, Human
uucgucaauaugcagccuguga

SEQ ID NO: 17676 - RNA, 22 nt, Human
uucgucauuguuguugguuuuc

SEQ ID NO: 17677 - RNA, 22 nt, Human
uucguugaagcaacgacuuugg

SEQ ID NO: 17678 - RNA, 22 nt, Human
uucuaagaaauggaaaacgauu

SEQ ID NO: 17679 - RNA, 22 nt, Human
uucuagaagggccuaggcauaa

SEQ ID NO: 17680 - RNA, 22 nt, Human
uucuagauagucugauauuccu

SEQ ID NO: 17681 - RNA, 22 nt, Human
uucuaggagucugguuccugcc

SEQ ID NO: 17682 - RNA, 22 nt, Human
uucuaguuacagaagccuugcu

SEQ ID NO: 17683 - RNA, 22 nt, Human
uucuaguuacucuuaaaugcug

SEQ ID NO: 17684 - RNA, 22 nt, Human
uucuauaagagaugaauacagu

SEQ ID NO: 17685 - RNA, 22 nt, Human
uucucaagccuuccuuucccaa

SEQ ID NO: 17686 - RNA, 22 nt, Human
uucucaauggcaacuuguugcu

SEQ ID NO: 17687 - RNA, 20 nt, Human
uucuccacaggguggaggag

SEQ ID NO: 17688 - RNA, 22 nt, Human
uucuccaccugcuccucccacc

SEQ ID NO: 17689 - RNA, 22 nt, Human
uucuccccacuccucccucuga

SEQ ID NO: 17690 - RNA, 22 nt, Human
uucuccucaaaccaucagacau

SEQ ID NO: 17691 - RNA, 22 nt, Human
uucuccucagcaaggcagcuuu

SEQ ID NO: 17692 - RNA, 22 nt, Human
uucuccugacuggccauucagu

SEQ ID NO: 17693 - RNA, 22 nt, Human
uucuccugcccuuggacuucca

SEQ ID NO: 17694 - RNA, 22 nt, Human
uucucuauuugcugcaccucuc

SEQ ID NO: 17695 - RNA, 22 nt, Human
uucucucaguuaaacuuuguga

SEQ ID NO: 17696 - RNA, 18 nt, Human
uucucucuggauaguagu

SEQ ID NO: 17697 - RNA, 22 nt, Human
uucucugaagagccagcccuua

SEQ ID NO: 17698 - RNA, 22 nt, Human
uucucuugccuucucuuuuauc

SEQ ID NO: 17699 - RNA, 22 nt, Human
uucucuuguaaaauuccuuuuu

SEQ ID NO: 17700 - RNA, 22 nt, Human
uucugaaccauugagcacugcc

SEQ ID NO: 17701 - RNA, 22 nt, Human
uucugagguagccacucacugg

SEQ ID NO: 17702 - RNA, 22 nt, Human
uucugauacagucccaacacaa

SEQ ID NO: 17703 - RNA, 20 nt, Human
uucugcagcagguguugaag

SEQ ID NO: 17704 - RNA, 22 nt, Human
uucugcauaggcuauauuuguu

SEQ ID NO: 17705 - RNA, 22 nt, Human
uucugcuagugguauauguuga

SEQ ID NO: 17706 - RNA, 22 nt, Human
gaauuagacggcaucacauggg

SEQ ID NO: 17707 - RNA, 22 nt, Human
gaauuagguaauagaacuagua

SEQ ID NO: 17708 - RNA, 22 nt, Human
gaauuccaggugagagaaggua

SEQ ID NO: 17709 - RNA, 20 nt, Human
gaauucugaagauaauuugg

SEQ ID NO: 17710 - RNA, 19 nt, Human
gaauugcacgagcagaggc

SEQ ID NO: 17711 - RNA, 18 nt, Human
gacaaaaguacagacaga

SEQ ID NO: 17712 - RNA, 22 nt, Human
gacaacuucaguaaaguagauu

SEQ ID NO: 17713 - RNA, 20 nt, Human
gacaagccacagcucccaga

SEQ ID NO: 17714 - RNA, 22 nt, Human
gacacaacuauccaguauggga

SEQ ID NO: 17715 - RNA, 22 nt, Human
gacacccgccggcgccugccuc

SEQ ID NO: 17716 - RNA, 22 nt, Human
gacacugccaagugccccgaga

SEQ ID NO: 17717 - RNA, 22 nt, Human
gacagcaggaugugaggggaug

SEQ ID NO: 17718 - RNA, 22 nt, Human
gacaggaccgagguggggcggg

SEQ ID NO: 17719 - RNA, 22 nt, Human
gacaggcagagaggaagagaga

SEQ ID NO: 17720 - RNA, 22 nt, Human
gacagggacacagccagugagg

SEQ ID NO: 17721 - RNA, 22 nt, Human
gacagguagacaugaauauuaa

SEQ ID NO: 17722 - RNA, 22 nt, Human
gacaguggagccacguugggag

SEQ ID NO: 17723 - RNA, 22 nt, Human
gacaucuguccauggcacugga

SEQ ID NO: 17724 - RNA, 22 nt, Human
gacauuuauuggauuuuacgag

SEQ ID NO: 17725 - RNA, 22 nt, Human
gaccagaacuucuagucuaagu

SEQ ID NO: 17726 - RNA, 22 nt, Human
gaccaggagauuugagcuaggc

SEQ ID NO: 17727 - RNA, 22 nt, Human
gacccgacaaguaaucagguga

SEQ ID NO: 17728 - RNA, 23 nt, Human
gaccucuuccuccagccucugaa

SEQ ID NO: 17729 - RNA, 22 nt, Human
gaccugcucagcccuguguguu

SEQ ID NO: 17730 - RNA, 22 nt, Human
gaccuuguucuggcauucucag

SEQ ID NO: 17731 - RNA, 22 nt, Human
gaccuuucccuaucucacucuc

SEQ ID NO: 17732 - RNA, 20 nt, Human
gacgaacuagaacaguggua

SEQ ID NO: 17733 - RNA, 22 nt, Human
gacgacgggccccguggccacc

SEQ ID NO: 17734 - RNA, 22 nt, Human
gacggaggacaucagcaguguc

SEQ ID NO: 17735 - RNA, 22 nt, Human
gacggggcagccagcugguggc

SEQ ID NO: 17736 - RNA, 22 nt, Human
gacuaaauaaaagccaaacuuc

SEQ ID NO: 17737 - RNA, 22 nt, Human
gacuacauuugguauugacgag

SEQ ID NO: 17738 - RNA, 22 nt, Human
gacuggaaucucugcuuguuaa

SEQ ID NO: 17739 - RNA, 22 nt, Human
gacuggcucuaucaggauaaau

SEQ ID NO: 17740 - RNA, 22 nt, Human
gacuggguaaagcuuauccaaa

SEQ ID NO: 17741 - RNA, 22 nt, Human
gacuggucuuuugugauggaug

SEQ ID NO: 17742 - RNA, 22 nt, Human
gacugucaaauaaaucguuuac

SEQ ID NO: 17743 - RNA, 22 nt, Human
gacuguuggcagauguuugagu

SEQ ID NO: 17744 - RNA, 22 nt, Human
gacuuaaccacggucacauggu

SEQ ID NO: 17745 - RNA, 22 nt, Human
gacuucaagaugaaucuuuggg

SEQ ID NO: 17746 - RNA, 23 nt, Human
gacuucacacucucaaccacugc

SEQ ID NO: 17747 - RNA, 22 nt, Human
gacuucaucagagcguacuguu

SEQ ID NO: 17748 - RNA, 22 nt, Human
gacuucuuaaagaggugaggaa

SEQ ID NO: 17749 - RNA, 22 nt, Human
gacuugaagcucucugguuuug

SEQ ID NO: 17750 - RNA, 22 nt, Human
gacuugcucaaaucagauuuua

SEQ ID NO: 17751 - RNA, 22 nt, Human
gacuuguguagcuucagaauuu

SEQ ID NO: 17752 - RNA, 22 nt, Human
gagaaaaauuucuuugcugcac

SEQ ID NO: 17753 - RNA, 22 nt, Human
gagaaaacauacuuaguguccu

SEQ ID NO: 17754 - RNA, 22 nt, Human
gagaacaaggaagagucggcag

SEQ ID NO: 17755 - RNA, 22 nt, Human
gagaacuauagaaaccuggucu

SEQ ID NO: 17756 - RNA, 22 nt, Human
gagaacuguguauucuuuuuca

SEQ ID NO: 17757 - RNA, 22 nt, Human
gagaaggagcagaaaaucuccu

SEQ ID NO: 17758 - RNA, 22 nt, Human
gagaaguaggaauaucaggagu

SEQ ID NO: 17759 - RNA, 22 nt, Human
gagaagucaggaguggagaaca

SEQ ID NO: 17760 - RNA, 20 nt, Human
gagaaugucauuccuuuuuu

SEQ ID NO: 17761 - RNA, 20 nt, Human
gagaauuccagguuucugug

SEQ ID NO: 17762 - RNA, 22 nt, Human
gagacagugucagccauugaaa

SEQ ID NO: 17763 - RNA, 22 nt, Human
gagaccaagcgugggugauaau

SEQ ID NO: 17764 - RNA, 22 nt, Human
gagacucagccccugcucucaa

SEQ ID NO: 17765 - RNA, 22 nt, Human
gagacugcguggcucugacaca

SEQ ID NO: 17766 - RNA, 22 nt, Human
gagacuguaagcuccuugagga

SEQ ID NO: 17767 - RNA, 22 nt, Human
gagagaaggaagugaauuuccc

SEQ ID NO: 17768 - RNA, 22 nt, Human
gagagagacugggaaaucauca

SEQ ID NO: 17769 - RNA, 22 nt, Human
gagagaguaucugcugguucac

SEQ ID NO: 17770 - RNA, 22 nt, Human
gagagcaaaccuguguuuggag

SEQ ID NO: 17771 - RNA, 22 nt, Human
gagaggcagcucaggaggucag

SEQ ID NO: 17772 - RNA, 18 nt, Human
gagaggcauuuagcugau

SEQ ID NO: 17773 - RNA, 22 nt, Human
gagaggguugggaggcagcaga

SEQ ID NO: 17774 - RNA, 22 nt, Human
gagaggugaagcuaauuaauuu

SEQ ID NO: 17775 - RNA, 22 nt, Human
gagagguuaucugcuaagguag

SEQ ID NO: 17776 - RNA, 22 nt, Human
gagagucuuaaguuacagaacu

SEQ ID NO: 17777 - RNA, 22 nt, Human
gagagugggagauuuccagcag

SEQ ID NO: 17778 - RNA, 22 nt, Human
gagaguuggaggguauguuagu

SEQ ID NO: 17779 - RNA, 22 nt, Human
gagaucuguguuugcugaagcu

SEQ ID NO: 17780 - RNA, 22 nt, Human
gagaugugguucaaggguguuu

SEQ ID NO: 17781 - RNA, 22 nt, Human
gagauuguggcagcagcuguuu

SEQ ID NO: 17782 - RNA, 22 nt, Human
gagauuucauuugugaggcuca

SEQ ID NO: 17783 - RNA, 22 nt, Human
gagauuugaguuccuacugagu

SEQ ID NO: 17784 - RNA, 22 nt, Human
gagcaacacauugaaugaggau

SEQ ID NO: 17785 - RNA, 22 nt, Human
gagcacugagcuggaauuggag

SEQ ID NO: 17786 - RNA, 22 nt, Human
gagcagacugcacaguucuugc

SEQ ID NO: 17787 - RNA, 22 nt, Human
gagcagcacagaccaaacagaa

SEQ ID NO: 17788 - RNA, 22 nt, Human
gagcagcucgagaaggaagcag

SEQ ID NO: 17789 - RNA, 22 nt, Human
gagcagcugagcuggaaugaga

SEQ ID NO: 17790 - RNA, 22 nt, Human
gagcagggagaggcagagaggc

SEQ ID NO: 17791 - RNA, 22 nt, Human
gagcaggucucaguucugccuc

SEQ ID NO: 17792 - RNA, 22 nt, Human
gagcaggucuuugguaaugcuu

SEQ ID NO: 17793 - RNA, 22 nt, Human
gagcaguuagggaccgcaggcu

SEQ ID NO: 17794 - RNA, 22 nt, Human
gagcaugacgcaacaccaagug

SEQ ID NO: 17795 - RNA, 19 nt, Human
gagcaugacuggccuugca

SEQ ID NO: 17796 - RNA, 22 nt, Human
gagccaugagauaagagcaccu

SEQ ID NO: 17797 - RNA, 22 nt, Human
gagccauggaggaugugcagca

SEQ ID NO: 17798 - RNA, 22 nt, Human
gagcccuguagcaagucauguc

SEQ ID NO: 17799 - RNA, 22 nt, Human
gagccgcagcugcguagggucc

SEQ ID NO: 17800 - RNA, 22 nt, Human
gagccucaggguuuuguugaca

SEQ ID NO: 17801 - RNA, 22 nt, Human
gagccuggagcuggaacgaagc

SEQ ID NO: 17802 - RNA, 22 nt, Human
gagccuguuaggcaccuguguu

SEQ ID NO: 17803 - RNA, 22 nt, Human
gagccuuucuggagggcacuug

SEQ ID NO: 17804 - RNA, 22 nt, Human
gagcgacucuuuuaguccagag

SEQ ID NO: 17805 - RNA, 22 nt, Human
gagcggcucaguggccauguga

SEQ ID NO: 17806 - RNA, 22 nt, Human
gagcgugaggcagcuuucuaag

SEQ ID NO: 17807 - RNA, 22 nt, Human
gagcuaauagacagcaacauca

SEQ ID NO: 17808 - RNA, 22 nt, Human
gagcucucgggcuggggcguug

SEQ ID NO: 17809 - RNA, 22 nt, Human
gagcuuuagcugagaccugcuu

SEQ ID NO: 17810 - RNA, 22 nt, Human
gagcuuuguuccgugguggcac

SEQ ID NO: 17811 - RNA, 22 nt, Human
gaggaaaauggaguguaauuaa

SEQ ID NO: 17812 - RNA, 22 nt, Human
gaggaaagcugguuuaaaguau

SEQ ID NO: 17813 - RNA, 22 nt, Human
gaggaagucuuaucuggaugca

SEQ ID NO: 17814 - RNA, 22 nt, Human
uuggcaaagagaugcauaagga

SEQ ID NO: 17815 - RNA, 22 nt, Human
uuggcagagaacagaaugauuu

SEQ ID NO: 17816 - RNA, 22 nt, Human
uuggccaaaaaagucauuagaa

SEQ ID NO: 17817 - RNA, 22 nt, Human
uuggccaaggaccuuuuuggag

SEQ ID NO: 17818 - RNA, 22 nt, Human
uuggccauuacugagccuggag

SEQ ID NO: 17819 - RNA, 22 nt, Human
gaggagcuucagaggaaucuua

SEQ ID NO: 17820 - RNA, 22 nt, Human
gaggaggacauuggaaagaacu

SEQ ID NO: 17821 - RNA, 22 nt, Human
gaggaggagaagcggcggcgga

SEQ ID NO: 17822 - RNA, 22 nt, Human
gaggaggagacggaggccuggg

SEQ ID NO: 17823 - RNA, 22 nt, Human
gaggagggagcuggaagcucuu

SEQ ID NO: 17824 - RNA, 22 nt, Human
gaggauaaugaaucugaaucau

SEQ ID NO: 17825 - RNA, 22 nt, Human
gaggaucuuuagcgggacugcu

SEQ ID NO: 17826 - RNA, 22 nt, Human
gaggcagaggaugggacuguau

SEQ ID NO: 17827 - RNA, 22 nt, Human
gaggcaggaagggaggguugug

SEQ ID NO: 17828 - RNA, 22 nt, Human
gaggcaggcggggcccaggugg

SEQ ID NO: 17829 - RNA, 22 nt, Human
gaggcauaaguagaagagauug

SEQ ID NO: 17830 - RNA, 22 nt, Human
gaggccagcacccagaugcaug

SEQ ID NO: 17831 - RNA, 22 nt, Human
gaggccuucauuucuccgucug

SEQ ID NO: 17832 - RNA, 22 nt, Human
gaggcggcgacgcgggcccggg

SEQ ID NO: 17833 - RNA, 22 nt, Human
gaggcucagagggacuuucaag

SEQ ID NO: 17834 - RNA, 22 nt, Human
gaggcugguucccuugaucuuu

SEQ ID NO: 17835 - RNA, 22 nt, Human
gaggcuugccacuguccauggc

SEQ ID NO: 17836 - RNA, 22 nt, Human
gagggaaaggggccaugauugg

SEQ ID NO: 17837 - RNA, 22 nt, Human
gagggcauugucuucuuaguuu

SEQ ID NO: 17838 - RNA, 22 nt, Human
gagggcucaacuacuacuaggc

SEQ ID NO: 17839 - RNA, 22 nt, Human
gagggcugccacguugggcgag

SEQ ID NO: 17840 - RNA, 22 nt, Human
gaggggaacaggcauucuuaag

SEQ ID NO: 17841 - RNA, 22 nt, Human
gaggggaagaacaauuuaauuu

SEQ ID NO: 17842 - RNA, 22 nt, Human
gaggggaaggauuucuucagaa

SEQ ID NO: 17843 - RNA, 22 nt, Human
gaggggaauguuccugagcugg

SEQ ID NO: 17844 - RNA, 22 nt, Human
gaggggcgaggacgcugaagua

SEQ ID NO: 17845 - RNA, 22 nt, Human
gaggggcuccagguguugagga

SEQ ID NO: 17846 - RNA, 22 nt, Human
gagggggaaaagggcagcagag

SEQ ID NO: 17847 - RNA, 22 nt, Human
gagggggcaggcucggcaccgg

SEQ ID NO: 17848 - RNA, 22 nt, Human
gaggggggcacuuguuuugacu

SEQ ID NO: 17849 - RNA, 22 nt, Human
gagggguuguuaacaaagaaua

SEQ ID NO: 17850 - RNA, 22 nt, Human
gaggguaaauucagaguaggag

SEQ ID NO: 17851 - RNA, 22 nt, Human
gaggguaagcugggacuccucg

SEQ ID NO: 17852 - RNA, 22 nt, Human
gagggugguggcggccggcacc

SEQ ID NO: 17853 - RNA, 22 nt, Human
gagggugugguauggauguguu

SEQ ID NO: 17854 - RNA, 22 nt, Human
gaggguuagauuuuaagaaaga

SEQ ID NO: 17855 - RNA, 22 nt, Human
gaggucacacugauagucuuga

SEQ ID NO: 17856 - RNA, 22 nt, Human
gagguccaggguggggccugag

SEQ ID NO: 17857 - RNA, 22 nt, Human
gagguucgauacagcguauuua

SEQ ID NO: 17858 - RNA, 20 nt, Human
gagguugcucagaguggggu

SEQ ID NO: 17859 - RNA, 22 nt, Human
gagguuggggugucucucccca

SEQ ID NO: 17860 - RNA, 22 nt, Human
gagguuuaguccauaguauuua

SEQ ID NO: 17861 - RNA, 22 nt, Human
gaguaaggaaguguuggccaca

SEQ ID NO: 17862 - RNA, 22 nt, Human
gaguaauuuucuuaaaacauca

SEQ ID NO: 17863 - RNA, 22 nt, Human
gaguacagaagauaaaggcaca

SEQ ID NO: 17864 - RNA, 22 nt, Human
gaguagccucagucugcaagug

SEQ ID NO: 17865 - RNA, 22 nt, Human
gaguaugugaggaaguaaagaa

SEQ ID NO: 17866 - RNA, 22 nt, Human
gaguauuagaagaguaguuauu

SEQ ID NO: 17867 - RNA, 22 nt, Human
gaguauucuauguauauuauug

SEQ ID NO: 17868 - RNA, 22 nt, Human
gagucaaugugcagugcagccc

SEQ ID NO: 17869 - RNA, 22 nt, Human
gagucaggucaggcuuguagau

SEQ ID NO: 17870 - RNA, 22 nt, Human
gaguccuggagagcccgagcgc

SEQ ID NO: 17871 - RNA, 22 nt, Human
gagucuacaugcaggcaauugu

SEQ ID NO: 17872 - RNA, 22 nt, Human
gagucuuuuaagaugucuuacu

SEQ ID NO: 17873 - RNA, 19 nt, Human
gagugaggagcaucguuua

SEQ ID NO: 17874 - RNA, 22 nt, Human
gagugggugaaugugcucauaa

SEQ ID NO: 17875 - RNA, 22 nt, Human
gagugguaaaguguacugaaua

SEQ ID NO: 17876 - RNA, 22 nt, Human
gaguggugagaauacaacggaa

SEQ ID NO: 17877 - RNA, 20 nt, Human
gagugucacacacaaccccu

SEQ ID NO: 17878 - RNA, 22 nt, Human
gaguguuugcuguauaauugga

SEQ ID NO: 17879 - RNA, 22 nt, Human
gaguuaaauagcuuaggauuca

SEQ ID NO: 17880 - RNA, 22 nt, Human
gaguuauuuuuccuguuuuuua

SEQ ID NO: 17881 - RNA, 22 nt, Human
gaguuucacguagaucaggguc

SEQ ID NO: 17882 - RNA, 22 nt, Human
gauaauuauaggcuaagccacu

SEQ ID NO: 17883 - RNA, 22 nt, Human
gauacugugggcacucauaaua

SEQ ID NO: 17884 - RNA, 19 nt, Human
gauauugagcugagaauuc

SEQ ID NO: 17885 - RNA, 22 nt, Human
gaucauauccagucaccacuau

SEQ ID NO: 17886 - RNA, 22 nt, Human
gaucauuuucauuaauguugca

SEQ ID NO: 17887 - RNA, 22 nt, Human
gaucccaguccuacccucauaa

SEQ ID NO: 17888 - RNA, 22 nt, Human
gaucccccaucuacuaucccca

SEQ ID NO: 17889 - RNA, 21 nt, Human
gaucgcaaugugggaaucaug

SEQ ID NO: 17890 - RNA, 22 nt, Human
gaucuguccuggcaguuaacac

SEQ ID NO: 17891 - RNA, 22 nt, Human
gaugaagaaacucaaccaagaa

SEQ ID NO: 17892 - RNA, 18 nt, Human
gaugaagaggaagaggag

SEQ ID NO: 17893 - RNA, 22 nt, Human
gaugauaacagcauuucaacug

SEQ ID NO: 17894 - RNA, 23 nt, Human
gaugauggcaacuacauccggug

SEQ ID NO: 17895 - RNA, 22 nt, Human
gaugauuccuuuguucauugug

SEQ ID NO: 17896 - RNA, 22 nt, Human
gaugauugaauaaauaugguca

SEQ ID NO: 17897 - RNA, 22 nt, Human
gaugauuuuguaacuggggaca

SEQ ID NO: 17898 - RNA, 22 nt, Human
gaugccuccaggaaagaggacg

SEQ ID NO: 17899 - RNA, 22 nt, Human
gauggcaaugcuagaaauuuag

SEQ ID NO: 17900 - RNA, 22 nt, Human
gaugggaggaugaauuggaccu

SEQ ID NO: 17901 - RNA, 22 nt, Human
gauggguugaguucauggagcc

SEQ ID NO: 17902 - RNA, 22 nt, Human
gauggguuugagauguuugggu

SEQ ID NO: 17903 - RNA, 22 nt, Human
gauggugcaauuaucgugcaug

SEQ ID NO: 17904 - RNA, 22 nt, Human
gaugguggggggcagcugggag

SEQ ID NO: 17905 - RNA, 22 nt, Human
gaugguuuuacauuuuaauguu

SEQ ID NO: 17906 - RNA, 22 nt, Human
gauguaucugagcugcuuaggu

SEQ ID NO: 17907 - RNA, 22 nt, Human
gaugugugugcccugggccugc

SEQ ID NO: 17908 - RNA, 22 nt, Human
gauguuaauauguuucaccaaa

SEQ ID NO: 17909 - RNA, 22 nt, Human
gauuaagaaagauagaugugga

SEQ ID NO: 17910 - RNA, 22 nt, Human
gauucagagcugcaacaaagaa

SEQ ID NO: 17911 - RNA, 22 nt, Human
gauucuaucauucuguauauua

SEQ ID NO: 17912 - RNA, 22 nt, Human
gauugauguaggugauaaaucu

SEQ ID NO: 17913 - RNA, 22 nt, Human
gauugauuuaauaugagaggau

SEQ ID NO: 17914 - RNA, 22 nt, Human
gauugcauaugcauucugauac

SEQ ID NO: 17915 - RNA, 22 nt, Human
gauugggagugugacauuguau

SEQ ID NO: 17916 - RNA, 20 nt, Human
gauuuaacgcugcgucuguc

SEQ ID NO: 17917 - RNA, 22 nt, Human
gauuuuaaaagauguauaaggu

SEQ ID NO: 17918 - RNA, 22 nt, Human
gauuuuuaaaaguaguuuugaa

SEQ ID NO: 17919 - RNA, 22 nt, Human
gcaaaaacaguguagucuucug

SEQ ID NO: 17920 - RNA, 22 nt, Human
gcaaggaagcagaguugcuauc

SEQ ID NO: 17921 - RNA, 22 nt, Human
gcaaggacagaagcccacacag

SEQ ID NO: 17922 - RNA, 22 nt, Human
gcaaggaggguaaccacauuuc

SEQ ID NO: 17923 - RNA, 22 nt, Human
uuuagugagugugaaucaaaug

SEQ ID NO: 17924 - RNA, 22 nt, Human
uuuaguugcuuuaguugagcug

SEQ ID NO: 17925 - RNA, 22 nt, Human
uuuauaagccagacacugcguu

SEQ ID NO: 17926 - RNA, 22 nt, Human
uuuauaauuacguaaaauauuu

SEQ ID NO: 17927 - RNA, 22 nt, Human
uuuauauauauguaggagcaca

SEQ ID NO: 17928 - RNA, 22 nt, Human
uuuaucaggccaucuuaugucu

SEQ ID NO: 17929 - RNA, 22 nt, Human
uuuaucucugcauagaagugau

SEQ ID NO: 17930 - RNA, 22 nt, Human
uuuaugauguagccuagagcug

SEQ ID NO: 17931 - RNA, 22 nt, Human
uuuaugguacaggaaugcuguu

SEQ ID NO: 17932 - RNA, 22 nt, Human
uuuauguugagcaaaauaccac

SEQ ID NO: 17933 - RNA, 22 nt, Human
uuuauuuagguaaacaugaguu

SEQ ID NO: 17934 - RNA, 19 nt, Human
uuuauuugagacaugccuu

SEQ ID NO: 17935 - RNA, 22 nt, Human
uuuauuugggauuucucaucug

SEQ ID NO: 17936 - RNA, 22 nt, Human
uuuauuuggugguguuacuguu

SEQ ID NO: 17937 - RNA, 19 nt, Human
uuucacaaagagagcguga

SEQ ID NO: 17938 - RNA, 22 nt, Human
uuucacagcgucuuucucuugc

SEQ ID NO: 17939 - RNA, 16 nt, Human
uuucacucuagaggua

SEQ ID NO: 17940 - RNA, 22 nt, Human
uuucacugaguaggagagcacu

SEQ ID NO: 17941 - RNA, 22 nt, Human
uuucacuucgaucagaguuuuu

SEQ ID NO: 17942 - RNA, 22 nt, Human
uuucagaaauggcacugaaauc

SEQ ID NO: 17943 - RNA, 22 nt, Human
uuucagagaaagcccaaagacu

SEQ ID NO: 17944 - RNA, 22 nt, Human
uuucagauuauguucauggguu

SEQ ID NO: 17945 - RNA, 22 nt, Human
uuucagcaugacuguuaucuuu

SEQ ID NO: 17946 - RNA, 22 nt, Human
uuucagguggaaguuuuagaug

SEQ ID NO: 17947 - RNA, 22 nt, Human
uuucagugaaugaauggcuaac

SEQ ID NO: 17948 - RNA, 22 nt, Human
uuucauagaggcagcggcggau

SEQ ID NO: 17949 - RNA, 22 nt, Human
uuucauggaggccaggacagag

SEQ ID NO: 17950 - RNA, 21 nt, Human
uuucauuaguacaucaauuug

SEQ ID NO: 17951 - RNA, 22 nt, Human
uuuccacacucacugcacucau

SEQ ID NO: 17952 - RNA, 22 nt, Human
uuuccagacaugguuuuucaaa

SEQ ID NO: 17953 - RNA, 21 nt, Human
uuuccagaggcagccggacuc

SEQ ID NO: 17954 - RNA, 22 nt, Human
uuuccccugggaacauugauuc

SEQ ID NO: 17955 - RNA, 22 nt, Human
uuucccuugcgcuugcucuccg

SEQ ID NO: 17956 - RNA, 18 nt, Human
uuuccucauuugcagacu

SEQ ID NO: 17957 - RNA, 22 nt, Human
uuuccuguccugguacuuggca

SEQ ID NO: 17958 - RNA, 22 nt, Human
uuuccuguuuugguuuggagag

SEQ ID NO: 17959 - RNA, 22 nt, Human
uuuccuuacuuauaaaaugggg

SEQ ID NO: 17960 - RNA, 22 nt, Human
uuuccuucccuccugggccuuc

SEQ ID NO: 17961 - RNA, 22 nt, Human
uuuccuuuguuuugguauaugu

SEQ ID NO: 17962 - RNA, 22 nt, Human
uuucgcuuguucggagugcuuu

SEQ ID NO: 17963 - RNA, 22 nt, Human
uuucguugcacucauaugguug

SEQ ID NO: 17964 - RNA, 22 nt, Human
uuucuaaaauuacugcagucgg

SEQ ID NO: 17965 - RNA, 22 nt, Human
uuucuaaguuugaggcgaagca

SEQ ID NO: 17966 - RNA, 22 nt, Human
uuucuacauuuguaaccagauu

SEQ ID NO: 17967 - RNA, 22 nt, Human
uuucuaguagcuacagcaccau

SEQ ID NO: 17968 - RNA, 22 nt, Human
uuucucagcauauugccuuuga

SEQ ID NO: 17969 - RNA, 22 nt, Human
uuucucagccuccuugcuggag

SEQ ID NO: 17970 - RNA, 20 nt, Human
uuucucccacaaugacccuc

SEQ ID NO: 17971 - RNA, 22 nt, Human
uuucucuuucaaucugcaguac

SEQ ID NO: 17972 - RNA, 22 nt, Human
uuucucuuuuugggguggggug

SEQ ID NO: 17973 - RNA, 23 nt, Human
uuucugaguuuuuuaaaagucca

SEQ ID NO: 17974 - RNA, 22 nt, Human
uuucugaugaaguagaaagacc

SEQ ID NO: 17975 - RNA, 22 nt, Human
uuucugcuuucuaguugguguu

SEQ ID NO: 17976 - RNA, 22 nt, Human
uuucuggaaacuguaaagagga

SEQ ID NO: 17977 - RNA, 22 nt, Human
uuucuggacuaaagggagagau

SEQ ID NO: 17978 - RNA, 22 nt, Human
uuucuggauaagcagggucucu

SEQ ID NO: 17979 - RNA, 19 nt, Human
uuucuggguucaccucuug

SEQ ID NO: 17980 - RNA, 22 nt, Human
uuucugguuuuauucugggguu

SEQ ID NO: 17981 - RNA, 22 nt, Human
uuucuguucuguuggauucuuu

SEQ ID NO: 17982 - RNA, 22 nt, Human
uuucuguuuguaacuccagcaa

SEQ ID NO: 17983 - RNA, 22 nt, Human
uuucuuaaaagcuuuuaaaguu

SEQ ID NO: 17984 - RNA, 22 nt, Human
uuucuuaguuaaguagguaggc

SEQ ID NO: 17985 - RNA, 22 nt, Human
uuucuugggaaaugucagaagu

SEQ ID NO: 17986 - RNA, 22 nt, Human
uuucuuugggcccuggcagucu

SEQ ID NO: 17987 - RNA, 18 nt, Human
uuucuuuuauuccagguc

SEQ ID NO: 17988 - RNA, 22 nt, Human
uuucuuuuucuacaccuuagcu

SEQ ID NO: 17989 - RNA, 22 nt, Human
uuugaauauacuucaaacaaag

SEQ ID NO: 17990 - RNA, 22 nt, Human
uuugaauauuaugucccacuuu

SEQ ID NO: 17991 - RNA, 21 nt, Human
uuugacagaccagguauaguu

SEQ ID NO: 17992 - RNA, 22 nt, Human
uuugaguacagcugccuuuuug

SEQ ID NO: 17993 - RNA, 22 nt, Human
uuugagugcccauguuucccag

SEQ ID NO: 17994 - RNA, 22 nt, Human
uuugagugccucgaguguggga

SEQ ID NO: 17995 - RNA, 22 nt, Human
uuugaugauuuucuagagugua

SEQ ID NO: 17996 - RNA, 22 nt, Human
uuugauuaccuggggcccucug

SEQ ID NO: 17997 - RNA, 20 nt, Human
uuugauugccccucugacuu

SEQ ID NO: 17998 - RNA, 22 nt, Human
uuugauuuuuugagcaguguau

SEQ ID NO: 17999 - RNA, 22 nt, Human
uuugcaaaguccauugaaguua

SEQ ID NO: 18000 - RNA, 23 nt, Human
uuugcaaauuggacacaaccaca

SEQ ID NO: 18001 - RNA, 22 nt, Human
uuugcacuuaaauuuacaacac

SEQ ID NO: 18002 - RNA, 22 nt, Human
uuugcauuaguuuagauuucaa

SEQ ID NO: 18003 - RNA, 22 nt, Human
uuugcauuugagagaggaaaca

SEQ ID NO: 18004 - RNA, 22 nt, Human
uuugccccacaggcagcuuugg

SEQ ID NO: 18005 - RNA, 22 nt, Human
uuugccggaucugucuccagcu

SEQ ID NO: 18006 - RNA, 23 nt, Human
uuugccuaaugaagacuauguca

SEQ ID NO: 18007 - RNA, 22 nt, Human
uuugcuccucuucauuuguauc

SEQ ID NO: 18008 - RNA, 22 nt, Human
uuugcuguaaugcaugucagag

SEQ ID NO: 18009 - RNA, 22 nt, Human
uuugcuguccaauauucagggu

SEQ ID NO: 18010 - RNA, 22 nt, Human
uuuggaggaaugaguuuaauau

SEQ ID NO: 18011 - RNA, 22 nt, Human
uuuggaugcugucauaugcugc

SEQ ID NO: 18012 - RNA, 22 nt, Human
uuuggcaccuccaaggacucgc

SEQ ID NO: 18013 - RNA, 22 nt, Human
uuuggcuaccugggagggaaag

SEQ ID NO: 18014 - RNA, 22 nt, Human
uuuggcuccccaggaucugaaa

SEQ ID NO: 18015 - RNA, 22 nt, Human
uuuggcuuugauccuaggauuc

SEQ ID NO: 18016 - RNA, 22 nt, Human
uuugggaaguaauuaauugcag

SEQ ID NO: 18017 - RNA, 18 nt, Human
uuugggauccucuuuucu

SEQ ID NO: 18018 - RNA, 22 nt, Human
uuugggccugucugccugcuuu

SEQ ID NO: 18019 - RNA, 22 nt, Human
uuuggguuuuuccuuagggacu

SEQ ID NO: 18020 - RNA, 22 nt, Human
uuuggugacuguaggaaaggau

SEQ ID NO: 18021 - RNA, 22 nt, Human
uuuggugauuuuuaaucccccu

SEQ ID NO: 18022 - RNA, 22 nt, Human
uuugguguuuucaggaauauac

SEQ ID NO: 18023 - RNA, 22 nt, Human
uuuguaaguuuguucuccuggg

SEQ ID NO: 18024 - RNA, 22 nt, Human
uuuguacuuucuaauguauuua

SEQ ID NO: 18025 - RNA, 22 nt, Human
uuuguauuucaaggcacucuca

SEQ ID NO: 18026 - RNA, 22 nt, Human
uuugucaggaauugaaaaguuu

SEQ ID NO: 18027 - RNA, 22 nt, Human
uuugugauaaguggauucaagg

SEQ ID NO: 18028 - RNA, 17 nt, Human
uuugugauggcagaugc

SEQ ID NO: 18029 - RNA, 22 nt, Human
uuuguggugagcagggaacguc

SEQ ID NO: 18030 - RNA, 22 nt, Human
uuuguguuacaguccuagaacu

SEQ ID NO: 18031 - RNA, 22 nt, Human
uuuguguuggaagaaaugcuac

SEQ ID NO: 18032 - RNA, 22 nt, Human
gccgcgggucugggucuggcuc

SEQ ID NO: 18033 - RNA, 22 nt, Human
gccgggagaggcggcgcagggg

SEQ ID NO: 18034 - RNA, 20 nt, Human
gccggggcauaggggccguc

SEQ ID NO: 18035 - RNA, 22 nt, Human
gccuaagguucuucagcuauaa

SEQ ID NO: 18036 - RNA, 22 nt, Human
gccuagaagaaugagcgcaggg

SEQ ID NO: 18037 - RNA, 22 nt, Human
gccuccagaggggacaaaaauu

SEQ ID NO: 18038 - RNA, 22 nt, Human
gccuccggagucgcagugucuu

SEQ ID NO: 18039 - RNA, 20 nt, Human
gccuccuccaaguuucauca

SEQ ID NO: 18040 - RNA, 22 nt, Human
gccucucagagcuguucaguuu

SEQ ID NO: 18041 - RNA, 22 nt, Human
gccucucagcuagaaggcaggu

SEQ ID NO: 18042 - RNA, 18 nt, Human
gccucuguugacagaguu

SEQ ID NO: 18043 - RNA, 22 nt, Human
gccucuuugcucuuugguuguu

SEQ ID NO: 18044 - RNA, 22 nt, Human
gccugaaaugaaccagaggacu

SEQ ID NO: 18045 - RNA, 22 nt, Human
uuuuaaauggcuuuuacuuuuc

SEQ ID NO: 18046 - RNA, 22 nt, Human
uuuuaacuuuaccauuucuuca

SEQ ID NO: 18047 - RNA, 22 nt, Human
uuuuacgucuuugcugccucgu

SEQ ID NO: 18048 - RNA, 22 nt, Human
uuuuagaagcauuuaugagauu

SEQ ID NO: 18049 - RNA, 22 nt, Human
uuuuauaauacccuugacuaau

SEQ ID NO: 18050 - RNA, 22 nt, Human
uuuuauguuccugaagcuaucu

SEQ ID NO: 18051 - RNA, 22 nt, Human
uuuucacugacuuggucuggaa

SEQ ID NO: 18052 - RNA, 22 nt, Human
uuuucauagccagaaacugaaa

SEQ ID NO: 18053 - RNA, 22 nt, Human
uuuucauuguuaguuucuccuu

SEQ ID NO: 18054 - RNA, 22 nt, Human
uuuuccaaaaguggagaggaau

SEQ ID NO: 18055 - RNA, 22 nt, Human
uuuuccccuacuaacacugagu

SEQ ID NO: 18056 - RNA, 22 nt, Human
uuuuccgaccuuaggaaggaac

SEQ ID NO: 18057 - RNA, 22 nt, Human
uuuuccuucugauacuccauuu

SEQ ID NO: 18058 - RNA, 22 nt, Human
uuuucggagaauguuaaugugu

SEQ ID NO: 18059 - RNA, 22 nt, Human
uuuucucucacuucacauauuu

SEQ ID NO: 18060 - RNA, 22 nt, Human
uuuucucuuugcuucucuaaaa

SEQ ID NO: 18061 - RNA, 22 nt, Human
uuuucuguuuaugaaauugugu

SEQ ID NO: 18062 - RNA, 22 nt, Human
uuuucuucggugcuggguugau

SEQ ID NO: 18063 - RNA, 22 nt, Human
uuuucuucucauucugaccuca

SEQ ID NO: 18064 - RNA, 22 nt, Human
uuuucuugagucacuccaguga

SEQ ID NO: 18065 - RNA, 22 nt, Human
uuuucuuggaguggcuguccuu

SEQ ID NO: 18066 - RNA, 22 nt, Human
uuuugaauaauucagaaacagc

SEQ ID NO: 18067 - RNA, 22 nt, Human
uuuugauacaaguuguaaaaaa

SEQ ID NO: 18068 - RNA, 22 nt, Human
uuuugccuauuguaucaucgua

SEQ ID NO: 18069 - RNA, 22 nt, Human
uuuuggaaaaaccaguauggaa

SEQ ID NO: 18070 - RNA, 22 nt, Human
uuuuggauugcuaacucagggu

SEQ ID NO: 18071 - RNA, 22 nt, Human
uuuugguaguccagaguuuagu

SEQ ID NO: 18072 - RNA, 22 nt, Human
uuuugguauaauuuaaaauuaa

SEQ ID NO: 18073 - RNA, 22 nt, Human
uuuugguauggcuugauagagu

SEQ ID NO: 18074 - RNA, 20 nt, Human
uuuuguccaccugcaggaag

SEQ ID NO: 18075 - RNA, 22 nt, Human
uuuuuaaaagaugauuuaauga

SEQ ID NO: 18076 - RNA, 22 nt, Human
uuuuuaauuuuaagcuauuugu

SEQ ID NO: 18077 - RNA, 22 nt, Human
uuuuuaccugguguccagcuuc

SEQ ID NO: 18078 - RNA, 22 nt, Human
uuuuuagcauaugucaaaucag

SEQ ID NO: 18079 - RNA, 21 nt, Human
uuuuucuccagaguuuccacu

SEQ ID NO: 18080 - RNA, 22 nt, Human
uuuuucuccucucucuuucauu

SEQ ID NO: 18081 - RNA, 22 nt, Human
uuuuucugccucucucccacau

SEQ ID NO: 18082 - RNA, 22 nt, Human
uuuuugaauaagugcaucauca

SEQ ID NO: 18083 - RNA, 22 nt, Human
uuuuugcccuaaagaagucauu

SEQ ID NO: 18084 - RNA, 22 nt, Human
uuuuugcuuuuuugucaucuaa

SEQ ID NO: 18085 - RNA, 22 nt, Human
uuuuugggaagaauucugauau

SEQ ID NO: 18086 - RNA, 22 nt, Human
uuuuugggccaaauauauuuac

SEQ ID NO: 18087 - RNA, 22 nt, Human
uuuuuguaaaugaaguuuuauu

SEQ ID NO: 18088 - RNA, 22 nt, Human
uuuuuguuauuuagguguagag

SEQ ID NO: 18089 - RNA, 22 nt, Human
uuuuuuaaucaaguaggaaaca

SEQ ID NO: 18090 - RNA, 22 nt, Human
uuuuuuccagcuucuagaggcc

SEQ ID NO: 18091 - RNA, 22 nt, Human
uuuuuuccugguuacagauugu

SEQ ID NO: 18092 - RNA, 22 nt, Human
uuuuuuccuguuugucuuuggg

SEQ ID NO: 18093 - RNA, 22 nt, Human
uuuuuucuucucuaucuuaaua

SEQ ID NO: 18094 - RNA, 22 nt, Human
uuuuuugguuuggggauuauuu

SEQ ID NO: 18095 - RNA, 22 nt, Human
uuuuuugucuugaagaaauggu

SEQ ID NO: 18096 - RNA, 22 nt, Human
uuuuuuguggcuggaagaaaaa

SEQ ID NO: 18097 - RNA, 22 nt, Human
uuuuuuguuccuugguuuuugu

SEQ ID NO: 18098 - RNA, 18 nt, Human
uuuuuuguucuguuuugu

SEQ ID NO: 18099 - RNA, 22 nt, Human
uuuuuuuccaguuauucauuuu

SEQ ID NO: 18100 - RNA, 22 nt, Human
uuuuuuuguagguguaugaaaa

SEQ ID NO: 18101 - RNA, 22 nt, Human
aaaaaaacuaauuuuaaaugug

SEQ ID NO: 18102 - RNA, 22 nt, Human
aaaaaauugcuggcagagcugu

SEQ ID NO: 18103 - RNA, 20 nt, Human
aaaaauguguuuauggagau

SEQ ID NO: 18104 - RNA, 22 nt, Human
aaaaauuucuggugaaaugccu

SEQ ID NO: 18105 - RNA, 22 nt, Human
aaaaccugcaagaugaaaucag

SEQ ID NO: 18106 - RNA, 22 nt, Human
aaaacuuucagggauacagaaa

SEQ ID NO: 18107 - RNA, 22 nt, Human
aaaagacaaggaucuggaguga

SEQ ID NO: 18108 - RNA, 22 nt, Human
aaaagcauuauuagucugggug

SEQ ID NO: 18109 - RNA, 22 nt, Human
aaaagcgaagagaacugaaguu

SEQ ID NO: 18110 - RNA, 22 nt, Human
aaaagcucucuucuucggcuuu

SEQ ID NO: 18111 - RNA, 22 nt, Human
aaaaggaagaguuuucagagac

SEQ ID NO: 18112 - RNA, 22 nt, Human
aaaagguuauagcuuugccuug

SEQ ID NO: 18113 - RNA, 22 nt, Human
aaaaguauaagugucuccugau

SEQ ID NO: 18114 - RNA, 22 nt, Human
aaaaguuguaauauuuccuuua

SEQ ID NO: 18115 - RNA, 22 nt, Human
aaaauacuaggaaaauaaauca

SEQ ID NO: 18116 - RNA, 22 nt, Human
aaaauauguugagauacugaaa

SEQ ID NO: 18117 - RNA, 22 nt, Human
aaaauauucuauaucaaagaua

SEQ ID NO: 18118 - RNA, 22 nt, Human
aaaaugggaaaauuuuagauua

SEQ ID NO: 18119 - RNA, 22 nt, Human
aaaauuuccuuggaccauuuuu

SEQ ID NO: 18120 - RNA, 19 nt, Human
aacuacagcgcacuguccu

SEQ ID NO: 18121 - RNA, 22 nt, Human
aacuagugucuguaugauaagg

SEQ ID NO: 18122 - RNA, 22 nt, Human
aacucccucaacuuccuucucu

SEQ ID NO: 18123 - RNA, 22 nt, Human
aacucugagaaacuugcaguug

SEQ ID NO: 18124 - RNA, 22 nt, Human
aacucugcaaugaaaucauguu

SEQ ID NO: 18125 - RNA, 19 nt, Human
aacucugccgaggcaagcc

SEQ ID NO: 18126 - RNA, 23 nt, Human
aacucuggcuagcauagaauaga

SEQ ID NO: 18127 - RNA, 23 nt, Human
aacugcaagguugcugggaagua

SEQ ID NO: 18128 - RNA, 22 nt, Human
aacugcauaagcuucgggaccu

SEQ ID NO: 18129 - RNA, 22 nt, Human
aacuggguuuaucuaaugugua

SEQ ID NO: 18130 - RNA, 22 nt, Human
aacugguaauuuaguauuacug

SEQ ID NO: 18131 - RNA, 22 nt, Human
aacuuagagcucuccuaaauga

SEQ ID NO: 18132 - RNA, 22 nt, Human
aacuuauacccagggcagaaau

SEQ ID NO: 18133 - RNA, 22 nt, Human
aacuucuggaaacuuccaugug

SEQ ID NO: 18134 - RNA, 22 nt, Human
aacuuucugaaaagcuugauca

SEQ ID NO: 18135 - RNA, 20 nt, Human
aacuuugagugcaugacuuu

SEQ ID NO: 18136 - RNA, 22 nt, Human
aacuuuuaugaaggaaaucaua

SEQ ID NO: 18137 - RNA, 22 nt, Human
aagaaaagguaaccgcuuaucu

SEQ ID NO: 18138 - RNA, 22 nt, Human
aagaaaccauauuaguuccugg

SEQ ID NO: 18139 - RNA, 22 nt, Human
aagaaagaucugaaagaagcga

SEQ ID NO: 18140 - RNA, 22 nt, Human
aagaaaggcacaagaaagaaaa

SEQ ID NO: 18141 - RNA, 22 nt, Human
aagaaauacagaaauggcagua

SEQ ID NO: 18142 - RNA, 22 nt, Human
aagaacaacugcuuuaaaagca

SEQ ID NO: 18143 - RNA, 19 nt, Human
aagaacaguucuaauuuca

SEQ ID NO: 18144 - RNA, 22 nt, Human
aagaacuagauagugguguaaa

SEQ ID NO: 18145 - RNA, 22 nt, Human
aagaaggcggaccagaagggag

SEQ ID NO: 18146 - RNA, 22 nt, Human
aagaagguugaaugacuacuuu

SEQ ID NO: 18147 - RNA, 22 nt, Human
aagaaguccuugaggcgcaccc

SEQ ID NO: 18148 - RNA, 22 nt, Human
aagaaugaaaugaaagaacuaa

SEQ ID NO: 18149 - RNA, 22 nt, Human
aagacacuuucuaaauagaagu

SEQ ID NO: 18150 - RNA, 22 nt, Human
aagacagaaaagcagagagagg

SEQ ID NO: 18151 - RNA, 22 nt, Human
aagaccacaggaaucaaacagg

SEQ ID NO: 18152 - RNA, 22 nt, Human
aagacccuaccccuggagagga

SEQ ID NO: 18153 - RNA, 21 nt, Human
aagacguaguuggguggacca

SEQ ID NO: 18154 - RNA, 22 nt, Human
aagagaaaaaucuuaaucuagu

SEQ ID NO: 18155 - RNA, 22 nt, Human
aagagaaagggaaaaugguaaa

SEQ ID NO: 18156 - RNA, 22 nt, Human
aagaggaauaauaaaaauugca

SEQ ID NO: 18157 - RNA, 22 nt, Human
aagaggcagcuugguaggcauc

SEQ ID NO: 18158 - RNA, 22 nt, Human
aagagugaguagcuugguuggu

SEQ ID NO: 18159 - RNA, 22 nt, Human
aagagugugagguugugcuuuu

SEQ ID NO: 18160 - RNA, 22 nt, Human
aagaguuaggagugggcuuuga

SEQ ID NO: 18161 - RNA, 22 nt, Human
aagauagaaugauguuggcuca

SEQ ID NO: 18162 - RNA, 22 nt, Human
aagaucugaccgugauggcggc

SEQ ID NO: 18163 - RNA, 22 nt, Human
aagaugcaagcauuuugaacug

SEQ ID NO: 18164 - RNA, 22 nt, Human
aagaugcuucaugagaguuggg

SEQ ID NO: 18165 - RNA, 22 nt, Human
aagauguuguagauuagugaga

SEQ ID NO: 18166 - RNA, 22 nt, Human
aagauuuaccacuuuauucaag

SEQ ID NO: 18167 - RNA, 22 nt, Human
aagauuugaaaguggugcauuu

SEQ ID NO: 18168 - RNA, 22 nt, Human
aagcaaaagguuacacuucugg

SEQ ID NO: 18169 - RNA, 22 nt, Human
aagcaaagucaucuagaguagu

SEQ ID NO: 18170 - RNA, 23 nt, Human
aagcaacagacuucaucagauau

SEQ ID NO: 18171 - RNA, 22 nt, Human
aagcaacccagugcuuguauag

SEQ ID NO: 18172 - RNA, 22 nt, Human
aagcaaguucuaaaguaauucu

SEQ ID NO: 18173 - RNA, 22 nt, Human
aagcaauucacaguucacuuaa

SEQ ID NO: 18174 - RNA, 22 nt, Human
aagcacuaauauuuuggcaccu

SEQ ID NO: 18175 - RNA, 22 nt, Human
aagcagaacuguuuuguuuucu

SEQ ID NO: 18176 - RNA, 22 nt, Human
aagcagacugggccauaaggaa

SEQ ID NO: 18177 - RNA, 22 nt, Human
aagcaugaaauaauguccuugu

SEQ ID NO: 18178 - RNA, 22 nt, Human
aagccagccaguuccagcagcu

SEQ ID NO: 18179 - RNA, 22 nt, Human
aagcccuuugaaaauguguguc

SEQ ID NO: 18180 - RNA, 22 nt, Human
aagccucaugccagauccaggu

SEQ ID NO: 18181 - RNA, 22 nt, Human
aagccugguuauuugaggaugu

SEQ ID NO: 18182 - RNA, 22 nt, Human
aagccuguugacagcugucagu

SEQ ID NO: 18183 - RNA, 22 nt, Human
aagcgcaaggugucagcagguu

SEQ ID NO: 18184 - RNA, 22 nt, Human
aagcgcggccgccgcggucgcu

SEQ ID NO: 18185 - RNA, 22 nt, Human
aagcgggcagcggccugcgcca

SEQ ID NO: 18186 - RNA, 22 nt, Human
aagcucuauaggagauacagua

SEQ ID NO: 18187 - RNA, 22 nt, Human
aagcugcagacccccugucuca

SEQ ID NO: 18188 - RNA, 22 nt, Human
aagcugccugggaggaagggcu

SEQ ID NO: 18189 - RNA, 20 nt, Human
aagcuguguucaagauggga

SEQ ID NO: 18190 - RNA, 22 nt, Human
aagcuguuagggagugguaggu

SEQ ID NO: 18191 - RNA, 22 nt, Human
aagcuguuauuucacagguuca

SEQ ID NO: 18192 - RNA, 22 nt, Human
aagcuuugaauauuagaccuug

SEQ ID NO: 18193 - RNA, 22 nt, Human
aagcuuugggcagaagaggauu

SEQ ID NO: 18194 - RNA, 22 nt, Human
aaggaacuucagggcgaaugga

SEQ ID NO: 18195 - RNA, 22 nt, Human
aaggacaccaaacuaauuggga

SEQ ID NO: 18196 - RNA, 22 nt, Human
aaggagcuuucauuacagccuu

SEQ ID NO: 18197 - RNA, 20 nt, Human
aaggaggcuuaaaguuagaa

SEQ ID NO: 18198 - RNA, 22 nt, Human
aaggaguacagggagggucccu

SEQ ID NO: 18199 - RNA, 22 nt, Human
aaggaugguaacaguuucauuu

SEQ ID NO: 18200 - RNA, 22 nt, Human
aaggauguuuaaacuacuuucc

SEQ ID NO: 18201 - RNA, 22 nt, Human
aaggcagagggaaaacgggaau

SEQ ID NO: 18202 - RNA, 22 nt, Human
aaggcaggagaguaggaggugg

SEQ ID NO: 18203 - RNA, 22 nt, Human
aaggccacacuugcuggccagc

SEQ ID NO: 18204 - RNA, 22 nt, Human
aaggcgauuuaaagauguuagg

SEQ ID NO: 18205 - RNA, 22 nt, Human
aaggcugaccaguuuacacuuu

SEQ ID NO: 18206 - RNA, 22 nt, Human
aaggcugugaacuuuucgggaa

SEQ ID NO: 18207 - RNA, 22 nt, Human
aagggaaggaugggcauuuaca

SEQ ID NO: 18208 - RNA, 22 nt, Human
aagggaaguuugacacuuuuua

SEQ ID NO: 18209 - RNA, 22 nt, Human
aagggaccucagcaaucaggga

SEQ ID NO: 18210 - RNA, 22 nt, Human
aagggagagggagaagguggga

SEQ ID NO: 18211 - RNA, 22 nt, Human
aagggcuucucgccugugugca

SEQ ID NO: 18212 - RNA, 22 nt, Human
aaggggaauaguaggaccuggg

SEQ ID NO: 18213 - RNA, 22 nt, Human
aaggggaggccugcgcuuucgg

SEQ ID NO: 18214 - RNA, 22 nt, Human
aaggggauuuaagguaagaaga

SEQ ID NO: 18215 - RNA, 22 nt, Human
aagguaaugcaucaggcaggga

SEQ ID NO: 18216 - RNA, 22 nt, Human
aagguauaaauaacucgggagg

SEQ ID NO: 18217 - RNA, 22 nt, Human
aaggucucucgggcuuugcuga

SEQ ID NO: 18218 - RNA, 22 nt, Human
aaggucuuggcucuggccgcac

SEQ ID NO: 18219 - RNA, 23 nt, Human
aaggugaagccaccaggugagga

SEQ ID NO: 18220 - RNA, 22 nt, Human
aaggugcauuaguuuggagggg

SEQ ID NO: 18221 - RNA, 22 nt, Human
aaggugccacuucccucagacu

SEQ ID NO: 18222 - RNA, 22 nt, Human
aaggugcugaggguccuggcuu

SEQ ID NO: 18223 - RNA, 22 nt, Human
aagguggugaucaucuugaagg

SEQ ID NO: 18224 - RNA, 22 nt, Human
aagguguaaguagcugguucau

SEQ ID NO: 18225 - RNA, 22 nt, Human
aagguuuuguaugaaaucucug

SEQ ID NO: 18226 - RNA, 22 nt, Human
aagguuuuguuuucgguuuuuu

SEQ ID NO: 18227 - RNA, 22 nt, Human
aaguaacuggguggccccaguu

SEQ ID NO: 18228 - RNA, 22 nt, Human
aaguaauuugugaaggcauguu

SEQ ID NO: 18229 - RNA, 21 nt, Human
aaguacccuuuugcuacucag

SEQ ID NO: 18230 - RNA, 22 nt, Human
aaguagaaaaccgcacuggacu

SEQ ID NO: 18231 - RNA, 22 nt, Human
aaacaaauccaauaauaaaauu

SEQ ID NO: 18232 - RNA, 22 nt, Human
aaacaauaauaauuaggaagga

SEQ ID NO: 18233 - RNA, 22 nt, Human
aaacaccaagagcuagcuauua

SEQ ID NO: 18234 - RNA, 22 nt, Human
aaacauaugccuucuuuuguaa

SEQ ID NO: 18235 - RNA, 22 nt, Human
aaacauguagugcaugaggauc

SEQ ID NO: 18236 - RNA, 22 nt, Human
aaacccaggguuuugucuuccc

SEQ ID NO: 18237 - RNA, 22 nt, Human
aaacccauauaccagcugugcu

SEQ ID NO: 18238 - RNA, 22 nt, Human
aaaccgguacccuccugccugc

SEQ ID NO: 18239 - RNA, 23 nt, Human
aaacuacauuuauaguuuuucuc

SEQ ID NO: 18240 - RNA, 22 nt, Human
aaacucuaagacuaaaauugaa

SEQ ID NO: 18241 - RNA, 20 nt, Human
aaacucuuuucuuacauuuu

SEQ ID NO: 18242 - RNA, 22 nt, Human
aaacugacugaugugaucuuau

SEQ ID NO: 18243 - RNA, 22 nt, Human
aaacugugcagucacauaagga

SEQ ID NO: 18244 - RNA, 22 nt, Human
aaacuuuaggcacauggaucua

SEQ ID NO: 18245 - RNA, 22 nt, Human
aaacuuuaucaaguacucuuca

SEQ ID NO: 18246 - RNA, 22 nt, Human
aaacuuuugaaggaggaaaaag

SEQ ID NO: 18247 - RNA, 22 nt, Human
aaagaauuucaagauucccaca

SEQ ID NO: 18248 - RNA, 22 nt, Human
aaagacagccuguuggcuuucu

SEQ ID NO: 18249 - RNA, 22 nt, Human
aaagaccuucacuuucuggcug

SEQ ID NO: 18250 - RNA, 22 nt, Human
aaagacuaaccaguugucaaaa

SEQ ID NO: 18251 - RNA, 22 nt, Human
aaagagggaaggaaggagugaa

SEQ ID NO: 18252 - RNA, 22 nt, Human
aaagagugugcauguaccugug

SEQ ID NO: 18253 - RNA, 20 nt, Human
aaagauacuuuuuguaaugg

SEQ ID NO: 18254 - RNA, 22 nt, Human
aaagaucaguuaacgccaucaa

SEQ ID NO: 18255 - RNA, 22 nt, Human
aaagaugaaguucagcgaagaa

SEQ ID NO: 18256 - RNA, 22 nt, Human
aaagcagguugcaauuacagug

SEQ ID NO: 18257 - RNA, 22 nt, Human
aaagcauuuguuucuccuggaa

SEQ ID NO: 18258 - RNA, 22 nt, Human
aaagccaagguccauguacuuu

SEQ ID NO: 18259 - RNA, 22 nt, Human
aaagccaagucugauuuuguug

SEQ ID NO: 18260 - RNA, 22 nt, Human
aaagccauaucuauucuauucu

SEQ ID NO: 18261 - RNA, 22 nt, Human
aaagcccuccaggguauacauu

SEQ ID NO: 18262 - RNA, 17 nt, Human
aaagccgaucagauguu

SEQ ID NO: 18263 - RNA, 22 nt, Human
aaagcgagccggcuuggaggga

SEQ ID NO: 18264 - RNA, 22 nt, Human
aaagcuccaaauggguggaagu

SEQ ID NO: 18265 - RNA, 22 nt, Human
aaaggcaugugcaacuacaaau

SEQ ID NO: 18266 - RNA, 22 nt, Human
aaagggagauaaaguaauuuua

SEQ ID NO: 18267 - RNA, 22 nt, Human
aaaggugccucuuacaaggcuu

SEQ ID NO: 18268 - RNA, 23 nt, Human
aaaguacuuaaucugcaaaccac

SEQ ID NO: 18269 - RNA, 22 nt, Human
aaaguagaauaauaaacccuug

SEQ ID NO: 18270 - RNA, 22 nt, Human
aaaguagaugagaauuuuguug

SEQ ID NO: 18271 - RNA, 22 nt, Human
aaaguguaagucccugguuguc

SEQ ID NO: 18272 - RNA, 22 nt, Human
aaaguguuaacacuggcuacuu

SEQ ID NO: 18273 - RNA, 22 nt, Human
aaaguguuuaacaaauugcuuu

SEQ ID NO: 18274 - RNA, 22 nt, Human
aaaguuacacgacuauuuaugu

SEQ ID NO: 18275 - RNA, 22 nt, Human
aaaguuacccaaucucuaugaa

SEQ ID NO: 18276 - RNA, 22 nt, Human
aaaguugcauccuaugaccuca

SEQ ID NO: 18277 - RNA, 22 nt, Human
aaaguuuguacugggaguuacu

SEQ ID NO: 18278 - RNA, 23 nt, Human
aaauaauaauuucucuguuggga

SEQ ID NO: 18279 - RNA, 22 nt, Human
aaauagauuugacuacuuggug

SEQ ID NO: 18280 - RNA, 22 nt, Human
aaauagucagaaaucaacgugc

SEQ ID NO: 18281 - RNA, 22 nt, Human
aaauauauauaauauauauauu

SEQ ID NO: 18282 - RNA, 22 nt, Human
aaauauauccuucuguccugcc

SEQ ID NO: 18283 - RNA, 22 nt, Human
aaauaugguaucugccaaacua

SEQ ID NO: 18284 - RNA, 22 nt, Human
aaauauuaaugaugaagguagu

SEQ ID NO: 18285 - RNA, 22 nt, Human
aaauauuagacauaccuggaga

SEQ ID NO: 18286 - RNA, 22 nt, Human
aaaucaaaagugguuauuuuau

SEQ ID NO: 18287 - RNA, 22 nt, Human
aaaucaagucagcugaauucca

SEQ ID NO: 18288 - RNA, 22 nt, Human
aaaucauagccaugaacauuug

SEQ ID NO: 18289 - RNA, 21 nt, Human
aaauccagugaucuccucuaa

SEQ ID NO: 18290 - RNA, 22 nt, Human
aaaucccacucacgaguuuugc

SEQ ID NO: 18291 - RNA, 22 nt, Human
aaaucgcuugaacccaggaagu

SEQ ID NO: 18292 - RNA, 22 nt, Human
aaaucuuucacauauuuuuuau

SEQ ID NO: 18293 - RNA, 22 nt, Human
aaauggauaaucaagauaauca

SEQ ID NO: 18294 - RNA, 22 nt, Human
aaaugguguucuuuagaugaaa

SEQ ID NO: 18295 - RNA, 22 nt, Human
aaaugucugagacuucugaacu

SEQ ID NO: 18296 - RNA, 22 nt, Human
aaauguguagaggggagagccg

SEQ ID NO: 18297 - RNA, 22 nt, Human
aaauguuucauucuauuuuuag

SEQ ID NO: 18298 - RNA, 22 nt, Human
aaauguuugguggauaaaagga

SEQ ID NO: 18299 - RNA, 22 nt, Human
aaauuaaaguuuuauuuagagc

SEQ ID NO: 18300 - RNA, 22 nt, Human
aaauuaacuaucacuuuuguga

SEQ ID NO: 18301 - RNA, 22 nt, Human
aaauucagauggcuuucuuuuc

SEQ ID NO: 18302 - RNA, 22 nt, Human
aaauucagcagguuucaaaagc

SEQ ID NO: 18303 - RNA, 22 nt, Human
aaauuuauaacuuaaagugaau

SEQ ID NO: 18304 - RNA, 21 nt, Human
aaauuucauauggccaaccua

SEQ ID NO: 18305 - RNA, 22 nt, Human
aacaaaacauuuuacgaauaua

SEQ ID NO: 18306 - RNA, 19 nt, Human
aacaaaauaguucuaguua

SEQ ID NO: 18307 - RNA, 22 nt, Human
aacaaagaacuuucuuccuuug

SEQ ID NO: 18308 - RNA, 22 nt, Human
aacacuguaucagucuucaaua

SEQ ID NO: 18309 - RNA, 22 nt, Human
aacaggaagaauccagauggug

SEQ ID NO: 18310 - RNA, 22 nt, Human
aacaggcuaaauuguccauuuc

SEQ ID NO: 18311 - RNA, 22 nt, Human
aacagggcaguuccuuauagug

SEQ ID NO: 18312 - RNA, 22 nt, Human
aacagggcgugaauaaugaaga

SEQ ID NO: 18313 - RNA, 22 nt, Human
aacagguucaagccuugcagca

SEQ ID NO: 18314 - RNA, 21 nt, Human
aacagguuuccuaccacuugc

SEQ ID NO: 18315 - RNA, 22 nt, Human
aacaguaugugagauuuacaca

SEQ ID NO: 18316 - RNA, 22 nt, Human
aacaucaaaggaagaaugauau

SEQ ID NO: 18317 - RNA, 22 nt, Human
aacaucugagagcccuugugca

SEQ ID NO: 18318 - RNA, 22 nt, Human
aacaugggcaacuucuuuucag

SEQ ID NO: 18319 - RNA, 22 nt, Human
aacauuuauguuuugaccaagu

SEQ ID NO: 18320 - RNA, 22 nt, Human
aaccaaaguugguauuuaauaa

SEQ ID NO: 18321 - RNA, 22 nt, Human
aaccaagcucaauggucugagu

SEQ ID NO: 18322 - RNA, 22 nt, Human
aaccaauaagaggaugccauuu

SEQ ID NO: 18323 - RNA, 22 nt, Human
aaccaaucaaauuggaauugaa

SEQ ID NO: 18324 - RNA, 22 nt, Human
aaccaggcgagagagcggucag

SEQ ID NO: 18325 - RNA, 22 nt, Human
aaccaguacuucucuauucagu

SEQ ID NO: 18326 - RNA, 22 nt, Human
aaccauggauuucaguucaccu

SEQ ID NO: 18327 - RNA, 22 nt, Human
aacccacuaugauuguccucau

SEQ ID NO: 18328 - RNA, 22 nt, Human
aacccuaguugauagcuugggu

SEQ ID NO: 18329 - RNA, 22 nt, Human
aaccggauugauccuucuuuga

SEQ ID NO: 18330 - RNA, 22 nt, Human
aaccuaagaacagcaggcuccu

SEQ ID NO: 18331 - RNA, 22 nt, Human
aaccuagaggaagaugggucag

SEQ ID NO: 18332 - RNA, 22 nt, Human
aaccucgggcugcacuuggcac

SEQ ID NO: 18333 - RNA, 22 nt, Human
aaccugaggguagacaaguuca

SEQ ID NO: 18334 - RNA, 22 nt, Human
aaccuggaggaccuuaugcuaa

SEQ ID NO: 18335 - RNA, 22 nt, Human
aacgaugauaaauuguucucug

SEQ ID NO: 18336 - RNA, 22 nt, Human
aacgauuugaguuaguuuuuag

SEQ ID NO: 18337 - RNA, 22 nt, Human
aacgcaacaacuggagcuguag

SEQ ID NO: 18338 - RNA, 22 nt, Human
aacgcagagaguaaugcugaac

SEQ ID NO: 18339 - RNA, 22 nt, Human
aacgccgggacucgcagggagc

SEQ ID NO: 18340 - RNA, 22 nt, Human
aacgggcacuuuauuuaaaaaa

SEQ ID NO: 18341 - RNA, 22 nt, Human
aacuaaggccacaagaggcaaa

SEQ ID NO: 18342 - RNA, 22 nt, Human
aguugugagaaugaacacugaa

SEQ ID NO: 18343 - RNA, 22 nt, Human
aguuuacccacuguugaaauua

SEQ ID NO: 18344 - RNA, 22 nt, Human
aguuucaguuaguugggugaca

SEQ ID NO: 18345 - RNA, 22 nt, Human
aguuuccacuggagacacugug

SEQ ID NO: 18346 - RNA, 22 nt, Human
aguuucccucacaggucugcau

SEQ ID NO: 18347 - RNA, 22 nt, Human
aguuuggauccugcuaaaccag

SEQ ID NO: 18348 - RNA, 22 nt, Human
aguuuguagguuaggaucagca

SEQ ID NO: 18349 - RNA, 22 nt, Human
aguuuucugccucuggaugcgu

SEQ ID NO: 18350 - RNA, 22 nt, Human
aguuuuugccucgaauucugcg

SEQ ID NO: 18351 - RNA, 22 nt, Human
auaaaagcacaauagaguuaug

SEQ ID NO: 18352 - RNA, 22 nt, Human
auaaaaucugaagcaagaauaa

SEQ ID NO: 18353 - RNA, 22 nt, Human
auaaagggccuuauuuuagcaa

SEQ ID NO: 18354 - RNA, 22 nt, Human
auaaaguaaugcauauaaugug

SEQ ID NO: 18355 - RNA, 22 nt, Human
auaaauucuaugauggauuggg

SEQ ID NO: 18356 - RNA, 22 nt, Human
auaaauuugacagcucuucaug

SEQ ID NO: 18357 - RNA, 22 nt, Human
auaaauuugccagcauauguuc

SEQ ID NO: 18358 - RNA, 22 nt, Human
auaaccaaaaauaguuuaguac

SEQ ID NO: 18359 - RNA, 22 nt, Human
auaacccuauuaaauggugcgc

SEQ ID NO: 18360 - RNA, 22 nt, Human
auaagccugccuuaucuccaga

SEQ ID NO: 18361 - RNA, 22 nt, Human
auaaggacuugaauuagacauu

SEQ ID NO: 18362 - RNA, 22 nt, Human
auaaggcauagugagucaucau

SEQ ID NO: 18363 - RNA, 22 nt, Human
auaaguuauuuuaguaaaucag

SEQ ID NO: 18364 - RNA, 23 nt, Human
auaaugauaaugcuauuuuuugu

SEQ ID NO: 18365 - RNA, 22 nt, Human
auaaugccucauaggguguucc

SEQ ID NO: 18366 - RNA, 22 nt, Human
auaauugaauaagagcugcagg

SEQ ID NO: 18367 - RNA, 19 nt, Human
auacacguguauacauaca

SEQ ID NO: 18368 - RNA, 22 nt, Human
auacagccuaguuugaguccca

SEQ ID NO: 18369 - RNA, 22 nt, Human
auacauaggauauguacgugca

SEQ ID NO: 18370 - RNA, 22 nt, Human
auacauauaugcacauuaauau

SEQ ID NO: 18371 - RNA, 22 nt, Human
auacaucuuaacgcgcucuugg

SEQ ID NO: 18372 - RNA, 21 nt, Human
auaccaaaagaacaccuuguu

SEQ ID NO: 18373 - RNA, 22 nt, Human
auacuaagcucauuacauuuug

SEQ ID NO: 18374 - RNA, 22 nt, Human
auacuacaucacagccaagaag

SEQ ID NO: 18375 - RNA, 22 nt, Human
auacuagccugggcaucuccua

SEQ ID NO: 18376 - RNA, 22 nt, Human
auacugagauguuaauagggug

SEQ ID NO: 18377 - RNA, 22 nt, Human
auacuuccugcuucccugaucu

SEQ ID NO: 18378 - RNA, 22 nt, Human
auacuuccuuaauuuggggaaa

SEQ ID NO: 18379 - RNA, 23 nt, Human
auacuuuuuuucuacguuaucuc

SEQ ID NO: 18380 - RNA, 22 nt, Human
auagaagguaaugccccaaggg

SEQ ID NO: 18381 - RNA, 22 nt, Human
auagaagugaaaagggaugacu

SEQ ID NO: 18382 - RNA, 22 nt, Human
auagaauggcaccagcaucuac

SEQ ID NO: 18383 - RNA, 22 nt, Human
auagacacagcuaugauuugag

SEQ ID NO: 18384 - RNA, 18 nt, Human
auagacaggaaaaaugga

SEQ ID NO: 18385 - RNA, 22 nt, Human
auagacauuuauagagaaugac

SEQ ID NO: 18386 - RNA, 22 nt, Human
auagacuagccaaagacuucug

SEQ ID NO: 18387 - RNA, 19 nt, Human
auagagggaauguuuuccu

SEQ ID NO: 18388 - RNA, 22 nt, Human
auagaguguguguuauguguga

SEQ ID NO: 18389 - RNA, 22 nt, Human
auagaguucucuuuggaggagu

SEQ ID NO: 18390 - RNA, 22 nt, Human
auagauagaagggacguggugc

SEQ ID NO: 18391 - RNA, 22 nt, Human
auagauugcucauauauuacuu

SEQ ID NO: 18392 - RNA, 22 nt, Human
auagcaacucugcuuccuugcc

SEQ ID NO: 18393 - RNA, 22 nt, Human
auagcacuuaauaugaaacagu

SEQ ID NO: 18394 - RNA, 19 nt, Human
auagcagaagucauuuuca

SEQ ID NO: 18395 - RNA, 22 nt, Human
auagcaguauuaugagauaacu

SEQ ID NO: 18396 - RNA, 22 nt, Human
auaggacuguacagaauacaag

SEQ ID NO: 18397 - RNA, 22 nt, Human
auaggacuuuguaucaggauga

SEQ ID NO: 18398 - RNA, 22 nt, Human
auaggagcaagauuauagcagg

SEQ ID NO: 18399 - RNA, 22 nt, Human
auaggaguauaaggcaguaacu

SEQ ID NO: 18400 - RNA, 22 nt, Human
auaggaguuauggaaugagccc

SEQ ID NO: 18401 - RNA, 22 nt, Human
auaggcauaacacugauguccu

SEQ ID NO: 18402 - RNA, 22 nt, Human
auagggaggcggagggagcugg

SEQ ID NO: 18403 - RNA, 22 nt, Human
auaggggagcagccagagaaga

SEQ ID NO: 18404 - RNA, 22 nt, Human
auaguaaauguuaacagcaaca

SEQ ID NO: 18405 - RNA, 23 nt, Human
auagucaggaacuguuggugugu

SEQ ID NO: 18406 - RNA, 22 nt, Human
auaguccuucuuuaacuuagau

SEQ ID NO: 18407 - RNA, 22 nt, Human
auaguuaagguguacugaagau

SEQ ID NO: 18408 - RNA, 22 nt, Human
auaguuaucuguggauaagguu

SEQ ID NO: 18409 - RNA, 22 nt, Human
auauaacccaaggcaggcugug

SEQ ID NO: 18410 - RNA, 22 nt, Human
auauaaugugugcuuuauugaa

SEQ ID NO: 18411 - RNA, 22 nt, Human
auauaggcugaaaaauagaauu

SEQ ID NO: 18412 - RNA, 22 nt, Human
auauaugcaacaagaaagcaua

SEQ ID NO: 18413 - RNA, 22 nt, Human
auauauguauauaugugugugu

SEQ ID NO: 18414 - RNA, 22 nt, Human
auaucugaugacgugacuaugu

SEQ ID NO: 18415 - RNA, 22 nt, Human
auaucuuguuuuugauuucuug

SEQ ID NO: 18416 - RNA, 22 nt, Human
auaugcagaaaauaaaggaauu

SEQ ID NO: 18417 - RNA, 21 nt, Human
auauggauauuauuuuguguc

SEQ ID NO: 18418 - RNA, 22 nt, Human
auauguaguuucagaaguggaa

SEQ ID NO: 18419 - RNA, 23 nt, Human
auaugucaugcaccagcacuuua

SEQ ID NO: 18420 - RNA, 22 nt, Human
auauguuaugccauuuucaagg

SEQ ID NO: 18421 - RNA, 22 nt, Human
auauguuuuaguagaaucccaa

SEQ ID NO: 18422 - RNA, 22 nt, Human
auauuauuaaaauagauggaua

SEQ ID NO: 18423 - RNA, 22 nt, Human
auauucaaugaggucauauaag

SEQ ID NO: 18424 - RNA, 21 nt, Human
auauuguugggguuuucuuuu

SEQ ID NO: 18425 - RNA, 22 nt, Human
auauuucuacaggcugauuuua

SEQ ID NO: 18426 - RNA, 22 nt, Human
auauuugcccccaugcccuggc

SEQ ID NO: 18427 - RNA, 22 nt, Human
auauuuguuagcugcuuuggag

SEQ ID NO: 18428 - RNA, 22 nt, Human
auauuuuugcagaauuuuucgu

SEQ ID NO: 18429 - RNA, 22 nt, Human
aucaaacuaugguccaugggca

SEQ ID NO: 18430 - RNA, 22 nt, Human
aucaacucacagugugcuggca

SEQ ID NO: 18431 - RNA, 22 nt, Human
aucaagacaaaggaaaggcuaa

SEQ ID NO: 18432 - RNA, 22 nt, Human
aucaaguuauuaaguagcuuuc

SEQ ID NO: 18433 - RNA, 22 nt, Human
aucaauaaccauagugguuaca

SEQ ID NO: 18434 - RNA, 22 nt, Human
aucaaugggucaaagagaaggu

SEQ ID NO: 18435 - RNA, 22 nt, Human
aucacaaauggaaucaccuccc

SEQ ID NO: 18436 - RNA, 22 nt, Human
aucacacaccuguuaaauugug

SEQ ID NO: 18437 - RNA, 22 nt, Human
aucacauggauuuuaucuuuug

SEQ ID NO: 18438 - RNA, 22 nt, Human
aucacugcaggcauauaggggu

SEQ ID NO: 18439 - RNA, 21 nt, Human
aucagaaucucuagauuugga

SEQ ID NO: 18440 - RNA, 22 nt, Human
aucagagcuaguacuugcaggu

SEQ ID NO: 18441 - RNA, 17 nt, Human
aucagaggauaggacaa

SEQ ID NO: 18442 - RNA, 22 nt, Human
ggaggggaguuugccucugggg

SEQ ID NO: 18443 - RNA, 22 nt, Human
ggaggucagcuggaggggaggc

SEQ ID NO: 18444 - RNA, 22 nt, Human
ggagguggagcuggaaguucca

SEQ ID NO: 18445 - RNA, 22 nt, Human
ggagguguguucuguuuuagug

SEQ ID NO: 18446 - RNA, 22 nt, Human
ggagucugugucuugaagcagu

SEQ ID NO: 18447 - RNA, 22 nt, Human
ggagugaagacagagugaacuu

SEQ ID NO: 18448 - RNA, 22 nt, Human
ggagugaaugguggccguguuu

SEQ ID NO: 18449 - RNA, 22 nt, Human
ggaguguuagacuaaauuggga

SEQ ID NO: 18450 - RNA, 22 nt, Human
ggaguucaaaucuggaccuugc

SEQ ID NO: 18451 - RNA, 22 nt, Human
ggaguucaaaucuuuuggaucu

SEQ ID NO: 18452 - RNA, 22 nt, Human
ggaguuucugucaucccguccc

SEQ ID NO: 18453 - RNA, 22 nt, Human
ggauaaaugaaggcauacagau

SEQ ID NO: 18454 - RNA, 19 nt, Human
ggauaagguuggagugauc

SEQ ID NO: 18455 - RNA, 22 nt, Human
ggauaauugaugauuuauaaga

SEQ ID NO: 18456 - RNA, 22 nt, Human
ggaucaccagguuuguuguugg

SEQ ID NO: 18457 - RNA, 22 nt, Human
ggauccuucagcacugaggugu

SEQ ID NO: 18458 - RNA, 22 nt, Human
ggaucuaaagccagaauauaug

SEQ ID NO: 18459 - RNA, 22 nt, Human
ggaugaguuguauauaggauuc

SEQ ID NO: 18460 - RNA, 22 nt, Human
ggaugauacuuggagaaauauu

SEQ ID NO: 18461 - RNA, 22 nt, Human
ggaugauuuucaguuguguggg

SEQ ID NO: 18462 - RNA, 22 nt, Human
ggcuuguaggugauggagaacu

SEQ ID NO: 18463 - RNA, 19 nt, Human
ggcuuugcccuucgcuccg

SEQ ID NO: 18464 - RNA, 22 nt, Human
ggcuuugggaggaugaggcggu

SEQ ID NO: 18465 - RNA, 22 nt, Human
ggcuuuuguuauaaucaggccu

SEQ ID NO: 18466 - RNA, 22 nt, Human
gggaaaaaggaaccuuauuacu

SEQ ID NO: 18467 - RNA, 22 nt, Human
gggaaaucugcuuccuagggcu

SEQ ID NO: 18468 - RNA, 22 nt, Human
gggaacccaaauaggaaaauug

SEQ ID NO: 18469 - RNA, 22 nt, Human
gggaacgacuguuaguacuugg

SEQ ID NO: 18470 - RNA, 22 nt, Human
gggaagaaccucugcuaccaau

SEQ ID NO: 18471 - RNA, 22 nt, Human
gggaagaacugauuucacacca

SEQ ID NO: 18472 - RNA, 22 nt, Human
gggaagaagaaaagagguggga

SEQ ID NO: 18473 - RNA, 21 nt, Human
gggaagagaagagaaaggagg

SEQ ID NO: 18474 - RNA, 22 nt, Human
gggaagagggagcuggaaugau

SEQ ID NO: 18475 - RNA, 22 nt, Human
gggaagugagcuggaaucaagg

SEQ ID NO: 18476 - RNA, 22 nt, Human
gggaagugcaguuuucuuuugg

SEQ ID NO: 18477 - RNA, 22 nt, Human
gggaaguugguaagaggcuguu

SEQ ID NO: 18478 - RNA, 22 nt, Human
gggaccaaaugcuaccauucua

SEQ ID NO: 18479 - RNA, 20 nt, Human
gggacugagccuuguuugug

SEQ ID NO: 18480 - RNA, 22 nt, Human
gggacugcgagauucucaaggg

SEQ ID NO: 18481 - RNA, 22 nt, Human
gggagaaccagccagugcaagg

SEQ ID NO: 18482 - RNA, 21 nt, Human
gggagaguagcgguagggagg

SEQ ID NO: 18483 - RNA, 22 nt, Human
gggagcccuggacgggcgguau

SEQ ID NO: 18484 - RNA, 21 nt, Human
gggagccucauuuucuucauc

SEQ ID NO: 18485 - RNA, 22 nt, Human
gggagcucaccaugcucugcau

SEQ ID NO: 18486 - RNA, 22 nt, Human
gggagcuggagcuggaagacuc

SEQ ID NO: 18487 - RNA, 21 nt, Human
gggaggagcuucccuuugccc

SEQ ID NO: 18488 - RNA, 22 nt, Human
gggaggcagacgcuggagccca

SEQ ID NO: 18489 - RNA, 22 nt, Human
gggagguaaugggggugcaggg

SEQ ID NO: 18490 - RNA, 22 nt, Human
gggaggucgaggcugggccgca

SEQ ID NO: 18491 - RNA, 22 nt, Human
gggaguggagagugaagcuaau

SEQ ID NO: 18492 - RNA, 22 nt, Human
gggauacuuuguuucccugcca

SEQ ID NO: 18493 - RNA, 20 nt, Human
gggaucgaguaccuccgggu

SEQ ID NO: 18494 - RNA, 22 nt, Human
gggaugaaugccuggcuccccc

SEQ ID NO: 18495 - RNA, 22 nt, Human
gggauuaaaaaucaccaaagua

SEQ ID NO: 18496 - RNA, 19 nt, Human
gggauuccuggcuuuagaa

SEQ ID NO: 18497 - RNA, 22 nt, Human
gggcaagaagcuggaagcauuc

SEQ ID NO: 18498 - RNA, 22 nt, Human
gggcagaaaggaaggcuggggg

SEQ ID NO: 18499 - RNA, 22 nt, Human
gggcaggacccguuagaguggc

SEQ ID NO: 18500 - RNA, 22 nt, Human
gggcagucagauucgggggccu

SEQ ID NO: 18501 - RNA, 22 nt, Human
gggcaugugauggacgugugcc

SEQ ID NO: 18502 - RNA, 22 nt, Human
gggccaaggggagcuggaaggg

SEQ ID NO: 18503 - RNA, 22 nt, Human
gggccaggaugugguucauuuu

SEQ ID NO: 18504 - RNA, 22 nt, Human
gggccggcuggggcggggcggg

SEQ ID NO: 18505 - RNA, 22 nt, Human
gggccucccggagcugcuccca

SEQ ID NO: 18506 - RNA, 22 nt, Human
gggcgagcgucucagccgggcg

SEQ ID NO: 18507 - RNA, 22 nt, Human
gggcgcaagcaugugucugggu

SEQ ID NO: 18508 - RNA, 22 nt, Human
gggcgcgccaggagcugcgcgg

SEQ ID NO: 18509 - RNA, 22 nt, Human
gggcgcgcggagccucgccggg

SEQ ID NO: 18510 - RNA, 22 nt, Human
gggcgcuguguuaggugcugua

SEQ ID NO: 18511 - RNA, 22 nt, Human
gggcgcuuucugggucagggcu

SEQ ID NO: 18512 - RNA, 22 nt, Human
gggcggccugcucuguggggag

SEQ ID NO: 18513 - RNA, 22 nt, Human
gggcggggcucacggugcggca

SEQ ID NO: 18514 - RNA, 22 nt, Human
gggcggggcuuccguccuccac

SEQ ID NO: 18515 - RNA, 22 nt, Human
gggcucaaccauagcacaaaga

SEQ ID NO: 18516 - RNA, 19 nt, Human
gggcucucugaauuuuuuu

SEQ ID NO: 18517 - RNA, 20 nt, Human
gggcucugcauccaucagcc

SEQ ID NO: 18518 - RNA, 22 nt, Human
gggcucuuaauuuuuuucucua

SEQ ID NO: 18519 - RNA, 22 nt, Human
gggcugagagcuggaaucugag

SEQ ID NO: 18520 - RNA, 22 nt, Human
gggcuggcaguuuucugaguuc

SEQ ID NO: 18521 - RNA, 22 nt, Human
gggcuguaggagcuggaauggg

SEQ ID NO: 18522 - RNA, 22 nt, Human
gggcuguggggccugcagaagg

SEQ ID NO: 18523 - RNA, 22 nt, Human
gggcuguuugcauauguuuaua

SEQ ID NO: 18524 - RNA, 22 nt, Human
gggcuuaaccuggguaugaggg

SEQ ID NO: 18525 - RNA, 18 nt, Human
gggcuuuacagaguggag

SEQ ID NO: 18526 - RNA, 20 nt, Human
gggcuuugagcucagggcuu

SEQ ID NO: 18527 - RNA, 22 nt, Human
gggcuuuuccaacacucuggag

SEQ ID NO: 18528 - RNA, 22 nt, Human
gggcuuuuccauuccaggguuc

SEQ ID NO: 18529 - RNA, 22 nt, Human
ggggaaauauuucugaccugug

SEQ ID NO: 18530 - RNA, 22 nt, Human
ggggaagaaauagaacauuuug

SEQ ID NO: 18531 - RNA, 22 nt, Human
ggggaagugguggggcuccgag

SEQ ID NO: 18532 - RNA, 22 nt, Human
ggggacaagggugucaguaggc

SEQ ID NO: 18533 - RNA, 22 nt, Human
ggggacggcuggccggggcccc

SEQ ID NO: 18534 - RNA, 22 nt, Human
ggggacugccgacagucucaaa

SEQ ID NO: 18535 - RNA, 22 nt, Human
ggggacuugguuuuaaugagcu

SEQ ID NO: 18536 - RNA, 22 nt, Human
ggggagaugauaagugcauuug

SEQ ID NO: 18537 - RNA, 22 nt, Human
ggggaggaagcuggaacacggg

SEQ ID NO: 18538 - RNA, 22 nt, Human
ggggauuucccaaugcgaagca

SEQ ID NO: 18539 - RNA, 22 nt, Human
ggggauuuuucuuacucuuagg

SEQ ID NO: 18540 - RNA, 22 nt, Human
ggggccaugauggacgagguga

SEQ ID NO: 18541 - RNA, 22 nt, Human
ggggccccuguggcuugaugcc

SEQ ID NO: 18542 - RNA, 22 nt, Human
ggggccgggccggcagacuggg

SEQ ID NO: 18543 - RNA, 22 nt, Human
ggggccuuugaguugggucccu

SEQ ID NO: 18544 - RNA, 22 nt, Human
ggggcggcgugggcgcggugau

SEQ ID NO: 18545 - RNA, 22 nt, Human
ggggcggggagcaugagcuggg

SEQ ID NO: 18546 - RNA, 22 nt, Human
ggggcucauuugcaggggggag

SEQ ID NO: 18547 - RNA, 22 nt, Human
ggggcuccuguggcuauaugua

SEQ ID NO: 18548 - RNA, 22 nt, Human
ggggcuggguuugcgcaggcuc

SEQ ID NO: 18549 - RNA, 22 nt, Human
ggggcuuccagcgcccgccggu

SEQ ID NO: 18550 - RNA, 22 nt, Human
ggggcuuggguagagcagaaac

SEQ ID NO: 18551 - RNA, 22 nt, Human
gggggacagugugccuggugug

SEQ ID NO: 18552 - RNA, 22 nt, Human
gggggaggcucggcgccgcggu

SEQ ID NO: 18553 - RNA, 22 nt, Human
gggggcgccgccgcucaucuca

SEQ ID NO: 18554 - RNA, 22 nt, Human
gggggcugugugcccgcucccc

SEQ ID NO: 18555 - RNA, 22 nt, Human
gggggggcagguuggaugucag

SEQ ID NO: 18556 - RNA, 22 nt, Human
gggguaggaagagaaaauagug

SEQ ID NO: 18557 - RNA, 22 nt, Human
gggguauuugguagacauuuug

SEQ ID NO: 18558 - RNA, 22 nt, Human
ggggucccucucugugucaguu

SEQ ID NO: 18559 - RNA, 22 nt, Human
ggggucugaucccuucuggcuu

SEQ ID NO: 18560 - RNA, 22 nt, Human
ggggugagaguguuuuaaagca

SEQ ID NO: 18561 - RNA, 22 nt, Human
ggggugggcuggguguccaagg

SEQ ID NO: 18562 - RNA, 22 nt, Human
ggggugugcugggagaagggau

SEQ ID NO: 18563 - RNA, 22 nt, Human
gggucagggaggccccaccaug

SEQ ID NO: 18564 - RNA, 22 nt, Human
gggucggcacucuggcagcacc

SEQ ID NO: 18565 - RNA, 21 nt, Human
gggugcacagcaaauuugaga

SEQ ID NO: 18566 - RNA, 22 nt, Human
gggugcucauggauaaggcgaa

SEQ ID NO: 18567 - RNA, 22 nt, Human
ggguggaaugugagugugugug

SEQ ID NO: 18568 - RNA, 22 nt, Human
ggguggcaagucuuucugcaac

SEQ ID NO: 18569 - RNA, 22 nt, Human
ggguggggcaugcucucuucug

SEQ ID NO: 18570 - RNA, 22 nt, Human
gggugggguaggugacucucgc

SEQ ID NO: 18571 - RNA, 22 nt, Human
ggguggugagagaacuuugcag

SEQ ID NO: 18572 - RNA, 22 nt, Human
ggguggugauacugcuucugcc

SEQ ID NO: 18573 - RNA, 22 nt, Human
gggugguggagguuugacagac

SEQ ID NO: 18574 - RNA, 22 nt, Human
ggguucauuugccggguaguuu

SEQ ID NO: 18575 - RNA, 22 nt, Human
ggguuccugaagugguucagga

SEQ ID NO: 18576 - RNA, 22 nt, Human
ggguuccuuggaacacuguuug

SEQ ID NO: 18577 - RNA, 20 nt, Human
ggguugagcguggccccucu

SEQ ID NO: 18578 - RNA, 22 nt, Human
ggguuggaggcauugaaacaga

SEQ ID NO: 18579 - RNA, 22 nt, Human
ggguuguagagcuggaagggga

SEQ ID NO: 18580 - RNA, 22 nt, Human
ggguuuguuccuacuucuacuc

SEQ ID NO: 18581 - RNA, 22 nt, Human
gguaacagaagagcacuuggca

SEQ ID NO: 18582 - RNA, 22 nt, Human
gguaagcugcuguagggucaga

SEQ ID NO: 18583 - RNA, 22 nt, Human
gguaagguugggugucagaggg

SEQ ID NO: 18584 - RNA, 22 nt, Human
gguaauugaaaguuuguugaug

SEQ ID NO: 18585 - RNA, 22 nt, Human
gguacgagcccugccuaguguc

SEQ ID NO: 18586 - RNA, 18 nt, Human
gguacguuuugaucaaug

SEQ ID NO: 18587 - RNA, 22 nt, Human
gguagagagugaggaggggcuc

SEQ ID NO: 18588 - RNA, 22 nt, Human
gguagaggaugaggagguugga

SEQ ID NO: 18589 - RNA, 22 nt, Human
gguagauacaaaaagauugugg

SEQ ID NO: 18590 - RNA, 22 nt, Human
gguauagacaaauuauauaucc

SEQ ID NO: 18591 - RNA, 22 nt, Human
gguaugaggaugaggguggcau

SEQ ID NO: 18592 - RNA, 22 nt, Human
ggucaaucaugggucauugucu

SEQ ID NO: 18593 - RNA, 20 nt, Human
ggucagccaagaaguuaccu

SEQ ID NO: 18594 - RNA, 22 nt, Human
ggucauacaaggcacuggugau

SEQ ID NO: 18595 - RNA, 22 nt, Human
ggucauagagcuggaaauuggc

SEQ ID NO: 18596 - RNA, 22 nt, Human
ggucccacgauguaccugucug

SEQ ID NO: 18597 - RNA, 22 nt, Human
gguccgcgcgcagaggcccugg

SEQ ID NO: 18598 - RNA, 19 nt, Human
gguccguuacaggcuuucc

SEQ ID NO: 18599 - RNA, 22 nt, Human
ggucgaguuccuuguuuuuuau

SEQ ID NO: 18600 - RNA, 22 nt, Human
ggucgucuguccugucgccgcu

SEQ ID NO: 18601 - RNA, 22 nt, Human
ggucugagcaaguuaccauggg

SEQ ID NO: 18602 - RNA, 22 nt, Human
ggucugauaccugcagguuguc

SEQ ID NO: 18603 - RNA, 22 nt, Human
ggucugcgauggcaagggucuu

SEQ ID NO: 18604 - RNA, 19 nt, Human
ggucugcggggugaccgug

SEQ ID NO: 18605 - RNA, 22 nt, Human
ggucuuauaauuaauuuaggcu

SEQ ID NO: 18606 - RNA, 22 nt, Human
ggucuucauaugccacagaguc

SEQ ID NO: 18607 - RNA, 22 nt, Human
ggucuucauucuaccagacuuu

SEQ ID NO: 18608 - RNA, 22 nt, Human
ggucuuccuugggggacuugaa

SEQ ID NO: 18609 - RNA, 22 nt, Human
ggugaaggaucccucuuggccu

SEQ ID NO: 18610 - RNA, 22 nt, Human
ggugacauuggagagacaggug

SEQ ID NO: 18611 - RNA, 22 nt, Human
ggugacucacauuaggacuucg

SEQ ID NO: 18612 - RNA, 22 nt, Human
ggugagagaaaagaaacacugu

SEQ ID NO: 18613 - RNA, 23 nt, Human
ggugagccuuucuaguagucuug

SEQ ID NO: 18614 - RNA, 22 nt, Human
ggugaguagaaguaguuggcuu

SEQ ID NO: 18615 - RNA, 22 nt, Human
ggugauaaaaagcauuuaaauu

SEQ ID NO: 18616 - RNA, 22 nt, Human
ggugaucucagucuagaugguu

SEQ ID NO: 18617 - RNA, 19 nt, Human
ggugaucugucccuugcuc

SEQ ID NO: 18618 - RNA, 22 nt, Human
ggugcaaagauggcaguugcaa

SEQ ID NO: 18619 - RNA, 22 nt, Human
ggugcaauaaaguuguagaacc

SEQ ID NO: 18620 - RNA, 22 nt, Human
ggugccugggcacggaaagcau

SEQ ID NO: 18621 - RNA, 22 nt, Human
ggugcguggcccauccuccacc

SEQ ID NO: 18622 - RNA, 22 nt, Human
ggugcugcugcugaacccagcu

SEQ ID NO: 18623 - RNA, 22 nt, Human
ggugcuucgauagguguccaua

SEQ ID NO: 18624 - RNA, 22 nt, Human
gguggccggcaccccacccucg

SEQ ID NO: 18625 - RNA, 22 nt, Human
gguggcuucuguuugcaagagg

SEQ ID NO: 18626 - RNA, 19 nt, Human
ggugggacaggugagauau

SEQ ID NO: 18627 - RNA, 22 nt, Human
ggugggccaaauuaaacauaua

SEQ ID NO: 18628 - RNA, 22 nt, Human
gguggggugagggggcgaggcc

SEQ ID NO: 18629 - RNA, 22 nt, Human
gguggguccuuugacagagaug

SEQ ID NO: 18630 - RNA, 22 nt, Human
gguguaaggaagauggaagaug

SEQ ID NO: 18631 - RNA, 22 nt, Human
gguguaaucacaagcuggaauu

SEQ ID NO: 18632 - RNA, 22 nt, Human
gguguacgaagaggcgggaguc

SEQ ID NO: 18633 - RNA, 22 nt, Human
ggugucguuucacaugacccag

SEQ ID NO: 18634 - RNA, 22 nt, Human
ggugucucagauuguaaaaugu

SEQ ID NO: 18635 - RNA, 22 nt, Human
ggugugugugugugugugugug

SEQ ID NO: 18636 - RNA, 22 nt, Human
gguguuaaccagcuaaaguuug

SEQ ID NO: 18637 - RNA, 22 nt, Human
gguuaacaccacagcugggaca

SEQ ID NO: 18638 - RNA, 19 nt, Human
gguuaccagugugucuggc

SEQ ID NO: 18639 - RNA, 22 nt, Human
gguuccagacaguuauaugggc

SEQ ID NO: 18640 - RNA, 22 nt, Human
gguugaagcuacuuucuggaug

SEQ ID NO: 18641 - RNA, 22 nt, Human
gguugccuuugcaguuggauca

SEQ ID NO: 18642 - RNA, 22 nt, Human
gguuuaucuuuacaaaugaaau

SEQ ID NO: 18643 - RNA, 22 nt, Human
gguuuauucccacaaaggaagu

SEQ ID NO: 18644 - RNA, 22 nt, Human
gguuugauauguuugugauucu

SEQ ID NO: 18645 - RNA, 22 nt, Human
gguuugccagugcuggaaugca

SEQ ID NO: 18646 - RNA, 22 nt, Human
gguuuguggagcuggaaacacu

SEQ ID NO: 18647 - RNA, 22 nt, Human
gguuuucagaaugcaguccugu

SEQ ID NO: 18648 - RNA, 22 nt, Human
gguuuuccaguagaucagaaga

SEQ ID NO: 18649 - RNA, 22 nt, Human
gguuuuuggcucaauauuuugg

SEQ ID NO: 18650 - RNA, 22 nt, Human
guaaacugaauuggauacugug

SEQ ID NO: 18651 - RNA, 22 nt, Human
guaaauaucucacgaaugauuc

SEQ ID NO: 18652 - RNA, 22 nt, Human
guaaaucuuggcaucugcuuuc

SEQ ID NO: 18653 - RNA, 22 nt, Human
guaaauuaugucugggucaguu

SEQ ID NO: 18654 - RNA, 22 nt, Human
guaaccacuaugguuauugauu

SEQ ID NO: 18655 - RNA, 22 nt, Human
guaacugguuuucuucccucuc

SEQ ID NO: 18656 - RNA, 22 nt, Human
guaagaauauacccaggaguca

SEQ ID NO: 18657 - RNA, 22 nt, Human
guaagcagcaugacgguuggau

SEQ ID NO: 18658 - RNA, 22 nt, Human
guaaugcuuuuauuucggggaa

SEQ ID NO: 18659 - RNA, 22 nt, Human
guaauucugugugaaucuauua

SEQ ID NO: 18660 - RNA, 22 nt, Human
guacauauggcacaugcuauuu

SEQ ID NO: 18661 - RNA, 22 nt, Human
guaccuguacauaacuacauau

SEQ ID NO: 18662 - RNA, 22 nt, Human
guacuaguuaaaaauagaauua

SEQ ID NO: 18663 - RNA, 22 nt, Human
guacugggaauggagccugggc

SEQ ID NO: 18664 - RNA, 22 nt, Human
guacuuccauccacauauaugu

SEQ ID NO: 18665 - RNA, 22 nt, Human
guagaauggggcucucaaagca

SEQ ID NO: 18666 - RNA, 22 nt, Human
guagagagugucuuccagaaau

SEQ ID NO: 18667 - RNA, 22 nt, Human
guagauaauuuuggaaagcugg

SEQ ID NO: 18668 - RNA, 22 nt, Human
guagaucaugaaaauucacugc

SEQ ID NO: 18669 - RNA, 22 nt, Human
guagcaugauuuuaaaauccug

SEQ ID NO: 18670 - RNA, 22 nt, Human
guaggaguguucgggaacuggg

SEQ ID NO: 18671 - RNA, 22 nt, Human
guagggguggggagguggucug

SEQ ID NO: 18672 - RNA, 22 nt, Human
guaggugggcuuccaagguccu

SEQ ID NO: 18673 - RNA, 22 nt, Human
guaguggaauuuagaguauaau

SEQ ID NO: 18674 - RNA, 22 nt, Human
guaguucuuucucaauguucaa

SEQ ID NO: 18675 - RNA, 22 nt, Human
guaguuuucaugguuagaaaua

SEQ ID NO: 18676 - RNA, 22 nt, Human
guaguuuuucuugcaagaguag

SEQ ID NO: 18677 - RNA, 22 nt, Human
guauaaagaugccauacuuacu

SEQ ID NO: 18678 - RNA, 22 nt, Human
guauauuuaugagcauuagccu

SEQ ID NO: 18679 - RNA, 22 nt, Human
guaucaggacuaaauuauggau

SEQ ID NO: 18680 - RNA, 21 nt, Human
guaucuuucuuuuaaaauauc

SEQ ID NO: 18681 - RNA, 22 nt, Human
guaugaguggauagauguaucu

SEQ ID NO: 18682 - RNA, 22 nt, Human
guaugucuuaggguucaguaac

SEQ ID NO: 18683 - RNA, 22 nt, Human
guaugugguaccaugcaacggg

SEQ ID NO: 18684 - RNA, 22 nt, Human
guaugugucuuagaacuuggga

SEQ ID NO: 18685 - RNA, 22 nt, Human
guaugugugcauacauguacga

SEQ ID NO: 18686 - RNA, 22 nt, Human
guauuauauaaccauugguucu

SEQ ID NO: 18687 - RNA, 22 nt, Human
guauuaugaaugccgaggcggc

SEQ ID NO: 18688 - RNA, 22 nt, Human
guauucugugugaucaagugau

SEQ ID NO: 18689 - RNA, 22 nt, Human
gucaaaggcggugcaggaggag

SEQ ID NO: 18690 - RNA, 20 nt, Human
gucaauguuuucuuggcccu

SEQ ID NO: 18691 - RNA, 22 nt, Human
gucaccgguuuuuagguaaaca

SEQ ID NO: 18692 - RNA, 23 nt, Human
gucaccuccccuugccuucuccc

SEQ ID NO: 18693 - RNA, 22 nt, Human
gucacgucgggacagacugggg

SEQ ID NO: 18694 - RNA, 22 nt, Human
gucacucuuuuucagcuagcuc

SEQ ID NO: 18695 - RNA, 22 nt, Human
gucacuguuucacuguucauua

SEQ ID NO: 18696 - RNA, 22 nt, Human
gucacuuugcuugcgaugcucc

SEQ ID NO: 18697 - RNA, 23 nt, Human
gucagcuugaccaguggagaguc

SEQ ID NO: 18698 - RNA, 22 nt, Human
gucaggaugagggaugaggagu

SEQ ID NO: 18699 - RNA, 19 nt, Human
gucagucuuaaguuucagc

SEQ ID NO: 18700 - RNA, 22 nt, Human
gucagugaaccuucaccaaacc

SEQ ID NO: 18701 - RNA, 22 nt, Human
gucagugcuuuaguucaggaug

SEQ ID NO: 18702 - RNA, 19 nt, Human
guccaaauggaaccccuug

SEQ ID NO: 18703 - RNA, 22 nt, Human
guccacauaggaacccagcuuc

SEQ ID NO: 18704 - RNA, 22 nt, Human
guccagaguagucgaguauucu

SEQ ID NO: 18705 - RNA, 22 nt, Human
guccaggucauuuaaaaagucc

SEQ ID NO: 18706 - RNA, 22 nt, Human
aggauugauggcauguuuacug

SEQ ID NO: 18707 - RNA, 22 nt, Human
aggauuuaauugcauuuuucuc

SEQ ID NO: 18708 - RNA, 22 nt, Human
aggauuuagcaugaaaugugaa

SEQ ID NO: 18709 - RNA, 22 nt, Human
aggauuuauuccagaaaugcaa

SEQ ID NO: 18710 - RNA, 22 nt, Human
aggcaacagacaggcuugguuc

SEQ ID NO: 18711 - RNA, 23 nt, Human
aggcaagaacggguuguucaccc

SEQ ID NO: 18712 - RNA, 22 nt, Human
aggcaagauuaggaccagaaga

SEQ ID NO: 18713 - RNA, 22 nt, Human
aggcaauagagggugaggagga

SEQ ID NO: 18714 - RNA, 22 nt, Human
aggcacagaauccagucugcug

SEQ ID NO: 18715 - RNA, 22 nt, Human
aggcagagauggcugcagggcc

SEQ ID NO: 18716 - RNA, 22 nt, Human
aggcagaugggagcuggaaguu

SEQ ID NO: 18717 - RNA, 23 nt, Human
aggcagcaugcaacaggccauuu

SEQ ID NO: 18718 - RNA, 19 nt, Human
aggcagccccaacuugcau

SEQ ID NO: 18719 - RNA, 21 nt, Human
aggcagcgauuuucauauugc

SEQ ID NO: 18720 - RNA, 22 nt, Human
aggcaggauuugcgaugugguu

SEQ ID NO: 18721 - RNA, 22 nt, Human
aggcaggcucaaugcccagucu

SEQ ID NO: 18722 - RNA, 22 nt, Human
aggcaggggagcuggaagggua

SEQ ID NO: 18723 - RNA, 22 nt, Human
agguuaugcacugcacaacccu

SEQ ID NO: 18724 - RNA, 18 nt, Human
agguugcaucugugcaga

SEQ ID NO: 18725 - RNA, 22 nt, Human
agguugggagaggucacccuga

SEQ ID NO: 18726 - RNA, 18 nt, Human
agguuguguaaaaagaag

SEQ ID NO: 18727 - RNA, 22 nt, Human
agguuguugagaucaucuggcu

SEQ ID NO: 18728 - RNA, 22 nt, Human
agguuuauggagcaccacaucu

SEQ ID NO: 18729 - RNA, 20 nt, Human
agguuugcuguauaucaugg

SEQ ID NO: 18730 - RNA, 22 nt, Human
agguuuggaaguggcgauccau

SEQ ID NO: 18731 - RNA, 22 nt, Human
agguuuuacuuuuuuuggaggu

SEQ ID NO: 18732 - RNA, 22 nt, Human
agguuuuagagagccaggaugu

SEQ ID NO: 18733 - RNA, 18 nt, Human
aguaaauguuaaauauug

SEQ ID NO: 18734 - RNA, 22 nt, Human
aguaacagguguacagacuauc

SEQ ID NO: 18735 - RNA, 22 nt, Human
aguaauaaacaacucauuuugg

SEQ ID NO: 18736 - RNA, 22 nt, Human
aguaaucgugaucgagagauca

SEQ ID NO: 18737 - RNA, 22 nt, Human
aguaauggucucaauaaauucu

SEQ ID NO: 18738 - RNA, 22 nt, Human
aguaauuucuuacggagaccuu

SEQ ID NO: 18739 - RNA, 22 nt, Human
aguacacuguucagaauuuuag

SEQ ID NO: 18740 - RNA, 20 nt, Human
aguacauauuugugauuuuu

SEQ ID NO: 18741 - RNA, 21 nt, Human
aguaccugugugccugugugu

SEQ ID NO: 18742 - RNA, 20 nt, Human
aguacugacaauauucugug

SEQ ID NO: 18743 - RNA, 22 nt, Human
aguacuuuuuguucaauugugc

SEQ ID NO: 18744 - RNA, 22 nt, Human
aguagaauuacagguuuucucu

SEQ ID NO: 18745 - RNA, 22 nt, Human
aguagagacgggguuuuaguag

SEQ ID NO: 18746 - RNA, 22 nt, Human
aguagcaguuccauuugaugug

SEQ ID NO: 18747 - RNA, 22 nt, Human
aguaggaauucaaagagacaaa

SEQ ID NO: 18748 - RNA, 22 nt, Human
aguaggagcucaauuaaauguu

SEQ ID NO: 18749 - RNA, 22 nt, Human
aguaggagugacaagcagguca

SEQ ID NO: 18750 - RNA, 22 nt, Human
aguagucacuucacccauccca

SEQ ID NO: 18751 - RNA, 22 nt, Human
aguauagacaucaaacugaaga

SEQ ID NO: 18752 - RNA, 22 nt, Human
aguaucuauaucaaaaauggcu

SEQ ID NO: 18753 - RNA, 22 nt, Human
aguaucugccagaaucucaguu

SEQ ID NO: 18754 - RNA, 22 nt, Human
aguaucuuccucaugaacacgu

SEQ ID NO: 18755 - RNA, 22 nt, Human
aguauucaguuagugagcuaag

SEQ ID NO: 18756 - RNA, 22 nt, Human
aguauugguaaguguagcaaau

SEQ ID NO: 18757 - RNA, 22 nt, Human
aguauuuucuuuaguuuguuag

SEQ ID NO: 18758 - RNA, 22 nt, Human
agucaaaaaaccuagaaacacc

SEQ ID NO: 18759 - RNA, 22 nt, Human
agucaacauuugagaugcaaug

SEQ ID NO: 18760 - RNA, 21 nt, Human
agucaagcugccugcuuggca

SEQ ID NO: 18761 - RNA, 20 nt, Human
agucacagacccucagguag

SEQ ID NO: 18762 - RNA, 22 nt, Human
agucaggacagauuuucugggg

SEQ ID NO: 18763 - RNA, 22 nt, Human
agucaguaucuucugggcggua

SEQ ID NO: 18764 - RNA, 22 nt, Human
agucaguaugacuuauaguucu

SEQ ID NO: 18765 - RNA, 22 nt, Human
agucaguguagaaagcccaggc

SEQ ID NO: 18766 - RNA, 22 nt, Human
agucauuguguucaguaaaauc

SEQ ID NO: 18767 - RNA, 22 nt, Human
aguccauccagaaaacaaagcu

SEQ ID NO: 18768 - RNA, 22 nt, Human
agucggggagcgugaccagaga

SEQ ID NO: 18769 - RNA, 22 nt, Human
agucuaaguuuuguaugcuaac

SEQ ID NO: 18770 - RNA, 22 nt, Human
agucuagcuguguuuugagcug

SEQ ID NO: 18771 - RNA, 22 nt, Human
agucucccauaggcuaaguauu

SEQ ID NO: 18772 - RNA, 22 nt, Human
agucucuagagucugucccucu

SEQ ID NO: 18773 - RNA, 22 nt, Human
agucugaaccagauggcaaggu

SEQ ID NO: 18774 - RNA, 18 nt, Human
agucugagugaaauguag

SEQ ID NO: 18775 - RNA, 22 nt, Human
agucugugguccucuguaucuc

SEQ ID NO: 18776 - RNA, 20 nt, Human
agucuuaucugcauuuagaa

SEQ ID NO: 18777 - RNA, 22 nt, Human
agugaaaacugaaucaccuucc

SEQ ID NO: 18778 - RNA, 22 nt, Human
agugaaagaaaacuguuagaac

SEQ ID NO: 18779 - RNA, 19 nt, Human
agugaacuccauaucaggu

SEQ ID NO: 18780 - RNA, 21 nt, Human
agugaagagugggcuugauca

SEQ ID NO: 18781 - RNA, 22 nt, Human
agugaauuagccuauuuguaaa

SEQ ID NO: 18782 - RNA, 21 nt, Human
agugagauuuaugccugguuc

SEQ ID NO: 18783 - RNA, 21 nt, Human
agugaguagagcacugaguca

SEQ ID NO: 18784 - RNA, 21 nt, Human
agugagugacagaagaagguu

SEQ ID NO: 18785 - RNA, 23 nt, Human
agugaugcaguaucugggucugu

SEQ ID NO: 18786 - RNA, 22 nt, Human
agugauguaauggugaauguga

SEQ ID NO: 18787 - RNA, 22 nt, Human
agugccaucuuuaacuguccca

SEQ ID NO: 18788 - RNA, 22 nt, Human
agugcccuugggcgguucacag

SEQ ID NO: 18789 - RNA, 22 nt, Human
agugccuggcugauggguccug

SEQ ID NO: 18790 - RNA, 22 nt, Human
agugccuuaaaggucuugcagc

SEQ ID NO: 18791 - RNA, 22 nt, Human
agugcuccucagaagaguugga

SEQ ID NO: 18792 - RNA, 22 nt, Human
aguggcuagaucaugagugagc

SEQ ID NO: 18793 - RNA, 22 nt, Human
aguggcuggcaggggagggucc

SEQ ID NO: 18794 - RNA, 22 nt, Human
aguggcugugaaauacauggga

SEQ ID NO: 18795 - RNA, 22 nt, Human
aguggcuguuccaggugaggac

SEQ ID NO: 18796 - RNA, 22 nt, Human
aguggcuucucuggggucaaga

SEQ ID NO: 18797 - RNA, 22 nt, Human
agugggaaagcugccuuguaga

SEQ ID NO: 18798 - RNA, 22 nt, Human
agugggacccagauuuucuuga

SEQ ID NO: 18799 - RNA, 19 nt, Human
agugggauggcuuuuuccc

SEQ ID NO: 18800 - RNA, 22 nt, Human
aguggugaucuguuacagucac

SEQ ID NO: 18801 - RNA, 22 nt, Human
aguggugccuaagcgcggaggc

SEQ ID NO: 18802 - RNA, 22 nt, Human
aguguccaacucagcuugucaa

SEQ ID NO: 18803 - RNA, 22 nt, Human
agugugacccauggcaagggca

SEQ ID NO: 18804 - RNA, 22 nt, Human
aguguggccaaugaggaugggc

SEQ ID NO: 18805 - RNA, 22 nt, Human
aguguggcccaugaauuauugg

SEQ ID NO: 18806 - RNA, 22 nt, Human
aguguguauauaugugugugug

SEQ ID NO: 18807 - RNA, 22 nt, Human
aguguuaggaauuaauguaggg

SEQ ID NO: 18808 - RNA, 22 nt, Human
aguguucaucacaggcuagaga

SEQ ID NO: 18809 - RNA, 20 nt, Human
aguguuggugcuuuucccag

SEQ ID NO: 18810 - RNA, 22 nt, Human
aguguuuuaagaaaguaauuuu

SEQ ID NO: 18811 - RNA, 22 nt, Human
aguuaaagggggcuacagugug

SEQ ID NO: 18812 - RNA, 17 nt, Human
aguuacugcacuugcca

SEQ ID NO: 18813 - RNA, 23 nt, Human
aguuaucuaaugaaguucuucca

SEQ ID NO: 18814 - RNA, 22 nt, Human
aguuauuaagaaaauuuugcca

SEQ ID NO: 18815 - RNA, 22 nt, Human
aguuauuuuucacuauuaggcu

SEQ ID NO: 18816 - RNA, 22 nt, Human
aguucauaucuacuuuuccauc

SEQ ID NO: 18817 - RNA, 22 nt, Human
aguucauccucauuuacaagga

SEQ ID NO: 18818 - RNA, 22 nt, Human
aguucaugugguuuaacuuaau

SEQ ID NO: 18819 - RNA, 22 nt, Human
aguucccgcgggagggcgcagg

SEQ ID NO: 18820 - RNA, 22 nt, Human
aguucccuguuuuuuuccacug

SEQ ID NO: 18821 - RNA, 22 nt, Human
gcugguuucucucauugucagu

SEQ ID NO: 18822 - RNA, 22 nt, Human
gcuguacugucugccaagccag

SEQ ID NO: 18823 - RNA, 21 nt, Human
gcuguagauucacaaagaggu

SEQ ID NO: 18824 - RNA, 22 nt, Human
gcugucccccaaagaugcuccu

SEQ ID NO: 18825 - RNA, 18 nt, Human
gcuguccgguagcuggug

SEQ ID NO: 18826 - RNA, 22 nt, Human
gcuguccugggaacaggcacua

SEQ ID NO: 18827 - RNA, 22 nt, Human
gcugugacaagaggcugcuucu

SEQ ID NO: 18828 - RNA, 22 nt, Human
gcuguggcuccaauggugagcc

SEQ ID NO: 18829 - RNA, 22 nt, Human
gcuguugagucagacaaguuuu

SEQ ID NO: 18830 - RNA, 22 nt, Human
gcuguugcaaucaaggccaugg

SEQ ID NO: 18831 - RNA, 22 nt, Human
gcuguuggaggaguucagugcu

SEQ ID NO: 18832 - RNA, 22 nt, Human
gcuguugugaggaucagcauau

SEQ ID NO: 18833 - RNA, 22 nt, Human
gcuguuguugcacggaaggugg

SEQ ID NO: 18834 - RNA, 22 nt, Human
gcuguuuaaguggaauuuguuu

SEQ ID NO: 18835 - RNA, 22 nt, Human
gcuuacuguuccuguuggugcu

SEQ ID NO: 18836 - RNA, 22 nt, Human
gcuuaggcgcuccuuuucacuc

SEQ ID NO: 18837 - RNA, 22 nt, Human
agcauucuguggucuucuaugg

SEQ ID NO: 18838 - RNA, 22 nt, Human
agcauuugcuguucuagaaagu

SEQ ID NO: 18839 - RNA, 22 nt, Human
agcauuuuaaaacuaguuacca

SEQ ID NO: 18840 - RNA, 22 nt, Human
agccaagucucacugagucugu

SEQ ID NO: 18841 - RNA, 22 nt, Human
agccacacuuagucacaaagau

SEQ ID NO: 18842 - RNA, 22 nt, Human
agccacagucuguagccagcuu

SEQ ID NO: 18843 - RNA, 22 nt, Human
agccagauuuuuugagaggcga

SEQ ID NO: 18844 - RNA, 21 nt, Human
agccagguuuccuuugaagag

SEQ ID NO: 18845 - RNA, 22 nt, Human
agccagugcagcuggaaauuca

SEQ ID NO: 18846 - RNA, 22 nt, Human
agccagugucgugugacaugag

SEQ ID NO: 18847 - RNA, 22 nt, Human
agccauggagauguggguuggg

SEQ ID NO: 18848 - RNA, 22 nt, Human
agccauggaggaugugcagcau

SEQ ID NO: 18849 - RNA, 23 nt, Human
agcccagcagagaaccuaggucc

SEQ ID NO: 18850 - RNA, 22 nt, Human
agccccaauuacagcugugcug

SEQ ID NO: 18851 - RNA, 22 nt, Human
agccccggugagggaguccugu

SEQ ID NO: 18852 - RNA, 22 nt, Human
agccccuaaaguagcuguucuu

SEQ ID NO: 18853 - RNA, 22 nt, Human
agccccuucuuuggggagcuga

SEQ ID NO: 18854 - RNA, 18 nt, Human
agcccucuguuacuggaa

SEQ ID NO: 18855 - RNA, 22 nt, Human
agcccugaccuguccuguucug

SEQ ID NO: 18856 - RNA, 22 nt, Human
agcccugugugcuuguguuccu

SEQ ID NO: 18857 - RNA, 22 nt, Human
agcccuucccuuucacuggugc

SEQ ID NO: 18858 - RNA, 22 nt, Human
agccgauaaauuguuuucuugg

SEQ ID NO: 18859 - RNA, 22 nt, Human
agccgcgcuguuccugcugcug

SEQ ID NO: 18860 - RNA, 22 nt, Human
agccggccucggacagagggag

SEQ ID NO: 18861 - RNA, 21 nt, Human
agccgggacaacguggacccc

SEQ ID NO: 18862 - RNA, 22 nt, Human
agccuacauuugacuauagucu

SEQ ID NO: 18863 - RNA, 22 nt, Human
agccugaaccaauauagcagcc

SEQ ID NO: 18864 - RNA, 22 nt, Human
agccugugacucugugaaacca

SEQ ID NO: 18865 - RNA, 22 nt, Human
agccuuucugcgcacucuuccg

SEQ ID NO: 18866 - RNA, 22 nt, Human
agcgaaaagaauggaguggagu

SEQ ID NO: 18867 - RNA, 22 nt, Human
agcgacuugacagacauguccu

SEQ ID NO: 18868 - RNA, 22 nt, Human
agcgagccugugcacuucuaac

SEQ ID NO: 18869 - RNA, 19 nt, Human
agcgccucuacugcaugga

SEQ ID NO: 18870 - RNA, 22 nt, Human
agcgcggccuuacacccagggg

SEQ ID NO: 18871 - RNA, 22 nt, Human
agcgcucauuuuccuccugcuc

SEQ ID NO: 18872 - RNA, 22 nt, Human
agcgcugugaaggcugggccac

SEQ ID NO: 18873 - RNA, 22 nt, Human
agcgcuguguucccgugggcau

SEQ ID NO: 18874 - RNA, 19 nt, Human
agcggagguuguauauugu

SEQ ID NO: 18875 - RNA, 22 nt, Human
agcggcaggacgucuucuucga

SEQ ID NO: 18876 - RNA, 19 nt, Human
agcggccgccgcgggcgcc

SEQ ID NO: 18877 - RNA, 22 nt, Human
agcggcucaggccccgugggcu

SEQ ID NO: 18878 - RNA, 22 nt, Human
agcgggucaugucggccgccca

SEQ ID NO: 18879 - RNA, 22 nt, Human
agcggugacauccuucugugcu

SEQ ID NO: 18880 - RNA, 22 nt, Human
agcguucuguuccaugcuaaca

SEQ ID NO: 18881 - RNA, 22 nt, Human
agcuaaaaugagguuuuuggau

SEQ ID NO: 18882 - RNA, 22 nt, Human
agcuaauguauguugaaagcac

SEQ ID NO: 18883 - RNA, 22 nt, Human
agcuaguucacugaagccuaug

SEQ ID NO: 18884 - RNA, 22 nt, Human
agcucagugugucuaugaggua

SEQ ID NO: 18885 - RNA, 22 nt, Human
agcucccaauugacuugaacua

SEQ ID NO: 18886 - RNA, 19 nt, Human
agcuccucaccucucgcgg

SEQ ID NO: 18887 - RNA, 22 nt, Human
agcucucaccauagugcuuaaa

SEQ ID NO: 18888 - RNA, 22 nt, Human
agcucugauccuuuaaaggaga

SEQ ID NO: 18889 - RNA, 22 nt, Human
agcucugugcaggcagaggcau

SEQ ID NO: 18890 - RNA, 22 nt, Human
agcucuguugcggucacaggag

SEQ ID NO: 18891 - RNA, 22 nt, Human
agcucuuuggacuuuguuuuau

SEQ ID NO: 18892 - RNA, 20 nt, Human
agcugaauaguuuugugaaa

SEQ ID NO: 18893 - RNA, 22 nt, Human
agcugacagugcauggagggac

SEQ ID NO: 18894 - RNA, 22 nt, Human
agcugagccagacagguaagca

SEQ ID NO: 18895 - RNA, 22 nt, Human
agcugaugucucaccuguuaga

SEQ ID NO: 18896 - RNA, 22 nt, Human
agcugcauguauauucuuaaca

SEQ ID NO: 18897 - RNA, 22 nt, Human
agcugcauucguaucauauugu

SEQ ID NO: 18898 - RNA, 19 nt, Human
agcugcugauugguggagg

SEQ ID NO: 18899 - RNA, 22 nt, Human
agcugcugcaaguggugcuaac

SEQ ID NO: 18900 - RNA, 22 nt, Human
agcuggaaucucggcaaagcgu

SEQ ID NO: 18901 - RNA, 22 nt, Human
agcuggauuaaucacagugacu

SEQ ID NO: 18902 - RNA, 22 nt, Human
agcuguaacagguuaauaugga

SEQ ID NO: 18903 - RNA, 20 nt, Human
agcugucccugacacuagga

SEQ ID NO: 18904 - RNA, 22 nt, Human
agcugugaccaguuacgaaauu

SEQ ID NO: 18905 - RNA, 22 nt, Human
agcugugaccuucaagagcuac

SEQ ID NO: 18906 - RNA, 22 nt, Human
agcugugccuauucguggcaag

SEQ ID NO: 18907 - RNA, 19 nt, Human
agcuuauuuacugcaggac

SEQ ID NO: 18908 - RNA, 22 nt, Human
agcuuccaaagaccaggauuga

SEQ ID NO: 18909 - RNA, 22 nt, Human
agcuugaaccuaaaacaauaau

SEQ ID NO: 18910 - RNA, 22 nt, Human
agcuugagauaauucaagcuga

SEQ ID NO: 18911 - RNA, 22 nt, Human
agcuugaugaaagugggugcuc

SEQ ID NO: 18912 - RNA, 22 nt, Human
agcuugauggauugcugaggca

SEQ ID NO: 18913 - RNA, 22 nt, Human
agcuugcccuuguaccagccag

SEQ ID NO: 18914 - RNA, 22 nt, Human
agcuuugcccaaugaguuaugu

SEQ ID NO: 18915 - RNA, 22 nt, Human
aggaaaaagaagaaaagaauca

SEQ ID NO: 18916 - RNA, 22 nt, Human
aggaaaaugaaggaagugggaa

SEQ ID NO: 18917 - RNA, 22 nt, Human
aggaaaguugagcugucuguag

SEQ ID NO: 18918 - RNA, 22 nt, Human
aggaaaguugcuuguagugcug

SEQ ID NO: 18919 - RNA, 22 nt, Human
aggaaauaggaccagacaaagc

SEQ ID NO: 18920 - RNA, 22 nt, Human
aggaaauaguuuagucccaaaa

SEQ ID NO: 18921 - RNA, 22 nt, Human
aggaacaacagccuuuauaucc

SEQ ID NO: 18922 - RNA, 22 nt, Human
aggaacaguuucaaagagugaa

SEQ ID NO: 18923 - RNA, 20 nt, Human
aggaacuggaagggaggaaa

SEQ ID NO: 18924 - RNA, 20 nt, Human
aggaaggagaaucugagcaa

SEQ ID NO: 18925 - RNA, 19 nt, Human
aggaaggggauaaguaaca

SEQ ID NO: 18926 - RNA, 22 nt, Human
aggaauugucgucauguauaau

SEQ ID NO: 18927 - RNA, 22 nt, Human
aggaauuuuaauaugcuugucu

SEQ ID NO: 18928 - RNA, 22 nt, Human
aggacaaaggaccagaucugga

SEQ ID NO: 18929 - RNA, 22 nt, Human
aggacaagacaaggaccagaga

SEQ ID NO: 18930 - RNA, 22 nt, Human
aggacacagaguauggaagugu

SEQ ID NO: 18931 - RNA, 22 nt, Human
aggacagagggaccagagccca

SEQ ID NO: 18932 - RNA, 22 nt, Human
aggacccacccugugaaaguuc

SEQ ID NO: 18933 - RNA, 22 nt, Human
aggacuguauacucuaggugaa

SEQ ID NO: 18934 - RNA, 22 nt, Human
aggagaaagaccagccugccga

SEQ ID NO: 18935 - RNA, 19 nt, Human
aggagacuacuucuugcug

SEQ ID NO: 18936 - RNA, 22 nt, Human
aggagcacugggcaugucaccc

SEQ ID NO: 18937 - RNA, 22 nt, Human
aggagcccaaagcacuuggcug

SEQ ID NO: 18938 - RNA, 22 nt, Human
aggagcccggucgucaugguaa

SEQ ID NO: 18939 - RNA, 22 nt, Human
aggaggcaaaugagagggcuca

SEQ ID NO: 18940 - RNA, 22 nt, Human
aggagguagggugugaaacagc

SEQ ID NO: 18941 - RNA, 22 nt, Human
aggauaaaggucauuauuccca

SEQ ID NO: 18942 - RNA, 22 nt, Human
aggauaaaugggucauuaggca

SEQ ID NO: 18943 - RNA, 22 nt, Human
aggauauguccuuuuuuucccc

SEQ ID NO: 18944 - RNA, 22 nt, Human
aggaugagugaagagguaaauu

SEQ ID NO: 18945 - RNA, 22 nt, Human
aggauggaaguaacuggauaau

SEQ ID NO: 18946 - RNA, 22 nt, Human
aggauucuccuguuucccaccc

SEQ ID NO: 18947 - RNA, 22 nt, Human
aggauugaaaaaacacauauau

SEQ ID NO: 18948 - RNA, 22 nt, Human
aaguagccuguuauguaguuca

SEQ ID NO: 18949 - RNA, 20 nt, Human
aaguagguuucaguugcugu

SEQ ID NO: 18950 - RNA, 19 nt, Human
aaguauagucagccuucua

SEQ ID NO: 18951 - RNA, 22 nt, Human
aaguauuccccaaguauucugg

SEQ ID NO: 18952 - RNA, 22 nt, Human
aagucauuaucucuucuaaucu

SEQ ID NO: 18953 - RNA, 22 nt, Human
aaguccaaaacauuucucugcu

SEQ ID NO: 18954 - RNA, 22 nt, Human
aagucccaucugccuccaugua

SEQ ID NO: 18955 - RNA, 22 nt, Human
aaguccgggcagcaggaauucu

SEQ ID NO: 18956 - RNA, 22 nt, Human
aagucgccuaaacaaaguaucu

SEQ ID NO: 18957 - RNA, 22 nt, Human
aagucuguucuacagcaccaga

SEQ ID NO: 18958 - RNA, 22 nt, Human
aagucuuugagaucggacauag

SEQ ID NO: 18959 - RNA, 22 nt, Human
aagugaagccaauuuuuuuagg

SEQ ID NO: 18960 - RNA, 22 nt, Human
aagugauauaaaucgagaggga

SEQ ID NO: 18961 - RNA, 22 nt, Human
aagugauuuagagagcucuuag

SEQ ID NO: 18962 - RNA, 23 nt, Human
aagugcucaguggacagcauugc

SEQ ID NO: 18963 - RNA, 20 nt, Human
aagugcuguuagcugccuga

SEQ ID NO: 18964 - RNA, 22 nt, Human
aaguggcaggggaaggguugga

SEQ ID NO: 18965 - RNA, 22 nt, Human
aaguggcccuaauugggccaaa

SEQ ID NO: 18966 - RNA, 17 nt, Human
aagugggcaaagugaga

SEQ ID NO: 18967 - RNA, 23 nt, Human
aaguggucaucuaucccaugguu

SEQ ID NO: 18968 - RNA, 23 nt, Human
aaguggugacugugcuacugaga

SEQ ID NO: 18969 - RNA, 22 nt, Human
aaguggugagacccugcugaaa

SEQ ID NO: 18970 - RNA, 22 nt, Human
aagugguuuauuguaugguuuu

SEQ ID NO: 18971 - RNA, 22 nt, Human
aagugucucugggaggcccgga

SEQ ID NO: 18972 - RNA, 22 nt, Human
aagugugugugcgcaugugcau

SEQ ID NO: 18973 - RNA, 22 nt, Human
aaguguucucuguuuuaucuac

SEQ ID NO: 18974 - RNA, 22 nt, Human
aaguucaccugcauuuacuaaa

SEQ ID NO: 18975 - RNA, 22 nt, Human
aaguuccuaaagucagggguca

SEQ ID NO: 18976 - RNA, 22 nt, Human
aaguucuugguuaauuagggaa

SEQ ID NO: 18977 - RNA, 23 nt, Human
aaguugucauguaaaaugggcua

SEQ ID NO: 18978 - RNA, 21 nt, Human
aaguuucucccuaauuguugc

SEQ ID NO: 18979 - RNA, 20 nt, Human
aauaaauauaacccauaauu

SEQ ID NO: 18980 - RNA, 22 nt, Human
aauaacaguuuauuugagggcu

SEQ ID NO: 18981 - RNA, 22 nt, Human
agaggcaggcagcagagaagau

SEQ ID NO: 18982 - RNA, 22 nt, Human
agaggcaugaacucccguagcc

SEQ ID NO: 18983 - RNA, 22 nt, Human
agaggugcuuaugcucaugguu

SEQ ID NO: 18984 - RNA, 22 nt, Human
agaguaauguggaguuugugcu

SEQ ID NO: 18985 - RNA, 22 nt, Human
agaguacagaagcauuucagau

SEQ ID NO: 18986 - RNA, 22 nt, Human
agaguagucuuuacucuuccaa

SEQ ID NO: 18987 - RNA, 19 nt, Human
agagucuccacuccacuug

SEQ ID NO: 18988 - RNA, 22 nt, Human
agagugagauaugugguuggua

SEQ ID NO: 18989 - RNA, 22 nt, Human
agaguggcaccuuaccugagac

SEQ ID NO: 18990 - RNA, 22 nt, Human
agaguguaauuaguauuuauau

SEQ ID NO: 18991 - RNA, 22 nt, Human
agaguguagugaaaagagauua

SEQ ID NO: 18992 - RNA, 22 nt, Human
agaguguguggggcugagguca

SEQ ID NO: 18993 - RNA, 22 nt, Human
agaguuaguggccucagcaggg

SEQ ID NO: 18994 - RNA, 22 nt, Human
agaguucaccccacugaugagu

SEQ ID NO: 18995 - RNA, 22 nt, Human
agaguucuauccagacucaugu

SEQ ID NO: 18996 - RNA, 21 nt, Human
agaguugaaggcaguaaagag

SEQ ID NO: 18997 - RNA, 21 nt, Human
agaguuuucuccauuucaggc

SEQ ID NO: 18998 - RNA, 22 nt, Human
agauaaacaacucuuagcuguu

SEQ ID NO: 18999 - RNA, 22 nt, Human
agauaagaacauuaguaagccg

SEQ ID NO: 19000 - RNA, 23 nt, Human
agauaaggaagcauuugagccag

SEQ ID NO: 19001 - RNA, 22 nt, Human
agauagccagauauaaauaguc

SEQ ID NO: 19002 - RNA, 22 nt, Human
agauaggccauuaagaaggaua

SEQ ID NO: 19003 - RNA, 22 nt, Human
agauaggcuuagccaagcuuuc

SEQ ID NO: 19004 - RNA, 22 nt, Human
agauauguuaggcuuguucccu

SEQ ID NO: 19005 - RNA, 22 nt, Human
agauauuauuuucuauuuauca

SEQ ID NO: 19006 - RNA, 22 nt, Human
agauccuagaugugaauagcua

SEQ ID NO: 19007 - RNA, 17 nt, Human
agaucugaaggagaaca

SEQ ID NO: 19008 - RNA, 22 nt, Human
agaugaccaguaagugguugaa

SEQ ID NO: 19009 - RNA, 22 nt, Human
agaugacuaacauaguauugcu

SEQ ID NO: 19010 - RNA, 22 nt, Human
agaugacuuuguccugagcuga

SEQ ID NO: 19011 - RNA, 23 nt, Human
agaugaugaauaaagagugagga

SEQ ID NO: 19012 - RNA, 21 nt, Human
agaugcaguuugcaggugggu

SEQ ID NO: 19013 - RNA, 20 nt, Human
agaugcccaacucuguuuug

SEQ ID NO: 19014 - RNA, 22 nt, Human
agauggaggaaagcaguuagaa

SEQ ID NO: 19015 - RNA, 22 nt, Human
agauggaguccugaagccagaa

SEQ ID NO: 19016 - RNA, 22 nt, Human
agauggcugggagcucuguuug

SEQ ID NO: 19017 - RNA, 22 nt, Human
agaugggacauuugucccuagg

SEQ ID NO: 19018 - RNA, 22 nt, Human
agaugguucagaauuauaaaga

SEQ ID NO: 19019 - RNA, 21 nt, Human
agauguucaguguccuaaccc

SEQ ID NO: 19020 - RNA, 22 nt, Human
agauuauuuaagacaggaacca

SEQ ID NO: 19021 - RNA, 22 nt, Human
agauugaugugaccauuggaag

SEQ ID NO: 19022 - RNA, 22 nt, Human
agauuucaauggauauugcaag

SEQ ID NO: 19023 - RNA, 22 nt, Human
agauuuggaauggggguucaua

SEQ ID NO: 19024 - RNA, 22 nt, Human
agauuuuacggaguauuagggu

SEQ ID NO: 19025 - RNA, 22 nt, Human
agauuuucuuuuccaucuuugu

SEQ ID NO: 19026 - RNA, 22 nt, Human
agcaaaauuccaaaaugcuaau

SEQ ID NO: 19027 - RNA, 22 nt, Human
agcaaagccucuuugaaaaaaa

SEQ ID NO: 19028 - RNA, 22 nt, Human
agcaaagguagcagcucccagg

SEQ ID NO: 19029 - RNA, 22 nt, Human
agcaaaguacugagcucaaagg

SEQ ID NO: 19030 - RNA, 22 nt, Human
agcaacauggaguuugugcgca

SEQ ID NO: 19031 - RNA, 22 nt, Human
agcaaggagcugaaaccgggcu

SEQ ID NO: 19032 - RNA, 22 nt, Human
agcaagggucucucauggcuug

SEQ ID NO: 19033 - RNA, 22 nt, Human
agcaauguuggccuauauaccu

SEQ ID NO: 19034 - RNA, 22 nt, Human
agcaauucagagcauggacuuu

SEQ ID NO: 19035 - RNA, 22 nt, Human
agcaauucugaaauuacuugac

SEQ ID NO: 19036 - RNA, 22 nt, Human
agcaccuuguucagaucuuaca

SEQ ID NO: 19037 - RNA, 22 nt, Human
agcacgcccaccuccugcggcg

SEQ ID NO: 19038 - RNA, 22 nt, Human
agcacguucuucauuacuucac

SEQ ID NO: 19039 - RNA, 22 nt, Human
agcacuagcugcuugucucaag

SEQ ID NO: 19040 - RNA, 22 nt, Human
agcacucacuagaguuagaacc

SEQ ID NO: 19041 - RNA, 22 nt, Human
agcacuugggugauaguacuuu

SEQ ID NO: 19042 - RNA, 22 nt, Human
agcagagaacauucauucaugu

SEQ ID NO: 19043 - RNA, 22 nt, Human
agcagagggucaguuuuuuagu

SEQ ID NO: 19044 - RNA, 22 nt, Human
agcagauuguacagugcauuag

SEQ ID NO: 19045 - RNA, 22 nt, Human
agcagcaaugacaauucaacca

SEQ ID NO: 19046 - RNA, 22 nt, Human
agcagcaccuguccucgcugcu

SEQ ID NO: 19047 - RNA, 22 nt, Human
agcagcaggugaccucgaugcc

SEQ ID NO: 19048 - RNA, 19 nt, Human
agcagccaucgaccaugga

SEQ ID NO: 19049 - RNA, 22 nt, Human
agcagccgccgccgccgcgcac

SEQ ID NO: 19050 - RNA, 22 nt, Human
agcagcugagccccagcuguga

SEQ ID NO: 19051 - RNA, 22 nt, Human
agcaggacuugcugagcccucc

SEQ ID NO: 19052 - RNA, 22 nt, Human
agcaggaggguuuuguagaguc

SEQ ID NO: 19053 - RNA, 22 nt, Human
agcaggccuuucaccucugucc

SEQ ID NO: 19054 - RNA, 22 nt, Human
agcagggagacagugcagcauu

SEQ ID NO: 19055 - RNA, 22 nt, Human
agcagggagaccaucucuuccu

SEQ ID NO: 19056 - RNA, 22 nt, Human
agcaggguggcaagucuuucug

SEQ ID NO: 19057 - RNA, 22 nt, Human
agcagggugugggugugagugu

SEQ ID NO: 19058 - RNA, 22 nt, Human
agcaggucagugguaaucaaaa

SEQ ID NO: 19059 - RNA, 22 nt, Human
agcagucagaucguggggaaaa

SEQ ID NO: 19060 - RNA, 22 nt, Human
agcaguuagauccugguuagcg

SEQ ID NO: 19061 - RNA, 18 nt, Human
agcaguugucucucucca

SEQ ID NO: 19062 - RNA, 22 nt, Human
agcaguuuauccucauaaugga

SEQ ID NO: 19063 - RNA, 22 nt, Human
agcaucuaucuucaaugugugu

SEQ ID NO: 19064 - RNA, 19 nt, Human
agcaucuccacagaaaaag

SEQ ID NO: 19065 - RNA, 22 nt, Human
agcaugaauugccauuuauuaa

SEQ ID NO: 19066 - RNA, 22 nt, Human
agcaugucuaacucuucagggu

SEQ ID NO: 19067 - RNA, 22 nt, Human
agcauuagguguguuucagagg

SEQ ID NO: 19068 - RNA, 22 nt, Human
agcauucagacaucugauggau

SEQ ID NO: 19069 - RNA, 22 nt, Human
guccaguaguguuugcaugugg

SEQ ID NO: 19070 - RNA, 22 nt, Human
guccauauuuauccuuaaagua

SEQ ID NO: 19071 - RNA, 19 nt, Human
guccaugguaaagaaggau

SEQ ID NO: 19072 - RNA, 22 nt, Human
gucccagaggacagggucacau

SEQ ID NO: 19073 - RNA, 22 nt, Human
guccccugcguguucauccugg

SEQ ID NO: 19074 - RNA, 22 nt, Human
guccccugcuguggaucugugg

SEQ ID NO: 19075 - RNA, 22 nt, Human
guccuaugggaagggauccugg

SEQ ID NO: 19076 - RNA, 22 nt, Human
guccucgggcucacucccaggg

SEQ ID NO: 19077 - RNA, 22 nt, Human
guccucgugucuuuuucucuaa

SEQ ID NO: 19078 - RNA, 22 nt, Human
guccugaaaaaaaucccugagu

SEQ ID NO: 19079 - RNA, 22 nt, Human
guccuggagcagcuggaagaug

SEQ ID NO: 19080 - RNA, 22 nt, Human
guccuguccuguccuggagaca

SEQ ID NO: 19081 - RNA, 22 nt, Human
guccuuuauuugaacaugacau

SEQ ID NO: 19082 - RNA, 22 nt, Human
guccuuuuuuuauacccaggcc

SEQ ID NO: 19083 - RNA, 22 nt, Human
gucgccuaauuaggguauccua

SEQ ID NO: 19084 - RNA, 22 nt, Human
gucgcuuuccugaggggucuca

SEQ ID NO: 19085 - RNA, 22 nt, Human
gucgguacuaguacugguguug

SEQ ID NO: 19086 - RNA, 22 nt, Human
gucguagaaccuuuuccaaaca

SEQ ID NO: 19087 - RNA, 20 nt, Human
gucguguauauagcuggggc

SEQ ID NO: 19088 - RNA, 22 nt, Human
gucuaccuucuuucucaacugg

SEQ ID NO: 19089 - RNA, 22 nt, Human
gucuauaaccuuuccaauuacc

SEQ ID NO: 19090 - RNA, 22 nt, Human
gucuauucaucauucaucaaac

SEQ ID NO: 19091 - RNA, 22 nt, Human
gucuccugcccacccugguccc

SEQ ID NO: 19092 - RNA, 22 nt, Human
gucuccuucauuuacuguuucc

SEQ ID NO: 19093 - RNA, 22 nt, Human
gucucuuuugauuuuucacuca

SEQ ID NO: 19094 - RNA, 22 nt, Human
gucugcucauguuugguuugug

SEQ ID NO: 19095 - RNA, 22 nt, Human
gucuggagccacugcugcugcu

SEQ ID NO: 19096 - RNA, 22 nt, Human
gucugguggaguuguauauacu

SEQ ID NO: 19097 - RNA, 22 nt, Human
gucuggugguggguguagggca

SEQ ID NO: 19098 - RNA, 22 nt, Human
gucuguacugccguuauucaga

SEQ ID NO: 19099 - RNA, 22 nt, Human
gucugugguccaaaauugccuc

SEQ ID NO: 19100 - RNA, 22 nt, Human
gucuguuggcacagggggaggu

SEQ ID NO: 19101 - RNA, 22 nt, Human
gucuucuauuuggcaugacaga

SEQ ID NO: 19102 - RNA, 22 nt, Human
gucuuugagccucaguuuccuc

SEQ ID NO: 19103 - RNA, 22 nt, Human
gucuuuguaguuuuaauuugag

SEQ ID NO: 19104 - RNA, 22 nt, Human
gugaaaauaguaaccuggcuag

SEQ ID NO: 19105 - RNA, 22 nt, Human
gugaaacuggaugugaaaacaa

SEQ ID NO: 19106 - RNA, 23 nt, Human
gugaacaaugcuccaggagauac

SEQ ID NO: 19107 - RNA, 20 nt, Human
gugaacuggagaacugaugu

SEQ ID NO: 19108 - RNA, 22 nt, Human
gugaagcaagggucaccugugg

SEQ ID NO: 19109 - RNA, 22 nt, Human
gugaaggcaugugugcugugcu

SEQ ID NO: 19110 - RNA, 22 nt, Human
gugaagguccugauuugugacc

SEQ ID NO: 19111 - RNA, 21 nt, Human
gugaccuguuaugcaaaggca

SEQ ID NO: 19112 - RNA, 22 nt, Human
gugacuaugguggagaucagua

SEQ ID NO: 19113 - RNA, 22 nt, Human
gugacucuacuuaagauuaagc

SEQ ID NO: 19114 - RNA, 22 nt, Human
gugacugagcuggcaaaguaug

SEQ ID NO: 19115 - RNA, 22 nt, Human
gugagaggaggcagcuuuuaca

SEQ ID NO: 19116 - RNA, 22 nt, Human
gugagagugguuuauguccaug

SEQ ID NO: 19117 - RNA, 22 nt, Human
gugaggcccaggugaaauuaac

SEQ ID NO: 19118 - RNA, 22 nt, Human
gugaguguguccgacuccaagg

SEQ ID NO: 19119 - RNA, 22 nt, Human
gugaguugugugaguaagcaga

SEQ ID NO: 19120 - RNA, 22 nt, Human
gugauaguucuuacuccaaagu

SEQ ID NO: 19121 - RNA, 19 nt, Human
gugauauuuauuauuuauu

SEQ ID NO: 19122 - RNA, 22 nt, Human
gugaugaaggccugcaccuggu

SEQ ID NO: 19123 - RNA, 22 nt, Human
gugaugaagguggagaaucaga

SEQ ID NO: 19124 - RNA, 19 nt, Human
gugaugaugccacuccaac

SEQ ID NO: 19125 - RNA, 22 nt, Human
gugauucaucuggggccuuauu

SEQ ID NO: 19126 - RNA, 22 nt, Human
gugauuucagguuuuucauacu

SEQ ID NO: 19127 - RNA, 22 nt, Human
gugcaaugaguguggcaaagcc

SEQ ID NO: 19128 - RNA, 22 nt, Human
gugcagcugguggagucugggg

SEQ ID NO: 19129 - RNA, 22 nt, Human
gugcauauguguguauacaaac

SEQ ID NO: 19130 - RNA, 22 nt, Human
gugccgcuggagcuggaauuga

SEQ ID NO: 19131 - RNA, 22 nt, Human
gugccgggcugcggcaaggugu

SEQ ID NO: 19132 - RNA, 22 nt, Human
gugccuaaugacccauuuaucc

SEQ ID NO: 19133 - RNA, 22 nt, Human
gugccucuaguuuucuccuaaa

SEQ ID NO: 19134 - RNA, 22 nt, Human
gugccugcucauucucaauauu

SEQ ID NO: 19135 - RNA, 22 nt, Human
gugccuggugcaggauaaucac

SEQ ID NO: 19136 - RNA, 22 nt, Human
gugccuuuuucccaguucauug

SEQ ID NO: 19137 - RNA, 22 nt, Human
gugcuaaguaaguauuuuggag

SEQ ID NO: 19138 - RNA, 22 nt, Human
gugcuacacaaauguuaguugu

SEQ ID NO: 19139 - RNA, 22 nt, Human
gugcucuagaaauugucagugg

SEQ ID NO: 19140 - RNA, 22 nt, Human
gugcugcaaggauggagaggca

SEQ ID NO: 19141 - RNA, 22 nt, Human
gugcugcaugagcaucacguag

SEQ ID NO: 19142 - RNA, 22 nt, Human
gugcuguuagcgguuuauaaca

SEQ ID NO: 19143 - RNA, 22 nt, Human
gugcuuccuguauugauuccau

SEQ ID NO: 19144 - RNA, 22 nt, Human
gugcuugcgcauaacuggggcc

SEQ ID NO: 19145 - RNA, 22 nt, Human
gugcuuuaccuuauuggucucg

SEQ ID NO: 19146 - RNA, 22 nt, Human
gugcuuugcuaggaccgauugu

SEQ ID NO: 19147 - RNA, 22 nt, Human
guggaaauaugggcaacaaaga

SEQ ID NO: 19148 - RNA, 22 nt, Human
guggaaauuuuaggaucaucuu

SEQ ID NO: 19149 - RNA, 22 nt, Human
guggaagauauuucugguccag

SEQ ID NO: 19150 - RNA, 22 nt, Human
guggaaggaauuaacagacuag

SEQ ID NO: 19151 - RNA, 22 nt, Human
guggacagacauaauccuaauu

SEQ ID NO: 19152 - RNA, 22 nt, Human
guggacuagaguaggaguugca

SEQ ID NO: 19153 - RNA, 22 nt, Human
ucacugccuagggcuacugugc

SEQ ID NO: 19154 - RNA, 20 nt, Human
ucacuguaauugccuacauu

SEQ ID NO: 19155 - RNA, 22 nt, Human
ucacuguugccacggugauaau

SEQ ID NO: 19156 - RNA, 22 nt, Human
ucacuguuucaccgucugaagg

SEQ ID NO: 19157 - RNA, 22 nt, Human
ucacuuccuugcagcuguagaa

SEQ ID NO: 19158 - RNA, 22 nt, Human
ucagaacuaacuuugcugaacc

SEQ ID NO: 19159 - RNA, 22 nt, Human
ucagaacucuagucucagccug

SEQ ID NO: 19160 - RNA, 18 nt, Human
ucagaaugauuuggugga

SEQ ID NO: 19161 - RNA, 22 nt, Human
ucagacacacaacuucugcuua

SEQ ID NO: 19162 - RNA, 18 nt, Human
ucagaggagauaccuaaa

SEQ ID NO: 19163 - RNA, 22 nt, Human
ucagagugagcuggggcugcuu

SEQ ID NO: 19164 - RNA, 22 nt, Human
ucagauaauccaauagagagga

SEQ ID NO: 19165 - RNA, 22 nt, Human
ucagcaaugggauucaggcuuu

SEQ ID NO: 19166 - RNA, 19 nt, Human
ucagcagauuuugcaaaca

SEQ ID NO: 19167 - RNA, 22 nt, Human
ucagcaguuaagcuucccugcc

SEQ ID NO: 19168 - RNA, 21 nt, Human
ucagccuguccaguguuaacc

SEQ ID NO: 19169 - RNA, 22 nt, Human
ucagccuugguuuugguguugg

SEQ ID NO: 19170 - RNA, 22 nt, Human
ucagcguuaguuuuucaucuaa

SEQ ID NO: 19171 - RNA, 22 nt, Human
ucagcuauccauucuccuauga

SEQ ID NO: 19172 - RNA, 22 nt, Human
ucagcucacaauguugagaaag

SEQ ID NO: 19173 - RNA, 22 nt, Human
ucagcucucucuuggugaucuc

SEQ ID NO: 19174 - RNA, 22 nt, Human
ucaggcgcucuucguggcugcc

SEQ ID NO: 19175 - RNA, 18 nt, Human
ucagggaaacuuugccug

SEQ ID NO: 19176 - RNA, 22 nt, Human
ucagggaggagaggcaggggga

SEQ ID NO: 19177 - RNA, 23 nt, Human
ucagggaucgucagaaaaugaaa

SEQ ID NO: 19178 - RNA, 22 nt, Human
ucaggguacuuguggccaaagu

SEQ ID NO: 19179 - RNA, 22 nt, Human
ucagguagugguuaaguucugu

SEQ ID NO: 19180 - RNA, 22 nt, Human
ucaggucacugauaaaguggaa

SEQ ID NO: 19181 - RNA, 22 nt, Human
ucagguuuaagugacuggaauc

SEQ ID NO: 19182 - RNA, 22 nt, Human
ucagguuuuuaaggagcuagga

SEQ ID NO: 19183 - RNA, 22 nt, Human
ucaguaagauugauauuucccc

SEQ ID NO: 19184 - RNA, 22 nt, Human
ucaguacaagauuuucuaaauc

SEQ ID NO: 19185 - RNA, 22 nt, Human
ucaguagcauuuaauguucagu

SEQ ID NO: 19186 - RNA, 22 nt, Human
ucagucacugugaaaugaauuu

SEQ ID NO: 19187 - RNA, 22 nt, Human
ucagucauacuuuaugauugaa

SEQ ID NO: 19188 - RNA, 18 nt, Human
ucaguccuccauagagcu

SEQ ID NO: 19189 - RNA, 22 nt, Human
ucagucugcuauagguauuugu

SEQ ID NO: 19190 - RNA, 22 nt, Human
ucagucuucaggacuaugaaaa

SEQ ID NO: 19191 - RNA, 23 nt, Human
ucagugaaggaacaacuaaauag

SEQ ID NO: 19192 - RNA, 22 nt, Human
ucaguggaacacacagaguggg

SEQ ID NO: 19193 - RNA, 19 nt, Human
ucagugggacauuugcuuu

SEQ ID NO: 19194 - RNA, 22 nt, Human
ucagugguuaaguucuguccac

SEQ ID NO: 19195 - RNA, 22 nt, Human
ucaguguccuucguucuuguug

SEQ ID NO: 19196 - RNA, 22 nt, Human
ucaguugauggcaguuaauguc

SEQ ID NO: 19197 - RNA, 17 nt, Human
ucaguugugcgagcagc

SEQ ID NO: 19198 - RNA, 20 nt, Human
ucaguuucccuauuagguug

SEQ ID NO: 19199 - RNA, 22 nt, Human
ucauaaaaucaguguccauugu

SEQ ID NO: 19200 - RNA, 22 nt, Human
ucauaaaggugccacucaguuu

SEQ ID NO: 19201 - RNA, 22 nt, Human
ucauaagucucauauaugucca

SEQ ID NO: 19202 - RNA, 21 nt, Human
ucauaauaauuacaugggggg

SEQ ID NO: 19203 - RNA, 22 nt, Human
ucauacuuuuuugacccuugug

SEQ ID NO: 19204 - RNA, 21 nt, Human
ucauccagguccugcuucuuc

SEQ ID NO: 19205 - RNA, 22 nt, Human
ucaucccuuccugcacuauuag

SEQ ID NO: 19206 - RNA, 22 nt, Human
ucauccucguccucuggugccc

SEQ ID NO: 19207 - RNA, 20 nt, Human
ucaucuuucaaauuugugac

SEQ ID NO: 19208 - RNA, 22 nt, Human
ucaugacaacuugcacaguuuu

SEQ ID NO: 19209 - RNA, 22 nt, Human
ucaugagcacaggugcagggac

SEQ ID NO: 19210 - RNA, 22 nt, Human
ucaugauaauacaggccuucua

SEQ ID NO: 19211 - RNA, 22 nt, Human
ucaugcagaguagaaagggcaa

SEQ ID NO: 19212 - RNA, 22 nt, Human
ucaugcagauaagaauaaguaa

SEQ ID NO: 19213 - RNA, 22 nt, Human
ucaugucagugucugugugugg

SEQ ID NO: 19214 - RNA, 22 nt, Human
ucauuauuuugauguauuuccu

SEQ ID NO: 19215 - RNA, 23 nt, Human
ucauugcucaagauaaugguuga

SEQ ID NO: 19216 - RNA, 22 nt, Human
ucauuggagcauaugaugguua

SEQ ID NO: 19217 - RNA, 22 nt, Human
ucauugguugcguaauuugauu

SEQ ID NO: 19218 - RNA, 22 nt, Human
ucauuguuucugcuuuucauga

SEQ ID NO: 19219 - RNA, 17 nt, Human
ucauuuauccucuuugg

SEQ ID NO: 19220 - RNA, 22 nt, Human
ucauuuaucgcugccuuuuaaa

SEQ ID NO: 19221 - RNA, 17 nt, Human
ucauuucaguaaaucca

SEQ ID NO: 19222 - RNA, 22 nt, Human
ucauuuguauucuacaaagcac

SEQ ID NO: 19223 - RNA, 22 nt, Human
uccaagacagauaccuagaaga

SEQ ID NO: 19224 - RNA, 23 nt, Human
uccaagagagauuuuaaauuucu

SEQ ID NO: 19225 - RNA, 22 nt, Human
uccaaggacuaaauucuagauu

SEQ ID NO: 19226 - RNA, 22 nt, Human
uccaaggacucuugucagcugu

SEQ ID NO: 19227 - RNA, 22 nt, Human
uccaaguuugagacugagagug

SEQ ID NO: 19228 - RNA, 22 nt, Human
uccaaugugccuuauuuugagc

SEQ ID NO: 19229 - RNA, 22 nt, Human
uccacagggaugccugcggcuu

SEQ ID NO: 19230 - RNA, 22 nt, Human
uccauugucaauaguauugauu

SEQ ID NO: 19231 - RNA, 22 nt, Human
uccauuuacuauucucauaucg

SEQ ID NO: 19232 - RNA, 22 nt, Human
ucccaaaacuugaagcaagccu

SEQ ID NO: 19233 - RNA, 22 nt, Human
ucccaagugcuccucuggcccc

SEQ ID NO: 19234 - RNA, 22 nt, Human
ucccaaguguuuggcgaggaga

SEQ ID NO: 19235 - RNA, 22 nt, Human
ucccaauuuacuagaugaauga

SEQ ID NO: 19236 - RNA, 22 nt, Human
ucccacugucuucucgugcucg

SEQ ID NO: 19237 - RNA, 22 nt, Human
ucccagccugacagugcaucaa

SEQ ID NO: 19238 - RNA, 22 nt, Human
ucccccuugucguuugagguuu

SEQ ID NO: 19239 - RNA, 22 nt, Human
uccccgcugcgcccgcugcugc

SEQ ID NO: 19240 - RNA, 22 nt, Human
uccccggagucccuggccaggg

SEQ ID NO: 19241 - RNA, 19 nt, Human
uccccuacuccuuucccuc

SEQ ID NO: 19242 - RNA, 20 nt, Human
uccccuccacuuuccuccua

SEQ ID NO: 19243 - RNA, 22 nt, Human
uccccucucugcgcucccaggu

SEQ ID NO: 19244 - RNA, 21 nt, Human
uccccugugccuggcauacag

SEQ ID NO: 19245 - RNA, 22 nt, Human
ucccguuucacuccuugccagc

SEQ ID NO: 19246 - RNA, 22 nt, Human
ucccuacuccucuggucccucu

SEQ ID NO: 19247 - RNA, 22 nt, Human
ucccucgccccggguucuuucu

SEQ ID NO: 19248 - RNA, 22 nt, Human
ucccucguuucgaucuuuagaa

SEQ ID NO: 19249 - RNA, 22 nt, Human
ucccucuccugucugcuucuuu

SEQ ID NO: 19250 - RNA, 22 nt, Human
ucccucugccugcaguccugcu

SEQ ID NO: 19251 - RNA, 22 nt, Human
ucccugagcuguguuuguuggu

SEQ ID NO: 19252 - RNA, 22 nt, Human
ucccugcaggcauguacucuga

SEQ ID NO: 19253 - RNA, 22 nt, Human
ucccugccuccuggcagugcca

SEQ ID NO: 19254 - RNA, 22 nt, Human
ucccugcgugagaaagcacuua

SEQ ID NO: 19255 - RNA, 22 nt, Human
ucccuguggauuaaggagaugu

SEQ ID NO: 19256 - RNA, 23 nt, Human
ucccuguuucagggccagaacug

SEQ ID NO: 19257 - RNA, 22 nt, Human
ucccuguuuccugcgcuccuuc

SEQ ID NO: 19258 - RNA, 22 nt, Human
ucccuucccaccccugccuuuu

SEQ ID NO: 19259 - RNA, 22 nt, Human
ucccuugacauuacuugggagg

SEQ ID NO: 19260 - RNA, 22 nt, Human
ucccuugacuucucuuuuucca

SEQ ID NO: 19261 - RNA, 22 nt, Human
ucccuuguguaggacaccccag

SEQ ID NO: 19262 - RNA, 22 nt, Human
ucccuuuuagccccgcccuccu

SEQ ID NO: 19263 - RNA, 22 nt, Human
ucccuuuucauccuaucccagc

SEQ ID NO: 19264 - RNA, 22 nt, Human
ucccuuuuuccugaucugugaa

SEQ ID NO: 19265 - RNA, 22 nt, Human
uccgcguugguuagagagggcu

SEQ ID NO: 19266 - RNA, 22 nt, Human
uccggcgaccuccagauguucc

SEQ ID NO: 19267 - RNA, 22 nt, Human
uccgggagcccccggaggagga

SEQ ID NO: 19268 - RNA, 22 nt, Human
uccgugguguuggcucuccggc

SEQ ID NO: 19269 - RNA, 21 nt, Human
uccguucgguuaaaaaggccc

SEQ ID NO: 19270 - RNA, 22 nt, Human
uccguugaggcugccaggcgag

SEQ ID NO: 19271 - RNA, 21 nt, Human
uccuaaaggaaauacucaauu

SEQ ID NO: 19272 - RNA, 20 nt, Human
uccuacauugacccucuucc

SEQ ID NO: 19273 - RNA, 22 nt, Human
uccuacccccuucuccagcucc

SEQ ID NO: 19274 - RNA, 22 nt, Human
uccuaccucaaaaggcaccagc

SEQ ID NO: 19275 - RNA, 22 nt, Human
uccuagaccuacugaaucagac

SEQ ID NO: 19276 - RNA, 22 nt, Human
uccucaaauccuagccucaucg

SEQ ID NO: 19277 - RNA, 22 nt, Human
uccucacaugcaaaaugguauu

SEQ ID NO: 19278 - RNA, 16 nt, Human
uccucacuguagccug

SEQ ID NO: 19279 - RNA, 22 nt, Human
uccucagcaagacgcuggcagc

SEQ ID NO: 19280 - RNA, 22 nt, Human
uccucaucuuaucaucccaaga

SEQ ID NO: 19281 - RNA, 22 nt, Human
uccuccacuuagcgccacuggg

SEQ ID NO: 19282 - RNA, 22 nt, Human
uccucccagguucuaucuccuc

SEQ ID NO: 19283 - RNA, 23 nt, Human
uccuccccaccuuuguccccucc

SEQ ID NO: 19284 - RNA, 22 nt, Human
uccucccgaaugaguagaaggg

SEQ ID NO: 19285 - RNA, 22 nt, Human
uccucccugcacucagugaagu

SEQ ID NO: 19286 - RNA, 22 nt, Human
uccuccucgccacgacucugcu

SEQ ID NO: 19287 - RNA, 22 nt, Human
uccuccuuccugccccuaacuu

SEQ ID NO: 19288 - RNA, 20 nt, Human
uccuccuugcagagcccaga

SEQ ID NO: 19289 - RNA, 22 nt, Human
uccucgccgucacgcagccucu

SEQ ID NO: 19290 - RNA, 22 nt, Human
uccucguccucauccgcgucau

SEQ ID NO: 19291 - RNA, 22 nt, Human
uccucuccaggugagccgaaau

SEQ ID NO: 19292 - RNA, 21 nt, Human
uccucucuaaguuccgccccg

SEQ ID NO: 19293 - RNA, 22 nt, Human
uccucuucaaaauagcucugaa

SEQ ID NO: 19294 - RNA, 22 nt, Human
uccucuuguguguuccgguacc

SEQ ID NO: 19295 - RNA, 22 nt, Human
uccugaaggccugaguuccacc

SEQ ID NO: 19296 - RNA, 22 nt, Human
uccugaaugguguaauagguuu

SEQ ID NO: 19297 - RNA, 22 nt, Human
uccugaggaaauuucaccuagu

SEQ ID NO: 19298 - RNA, 22 nt, Human
uccugcaugcuagugagugcuu

SEQ ID NO: 19299 - RNA, 22 nt, Human
uccugcccuguccuugccucug

SEQ ID NO: 19300 - RNA, 21 nt, Human
uccugccuggccuucugacua

SEQ ID NO: 19301 - RNA, 22 nt, Human
uccuggaagggaugguugagga

SEQ ID NO: 19302 - RNA, 22 nt, Human
uccuggcuguuagagaggcaag

SEQ ID NO: 19303 - RNA, 22 nt, Human
uccuuacuccuggagauucuga

SEQ ID NO: 19304 - RNA, 22 nt, Human
uccuuagccagggcagcucaaa

SEQ ID NO: 19305 - RNA, 22 nt, Human
ucaaaaauaagauauucuggac

SEQ ID NO: 19306 - RNA, 22 nt, Human
ucaaagaucuuugcuuuugggg

SEQ ID NO: 19307 - RNA, 22 nt, Human
ucaaauaugggccagaggaaau

SEQ ID NO: 19308 - RNA, 22 nt, Human
ucaaaucugauaggcgacaccu

SEQ ID NO: 19309 - RNA, 22 nt, Human
ucaaaucuuuuuuccuucccug

SEQ ID NO: 19310 - RNA, 22 nt, Human
ucaaccagcuuaucugcaggau

SEQ ID NO: 19311 - RNA, 21 nt, Human
ucaagcggcagagcaguuauu

SEQ ID NO: 19312 - RNA, 22 nt, Human
ucaagggaccaagcauucauua

SEQ ID NO: 19313 - RNA, 22 nt, Human
ucaagguauuauuuuuguggug

SEQ ID NO: 19314 - RNA, 21 nt, Human
ucaagugcccaagguuuguuu

SEQ ID NO: 19315 - RNA, 22 nt, Human
ucaauuggcuacaaauaaugua

SEQ ID NO: 19316 - RNA, 22 nt, Human
ucaauuuauguggcuauucauu

SEQ ID NO: 19317 - RNA, 22 nt, Human
ucacaagaagaaauuaaacugu

SEQ ID NO: 19318 - RNA, 22 nt, Human
ucacaggagucaaggaauagua

SEQ ID NO: 19319 - RNA, 22 nt, Human
ucacaguucaacuaguucagau

SEQ ID NO: 19320 - RNA, 22 nt, Human
ucacaugcucaccuaagccaca

SEQ ID NO: 19321 - RNA, 22 nt, Human
ucacauggauuaacucauuuau

SEQ ID NO: 19322 - RNA, 22 nt, Human
ucacauugcauuuucucauuug

SEQ ID NO: 19323 - RNA, 22 nt, Human
ucaccaggauugggcuguaggc

SEQ ID NO: 19324 - RNA, 22 nt, Human
ucaccaugcccuucucugcucu

SEQ ID NO: 19325 - RNA, 22 nt, Human
ucaccauguacaugaagggcgg

SEQ ID NO: 19326 - RNA, 22 nt, Human
ucaccccagccuuaugacucag

SEQ ID NO: 19327 - RNA, 22 nt, Human
ucaccgucucaguacggaggga

SEQ ID NO: 19328 - RNA, 22 nt, Human
ucaccuggagagcuugcuaaua

SEQ ID NO: 19329 - RNA, 22 nt, Human
ucaccuguuggauguauacugu

SEQ ID NO: 19330 - RNA, 19 nt, Human
ucacggucaaccagagccu

SEQ ID NO: 19331 - RNA, 22 nt, Human
ucacuagugguuucuggugguu

SEQ ID NO: 19332 - RNA, 22 nt, Human
ucacuauagugccgaggacuga

SEQ ID NO: 19333 - RNA, 22 nt, Human
ucacuaugcccagaauacaguu

SEQ ID NO: 19334 - RNA, 22 nt, Human
ucacucagucugagcaauugcu

SEQ ID NO: 19335 - RNA, 22 nt, Human
ucacucgccuuuucguucgccg

SEQ ID NO: 19336 - RNA, 22 nt, Human
ucacucuuuaucuuuuaugucu

SEQ ID NO: 19337 - RNA, 23 nt, Human
ucacugccaagaaaaguuacaga

SEQ ID NO: 19338 - RNA, 22 nt, Human
ugaccuacauuuauagcuguca

SEQ ID NO: 19339 - RNA, 22 nt, Human
ugaccucaagcaugcggagggc

SEQ ID NO: 19340 - RNA, 22 nt, Human
ugaccuccuaagugacagaauu

SEQ ID NO: 19341 - RNA, 22 nt, Human
ugaccuuuuuaaauuauuuuua

SEQ ID NO: 19342 - RNA, 22 nt, Human
ugacgcauggccagcucugucu

SEQ ID NO: 19343 - RNA, 22 nt, Human
ugacguuugcgccgcgcacgac

SEQ ID NO: 19344 - RNA, 22 nt, Human
ugacuagggauauuuucuuucc

SEQ ID NO: 19345 - RNA, 22 nt, Human
ugacugagacugcaaugaccga

SEQ ID NO: 19346 - RNA, 19 nt, Human
ugacuggguucuaggcagg

SEQ ID NO: 19347 - RNA, 22 nt, Human
ugacugguauuuguaaaccaua

SEQ ID NO: 19348 - RNA, 22 nt, Human
ugacuuauuaaaaguuuuuauu

SEQ ID NO: 19349 - RNA, 22 nt, Human
ugacuuuucuccucugaaguuu

SEQ ID NO: 19350 - RNA, 22 nt, Human
ugagaaaacaguuuguaauaau

SEQ ID NO: 19351 - RNA, 20 nt, Human
ugagaaacaagggcuggucu

SEQ ID NO: 19352 - RNA, 22 nt, Human
ugagaacacuuuucucuuugcu

SEQ ID NO: 19353 - RNA, 22 nt, Human
ugagaagucagucuauugugaa

SEQ ID NO: 19354 - RNA, 22 nt, Human
ugagaauuuaacuugauuagga

SEQ ID NO: 19355 - RNA, 22 nt, Human
ugagacagaccuuggaccaugu

SEQ ID NO: 19356 - RNA, 22 nt, Human
ugagacucuccugugcagccuc

SEQ ID NO: 19357 - RNA, 22 nt, Human
ugagacugaguuugguuuuguu

SEQ ID NO: 19358 - RNA, 22 nt, Human
ugagacuugaacuccagugcca

SEQ ID NO: 19359 - RNA, 22 nt, Human
ugagacuuggggggcugagggc

SEQ ID NO: 19360 - RNA, 22 nt, Human
ugagagaauuacuaaagggcuu

SEQ ID NO: 19361 - RNA, 22 nt, Human
ugagagaggugaaaugacuuuc

SEQ ID NO: 19362 - RNA, 22 nt, Human
ugagaggaagggaaagaugauu

SEQ ID NO: 19363 - RNA, 22 nt, Human
ugagagggagacagcucuagca

SEQ ID NO: 19364 - RNA, 22 nt, Human
ugagauuuagaacuggauuuca

SEQ ID NO: 19365 - RNA, 22 nt, Human
ugagcagagcacuugggaacga

SEQ ID NO: 19366 - RNA, 22 nt, Human
ugagcagccagucauucaaaaa

SEQ ID NO: 19367 - RNA, 22 nt, Human
ugagccauguucaugaguucau

SEQ ID NO: 19368 - RNA, 22 nt, Human
ugagccugaguguguauugaac

SEQ ID NO: 19369 - RNA, 22 nt, Human
ugagcuauuucaccauauagau

SEQ ID NO: 19370 - RNA, 22 nt, Human
ugaggaggugcuaccagcgucu

SEQ ID NO: 19371 - RNA, 22 nt, Human
ugaggaugagaaggaagagaag

SEQ ID NO: 19372 - RNA, 22 nt, Human
ugaggcaguucuuacuuguauu

SEQ ID NO: 19373 - RNA, 21 nt, Human
ugaggccugccagucucagaa

SEQ ID NO: 19374 - RNA, 17 nt, Human
ugaggcugucucccugg

SEQ ID NO: 19375 - RNA, 22 nt, Human
ugagggaagguugauaauguuc

SEQ ID NO: 19376 - RNA, 22 nt, Human
ugagggaggggaaugugugcag

SEQ ID NO: 19377 - RNA, 22 nt, Human
ugagggagggggagccguucua

SEQ ID NO: 19378 - RNA, 22 nt, Human
ugagggaguguggauacaguag

SEQ ID NO: 19379 - RNA, 22 nt, Human
ugagggaugccucuccuuccgg

SEQ ID NO: 19380 - RNA, 22 nt, Human
ugaggggaggggagaaaauggu

SEQ ID NO: 19381 - RNA, 22 nt, Human
ugaggggucuccuaccaugaug

SEQ ID NO: 19382 - RNA, 22 nt, Human
ugagguauuuggauuuauauuu

SEQ ID NO: 19383 - RNA, 22 nt, Human
ugaggucaggcagggguuuggc

SEQ ID NO: 19384 - RNA, 23 nt, Human
ugaggucuuggaaguucuguuug

SEQ ID NO: 19385 - RNA, 22 nt, Human
ugagguuacauuaggaauaacc

SEQ ID NO: 19386 - RNA, 22 nt, Human
ugaguacauuugauuaucagag

SEQ ID NO: 19387 - RNA, 19 nt, Human
ugaguacuaaugagauuga

SEQ ID NO: 19388 - RNA, 22 nt, Human
ugagucugaagagagaauaagg

SEQ ID NO: 19389 - RNA, 22 nt, Human
ugagucuguugcuagggggaau

SEQ ID NO: 19390 - RNA, 21 nt, Human
ugagucuuagagaacuucagg

SEQ ID NO: 19391 - RNA, 22 nt, Human
ugagugacuguugucaagaugg

SEQ ID NO: 19392 - RNA, 22 nt, Human
ugagugccagugcuugcucuac

SEQ ID NO: 19393 - RNA, 22 nt, Human
ugagugggaggugggaagggua

SEQ ID NO: 19394 - RNA, 22 nt, Human
ugaguugcagucaauauugcaa

SEQ ID NO: 19395 - RNA, 22 nt, Human
ugaguugucacaacgucacaag

SEQ ID NO: 19396 - RNA, 22 nt, Human
ugauaguaucugauuauuucac

SEQ ID NO: 19397 - RNA, 22 nt, Human
ugaucaguacuguaugagggau

SEQ ID NO: 19398 - RNA, 22 nt, Human
ugaucauguucuccaaaagcgu

SEQ ID NO: 19399 - RNA, 20 nt, Human
ugauccacucucauugcucu

SEQ ID NO: 19400 - RNA, 19 nt, Human
ugaucuccaguacagacau

SEQ ID NO: 19401 - RNA, 22 nt, Human
ugaugaaguuggaaggaaaguu

SEQ ID NO: 19402 - RNA, 22 nt, Human
ugaugaucaugcagguugguuu

SEQ ID NO: 19403 - RNA, 22 nt, Human
ugaugaugauacauuucuucag

SEQ ID NO: 19404 - RNA, 22 nt, Human
ugauggaucuguuggcggguuu

SEQ ID NO: 19405 - RNA, 18 nt, Human
ugauggcuaagagccggg

SEQ ID NO: 19406 - RNA, 22 nt, Human
ugauggugagaugucccguguu

SEQ ID NO: 19407 - RNA, 22 nt, Human
ugauguaggacauuauuauuuc

SEQ ID NO: 19408 - RNA, 22 nt, Human
ugauguauaaaaagagugaaau

SEQ ID NO: 19409 - RNA, 22 nt, Human
ugauguggaucuauaacuguaa

SEQ ID NO: 19410 - RNA, 22 nt, Human
ugauguuucugaagggguuacu

SEQ ID NO: 19411 - RNA, 20 nt, Human
ugauuauuccaacaagaaug

SEQ ID NO: 19412 - RNA, 22 nt, Human
ugauucacagacuucacaaggc

SEQ ID NO: 19413 - RNA, 22 nt, Human
ugauuccugugcuuauuccagu

SEQ ID NO: 19414 - RNA, 22 nt, Human
ugauugaauaauguuaugugaa

SEQ ID NO: 19415 - RNA, 22 nt, Human
ugauugauaaugaagacaguca

SEQ ID NO: 19416 - RNA, 22 nt, Human
ugauugguauguauguuuguca

SEQ ID NO: 19417 - RNA, 22 nt, Human
ugauuguauuuauccucuguuc

SEQ ID NO: 19418 - RNA, 22 nt, Human
ugauuucauaugacagcuuuuu

SEQ ID NO: 19419 - RNA, 22 nt, Human
ugauuuggcaucaguguauccu

SEQ ID NO: 19420 - RNA, 22 nt, Human
ugauuuguuuaaauugcucguu

SEQ ID NO: 19421 - RNA, 22 nt, Human
ugcaaaaagagcgaggagcccu

SEQ ID NO: 19422 - RNA, 22 nt, Human
ugcaaauucuuuacucugugau

SEQ ID NO: 19423 - RNA, 22 nt, Human
ugcaaauuuuuuuauuuuuccu

SEQ ID NO: 19424 - RNA, 22 nt, Human
ugcaagagcccaaacuauauac

SEQ ID NO: 19425 - RNA, 22 nt, Human
ugcaagauccagucuugagaag

SEQ ID NO: 19426 - RNA, 23 nt, Human
ugcaaugcagcuagauguaaaau

SEQ ID NO: 19427 - RNA, 21 nt, Human
ugcaaugcauugacagcagca

SEQ ID NO: 19428 - RNA, 22 nt, Human
ugcacacaguucucaggaaaga

SEQ ID NO: 19429 - RNA, 22 nt, Human
ugcacagagggaggcauaaaau

SEQ ID NO: 19430 - RNA, 22 nt, Human
ugcacccacuuagcugaaguuc

SEQ ID NO: 19431 - RNA, 16 nt, Human
ugcaccgggaacacug

SEQ ID NO: 19432 - RNA, 22 nt, Human
ugcacgcacuugcucuccagcg

SEQ ID NO: 19433 - RNA, 20 nt, Human
ugcacggcugugugugugca

SEQ ID NO: 19434 - RNA, 19 nt, Human
ugcacucauggagggucug

SEQ ID NO: 19435 - RNA, 22 nt, Human
ugcacugccuuucuuggcauga

SEQ ID NO: 19436 - RNA, 22 nt, Human
ugcagaacacaguagacagaac

SEQ ID NO: 19437 - RNA, 22 nt, Human
ugcagaauauucuggugacaau

SEQ ID NO: 19438 - RNA, 19 nt, Human
ugcagcacuaaaaacuuuc

SEQ ID NO: 19439 - RNA, 22 nt, Human
ugcagcagaauauggcugcagg

SEQ ID NO: 19440 - RNA, 22 nt, Human
ugcagccucacgcauccgcauu

SEQ ID NO: 19441 - RNA, 22 nt, Human
ugcagccuuuguccuugggcua

SEQ ID NO: 19442 - RNA, 22 nt, Human
ugcagcgugaggacagcugagc

SEQ ID NO: 19443 - RNA, 19 nt, Human
ugcagcuguaugagcuuaa

SEQ ID NO: 19444 - RNA, 18 nt, Human
ugcagcuuugugauuggc

SEQ ID NO: 19445 - RNA, 22 nt, Human
ugcaggaacucgaaaacuauag

SEQ ID NO: 19446 - RNA, 22 nt, Human
ugcaggaagcucagcggggccg

SEQ ID NO: 19447 - RNA, 18 nt, Human
ugcaggggaggggugaua

SEQ ID NO: 19448 - RNA, 22 nt, Human
ugcagggucuccuguacuuggg

SEQ ID NO: 19449 - RNA, 22 nt, Human
ugcaggguuucaauacacagga

SEQ ID NO: 19450 - RNA, 22 nt, Human
ugcaggucuggacccccacuuu

SEQ ID NO: 19451 - RNA, 22 nt, Human
ugcagguggcagcggggcacca

SEQ ID NO: 19452 - RNA, 22 nt, Human
ugcagugcagcuggaauaucuu

SEQ ID NO: 19453 - RNA, 22 nt, Human
ugcaguugcguuugcauuccau

SEQ ID NO: 19454 - RNA, 17 nt, Human
ugcauagugggaggaga

SEQ ID NO: 19455 - RNA, 22 nt, Human
ugcaucccugaggcauuauccu

SEQ ID NO: 19456 - RNA, 22 nt, Human
ugcaucuaaguggcuaacaacc

SEQ ID NO: 19457 - RNA, 22 nt, Human
ugcaucugagcacuacggugga

SEQ ID NO: 19458 - RNA, 22 nt, Human
ugcaugacugaucuguuuguca

SEQ ID NO: 19459 - RNA, 23 nt, Human
ugcaugagcaucuccaccucagu

SEQ ID NO: 19460 - RNA, 22 nt, Human
ugcaugaucucacuuacaggug

SEQ ID NO: 19461 - RNA, 22 nt, Human
ugcaugcagcuggucgggcgcc

SEQ ID NO: 19462 - RNA, 17 nt, Human
ugcaugcgucugugaua

SEQ ID NO: 19463 - RNA, 22 nt, Human
ugcaugguuauauacuacuagu

SEQ ID NO: 19464 - RNA, 22 nt, Human
ugcauguuauuguggcaagaau

SEQ ID NO: 19465 - RNA, 22 nt, Human
ugcauuacuuugauaagcgucu

SEQ ID NO: 19466 - RNA, 22 nt, Human
ugcauuaguaaagagaggaggg

SEQ ID NO: 19467 - RNA, 22 nt, Human
ugcauuccagcucccuucuggc

SEQ ID NO: 19468 - RNA, 22 nt, Human
ugcauucugaacguaaauguga

SEQ ID NO: 19469 - RNA, 22 nt, Human
ugcauuugcaauggguacacaa

SEQ ID NO: 19470 - RNA, 22 nt, Human
ugcauuuucuaccacacccacu

SEQ ID NO: 19471 - RNA, 22 nt, Human
ugcauuuuuaauuuggaaaaaa

SEQ ID NO: 19472 - RNA, 20 nt, Human
ugccagagagcucauacccu

SEQ ID NO: 19473 - RNA, 22 nt, Human
ugccagauuaugucuccagggc

SEQ ID NO: 19474 - RNA, 22 nt, Human
ugccaguaauuguccuguagcu

SEQ ID NO: 19475 - RNA, 22 nt, Human
ugccagugugccuuccgcucac

SEQ ID NO: 19476 - RNA, 22 nt, Human
ugccauagaaguccaacccaau

SEQ ID NO: 19477 - RNA, 22 nt, Human
ugccauagccacugaggugagu

SEQ ID NO: 19478 - RNA, 22 nt, Human
ugccauauuuugaggauguaca

SEQ ID NO: 19479 - RNA, 22 nt, Human
ugccaucaugucagauuuggga

SEQ ID NO: 19480 - RNA, 22 nt, Human
ugccaucuuugccccuauuuua

SEQ ID NO: 19481 - RNA, 22 nt, Human
ugccauuggucuuaaggcuagc

SEQ ID NO: 19482 - RNA, 22 nt, Human
ugcccaaucaauuguagcuauu

SEQ ID NO: 19483 - RNA, 18 nt, Human
ugcccaccagaagaggga

SEQ ID NO: 19484 - RNA, 22 nt, Human
ugcccacuucaaaaucuucauu

SEQ ID NO: 19485 - RNA, 22 nt, Human
ugcccacuuugucuccaugcug

SEQ ID NO: 19486 - RNA, 22 nt, Human
ugcccccggcugcccaggggaa

SEQ ID NO: 19487 - RNA, 22 nt, Human
ugccccuggaggagagcaaugg

SEQ ID NO: 19488 - RNA, 19 nt, Human
ugccccuucuucauccauc

SEQ ID NO: 19489 - RNA, 22 nt, Human
ugcccugucccuagguuugugg

SEQ ID NO: 19490 - RNA, 22 nt, Human
ugcccuuucuccagugaccauu

SEQ ID NO: 19491 - RNA, 22 nt, Human
ugccgcaggaggggcgauuucu

SEQ ID NO: 19492 - RNA, 22 nt, Human
ugccuaguuuaaaucauuuucu

SEQ ID NO: 19493 - RNA, 22 nt, Human
ugccucuccaagcuuccuaagg

SEQ ID NO: 19494 - RNA, 20 nt, Human
ugccugagcgcagcuccagg

SEQ ID NO: 19495 - RNA, 22 nt, Human
ugccuggacgacaucacaguga

SEQ ID NO: 19496 - RNA, 21 nt, Human
ugccuggccuuugcuuuuccu

SEQ ID NO: 19497 - RNA, 22 nt, Human
ugccugucuaucuuugucaucu

SEQ ID NO: 19498 - RNA, 22 nt, Human
ugcgccaggacacccguggcgg

SEQ ID NO: 19499 - RNA, 22 nt, Human
ugcgcgccgacggcuccgugac

SEQ ID NO: 19500 - RNA, 22 nt, Human
ugcggcucaaagggaaggccuu

SEQ ID NO: 19501 - RNA, 22 nt, Human
ugcggugcgcccgggcgagugc

SEQ ID NO: 19502 - RNA, 22 nt, Human
ugcgucccagcauguagggcag

SEQ ID NO: 19503 - RNA, 22 nt, Human
ugcguugaggaccgcgagggcg

SEQ ID NO: 19504 - RNA, 22 nt, Human
ugcguuuaguuucaagacacgu

SEQ ID NO: 19505 - RNA, 23 nt, Human
ugcuaaaggcagaauauucaccu

SEQ ID NO: 19506 - RNA, 22 nt, Human
ugcuaaguacauuccaggacuu

SEQ ID NO: 19507 - RNA, 21 nt, Human
ugcuaagugucacaugucugc

SEQ ID NO: 19508 - RNA, 22 nt, Human
ugcuaaugaauggaggaucuga

SEQ ID NO: 19509 - RNA, 22 nt, Human
ugcuaaugagugcugugugaag

SEQ ID NO: 19510 - RNA, 22 nt, Human
ugcuagccacuauuguaaguau

SEQ ID NO: 19511 - RNA, 22 nt, Human
ugcuagggcaggaggugaggag

SEQ ID NO: 19512 - RNA, 22 nt, Human
ugcuauccagacacauaugauc

SEQ ID NO: 19513 - RNA, 20 nt, Human
ugcuaucugcucucccuucu

SEQ ID NO: 19514 - RNA, 22 nt, Human
ugcuauuaagagaaagugaaca

SEQ ID NO: 19515 - RNA, 22 nt, Human
ugcucacugcuuguguucaguu

SEQ ID NO: 19516 - RNA, 20 nt, Human
ugcuccaggaacacuggccg

SEQ ID NO: 19517 - RNA, 22 nt, Human
ugcuccucugcaugucugcggc

SEQ ID NO: 19518 - RNA, 22 nt, Human
ugcucgauuauuucauuuugca

SEQ ID NO: 19519 - RNA, 23 nt, Human
ugcucgccuucaggacuugggcu

SEQ ID NO: 19520 - RNA, 22 nt, Human
ugcucgggcuccuuugagugag

SEQ ID NO: 19521 - RNA, 22 nt, Human
ugcucuguucaguguaucuugu

SEQ ID NO: 19522 - RNA, 22 nt, Human
ugcucuuucaggcauagaccuu

SEQ ID NO: 19523 - RNA, 22 nt, Human
ugcugaccggccuccccccagc

SEQ ID NO: 19524 - RNA, 22 nt, Human
ugcugcacccuucauuuuccca

SEQ ID NO: 19525 - RNA, 22 nt, Human
ugcugcacucacaggaagaguu

SEQ ID NO: 19526 - RNA, 22 nt, Human
ugcugcacuuauggcucugagg

SEQ ID NO: 19527 - RNA, 19 nt, Human
ugcugcaggaauucucaag

SEQ ID NO: 19528 - RNA, 22 nt, Human
ugcugccgccgccaccgccgcc

SEQ ID NO: 19529 - RNA, 22 nt, Human
ugcugccucccaucccucccga

SEQ ID NO: 19530 - RNA, 22 nt, Human
ugcugccucugaauggagcagu

SEQ ID NO: 19531 - RNA, 22 nt, Human
ugcugcggauauacaggaucug

SEQ ID NO: 19532 - RNA, 22 nt, Human
ugcugcucuucaccauggccuc

SEQ ID NO: 19533 - RNA, 23 nt, Human
ugcugcuggaguaucuacaaugc

SEQ ID NO: 19534 - RNA, 22 nt, Human
ugcuggagccauguuuucucua

SEQ ID NO: 19535 - RNA, 22 nt, Human
ugcuggagucucuugacccugg

SEQ ID NO: 19536 - RNA, 22 nt, Human
ugcuggaguggcacuguguggc

SEQ ID NO: 19537 - RNA, 22 nt, Human
ugcuggugauuaaauccugaag

SEQ ID NO: 19538 - RNA, 20 nt, Human
ugcuguggguaagcuuuaua

SEQ ID NO: 19539 - RNA, 22 nt, Human
ugcuuaaccagccccuucccuu

SEQ ID NO: 19540 - RNA, 22 nt, Human
ugcuucucacuucuugguuucc

SEQ ID NO: 19541 - RNA, 22 nt, Human
ugcuucuuugggggugaagaga

SEQ ID NO: 19542 - RNA, 22 nt, Human
ugcuugacucagcaucggcaau

SEQ ID NO: 19543 - RNA, 22 nt, Human
ugcuugaggcuugucaucuaac

SEQ ID NO: 19544 - RNA, 22 nt, Human
ugcuugcuaucuaaguguuuca

SEQ ID NO: 19545 - RNA, 22 nt, Human
ugcuuggagaaucagucccagc

SEQ ID NO: 19546 - RNA, 22 nt, Human
ugcuuggauuuccaaaugguuu

SEQ ID NO: 19547 - RNA, 22 nt, Human
ugcuugggucuguuuugcaaag

SEQ ID NO: 19548 - RNA, 22 nt, Human
ugcuuuaccuuccauuuaagga

SEQ ID NO: 19549 - RNA, 22 nt, Human
ugcuuuauucgacaucugguag

SEQ ID NO: 19550 - RNA, 22 nt, Human
ugcuuucaaaacucagaggaau

SEQ ID NO: 19551 - RNA, 22 nt, Human
ugcuuuccuucccuauguugag

SEQ ID NO: 19552 - RNA, 23 nt, Human
ugcuuugauuauuauucccaccu

SEQ ID NO: 19553 - RNA, 22 nt, Human
ugcuuuuguaucagaguauuca

SEQ ID NO: 19554 - RNA, 21 nt, Human
ugcuuuuguugucagcugcug

SEQ ID NO: 19555 - RNA, 22 nt, Human
uggaaaacgcaguuuaauuuuu

SEQ ID NO: 19556 - RNA, 22 nt, Human
uggaaaagaugucuuccugaau

SEQ ID NO: 19557 - RNA, 22 nt, Human
uggaaagauuuaaaauaacgag

SEQ ID NO: 19558 - RNA, 20 nt, Human
uggagggaggaggggcccaa

SEQ ID NO: 19559 - RNA, 22 nt, Human
uggaguaauggguguuuuugaa

SEQ ID NO: 19560 - RNA, 22 nt, Human
uggaguagaagggcuccuggaa

SEQ ID NO: 19561 - RNA, 22 nt, Human
uggagucagaaugcgacaggcc

SEQ ID NO: 19562 - RNA, 22 nt, Human
uggagucucacuuccuggaauu

SEQ ID NO: 19563 - RNA, 22 nt, Human
uggaguuuauuugaauucuugg

SEQ ID NO: 19564 - RNA, 22 nt, Human
uggaguuuuaaucuguacagaa

SEQ ID NO: 19565 - RNA, 22 nt, Human
uggauauagcugaggugucuug

SEQ ID NO: 19566 - RNA, 22 nt, Human
uggauaugaaacaaaacaagag

SEQ ID NO: 19567 - RNA, 20 nt, Human
uggaucaccauccuguugcu

SEQ ID NO: 19568 - RNA, 22 nt, Human
uggaucaugcgaggccuccccu

SEQ ID NO: 19569 - RNA, 20 nt, Human
uggaugacuucaggcagccu

SEQ ID NO: 19570 - RNA, 22 nt, Human
uggaugagugaauggauaaauc

SEQ ID NO: 19571 - RNA, 22 nt, Human
uggauucucuguagccugguuc

SEQ ID NO: 19572 - RNA, 22 nt, Human
uggauuguauugauugguuggc

SEQ ID NO: 19573 - RNA, 22 nt, Human
uggauuguuuacaucaugucug

SEQ ID NO: 19574 - RNA, 15 nt, Human
uggauuugccacaua

SEQ ID NO: 19575 - RNA, 22 nt, Human
uggauuuuggaauguuucagua

SEQ ID NO: 19576 - RNA, 22 nt, Human
uggcaaaaccugcaauuacuuu

SEQ ID NO: 19577 - RNA, 23 nt, Human
uggcaaacgggaauaaaggaauu

SEQ ID NO: 19578 - RNA, 22 nt, Human
uggcaagcuguuggcagauagc

SEQ ID NO: 19579 - RNA, 22 nt, Human
uggcagaaugaagacuggggcc

SEQ ID NO: 19580 - RNA, 22 nt, Human
uggcagccucugguccuuaguu

SEQ ID NO: 19581 - RNA, 22 nt, Human
uggcagccugcgugaaggagcu

SEQ ID NO: 19582 - RNA, 22 nt, Human
uggcagcucauuuggaaaugga

SEQ ID NO: 19583 - RNA, 22 nt, Human
uggcaggggaaaagggguggga

SEQ ID NO: 19584 - RNA, 22 nt, Human
uggcaguaaagcuggaaaagug

SEQ ID NO: 19585 - RNA, 22 nt, Human
uggcagugggaagcuggaaguc

SEQ ID NO: 19586 - RNA, 22 nt, Human
uggcaucucggugcugguucuu

SEQ ID NO: 19587 - RNA, 20 nt, Human
uggcaugaaauuuuccaagc

SEQ ID NO: 19588 - RNA, 20 nt, Human
uggcaugcucucuuuuuagg

SEQ ID NO: 19589 - RNA, 18 nt, Human
uggcaugcuuugauacau

SEQ ID NO: 19590 - RNA, 22 nt, Human
uggcaugugaauuguuacauug

SEQ ID NO: 19591 - RNA, 21 nt, Human
uggccaaggaauagaagcucu

SEQ ID NO: 19592 - RNA, 22 nt, Human
uggccagucuuagcugugccug

SEQ ID NO: 19593 - RNA, 22 nt, Human
uggccaugagaaucuuugcugu

SEQ ID NO: 19594 - RNA, 22 nt, Human
uggccauuuacucuguaagagu

SEQ ID NO: 19595 - RNA, 22 nt, Human
uggcccaagggaggcuuggccu

SEQ ID NO: 19596 - RNA, 22 nt, Human
uggcccagaucucugaccuuga

SEQ ID NO: 19597 - RNA, 20 nt, Human
uggcccagcacgacgaggac

SEQ ID NO: 19598 - RNA, 21 nt, Human
uggcccgagccgggguuggcu

SEQ ID NO: 19599 - RNA, 22 nt, Human
uggcccugaaucaaggccagca

SEQ ID NO: 19600 - RNA, 20 nt, Human
uggccgacccugaggaguug

SEQ ID NO: 19601 - RNA, 22 nt, Human
uggccgaugagcaugcgcugau

SEQ ID NO: 19602 - RNA, 23 nt, Human
uggccguccccugacucucuggc

SEQ ID NO: 19603 - RNA, 22 nt, Human
uggccucuuucuucccuuugac

SEQ ID NO: 19604 - RNA, 22 nt, Human
uggccugauuuugcuaagagaa

SEQ ID NO: 19605 - RNA, 22 nt, Human
uggccuucagcucuggggugca

SEQ ID NO: 19606 - RNA, 22 nt, Human
uggcgacuggaauuaaucuuuu

SEQ ID NO: 19607 - RNA, 22 nt, Human
uggcgcgcagccugcuggugcu

SEQ ID NO: 19608 - RNA, 22 nt, Human
uggcggcggggagguaggcaga

SEQ ID NO: 19609 - RNA, 22 nt, Human
uggcggcuggacuggggggcca

SEQ ID NO: 19610 - RNA, 18 nt, Human
uggcuagaagagcucuca

SEQ ID NO: 19611 - RNA, 22 nt, Human
uggcucaguaaucgagucuccu

SEQ ID NO: 19612 - RNA, 22 nt, Human
uggcucuucucaagcauuggcu

SEQ ID NO: 19613 - RNA, 22 nt, Human
uggcugaggcuuuucuuaaaga

SEQ ID NO: 19614 - RNA, 22 nt, Human
uggcuguuggagcuggaagaug

SEQ ID NO: 19615 - RNA, 22 nt, Human
uggcuucagacuucugcuacgu

SEQ ID NO: 19616 - RNA, 16 nt, Human
uggcuuccaguucucu

SEQ ID NO: 19617 - RNA, 22 nt, Human
uggcuucuggccaggcacagga

SEQ ID NO: 19618 - RNA, 22 nt, Human
uggcuuuugaaaaggugaugua

SEQ ID NO: 19619 - RNA, 22 nt, Human
ugggaaaauagcuauuuugaaa

SEQ ID NO: 19620 - RNA, 22 nt, Human
ugggaaaauugugauucuuucu

SEQ ID NO: 19621 - RNA, 22 nt, Human
ugggaacuggaaaaaaugaagu

SEQ ID NO: 19622 - RNA, 22 nt, Human
ugggaagaggaggcagggggca

SEQ ID NO: 19623 - RNA, 22 nt, Human
ugggaagccaguaucagacuaa

SEQ ID NO: 19624 - RNA, 22 nt, Human
ugggaagcugagccucgaugug

SEQ ID NO: 19625 - RNA, 22 nt, Human
ugggaauuuaugagaaaauaua

SEQ ID NO: 19626 - RNA, 22 nt, Human
ugggagagaaauuuaaguuuuu

SEQ ID NO: 19627 - RNA, 22 nt, Human
ugggagagaagcugaggcaggg

SEQ ID NO: 19628 - RNA, 22 nt, Human
ugggagccuuccacugggggaa

SEQ ID NO: 19629 - RNA, 22 nt, Human
ugggaggcugugggaauggguc

SEQ ID NO: 19630 - RNA, 22 nt, Human
uggguguguccauauuuugacu

SEQ ID NO: 19631 - RNA, 22 nt, Human
uggguguuccuggggugcaagg

SEQ ID NO: 19632 - RNA, 22 nt, Human
uggguuaaaaguugaaugaauu

SEQ ID NO: 19633 - RNA, 22 nt, Human
uggguuaaaguuugucacugac

SEQ ID NO: 19634 - RNA, 22 nt, Human
uggguuuauuguauuucccuua

SEQ ID NO: 19635 - RNA, 23 nt, Human
uggguuucagugccaaugcugcc

SEQ ID NO: 19636 - RNA, 22 nt, Human
ugguaaaguguacugaauauga

SEQ ID NO: 19637 - RNA, 22 nt, Human
ugguaaaugucuaacaaucacu

SEQ ID NO: 19638 - RNA, 22 nt, Human
ugguaacgguuuccuugccauu

SEQ ID NO: 19639 - RNA, 22 nt, Human
ugguacaaaaaagauuuuggac

SEQ ID NO: 19640 - RNA, 22 nt, Human
ugguagacaacagcagugggac

SEQ ID NO: 19641 - RNA, 22 nt, Human
ugguauaaaaauuugugaaugu

SEQ ID NO: 19642 - RNA, 22 nt, Human
uggucaaauccuagauccuuug

SEQ ID NO: 19643 - RNA, 22 nt, Human
uggucaagcaaugaauuuauuu

SEQ ID NO: 19644 - RNA, 22 nt, Human
uggucacacugcauaacacgca

SEQ ID NO: 19645 - RNA, 22 nt, Human
uggucacagauuuacaggaaug

SEQ ID NO: 19646 - RNA, 22 nt, Human
ugguccaaaccagugcuguggu

SEQ ID NO: 19647 - RNA, 21 nt, Human
ugguccaaggacucauaccug

SEQ ID NO: 19648 - RNA, 22 nt, Human
ugguccaugcuccaggcacauu

SEQ ID NO: 19649 - RNA, 22 nt, Human
uggucccugaagagagaccuug

SEQ ID NO: 19650 - RNA, 22 nt, Human
ugguccgagaacuguccugguu

SEQ ID NO: 19651 - RNA, 22 nt, Human
ugguccucacccuacccagcug

SEQ ID NO: 19652 - RNA, 22 nt, Human
uggucucaaagcaaggaaggaa

SEQ ID NO: 19653 - RNA, 22 nt, Human
uggucuccucuuaauugccuac

SEQ ID NO: 19654 - RNA, 22 nt, Human
uggucugauggucccaccaccg

SEQ ID NO: 19655 - RNA, 22 nt, Human
uggucugggaagaucacaauua

SEQ ID NO: 19656 - RNA, 23 nt, Human
uggugcagcgcaggccggguggc

SEQ ID NO: 19657 - RNA, 22 nt, Human
uggugcucucgauauauaaggc

SEQ ID NO: 19658 - RNA, 22 nt, Human
uggugcucuugauauauaaggc

SEQ ID NO: 19659 - RNA, 22 nt, Human
uggugcuuuuguggaugcuaac

SEQ ID NO: 19660 - RNA, 22 nt, Human
ugguggccucaguggcuucugu

SEQ ID NO: 19661 - RNA, 22 nt, Human
ugguggcuuuucguagguucac

SEQ ID NO: 19662 - RNA, 22 nt, Human
uggugguaggggugguuucuga

SEQ ID NO: 19663 - RNA, 21 nt, Human
ugguguacauuuccauaguuu

SEQ ID NO: 19664 - RNA, 22 nt, Human
ugguguccccugaguuucuauc

SEQ ID NO: 19665 - RNA, 23 nt, Human
uggugugaggaaggaagacuuua

SEQ ID NO: 19666 - RNA, 22 nt, Human
ugguuauggaacuggcuauggc

SEQ ID NO: 19667 - RNA, 22 nt, Human
ugguucggcuguaaguauaucu

SEQ ID NO: 19668 - RNA, 22 nt, Human
ugguucuagaugagaugaugag

SEQ ID NO: 19669 - RNA, 22 nt, Human
ugguucugucugugcugggggg

SEQ ID NO: 19670 - RNA, 17 nt, Human
ugguucuuuuccugacc

SEQ ID NO: 19671 - RNA, 22 nt, Human
ugguugauuaauuuugccaagc

SEQ ID NO: 19672 - RNA, 22 nt, Human
ugguugcaguggugcuuauaca

SEQ ID NO: 19673 - RNA, 22 nt, Human
ugguugugcucuguuugaaagu

SEQ ID NO: 19674 - RNA, 22 nt, Human
ugguugugcuucuuugccucag

SEQ ID NO: 19675 - RNA, 22 nt, Human
ugguuucagacagacucgaacu

SEQ ID NO: 19676 - RNA, 15 nt, Human
ugguuucagaugaug

SEQ ID NO: 19677 - RNA, 22 nt, Human
ugguuuccugauggacacuugg

SEQ ID NO: 19678 - RNA, 22 nt, Human
ugguuuguauauguuugugaga

SEQ ID NO: 19679 - RNA, 22 nt, Human
ugguuuuuuguaggauaaacau

SEQ ID NO: 19680 - RNA, 22 nt, Human
uguaaacuuuugcauacugcuu

SEQ ID NO: 19681 - RNA, 22 nt, Human
uguaaagaaagacgcagaguua

SEQ ID NO: 19682 - RNA, 22 nt, Human
uguaaagguuuuagagcagaga

SEQ ID NO: 19683 - RNA, 22 nt, Human
uguaaagugguauuuaauuuua

SEQ ID NO: 19684 - RNA, 22 nt, Human
uguaaaguuuccuauugcccua

SEQ ID NO: 19685 - RNA, 22 nt, Human
uguaaauucuauacacuuaaaa

SEQ ID NO: 19686 - RNA, 22 nt, Human
uguaagaagaaaaccguaugga

SEQ ID NO: 19687 - RNA, 22 nt, Human
uguaaucaugguagaggcaaag

SEQ ID NO: 19688 - RNA, 22 nt, Human
uguaauucuaauccagagcugg

SEQ ID NO: 19689 - RNA, 22 nt, Human
uguacagauaucaggagugagg

SEQ ID NO: 19690 - RNA, 17 nt, Human
uguaccgaguguguaua

SEQ ID NO: 19691 - RNA, 22 nt, Human
uguaccucagauuauugaucuc

SEQ ID NO: 19692 - RNA, 22 nt, Human
uguacuacaugauuauugacca

SEQ ID NO: 19693 - RNA, 20 nt, Human
uguacuauaaaagguugagu

SEQ ID NO: 19694 - RNA, 22 nt, Human
uguacuguuuucuaggcaaaaa

SEQ ID NO: 19695 - RNA, 22 nt, Human
uguacuuguaauaucagugaaa

SEQ ID NO: 19696 - RNA, 22 nt, Human
uguagaaguuaauugaugagua

SEQ ID NO: 19697 - RNA, 22 nt, Human
uguagacaugcuuuucugauga

SEQ ID NO: 19698 - RNA, 22 nt, Human
uguagaccuuugaaugggaaau

SEQ ID NO: 19699 - RNA, 20 nt, Human
uguagacuagcggggaaaua

SEQ ID NO: 19700 - RNA, 22 nt, Human
ugucguaaaagggccgcagugg

SEQ ID NO: 19701 - RNA, 22 nt, Human
ugucuaaggaaaaagucuauuu

SEQ ID NO: 19702 - RNA, 22 nt, Human
ugucucuagggcagauagagug

SEQ ID NO: 19703 - RNA, 16 nt, Human
ugucucuucccaguuc

SEQ ID NO: 19704 - RNA, 21 nt, Human
ugucugcaauuccagggaacc

SEQ ID NO: 19705 - RNA, 22 nt, Human
ugucuguauuugaggacauugu

SEQ ID NO: 19706 - RNA, 22 nt, Human
ugucuuaaaauuuuagggcuau

SEQ ID NO: 19707 - RNA, 22 nt, Human
ugucuuaugcugcauagacuau

SEQ ID NO: 19708 - RNA, 22 nt, Human
ugucuucagguuccucaccacu

SEQ ID NO: 19709 - RNA, 22 nt, Human
ugucuucauuccccaugaaguc

SEQ ID NO: 19710 - RNA, 22 nt, Human
ugucuucuuuucccuuagcccu

SEQ ID NO: 19711 - RNA, 22 nt, Human
ugucuuguaaacaagaggggcu

SEQ ID NO: 19712 - RNA, 22 nt, Human
ugucuuucuuucucuugacaga

SEQ ID NO: 19713 - RNA, 17 nt, Human
ugucuuuuuccuccucc

SEQ ID NO: 19714 - RNA, 22 nt, Human
ugugaagaauuaaugugaauca

SEQ ID NO: 19715 - RNA, 22 nt, Human
ugugaagcgugugcaggggaca

SEQ ID NO: 19716 - RNA, 22 nt, Human
ugugaaggaaaguaggagggac

SEQ ID NO: 19717 - RNA, 22 nt, Human
ugugaagugaugggugaccgag

SEQ ID NO: 19718 - RNA, 23 nt, Human
ugugaauggccuucuuuagaggu

SEQ ID NO: 19719 - RNA, 22 nt, Human
ugugacugaaaaugauugagug

SEQ ID NO: 19720 - RNA, 22 nt, Human
ugugagauuuuauuugauaugc

SEQ ID NO: 19721 - RNA, 22 nt, Human
ugugagccuuuauuaaccucau

SEQ ID NO: 19722 - RNA, 22 nt, Human
ugugagcugccacuucuaaucu

SEQ ID NO: 19723 - RNA, 22 nt, Human
ugugauaaaggcccgcagaucc

SEQ ID NO: 19724 - RNA, 22 nt, Human
ugugauaauauuauuagagcuc

SEQ ID NO: 19725 - RNA, 22 nt, Human
ugugaugagaugaacuguagac

SEQ ID NO: 19726 - RNA, 22 nt, Human
ugugauugcauugcagauuacu

SEQ ID NO: 19727 - RNA, 22 nt, Human
ugugauugucuucugaaaguca

SEQ ID NO: 19728 - RNA, 22 nt, Human
ugugcagaaaacacuuaagaac

SEQ ID NO: 19729 - RNA, 22 nt, Human
ugugcaguauugaaauauaugu

SEQ ID NO: 19730 - RNA, 22 nt, Human
ugugccuguugguguagacaua

SEQ ID NO: 19731 - RNA, 22 nt, Human
ugugccuucuucauuuaauuua

SEQ ID NO: 19732 - RNA, 22 nt, Human
ugugcgcgugugcuuugugugu

SEQ ID NO: 19733 - RNA, 22 nt, Human
ugugcgucuguguacagaugug

SEQ ID NO: 19734 - RNA, 22 nt, Human
ugugcuugucguggagccaggc

SEQ ID NO: 19735 - RNA, 22 nt, Human
uguggacauuccaaaaggacca

SEQ ID NO: 19736 - RNA, 22 nt, Human
uguggauauauuuuaaaaggaa

SEQ ID NO: 19737 - RNA, 22 nt, Human
uguggccaccagagcugcuauu

SEQ ID NO: 19738 - RNA, 22 nt, Human
uguggcucugaugucauaaagg

SEQ ID NO: 19739 - RNA, 22 nt, Human
uguggcuuaggugagcauguga

SEQ ID NO: 19740 - RNA, 22 nt, Human
ugugggaucauggaucagggcc

SEQ ID NO: 19741 - RNA, 22 nt, Human
ugugggaucguaaauuugggac

SEQ ID NO: 19742 - RNA, 22 nt, Human
uguggucuccucucugucuucc

SEQ ID NO: 19743 - RNA, 22 nt, Human
uguggugcagcgggaacagcuu

SEQ ID NO: 19744 - RNA, 22 nt, Human
ugugguuuguaagcaaagcaaa

SEQ ID NO: 19745 - RNA, 17 nt, Human
uguguaaguugcauaga

SEQ ID NO: 19746 - RNA, 19 nt, Human
uguguaccuaauguuugug

SEQ ID NO: 19747 - RNA, 21 nt, Human
uguguaccuucuuccgagcuc

SEQ ID NO: 19748 - RNA, 22 nt, Human
uguguagagcaugggguugugg

SEQ ID NO: 19749 - RNA, 22 nt, Human
uguguauguauguauguaugua

SEQ ID NO: 19750 - RNA, 22 nt, Human
ugugucgccaacaauugugucu

SEQ ID NO: 19751 - RNA, 22 nt, Human
ugugucuccacugugcuauuuu

SEQ ID NO: 19752 - RNA, 22 nt, Human
ugugucucucuuagguugucug

SEQ ID NO: 19753 - RNA, 22 nt, Human
ugugucuuuggcgaugucugga

SEQ ID NO: 19754 - RNA, 22 nt, Human
ugugugcacguacauacuguau

SEQ ID NO: 19755 - RNA, 22 nt, Human
ugugugcuaguuuugucaguau

SEQ ID NO: 19756 - RNA, 22 nt, Human
uguguggaggugggugaugucu

SEQ ID NO: 19757 - RNA, 22 nt, Human
ugugugguaaugagagauccaa

SEQ ID NO: 19758 - RNA, 22 nt, Human
uguguguauauauauguaucau

SEQ ID NO: 19759 - RNA, 22 nt, Human
uguguguauauauggaauauug

SEQ ID NO: 19760 - RNA, 22 nt, Human
uguguguauauauuuuuauaug

SEQ ID NO: 19761 - RNA, 22 nt, Human
uguguguaugagcauuuguaug

SEQ ID NO: 19762 - RNA, 22 nt, Human
uguguguguauacauguauaua

SEQ ID NO: 19763 - RNA, 22 nt, Human
uguguguguccucauuugcaga

SEQ ID NO: 19764 - RNA, 22 nt, Human
uguguguguguguguaauauau

SEQ ID NO: 19765 - RNA, 22 nt, Human
ugugugugugugugugugugug

SEQ ID NO: 19766 - RNA, 23 nt, Human
ugugugugugugugugugugugu

SEQ ID NO: 19767 - RNA, 19 nt, Human
uguguguguuuuguuugaa

SEQ ID NO: 19768 - RNA, 22 nt, Human
uucuagcucauggugacagauc

SEQ ID NO: 19769 - RNA, 21 nt, Human
uucuauauugagaauuggcua

SEQ ID NO: 19770 - RNA, 22 nt, Human
uucucagagaaagcuccucaug

SEQ ID NO: 19771 - RNA, 22 nt, Human
uucuccacguucuucucggccu

SEQ ID NO: 19772 - RNA, 22 nt, Human
uucuccccagcuuucaaaauaa

SEQ ID NO: 19773 - RNA, 22 nt, Human
uucuccucuuugucacugcuuu

SEQ ID NO: 19774 - RNA, 22 nt, Human
uucucgaacaaccuacagggug

SEQ ID NO: 19775 - RNA, 22 nt, Human
uucucucacucuuagaucccgc

SEQ ID NO: 19776 - RNA, 20 nt, Human
uucucugcagcaggcggccc

SEQ ID NO: 19777 - RNA, 22 nt, Human
uucucugcgcuccggcccaguu

SEQ ID NO: 19778 - RNA, 22 nt, Human
uucucuggggacugucucuauu

SEQ ID NO: 19779 - RNA, 22 nt, Human
uucugaaacauugcuauuuucc

SEQ ID NO: 19780 - RNA, 22 nt, Human
uucugaaggcaggggcuaucuu

SEQ ID NO: 19781 - RNA, 22 nt, Human
uucugagccacaguaaggaucu

SEQ ID NO: 19782 - RNA, 23 nt, Human
uucugaggucacgguggaccugg

SEQ ID NO: 19783 - RNA, 22 nt, Human
uucugaguguugucaccaugug

SEQ ID NO: 19784 - RNA, 22 nt, Human
uucugaugccuggguugcuucu

SEQ ID NO: 19785 - RNA, 22 nt, Human
uucugcccuugccagacaagua

SEQ ID NO: 19786 - RNA, 18 nt, Human
uucugcggugacagauau

SEQ ID NO: 19787 - RNA, 17 nt, Human
uucugcucaggaacaga

SEQ ID NO: 19788 - RNA, 22 nt, Human
uucugcuuuaaagcucauguuu

SEQ ID NO: 19789 - RNA, 22 nt, Human
uucuggagacccagcaacaggg

SEQ ID NO: 19790 - RNA, 22 nt, Human
uucuggccagggaagagggguc

SEQ ID NO: 19791 - RNA, 22 nt, Human
uucuggggccgugacgaggggc

SEQ ID NO: 19792 - RNA, 19 nt, Human
uucugguacauacugccug

SEQ ID NO: 19793 - RNA, 22 nt, Human
uucuggucucucugaccuagga

SEQ ID NO: 19794 - RNA, 22 nt, Human
uucuggugauuugccucuuuag

SEQ ID NO: 19795 - RNA, 22 nt, Human
uucugucaguguugguggaaau

SEQ ID NO: 19796 - RNA, 22 nt, Human
uucugugcugagaaauagagag

SEQ ID NO: 19797 - RNA, 20 nt, Human
uucuguggcccguuuaagug

SEQ ID NO: 19798 - RNA, 22 nt, Human
uucuguucugcuuucuccaucc

SEQ ID NO: 19799 - RNA, 22 nt, Human
uucuguucuuuguccccuuggu

SEQ ID NO: 19800 - RNA, 22 nt, Human
uucuguuuauaauuugcaguug

SEQ ID NO: 19801 - RNA, 22 nt, Human
uucuguuuuuauucuaucucug

SEQ ID NO: 19802 - RNA, 22 nt, Human
uucuuagauuuuauuucuucug

SEQ ID NO: 19803 - RNA, 22 nt, Human
uucuuaggauuauuuaaaauuc

SEQ ID NO: 19804 - RNA, 22 nt, Human
uucuuauuuuucguaaauccug

SEQ ID NO: 19805 - RNA, 22 nt, Human
uucuucauucccuuacuuccga

SEQ ID NO: 19806 - RNA, 22 nt, Human
uucuucgacuguauaaaaguau

SEQ ID NO: 19807 - RNA, 22 nt, Human
uucuucuucuuccucauccuca

SEQ ID NO: 19808 - RNA, 22 nt, Human
uucuugagaacaaauuccugga

SEQ ID NO: 19809 - RNA, 22 nt, Human
uucuugcuuccggugcuccagg

SEQ ID NO: 19810 - RNA, 22 nt, Human
uucuugcuucucugucugccuc

SEQ ID NO: 19811 - RNA, 22 nt, Human
uucuuggcacagaugagauucu

SEQ ID NO: 19812 - RNA, 22 nt, Human
uucuuguccacagaagagcuca

SEQ ID NO: 19813 - RNA, 22 nt, Human
uucuuucgaacaagagaaguuc

SEQ ID NO: 19814 - RNA, 22 nt, Human
uucuuugcucaccugccgcucc

SEQ ID NO: 19815 - RNA, 21 nt, Human
uucuuugcugcuguuuuugua

SEQ ID NO: 19816 - RNA, 22 nt, Human
uucuuuuaauagagauccugug

SEQ ID NO: 19817 - RNA, 22 nt, Human
uucuuuucuucccuguuuauua

SEQ ID NO: 19818 - RNA, 22 nt, Human
uugaaaaguuuguuacucacau

SEQ ID NO: 19819 - RNA, 20 nt, Human
uugaaagucagggcuccagu

SEQ ID NO: 19820 - RNA, 22 nt, Human
uugaaagucuaagaauagguau

SEQ ID NO: 19821 - RNA, 22 nt, Human
uugaagaagucaaaagcugcag

SEQ ID NO: 19822 - RNA, 22 nt, Human
uugaagccaccacuguaaguca

SEQ ID NO: 19823 - RNA, 22 nt, Human
uugaauaaggcauaaagauacu

SEQ ID NO: 19824 - RNA, 22 nt, Human
uugaauaguuuuggauagcaua

SEQ ID NO: 19825 - RNA, 19 nt, Human
uugaauguuugauagucuc

SEQ ID NO: 19826 - RNA, 22 nt, Human
uugaccauguggcccaggccaa

SEQ ID NO: 19827 - RNA, 22 nt, Human
uugacguccucgauggggaacu

SEQ ID NO: 19828 - RNA, 22 nt, Human
uugacuauacucuggcggaaaa

SEQ ID NO: 19829 - RNA, 22 nt, Human
uugagauggccuuuuuuauacu

SEQ ID NO: 19830 - RNA, 22 nt, Human
uugagauuuggagguaauuccc

SEQ ID NO: 19831 - RNA, 22 nt, Human
uugagcagccauuagcuggggu

SEQ ID NO: 19832 - RNA, 20 nt, Human
uugagccucauggauugucu

SEQ ID NO: 19833 - RNA, 21 nt, Human
uugagcuuuuaguacagacag

SEQ ID NO: 19834 - RNA, 22 nt, Human
uugaguuuacauuguauuagcc

SEQ ID NO: 19835 - RNA, 22 nt, Human
uugaugagucacuuucuguaaa

SEQ ID NO: 19836 - RNA, 20 nt, Human
uugauucacaaaaagcuuag

SEQ ID NO: 19837 - RNA, 22 nt, Human
uugauucauuuguucccauuuu

SEQ ID NO: 19838 - RNA, 22 nt, Human
uugauuccagcguuccaucagc

SEQ ID NO: 19839 - RNA, 22 nt, Human
uugauuggguauaaugacagga

SEQ ID NO: 19840 - RNA, 22 nt, Human
uugauuuggaauuuuuagagcu

SEQ ID NO: 19841 - RNA, 22 nt, Human
uugcaagauaguguauuuuuca

SEQ ID NO: 19842 - RNA, 22 nt, Human
uugcacagaugcacaugguugc

SEQ ID NO: 19843 - RNA, 22 nt, Human
uugcacgucacccuucccaccu

SEQ ID NO: 19844 - RNA, 22 nt, Human
uugcagaauucuucccacucag

SEQ ID NO: 19845 - RNA, 22 nt, Human
uugcagcuguugcaaagucucu

SEQ ID NO: 19846 - RNA, 22 nt, Human
uugcagugucaucuagacgugg

SEQ ID NO: 19847 - RNA, 22 nt, Human
uugcauauguccagccaugcau

SEQ ID NO: 19848 - RNA, 22 nt, Human
uugcaucaaauauguaccacag

SEQ ID NO: 19849 - RNA, 23 nt, Human
uugcauuaauguggaggcacagg

SEQ ID NO: 19850 - RNA, 22 nt, Human
uugcccccuguccuucccugua

SEQ ID NO: 19851 - RNA, 22 nt, Human
uugccuacaaacgaaucuaucu

SEQ ID NO: 19852 - RNA, 22 nt, Human
uugccuagugguagugacuguu

SEQ ID NO: 19853 - RNA, 22 nt, Human
uugccuguuugagagcuguguu

SEQ ID NO: 19854 - RNA, 22 nt, Human
uugcggaucuucauggccucag

SEQ ID NO: 19855 - RNA, 20 nt, Human
uugcggccuaacagccccuu

SEQ ID NO: 19856 - RNA, 22 nt, Human
uugcguaucuacauugccugua

SEQ ID NO: 19857 - RNA, 22 nt, Human
uugcucaugucaccaaagcaca

SEQ ID NO: 19858 - RNA, 18 nt, Human
uugcucucucugggggca

SEQ ID NO: 19859 - RNA, 22 nt, Human
uugcucuuaccauuauguguga

SEQ ID NO: 19860 - RNA, 22 nt, Human
uugcugagcugaaccagccacc

SEQ ID NO: 19861 - RNA, 22 nt, Human
uugcugcgcugaccuccaguga

SEQ ID NO: 19862 - RNA, 21 nt, Human
uugcuggagcaauguaaauca

SEQ ID NO: 19863 - RNA, 22 nt, Human
uugcuggaguagaaaacuuaac

SEQ ID NO: 19864 - RNA, 22 nt, Human
uugcuuaaaucgcuuaaacugg

SEQ ID NO: 19865 - RNA, 22 nt, Human
uugcuuaggccaaauggcgcau

SEQ ID NO: 19866 - RNA, 22 nt, Human
uugcuuucuuuguagguuuucc

SEQ ID NO: 19867 - RNA, 22 nt, Human
uugcuuugcuucuuuaugguca

SEQ ID NO: 19868 - RNA, 22 nt, Human
uugcuuuuugggguuuacuggg

SEQ ID NO: 19869 - RNA, 22 nt, Human
uugcuuuuuuggguuuacuggg

SEQ ID NO: 19870 - RNA, 22 nt, Human
uuggaaaagaaauacucauaua

SEQ ID NO: 19871 - RNA, 22 nt, Human
uuggaaaugcauuuguuauuau

SEQ ID NO: 19872 - RNA, 22 nt, Human
uuggaaauguagaaaagcagau

SEQ ID NO: 19873 - RNA, 22 nt, Human
uuggaagacagccgucuuuauu

SEQ ID NO: 19874 - RNA, 22 nt, Human
uuuacuuguuuugcucuuuucc

SEQ ID NO: 19875 - RNA, 22 nt, Human
uuuagaaugaaugcaagagaau

SEQ ID NO: 19876 - RNA, 22 nt, Human
uuuagagguacaguaggcauga

SEQ ID NO: 19877 - RNA, 22 nt, Human
uuuagaguucuaaggacggguu

SEQ ID NO: 19878 - RNA, 22 nt, Human
uuuagauguucccucuacccug

SEQ ID NO: 19879 - RNA, 22 nt, Human
uuuagcaaggagaaauaauccu

SEQ ID NO: 19880 - RNA, 20 nt, Human
uuuagcacauuguacaaaac

SEQ ID NO: 19881 - RNA, 19 nt, Human
uuuagcuacugugguauua

SEQ ID NO: 19882 - RNA, 22 nt, Human
uuuagcugugugugucgcucca

SEQ ID NO: 19883 - RNA, 22 nt, Human
uuuaggaagaucugaaggaaga

SEQ ID NO: 19884 - RNA, 22 nt, Human
uuuaggauaacuccaguuuucc

SEQ ID NO: 19885 - RNA, 22 nt, Human
uuuagguuguguucuggcaugu

SEQ ID NO: 19886 - RNA, 22 nt, Human
uuuaguauaguaugugcucaaa

SEQ ID NO: 19887 - RNA, 20 nt, Human
uuuagucauuuccuaggaaa

SEQ ID NO: 19888 - RNA, 22 nt, Human
uuuagugaagcuuugcauuuca

SEQ ID NO: 19889 - RNA, 22 nt, Human
uuuauaaacacaagaugggcuc

SEQ ID NO: 19890 - RNA, 22 nt, Human
uuuauaauuguuauguuaccca

SEQ ID NO: 19891 - RNA, 22 nt, Human
uuuaucaucuucugaauuugga

SEQ ID NO: 19892 - RNA, 22 nt, Human
uuuauccacucauccaugccuc

SEQ ID NO: 19893 - RNA, 22 nt, Human
uuuaugucaaaaguaaaaugaa

SEQ ID NO: 19894 - RNA, 22 nt, Human
uuuauguuuguuuuugaaauaa

SEQ ID NO: 19895 - RNA, 22 nt, Human
uuuauucacuuaucaggaacga

SEQ ID NO: 19896 - RNA, 22 nt, Human
uuuauucuuugcuagguuccau

SEQ ID NO: 19897 - RNA, 22 nt, Human
uuuauugaccugaguaucagca

SEQ ID NO: 19898 - RNA, 22 nt, Human
uuuauugcuaugucuugauugu

SEQ ID NO: 19899 - RNA, 22 nt, Human
uuuauuuacuuucgguucugcu

SEQ ID NO: 19900 - RNA, 22 nt, Human
uuuauuugugguaguguaaucu

SEQ ID NO: 19901 - RNA, 22 nt, Human
uuuauuuuccaugucucuaggu

SEQ ID NO: 19902 - RNA, 22 nt, Human
uuucaagccucacugcguuuug

SEQ ID NO: 19903 - RNA, 22 nt, Human
uuucaaguagagggaucgcuag

SEQ ID NO: 19904 - RNA, 22 nt, Human
uuucacauacaguguauaguag

SEQ ID NO: 19905 - RNA, 22 nt, Human
uuucagacugcccauguuugcc

SEQ ID NO: 19906 - RNA, 21 nt, Human
uuucauaggguuaaaggguua

SEQ ID NO: 19907 - RNA, 22 nt, Human
uuucaucccugucagugaaggc

SEQ ID NO: 19908 - RNA, 22 nt, Human
uuucaugauuaacuuagugaau

SEQ ID NO: 19909 - RNA, 22 nt, Human
uuucauguuggauacuguuuca

SEQ ID NO: 19910 - RNA, 22 nt, Human
uuuccaguaaguggcaaggagc

SEQ ID NO: 19911 - RNA, 22 nt, Human
uuuccaguuguucuagaaagcu

SEQ ID NO: 19912 - RNA, 22 nt, Human
uuuccuaggaaaugauugaagu

SEQ ID NO: 19913 - RNA, 22 nt, Human
uuuccugacuucaccuuuuacc

SEQ ID NO: 19914 - RNA, 22 nt, Human
uuuccugcagacaguuuaagca

SEQ ID NO: 19915 - RNA, 22 nt, Human
uuuccuuaauuguaaaauggag

SEQ ID NO: 19916 - RNA, 22 nt, Human
uuucgggauuucaaagagcaaa

SEQ ID NO: 19917 - RNA, 22 nt, Human
uuucuaaaaccagaguuuauaa

SEQ ID NO: 19918 - RNA, 22 nt, Human
uuucuaacacccuccuuccaga

SEQ ID NO: 19919 - RNA, 22 nt, Human
uuucuacacuucgugguguuuu

SEQ ID NO: 19920 - RNA, 22 nt, Human
uuucuaguauauaacuagaucu

SEQ ID NO: 19921 - RNA, 22 nt, Human
uuucuauauucaguuucauaaa

SEQ ID NO: 19922 - RNA, 22 nt, Human
uuucuauuuacagugcuaggua

SEQ ID NO: 19923 - RNA, 19 nt, Human
uuucucacugagucguuug

SEQ ID NO: 19924 - RNA, 22 nt, Human
uuucuccauuuuguguguucug

SEQ ID NO: 19925 - RNA, 22 nt, Human
uuucucuccucgaaauucuuau

SEQ ID NO: 19926 - RNA, 22 nt, Human
uuucucugggugaugagguggc

SEQ ID NO: 19927 - RNA, 22 nt, Human
uuucucuuguauuugaaucacu

SEQ ID NO: 19928 - RNA, 22 nt, Human
uuucugagccacauauaauuug

SEQ ID NO: 19929 - RNA, 17 nt, Human
uuucugcaugauuggac

SEQ ID NO: 19930 - RNA, 22 nt, Human
uuucugcauuuguauuggaaaa

SEQ ID NO: 19931 - RNA, 22 nt, Human
uuucugggggucgugcuggcug

SEQ ID NO: 19932 - RNA, 22 nt, Human
uuucugugguggguaguucaga

SEQ ID NO: 19933 - RNA, 22 nt, Human
uuucuguugugaccugacucuu

SEQ ID NO: 19934 - RNA, 22 nt, Human
uuucuuccaucuggcuuuauuu

SEQ ID NO: 19935 - RNA, 22 nt, Human
uuucuuccuucuugaucauuug

SEQ ID NO: 19936 - RNA, 22 nt, Human
uuucuugugauuuugaugaacu

SEQ ID NO: 19937 - RNA, 22 nt, Human
uuucuuugcugguuggcucucc

SEQ ID NO: 19938 - RNA, 22 nt, Human
uuugaaaggagcuuuauccaga

SEQ ID NO: 19939 - RNA, 22 nt, Human
uuugaagaaacagucuuaagag

SEQ ID NO: 19940 - RNA, 22 nt, Human
uuugaagaccuuaucucuaaau

SEQ ID NO: 19941 - RNA, 22 nt, Human
uuugaagauaaauauggagaaa

SEQ ID NO: 19942 - RNA, 23 nt, Human
uuugaaucauuguggggcuuuug

SEQ ID NO: 19943 - RNA, 22 nt, Human
uuugacaccaggagagaaaaca

SEQ ID NO: 19944 - RNA, 22 nt, Human
uuugagaagauaggggaauacu

SEQ ID NO: 19945 - RNA, 22 nt, Human
uuugagaaugucaaucacaaga

SEQ ID NO: 19946 - RNA, 22 nt, Human
uuugagguuuagcucacuauuu

SEQ ID NO: 19947 - RNA, 22 nt, Human
uuugaguaagauguugauacug

SEQ ID NO: 19948 - RNA, 22 nt, Human
uuugauauaaaggcuugggcug

SEQ ID NO: 19949 - RNA, 22 nt, Human
uuugaugagaaaugacuuaagu

SEQ ID NO: 19950 - RNA, 22 nt, Human
uuugauuuuguuuauagugccg

SEQ ID NO: 19951 - RNA, 22 nt, Human
uuugcaggaaauguacugaaug

SEQ ID NO: 19952 - RNA, 22 nt, Human
uuugccaucagaugugguaggu

SEQ ID NO: 19953 - RNA, 19 nt, Human
uuugccugugguucagaag

SEQ ID NO: 19954 - RNA, 22 nt, Human
uuugcugaaaaaccacuugagu

SEQ ID NO: 19955 - RNA, 22 nt, Human
uuugcugggaagccuucacucu

SEQ ID NO: 19956 - RNA, 22 nt, Human
uuugcuuugacuuugggaguau

SEQ ID NO: 19957 - RNA, 22 nt, Human
uuuggcaagcagaugaagguag

SEQ ID NO: 19958 - RNA, 22 nt, Human
uuuggccauuuguaugcaugau

SEQ ID NO: 19959 - RNA, 22 nt, Human
uuuggcgucucucaggagcuca

SEQ ID NO: 19960 - RNA, 22 nt, Human
uuuggcuacucuucauugguga

SEQ ID NO: 19961 - RNA, 22 nt, Human
uuuggcugucauuugaaaaugu

SEQ ID NO: 19962 - RNA, 22 nt, Human
uuugggaaacuuaggggucaga

SEQ ID NO: 19963 - RNA, 23 nt, Human
uuugggaaauagccuauaggcac

SEQ ID NO: 19964 - RNA, 22 nt, Human
uuugggcauuuuuaaggaucuu

SEQ ID NO: 19965 - RNA, 22 nt, Human
uuugggcuuuguuuuaagguau

SEQ ID NO: 19966 - RNA, 22 nt, Human
uuuggggcucauuugcuuuugu

SEQ ID NO: 19967 - RNA, 22 nt, Human
uuugggguuuuuuggugaaauc

SEQ ID NO: 19968 - RNA, 22 nt, Human
uuuggguauuaguuuagcuaga

SEQ ID NO: 19969 - RNA, 22 nt, Human
uuuggguuaguuuuccaaucuu

SEQ ID NO: 19970 - RNA, 22 nt, Human
uuugguaccucucgucacaaug

SEQ ID NO: 19971 - RNA, 19 nt, Human
uuugguaggcuugagggaa

SEQ ID NO: 19972 - RNA, 22 nt, Human
uuuggucaucaaagacaaguaa

SEQ ID NO: 19973 - RNA, 22 nt, Human
uuuggucuggaaucuucagggu

SEQ ID NO: 19974 - RNA, 20 nt, Human
uuugguuggcuaggggaagc

SEQ ID NO: 19975 - RNA, 22 nt, Human
uuuguaguuguggaugcugaag

SEQ ID NO: 19976 - RNA, 22 nt, Human
uuuguauuguuuauuucauuuu

SEQ ID NO: 19977 - RNA, 20 nt, Human
uuugucaacugcauccagca

SEQ ID NO: 19978 - RNA, 23 nt, Human
uuugucaucccucucacuuucug

SEQ ID NO: 19979 - RNA, 22 nt, Human
uuugucaucuuccauauuugca

SEQ ID NO: 19980 - RNA, 22 nt, Human
uuugucauuuagcccauggugg

SEQ ID NO: 19981 - RNA, 22 nt, Human
uuuguccuguuggcaugaaaau

SEQ ID NO: 19982 - RNA, 20 nt, Human
uuugugaggccagagaacag

SEQ ID NO: 19983 - RNA, 22 nt, Human
uuuguggaaaagagcccaggag

SEQ ID NO: 19984 - RNA, 22 nt, Human
uuugugguuuugagagaguugc

SEQ ID NO: 19985 - RNA, 22 nt, Human
uuuguguuuucaggcacauggc

SEQ ID NO: 19986 - RNA, 22 nt, Human
uuuguguuuugaggucuugcaa

SEQ ID NO: 19987 - RNA, 22 nt, Human
uuuguuaggguuucagcuagcc

SEQ ID NO: 19988 - RNA, 22 nt, Human
uuuguuaugguuggaagcagga

SEQ ID NO: 19989 - RNA, 21 nt, Human
uuuguucacacacagggcagc

SEQ ID NO: 19990 - RNA, 22 nt, Human
uuuguucaccuagcaaacuuuu

SEQ ID NO: 19991 - RNA, 22 nt, Human
uuuguugaauggcaggauuuua

SEQ ID NO: 19992 - RNA, 23 nt, Human
uuuguugguuuaagaguagcaga

SEQ ID NO: 19993 - RNA, 19 nt, Human
uuuguuguaucagagcuuu

SEQ ID NO: 19994 - RNA, 22 nt, Human
uuuguuguauuaacccagggua

SEQ ID NO: 19995 - RNA, 22 nt, Human
uuuguugucuucauaauacuuu

SEQ ID NO: 19996 - RNA, 17 nt, Human
uuuguuucauacuucau

SEQ ID NO: 19997 - RNA, 22 nt, Human
uuuguuuccagccuuuugucuu

SEQ ID NO: 19998 - RNA, 22 nt, Human
uuuguuugcuaguauuuuguuu

SEQ ID NO: 19999 - RNA, 22 nt, Human
uuuuaaaagguugcuguuauaa

SEQ ID NO: 20000 - RNA, 22 nt, Human
uuuuaacuuuggguucucuuua

SEQ ID NO: 20001 - RNA, 22 nt, Human
uuuuaaguauuuucuuuuuuua

SEQ ID NO: 20002 - RNA, 22 nt, Human
uuuuaauaguauaucuagacac

SEQ ID NO: 20003 - RNA, 23 nt, Human
uuuuaauaguaugacaugagcug

SEQ ID NO: 20004 - RNA, 22 nt, Human
uuuuaaucagguauuugaguau

SEQ ID NO: 20005 - RNA, 22 nt, Human
uuuuaauccucuugguaucuua

SEQ ID NO: 20006 - RNA, 22 nt, Human
uuuuaauucaacauuugcuuuu

SEQ ID NO: 20007 - RNA, 23 nt, Human
uuuuacaagagugcauuugucuc

SEQ ID NO: 20008 - RNA, 22 nt, Human
uuuuacaaugcaaauucuugcu

SEQ ID NO: 20009 - RNA, 22 nt, Human
uuuuacauuuuauucguuuauu

SEQ ID NO: 20010 - RNA, 22 nt, Human
uuuuacuuuucccacuuacagc

SEQ ID NO: 20011 - RNA, 22 nt, Human
uuuuagagacagcauggagaaa

SEQ ID NO: 20012 - RNA, 22 nt, Human
uuuuagccagaguuuaucacag

SEQ ID NO: 20013 - RNA, 22 nt, Human
uuuuagccagcaucugggucga

SEQ ID NO: 20014 - RNA, 22 nt, Human
uuuuaggauuugaguugcugga

SEQ ID NO: 20015 - RNA, 22 nt, Human
uuuuaguaauacuuuggccuuu

SEQ ID NO: 20016 - RNA, 22 nt, Human
uuuuauaaaaccuguuugaccu

SEQ ID NO: 20017 - RNA, 22 nt, Human
uuuuaucagagcuugcagugug

SEQ ID NO: 20018 - RNA, 22 nt, Human
uuuuaucuuacauggaaucucc

SEQ ID NO: 20019 - RNA, 22 nt, Human
uuuuauuuguauguugaaugua

SEQ ID NO: 20020 - RNA, 19 nt, Human
uuuucaacguccgguucau

SEQ ID NO: 20021 - RNA, 22 nt, Human
uuuucaacuuuauuuuccccca

SEQ ID NO: 20022 - RNA, 22 nt, Human
uuuucaaucaaguuuauuuaua

SEQ ID NO: 20023 - RNA, 22 nt, Human
uuuucaauuuucauuugcaaga

SEQ ID NO: 20024 - RNA, 22 nt, Human
uuuucaguuccaucucugcucu

SEQ ID NO: 20025 - RNA, 23 nt, Human
uuuuccaaaucgacucucuaguu

SEQ ID NO: 20026 - RNA, 22 nt, Human
uuuuccuguccuugggucugca

SEQ ID NO: 20027 - RNA, 22 nt, Human
uuuuccuuaacagagggagaaa

SEQ ID NO: 20028 - RNA, 22 nt, Human
uuuuccuuagaaauacauugau

SEQ ID NO: 20029 - RNA, 22 nt, Human
uuuuccuuccugucucuuuauu

SEQ ID NO: 20030 - RNA, 22 nt, Human
uuuuccuucuuccugccuugcc

SEQ ID NO: 20031 - RNA, 22 nt, Human
uuuuccuugagucggggcacag

SEQ ID NO: 20032 - RNA, 22 nt, Human
uuuucggggcgacuuagguucu

SEQ ID NO: 20033 - RNA, 22 nt, Human
uuuucuacaaaucuggacuuuu

SEQ ID NO: 20034 - RNA, 22 nt, Human
uuuucuacaaucacucuggaag

SEQ ID NO: 20035 - RNA, 22 nt, Human
uuuucuaggcccuggauuaugu

SEQ ID NO: 20036 - RNA, 22 nt, Human
uuuucucacugagagccuugau

SEQ ID NO: 20037 - RNA, 22 nt, Human
uuuucucaguuuuuuucaaaag

SEQ ID NO: 20038 - RNA, 22 nt, Human
uuuucugauccuucuaacuuga

SEQ ID NO: 20039 - RNA, 22 nt, Human
uuuugagucuggcaguuuuguu

SEQ ID NO: 20040 - RNA, 22 nt, Human
uuuugaugaccauucuucuuuu

SEQ ID NO: 20041 - RNA, 22 nt, Human
uuuugcaaauuacuaaauuucu

SEQ ID NO: 20042 - RNA, 22 nt, Human
uuuugcuagaaaucaccaauac

SEQ ID NO: 20043 - RNA, 22 nt, Human
uuuugcuucuaguauauuuuuu

SEQ ID NO: 20044 - RNA, 22 nt, Human
uuuuggagaaaugggacuuaau

SEQ ID NO: 20045 - RNA, 22 nt, Human
uuuugggugcaaauuguuuguu

SEQ ID NO: 20046 - RNA, 22 nt, Human
uuuugguuugaguauuuuuuuu

SEQ ID NO: 20047 - RNA, 22 nt, Human
uuuuguagauagggaaacagag

SEQ ID NO: 20048 - RNA, 22 nt, Human
uuuuguagauuggaaaaucugg

SEQ ID NO: 20049 - RNA, 22 nt, Human
uuuugucagggcaggaggaaga

SEQ ID NO: 20050 - RNA, 22 nt, Human
uuuugucuguggaaagcugcua

SEQ ID NO: 20051 - RNA, 22 nt, Human
uuuuguggacugauccgaggac

SEQ ID NO: 20052 - RNA, 22 nt, Human
uuuuguggacugugagggugca

SEQ ID NO: 20053 - RNA, 21 nt, Human
uuuuguguugcgcacuuugag

SEQ ID NO: 20054 - RNA, 18 nt, Human
uuuuguguuuauucugca

SEQ ID NO: 20055 - RNA, 22 nt, Human
uuuuguuacugauuauuaaaau

SEQ ID NO: 20056 - RNA, 22 nt, Human
uuuuguuuacauuaaauuuuga

SEQ ID NO: 20057 - RNA, 22 nt, Human
uuuuuaaaauuaggacggcacg

SEQ ID NO: 20058 - RNA, 22 nt, Human
uuuuuaagguuuguuuauauau

SEQ ID NO: 20059 - RNA, 22 nt, Human
uuuuuagcuguuauuguggaag

SEQ ID NO: 20060 - RNA, 22 nt, Human
uuuuuagggauuaguguuugag

SEQ ID NO: 20061 - RNA, 22 nt, Human
uuuuuauaagagcagcagaguu

SEQ ID NO: 20062 - RNA, 22 nt, Human
uuuuuauaagauuuaaaaugua

SEQ ID NO: 20063 - RNA, 22 nt, Human
uuuuuauguaaaauauuaaaag

SEQ ID NO: 20064 - RNA, 22 nt, Human
uuuuucacacuccuuuccaguu

SEQ ID NO: 20065 - RNA, 22 nt, Human
uuuuucagacuaauagggcaua

SEQ ID NO: 20066 - RNA, 19 nt, Human
uuuuucccccucuccucag

SEQ ID NO: 20067 - RNA, 22 nt, Human
uuuuucuccauuccaggugccu

SEQ ID NO: 20068 - RNA, 22 nt, Human
uuuuucugacugcuaacaaaaa

SEQ ID NO: 20069 - RNA, 22 nt, Human
uuuuucuuugcuuuccacuggc

SEQ ID NO: 20070 - RNA, 22 nt, Human
uuuuucuuugguaacucuuccu

SEQ ID NO: 20071 - RNA, 22 nt, Human
uuuuuggacccaucuucuuuuu

SEQ ID NO: 20072 - RNA, 21 nt, Human
uuuuuggagggguggggagga

SEQ ID NO: 20073 - RNA, 22 nt, Human
uuuuuguauaugcuucgaggau

SEQ ID NO: 20074 - RNA, 22 nt, Human
uuuuuguggggggcggugugaa

SEQ ID NO: 20075 - RNA, 20 nt, Human
uuuuuuaaauagagcuguug

SEQ ID NO: 20076 - RNA, 22 nt, Human
uuuuuucuggaguuugggguuu

SEQ ID NO: 20077 - RNA, 22 nt, Human
uuuuuuuaaguuuugauuuuag

SEQ ID NO: 20078 - RNA, 22 nt, Human
uuuuuuuagaaagaucauaguu

SEQ ID NO: 20079 - RNA, 22 nt, Human
uuuuuuuuacuccggacagcuc

SEQ ID NO: 20080 - RNA, 22 nt, Leptospira interrogans serovar lai str. 56601
aaacgcgauuuuaaaaggagga

SEQ ID NO: 20081 - RNA, 22 nt, Leptospira interrogans serovar lai str. 56601
aaacucagggcuucuuuguuuc

SEQ ID NO: 20082 - RNA, 22 nt, Leptospira interrogans serovar lai str. 56601
aaagaacugaccccuggaacaa

SEQ ID NO: 20083 - RNA, 22 nt, Leptospira interrogans serovar lai str. 56601
aaagcucaaauuagauuguaaa

SEQ ID NO: 20084 - RNA, 22 nt, Leptospira interrogans serovar lai str. 56601
aaaguuucucccggagguguuc

SEQ ID NO: 20085 - RNA, 22 nt, Leptospira interrogans serovar lai str. 56601
aaaucguuuaucuauguccguc

SEQ ID NO: 20086 - RNA, 22 nt, Leptospira interrogans serovar lai str. 56601
aaauucucuuucgguagaagug

SEQ ID NO: 20087 - RNA, 22 nt, Leptospira interrogans serovar lai str. 56601
aacauucuuuaauuguucugca

SEQ ID NO: 20088 - RNA, 22 nt, Leptospira interrogans serovar lai str. 56601
uguucaaucggauugacuaaau

SEQ ID NO: 20089 - RNA, 22 nt, Leptospira interrogans serovar lai str. 56601
uguuugaaugugagauauuggg

SEQ ID NO: 20090 - RNA, 22 nt, Leptospira interrogans serovar lai str. 56601
uuaaucugugggaacuaccaca

SEQ ID NO: 20091 - RNA, 22 nt, Leptospira interrogans serovar lai str. 56601
uuacaccagugguacaaaucaa

SEQ ID NO: 20092 - RNA, 22 nt, Leptospira interrogans serovar lai str. 56601
uuacagaaaaaucagauuuuac

SEQ ID NO: 20093 - RNA, 22 nt, Leptospira interrogans serovar lai str. 56601
uuacagaagaagauucuucuac

SEQ ID NO: 20094 - RNA, 22 nt, Leptospira interrogans serovar lai str. 56601
uuagaacuuauuuuuccgggac

SEQ ID NO: 20095 - RNA, 23 nt, Leptospira interrogans serovar lai str. 56601
uuagacgacuuggucgaucuucc

SEQ ID NO: 20096 - RNA, 22 nt, Leptospira interrogans serovar lai str. 56601
uuagaugaguugaccgaacucg

SEQ ID NO: 20097 - RNA, 22 nt, Leptospira interrogans serovar lai str. 56601
uuaguggaugguuacguauuua

SEQ ID NO: 20098 - RNA, 22 nt, Leptospira interrogans serovar lai str. 56601
uucaagaaaugagacgcuuuaa

SEQ ID NO: 20099 - RNA, 22 nt, Leptospira interrogans serovar lai str. 56601
uucaagcucuaguagaaaaaau

SEQ ID NO: 20100 - RNA, 22 nt, Leptospira interrogans serovar lai str. 56601
uucagaagaauguguagugggc

SEQ ID NO: 20101 - RNA, 22 nt, Leptospira interrogans serovar lai str. 56601
uucaggauucuaucaauuucua

SEQ ID NO: 20102 - RNA, 22 nt, Leptospira interrogans serovar lai str. 56601
uuccgaguacgauauccugagu

SEQ ID NO: 20103 - RNA, 22 nt, Leptospira interrogans serovar lai str. 56601
uucgaauugaacuaugaagguu

SEQ ID NO: 20104 - RNA, 22 nt, Leptospira interrogans serovar lai str. 56601
uucuaucaguguuuugccuuua

SEQ ID NO: 20105 - RNA, 22 nt, Leptospira interrogans serovar lai str. 56601
uucugguauaggaacuucuuuu

SEQ ID NO: 20106 - RNA, 22 nt, Leptospira interrogans serovar lai str. 56601
uucuuacaaaacuuuguauuga

SEQ ID NO: 20107 - RNA, 22 nt, Leptospira interrogans serovar lai str. 56601
uucuuugagguuuugggcaagc

SEQ ID NO: 20108 - RNA, 22 nt, Leptospira interrogans serovar lai str. 56601
uugaaguuccacgaguuguuuu

SEQ ID NO: 20109 - RNA, 22 nt, Leptospira interrogans serovar lai str. 56601
uugaauuccccuaggaaagaau

SEQ ID NO: 20110 - RNA, 23 nt, Leptospira interrogans serovar lai str. 56601
uugcacauugaaaguacucacuu

SEQ ID NO: 20111 - RNA, 20 nt, Leptospira interrogans serovar lai str. 56601
uugcaguuuuugaaccuucu

SEQ ID NO: 20112 - RNA, 22 nt, Leptospira interrogans serovar lai str. 56601
uugccgaacuuucugcaagcca

SEQ ID NO: 20113 - RNA, 22 nt, Leptospira interrogans serovar lai str. 56601
uugccggaaguuuuauuuacga

SEQ ID NO: 20114 - RNA, 22 nt, Leptospira interrogans serovar lai str. 56601
uuggaaaggaacacaaauggcu

SEQ ID NO: 20115 - RNA, 22 nt, Leptospira interrogans serovar lai str. 56601
uuggaaguagaacucuucaacc

SEQ ID NO: 20116 - RNA, 22 nt, Leptospira interrogans serovar lai str. 56601
uuggaauaaggaucguauguua

SEQ ID NO: 20117 - RNA, 22 nt, Leptospira interrogans serovar lai str. 56601
uugggcaguaguaaaauugaua

SEQ ID NO: 20118 - RNA, 22 nt, Leptospira interrogans serovar lai str. 56601
uugucaagucgucuguaaguuu

SEQ ID NO: 20119 - RNA, 22 nt, Leptospira interrogans serovar lai str. 56601
uuucaugagaauggcuugaagu

SEQ ID NO: 20120 - RNA, 22 nt, Leptospira interrogans serovar lai str. 56601
uuucuaacuuuacucaaucaag

SEQ ID NO: 20121 - RNA, 22 nt, Leptospira interrogans serovar lai str. 56601
uuucuacggagucggccuuuga

SEQ ID NO: 20122 - RNA, 22 nt, Leptospira interrogans serovar lai str. 56601
uuugaacaaaucgguucuucua

SEQ ID NO: 20123 - RNA, 22 nt, Leptospira interrogans serovar lai str. 56601
uuugaagugguucuugaaaagu

SEQ ID NO: 20124 - RNA, 22 nt, Leptospira interrogans serovar lai str. 56601
uuugagaagucuucuaauuuaa

SEQ ID NO: 20125 - RNA, 22 nt, Leptospira interrogans serovar lai str. 56601
uuuguagcccauucuuuuagau

SEQ ID NO: 20126 - RNA, 22 nt, Leptospira interrogans serovar lai str. 56601
aaacgaguuugaaaaggaucgc

SEQ ID NO: 20127 - RNA, 22 nt, Leptospira interrogans serovar lai str. 56601
aaacgcagacaguucucucaga

SEQ ID NO: 20128 - RNA, 22 nt, Leptospira interrogans serovar lai str. 56601
aaacuugaaguguaguaguucc

SEQ ID NO: 20129 - RNA, 22 nt, Leptospira interrogans serovar lai str. 56601
aaacuugcagaauuuacggcua

SEQ ID NO: 20130 - RNA, 22 nt, Leptospira interrogans serovar lai str. 56601
aaagacuuaacccuucggaaga

SEQ ID NO: 20131 - RNA, 22 nt, Leptospira interrogans serovar lai str. 56601
aaagaguugcguccagauaaga

SEQ ID NO: 20132 - RNA, 22 nt, Leptospira interrogans serovar lai str. 56601
aaaguaacugguuuaccuucug

SEQ ID NO: 20133 - RNA, 22 nt, Leptospira interrogans serovar lai str. 56601
aaaucaguuuggaaaucgcuuc

SEQ ID NO: 20134 - RNA, 22 nt, Leptospira interrogans serovar lai str. 56601
aaaugcagccguagaauaaggu

SEQ ID NO: 20135 - RNA, 22 nt, Leptospira interrogans serovar lai str. 56601
aaaugguagaucgacuuagauc

SEQ ID NO: 20136 - RNA, 22 nt, Leptospira interrogans serovar lai str. 56601
aaauucagucugagcuuaacuu

SEQ ID NO: 20137 - RNA, 22 nt, Leptospira interrogans serovar lai str. 56601
aaauuccagauucuucugcaua

SEQ ID NO: 20138 - RNA, 22 nt, Leptospira interrogans serovar lai str. 56601
aacauucuauccaauacgcaaa

SEQ ID NO: 20139 - RNA, 22 nt, Leptospira interrogans serovar lai str. 56601
aacgaucucuuaaaacuucuua

SEQ ID NO: 20140 - RNA, 22 nt, Leptospira interrogans serovar lai str. 56601
aacgucgacuuguuuucaaaau

SEQ ID NO: 20141 - RNA, 22 nt, Leptospira interrogans serovar lai str. 56601
aacgucuaguauaaaagcgauu

SEQ ID NO: 20142 - RNA, 22 nt, Leptospira interrogans serovar lai str. 56601
aacucaguaucucuuuucuaug

SEQ ID NO: 20143 - RNA, 22 nt, Leptospira interrogans serovar lai str. 56601
aacuggaacguuuuacugguaa

SEQ ID NO: 20144 - RNA, 22 nt, Leptospira interrogans serovar lai str. 56601
aagaaacuuacucaagaucgga

SEQ ID NO: 20145 - RNA, 22 nt, Leptospira interrogans serovar lai str. 56601
aagaaaucugaauuugauuugg

SEQ ID NO: 20146 - RNA, 22 nt, Leptospira interrogans serovar lai str. 56601
aagauguagagcguuuuuccag

SEQ ID NO: 20147 - RNA, 22 nt, Leptospira interrogans serovar lai str. 56601
aagcgauuacagauucucugau

SEQ ID NO: 20148 - RNA, 22 nt, Leptospira interrogans serovar lai str. 56601
aaguaugagaacuuuugaaaua

SEQ ID NO: 20149 - RNA, 22 nt, Leptospira interrogans serovar lai str. 56601
aaguucaggauuauauuuuucu

SEQ ID NO: 20150 - RNA, 22 nt, Leptospira interrogans serovar lai str. 56601
aaguucuucagagguuuucccu

SEQ ID NO: 20151 - RNA, 22 nt, Leptospira interrogans serovar lai str. 56601
aaguuuggaauugugggaacuc

SEQ ID NO: 20152 - RNA, 22 nt, Leptospira interrogans serovar lai str. 56601
ggaacuguauaugaaaucgguu

SEQ ID NO: 20153 - RNA, 22 nt, Leptospira interrogans serovar lai str. 56601
ggaauaucgggauguuuggauc

SEQ ID NO: 20154 - RNA, 22 nt, Leptospira interrogans serovar lai str. 56601
ggacguuuggauguuuccaucg

SEQ ID NO: 20155 - RNA, 22 nt, Leptospira interrogans serovar lai str. 56601
ggacucgaugcaauuuuaaaga

SEQ ID NO: 20156 - RNA, 22 nt, Leptospira interrogans serovar lai str. 56601
ggaucaguauugauucucaaga

SEQ ID NO: 20157 - RNA, 22 nt, Leptospira interrogans serovar lai str. 56601
ggauuguaucaaguaagacuaa

SEQ ID NO: 20158 - RNA, 22 nt, Leptospira interrogans serovar lai str. 56601
gggacucugaaauaaauuucua

SEQ ID NO: 20159 - RNA, 22 nt, Leptospira interrogans serovar lai str. 56601
guaggauuuuacgagcuucuug

SEQ ID NO: 20160 - RNA, 22 nt, Leptospira interrogans serovar lai str. 56601
guaguucccacauuuuagaguu

SEQ ID NO: 20161 - RNA, 22 nt, Leptospira interrogans serovar lai str. 56601
gucaaguuauugguauuuuaua

SEQ ID NO: 20162 - RNA, 22 nt, Leptospira interrogans serovar lai str. 56601
gucgauugaaguaguuuuguua

SEQ ID NO: 20163 - RNA, 22 nt, Leptospira interrogans serovar lai str. 56601
gucgucucaaaaauauuguagg

SEQ ID NO: 20164 - RNA, 22 nt, Leptospira interrogans serovar lai str. 56601
guuccuauuucuguuggcucuu

SEQ ID NO: 20165 - RNA, 16 nt, Leptospira interrogans serovar lai str. 56601
guuugacuagcauuga

SEQ ID NO: 20166 - RNA, 22 nt, Leptospira interrogans serovar lai str. 56601
uaaaccgaagugaauuagaaug

SEQ ID NO: 20167 - RNA, 22 nt, Leptospira interrogans serovar lai str. 56601
uaaacguaaguguauccgguag

SEQ ID NO: 20168 - RNA, 22 nt, Leptospira interrogans serovar lai str. 56601
uaacaugaguuugguguaagag

SEQ ID NO: 20169 - RNA, 22 nt, Leptospira interrogans serovar lai str. 56601
uaagacgagaacuuggauuuuu

SEQ ID NO: 20170 - RNA, 22 nt, Leptospira interrogans serovar lai str. 56601
uaaucgaucgucuuguaucugg

SEQ ID NO: 20171 - RNA, 17 nt, Leptospira interrogans serovar lai str. 56601
uacaauccguuucucau

SEQ ID NO: 20172 - RNA, 22 nt, Leptospira interrogans serovar lai str. 56601
uacucagcaaucgcuagagguu

SEQ ID NO: 20173 - RNA, 22 nt, Leptospira interrogans serovar lai str. 56601
uacuucuaaacuugcagacuug

SEQ ID NO: 20174 - RNA, 22 nt, Leptospira interrogans serovar lai str. 56601
uagagguagaaggaggauuuuu

SEQ ID NO: 20175 - RNA, 22 nt, Leptospira interrogans serovar lai str. 56601
uagauggaacuuuuaaucauga

SEQ ID NO: 20176 - RNA, 22 nt, Leptospira interrogans serovar lai str. 56601
uagcuguugaucgauuccuuuu

SEQ ID NO: 20177 - RNA, 22 nt, Leptospira interrogans serovar lai str. 56601
uaggaauucuuagcaaaccguu

SEQ ID NO: 20178 - RNA, 22 nt, Leptospira interrogans serovar lai str. 56601
uauacaguaacccuucaaguaa

SEQ ID NO: 20179 - RNA, 22 nt, Leptospira interrogans serovar lai str. 56601
uauaguuccuguuucguccgua

SEQ ID NO: 20180 - RNA, 22 nt, Leptospira interrogans serovar lai str. 56601
uaucuagauauuugcaaacuuu

SEQ ID NO: 20181 - RNA, 22 nt, Leptospira interrogans serovar lai str. 56601
uaugaagcaaaggauuuauaaa

SEQ ID NO: 20182 - RNA, 22 nt, Leptospira interrogans serovar lai str. 56601
uaugauccgucucuccgaucaa

SEQ ID NO: 20183 - RNA, 22 nt, Leptospira interrogans serovar lai str. 56601
ucaaguuauuguguuuuguagg

SEQ ID NO: 20184 - RNA, 22 nt, Leptospira interrogans serovar lai str. 56601
ucaaguucaaguacuuucugca

SEQ ID NO: 20185 - RNA, 22 nt, Leptospira interrogans serovar lai str. 56601
ucacggaauuuuauuuuaugga

SEQ ID NO: 20186 - RNA, 22 nt, Leptospira interrogans serovar lai str. 56601
uccggaaacgggagaaagaacg

SEQ ID NO: 20187 - RNA, 22 nt, Leptospira interrogans serovar lai str. 56601
uccggaacuacgauuucuucug

SEQ ID NO: 20188 - RNA, 22 nt, Leptospira interrogans serovar lai str. 56601
uccuuuaaaauuaaccacucga

SEQ ID NO: 20189 - RNA, 22 nt, Leptospira interrogans serovar lai str. 56601
ucgaaaggauauucuuuuuccg

SEQ ID NO: 20190 - RNA, 22 nt, Leptospira interrogans serovar lai str. 56601
ucgaaauaucuggaugcgauuu

SEQ ID NO: 20191 - RNA, 22 nt, Leptospira interrogans serovar lai str. 56601
ucgauuguuaagcgaagaggaa

SEQ ID NO: 20192 - RNA, 22 nt, Leptospira interrogans serovar lai str. 56601
ucggagaaauuccagagcucaa

SEQ ID NO: 20193 - RNA, 22 nt, Leptospira interrogans serovar lai str. 56601
ucggauucuucuaaaagucgua

SEQ ID NO: 20194 - RNA, 22 nt, Leptospira interrogans serovar lai str. 56601
ucguauuuuuuaaaguagaucg

SEQ ID NO: 20195 - RNA, 22 nt, Leptospira interrogans serovar lai str. 56601
ucuaaaggucugcauucaggaa

SEQ ID NO: 20196 - RNA, 22 nt, Leptospira interrogans serovar lai str. 56601
ucuaagcuauuuuugagaugau

SEQ ID NO: 20197 - RNA, 22 nt, Leptospira interrogans serovar lai str. 56601
ucuaauuccuccauucaggaag

SEQ ID NO: 20198 - RNA, 22 nt, Leptospira interrogans serovar lai str. 56601
ucuaguuuggauuuauuucaga

SEQ ID NO: 20199 - RNA, 22 nt, Leptospira interrogans serovar lai str. 56601
ucucauaccguuuaucuugcaa

SEQ ID NO: 20200 - RNA, 22 nt, Leptospira interrogans serovar lai str. 56601
ucuccggaauucaaaaaacggu

SEQ ID NO: 20201 - RNA, 22 nt, Leptospira interrogans serovar lai str. 56601
ucuccggagaucaaaguauuuu

SEQ ID NO: 20202 - RNA, 22 nt, Leptospira interrogans serovar lai str. 56601
ucugaaagacgucuaacgucuu

SEQ ID NO: 20203 - RNA, 22 nt, Leptospira interrogans serovar lai str. 56601
ucuguuaaacuuuugugaagau

SEQ ID NO: 20204 - RNA, 22 nt, Leptospira interrogans serovar lai str. 56601
ucuguuuauucuuaaguccuaa

SEQ ID NO: 20205 - RNA, 22 nt, Leptospira interrogans serovar lai str. 56601
ucuuauagaaguauuaggagaa

SEQ ID NO: 20206 - RNA, 22 nt, Leptospira interrogans serovar lai str. 56601
ucuucaauuuuugcuuuaggga

SEQ ID NO: 20207 - RNA, 22 nt, Leptospira interrogans serovar lai str. 56601
ucuucagaaugauuauuugcuu

SEQ ID NO: 20208 - RNA, 22 nt, Leptospira interrogans serovar lai str. 56601
ucuuuguagaucauucugcauu

SEQ ID NO: 20209 - RNA, 22 nt, Leptospira interrogans serovar lai str. 56601
ugaaaucguugucuuuuuugua

SEQ ID NO: 20210 - RNA, 22 nt, Leptospira interrogans serovar lai str. 56601
ugaagucuaagauacguaugau

SEQ ID NO: 20211 - RNA, 22 nt, Leptospira interrogans serovar lai str. 56601
ugaauggauugaaaugggcuga

SEQ ID NO: 20212 - RNA, 22 nt, Leptospira interrogans serovar lai str. 56601
ugagauuagauuuucgaaucga

SEQ ID NO: 20213 - RNA, 22 nt, Leptospira interrogans serovar lai str. 56601
ugcaaacucuaguauucuauuu

SEQ ID NO: 20214 - RNA, 20 nt, Leptospira interrogans serovar lai str. 56601
ugcaaauucaaaaggucgca

SEQ ID NO: 20215 - RNA, 22 nt, Leptospira interrogans serovar lai str. 56601
ugcagagcaaccauccauagaa

SEQ ID NO: 20216 - RNA, 22 nt, Leptospira interrogans serovar lai str. 56601
ugcauuuguggacauuagaaga

SEQ ID NO: 20217 - RNA, 22 nt, Leptospira interrogans serovar lai str. 56601
ugcggaaguuucugaaauuucu

SEQ ID NO: 20218 - RNA, 22 nt, Leptospira interrogans serovar lai str. 56601
ugcuuugauauccaacauagga

SEQ ID NO: 20219 - RNA, 21 nt, Leptospira interrogans serovar lai str. 56601
uggaaacuacggaaugugugg

SEQ ID NO: 20220 - RNA, 22 nt, Leptospira interrogans serovar lai str. 56601
uggaacuuuccgauagacgucu

SEQ ID NO: 20221 - RNA, 22 nt, Leptospira interrogans serovar lai str. 56601
uggaauucaaaugggaggagga

SEQ ID NO: 20222 - RNA, 22 nt, Leptospira interrogans serovar lai str. 56601
aacccuuuuaccuucaauuugg

SEQ ID NO: 20223 - RNA, 22 nt, Leptospira interrogans serovar lai str. 56601
aaccucuagcgauugcugagua

SEQ ID NO: 20224 - RNA, 22 nt, Leptospira interrogans serovar lai str. 56601
aaccugcauuuuuaauuuggua

SEQ ID NO: 20225 - RNA, 22 nt, Leptospira interrogans serovar lai str. 56601
aaccugugcgagaauuaccuaa

SEQ ID NO: 20226 - RNA, 22 nt, Leptospira interrogans serovar lai str. 56601
aacgaauaccauuauuucuagc

SEQ ID NO: 20227 - RNA, 22 nt, Leptospira interrogans serovar lai str. 56601
aacgaugggaggaaacauaucc

SEQ ID NO: 20228 - RNA, 22 nt, Leptospira interrogans serovar lai str. 56601
aacgcucuuuaugaaucgcguu

SEQ ID NO: 20229 - RNA, 22 nt, Leptospira interrogans serovar lai str. 56601
aacgcuuuccuaugggucgcgu

SEQ ID NO: 20230 - RNA, 22 nt, Leptospira interrogans serovar lai str. 56601
aacggauugaauuucuuaauuu

SEQ ID NO: 20231 - RNA, 22 nt, Leptospira interrogans serovar lai str. 56601
aagcauuuccugcacuuuuaga

SEQ ID NO: 20232 - RNA, 22 nt, Leptospira interrogans serovar lai str. 56601
aaggaauccgaaauaucgauuu

SEQ ID NO: 20233 - RNA, 22 nt, Leptospira interrogans serovar lai str. 56601
aaggaucagaaacuauaguuug

SEQ ID NO: 20234 - RNA, 22 nt, Leptospira interrogans serovar lai str. 56601
aaggcgauucuuuccgauuggg

SEQ ID NO: 20235 - RNA, 22 nt, Leptospira interrogans serovar lai str. 56601
aaguccuaauuuuugaauugau

SEQ ID NO: 20236 - RNA, 22 nt, Leptospira interrogans serovar lai str. 56601
aagucuaaaucguugucuucua

SEQ ID NO: 20237 - RNA, 22 nt, Leptospira interrogans serovar lai str. 56601
aagucuuuauaaaauaguauuu

SEQ ID NO: 20238 - RNA, 18 nt, Leptospira interrogans serovar lai str. 56601
aagugaacuuacugaguu

SEQ ID NO: 20239 - RNA, 22 nt, Leptospira interrogans serovar lai str. 56601
aaguguuuuaucuucugaggaa

SEQ ID NO: 20240 - RNA, 22 nt, Leptospira interrogans serovar lai str. 56601
aaguuagaauaugacgguaaga

SEQ ID NO: 20241 - RNA, 22 nt, Leptospira interrogans serovar lai str. 56601
aaucgaauacucaaaucgauga

SEQ ID NO: 20242 - RNA, 22 nt, Leptospira interrogans serovar lai str. 56601
aaucgggauuuuacauauggua

SEQ ID NO: 20243 - RNA, 22 nt, Leptospira interrogans serovar lai str. 56601
aaucugcuuuuuggaagacuca

SEQ ID NO: 20244 - RNA, 22 nt, Leptospira interrogans serovar lai str. 56601
aaugaucauccgacuugcaaaa

SEQ ID NO: 20245 - RNA, 22 nt, Leptospira interrogans serovar lai str. 56601
aauugcaaaaccucaaaaggua

SEQ ID NO: 20246 - RNA, 22 nt, Leptospira interrogans serovar lai str. 56601
aauugguuuuucucuaugcccu

SEQ ID NO: 20247 - RNA, 22 nt, Leptospira interrogans serovar lai str. 56601
acauucuuuaaaaguauaugau

SEQ ID NO: 20248 - RNA, 22 nt, Leptospira interrogans serovar lai str. 56601
acauugacaaaguuuuucaaag

SEQ ID NO: 20249 - RNA, 23 nt, Leptospira interrogans serovar lai str. 56601
acgaacucaauucuaccauugga

SEQ ID NO: 20250 - RNA, 22 nt, Leptospira interrogans serovar lai str. 56601
acgcucuuuaugaaucgcguug

SEQ ID NO: 20251 - RNA, 22 nt, Leptospira interrogans serovar lai str. 56601
acguuauaaauuuuggaauugu

SEQ ID NO: 20252 - RNA, 22 nt, Leptospira interrogans serovar lai str. 56601
acucaguucguugggagugauu

SEQ ID NO: 20253 - RNA, 22 nt, Leptospira interrogans serovar lai str. 56601
acucguuuuacuuccaauuuga

SEQ ID NO: 20254 - RNA, 22 nt, Leptospira interrogans serovar lai str. 56601
acuuggaaguuaggaaaagacc

SEQ ID NO: 20255 - RNA, 22 nt, Leptospira interrogans serovar lai str. 56601
agaaaucuuagguucaauuaau

SEQ ID NO: 20256 - RNA, 22 nt, Leptospira interrogans serovar lai str. 56601
agaauccuacacuaaaauuauu

SEQ ID NO: 20257 - RNA, 22 nt, Leptospira interrogans serovar lai str. 56601
agagcgaucaaucugccaccgg

SEQ ID NO: 20258 - RNA, 21 nt, Leptospira interrogans serovar lai str. 56601
agaguucauaucuucggaggu

SEQ ID NO: 20259 - RNA, 22 nt, Leptospira interrogans serovar lai str. 56601
agaucgaauggaauuuuauauu

SEQ ID NO: 20260 - RNA, 22 nt, Leptospira interrogans serovar lai str. 56601
agaucuguuuaucugugauucc

SEQ ID NO: 20261 - RNA, 22 nt, Leptospira interrogans serovar lai str. 56601
agaugcaaguucuuuaaauucu

SEQ ID NO: 20262 - RNA, 22 nt, Leptospira interrogans serovar lai str. 56601
agauuagacaacauaagaauuu

SEQ ID NO: 20263 - RNA, 23 nt, Leptospira interrogans serovar lai str. 56601
agcuacaaagauaguuccauuga

SEQ ID NO: 20264 - RNA, 23 nt, Leptospira interrogans serovar lai str. 56601
agguucaaaaagaguacuauuau

SEQ ID NO: 20265 - RNA, 22 nt, Leptospira interrogans serovar lai str. 56601
agguuuaauacguuuucuuugc

SEQ ID NO: 20266 - RNA, 22 nt, Leptospira interrogans serovar lai str. 56601
agguuuacgaacuuauuucugg

SEQ ID NO: 20267 - RNA, 22 nt, Leptospira interrogans serovar lai str. 56601
aguauagauucacauucaaagc

SEQ ID NO: 20268 - RNA, 22 nt, Leptospira interrogans serovar lai str. 56601
aguucauaaaagaguucccgca

SEQ ID NO: 20269 - RNA, 22 nt, Leptospira interrogans serovar lai str. 56601
aguuuaaggaagcguuuugcug

SEQ ID NO: 20270 - RNA, 22 nt, Leptospira interrogans serovar lai str. 56601
aguuugaacuuucucgugcuuc

SEQ ID NO: 20271 - RNA, 18 nt, Leptospira interrogans serovar lai str. 56601
aguuuggaucucugcuuc

SEQ ID NO: 20272 - RNA, 22 nt, Leptospira interrogans serovar lai str. 56601
auaacucuuggaaaacgaucaa

SEQ ID NO: 20273 - RNA, 22 nt, Leptospira interrogans serovar lai str. 56601
auagaagcguucagauuuuuuc

SEQ ID NO: 20274 - RNA, 22 nt, Leptospira interrogans serovar lai str. 56601
aucaaacucuccguguugaaau

SEQ ID NO: 20275 - RNA, 22 nt, Leptospira interrogans serovar lai str. 56601
aucaagccagauuuucuucgga

SEQ ID NO: 20276 - RNA, 22 nt, Leptospira interrogans serovar lai str. 56601
aucauagaauagggaauuggac

SEQ ID NO: 20277 - RNA, 20 nt, Leptospira interrogans serovar lai str. 56601
auccgaguuagauucaaaac

SEQ ID NO: 20278 - RNA, 22 nt, Leptospira interrogans serovar lai str. 56601
aucgaaagggcucgacgucaau

SEQ ID NO: 20279 - RNA, 22 nt, Leptospira interrogans serovar lai str. 56601
aucgauuuaucugggguuuugu

SEQ ID NO: 20280 - RNA, 22 nt, Leptospira interrogans serovar lai str. 56601
aucgugaauugguuauccugca

SEQ ID NO: 20281 - RNA, 22 nt, Leptospira interrogans serovar lai str. 56601
aucuucauuagagauauacgag

SEQ ID NO: 20282 - RNA, 22 nt, Leptospira interrogans serovar lai str. 56601
aucuuguuguucuaucuugauc

SEQ ID NO: 20283 - RNA, 22 nt, Leptospira interrogans serovar lai str. 56601
augaacuuuugggaaauuuguu

SEQ ID NO: 20284 - RNA, 22 nt, Leptospira interrogans serovar lai str. 56601
augagauuguuguuaguaggga

SEQ ID NO: 20285 - RNA, 22 nt, Leptospira interrogans serovar lai str. 56601
augauucuuguuuugggaacca

SEQ ID NO: 20286 - RNA, 22 nt, Leptospira interrogans serovar lai str. 56601
augcaguaugggaaagaauugc

SEQ ID NO: 20287 - RNA, 22 nt, Leptospira interrogans serovar lai str. 56601
augcguagccugcuauuuuugg

SEQ ID NO: 20288 - RNA, 21 nt, Leptospira interrogans serovar lai str. 56601
auggaaguauuuaaacgauuu

SEQ ID NO: 20289 - RNA, 22 nt, Leptospira interrogans serovar lai str. 56601
auggaauuacgaaaucguuuuu

SEQ ID NO: 20290 - RNA, 22 nt, Leptospira interrogans serovar lai str. 56601
auucccauaaauacaacguuag

SEQ ID NO: 20291 - RNA, 22 nt, Leptospira interrogans serovar lai str. 56601
auucguuuuuaaaauucggaga

SEQ ID NO: 20292 - RNA, 22 nt, Leptospira interrogans serovar lai str. 56601
auucuaguuuucaauaacuuga

SEQ ID NO: 20293 - RNA, 22 nt, Leptospira interrogans serovar lai str. 56601
auuggaaauuaggauugacagg

SEQ ID NO: 20294 - RNA, 22 nt, Leptospira interrogans serovar lai str. 56601
auuguaggaacucccaugaaca

SEQ ID NO: 20295 - RNA, 22 nt, Leptospira interrogans serovar lai str. 56601
auugucgaaaauugaauaucuu

SEQ ID NO: 20296 - RNA, 22 nt, Leptospira interrogans serovar lai str. 56601
auuugcgagugaaaagcuaaau

SEQ ID NO: 20297 - RNA, 22 nt, Leptospira interrogans serovar lai str. 56601
caaaggauacgcgcucaucuua

SEQ ID NO: 20298 - RNA, 22 nt, Leptospira interrogans serovar lai str. 56601
caaguuauuggaaauuauaaaa

SEQ ID NO: 20299 - RNA, 22 nt, Leptospira interrogans serovar lai str. 56601
caaguuauugguauuuuauaaa

SEQ ID NO: 20300 - RNA, 20 nt, Leptospira interrogans serovar lai str. 56601
caauacuugccuugaugcgu

SEQ ID NO: 20301 - RNA, 22 nt, Leptospira interrogans serovar lai str. 56601
caauuugagauuuuacaguaaa

SEQ ID NO: 20302 - RNA, 22 nt, Leptospira interrogans serovar lai str. 56601
cacguuaugcucccuuuuagac

SEQ ID NO: 20303 - RNA, 22 nt, Leptospira interrogans serovar lai str. 56601
cagaauuuuugcgcauaaauuu

SEQ ID NO: 20304 - RNA, 22 nt, Leptospira interrogans serovar lai str. 56601
cagcaguaagaaaaauuuugga

SEQ ID NO: 20305 - RNA, 22 nt, Leptospira interrogans serovar lai str. 56601
caggaucuucguaaggaacuug

SEQ ID NO: 20306 - RNA, 22 nt, Leptospira interrogans serovar lai str. 56601
caucaauuaugucaaaucucug

SEQ ID NO: 20307 - RNA, 22 nt, Leptospira interrogans serovar lai str. 56601
caucauggucguugccggugga

SEQ ID NO: 20308 - RNA, 22 nt, Leptospira interrogans serovar lai str. 56601
cauuucguagagauuaucuaca

SEQ ID NO: 20309 - RNA, 18 nt, Leptospira interrogans serovar lai str. 56601
ccagaguucuaauugcug

SEQ ID NO: 20310 - RNA, 22 nt, Leptospira interrogans serovar lai str. 56601
ccgaaaguagaaaguauauuuu

SEQ ID NO: 20311 - RNA, 22 nt, Leptospira interrogans serovar lai str. 56601
ccuaucaguuuauauuuugaau

SEQ ID NO: 20312 - RNA, 22 nt, Leptospira interrogans serovar lai str. 56601
cgaaucaaauguucuacuucag

SEQ ID NO: 20313 - RNA, 22 nt, Leptospira interrogans serovar lai str. 56601
cgguucaauagguuuucgugau

SEQ ID NO: 20314 - RNA, 22 nt, Leptospira interrogans serovar lai str. 56601
cguagcucucguauucucuuuu

SEQ ID NO: 20315 - RNA, 21 nt, Leptospira interrogans serovar lai str. 56601
cguauucucuuagaagaauuu

SEQ ID NO: 20316 - RNA, 22 nt, Leptospira interrogans serovar lai str. 56601
cuauaugagcagguuccauaaa

SEQ ID NO: 20317 - RNA, 22 nt, Leptospira interrogans serovar lai str. 56601
cucaugauucugaaaaaaguug

SEQ ID NO: 20318 - RNA, 22 nt, Leptospira interrogans serovar lai str. 56601
cucgaagaagaggguucaauug

SEQ ID NO: 20319 - RNA, 22 nt, Leptospira interrogans serovar lai str. 56601
cugaacagaagugauugauccu

SEQ ID NO: 20320 - RNA, 22 nt, Leptospira interrogans serovar lai str. 56601
cugagaauuuuuucagaaguca

SEQ ID NO: 20321 - RNA, 22 nt, Leptospira interrogans serovar lai str. 56601
cuggaauugaaagugauuugaa

SEQ ID NO: 20322 - RNA, 22 nt, Leptospira interrogans serovar lai str. 56601
cuggcaauuagucuugaaaauu

SEQ ID NO: 20323 - RNA, 22 nt, Leptospira interrogans serovar lai str. 56601
cuguagaugcuuguuuauuuuc

SEQ ID NO: 20324 - RNA, 22 nt, Leptospira interrogans serovar lai str. 56601
cuuaccgucauauucucaauuu

SEQ ID NO: 20325 - RNA, 22 nt, Leptospira interrogans serovar lai str. 56601
cuugaauuggagcgggaaaaaa

SEQ ID NO: 20326 - RNA, 22 nt, Leptospira interrogans serovar lai str. 56601
cuuuggaucuaaaucggaagca

SEQ ID NO: 20327 - RNA, 22 nt, Leptospira interrogans serovar lai str. 56601
gaaauacuuucgaucgaaaauu

SEQ ID NO: 20328 - RNA, 22 nt, Leptospira interrogans serovar lai str. 56601
gaaauccuuuuaccucuugcua

SEQ ID NO: 20329 - RNA, 22 nt, Leptospira interrogans serovar lai str. 56601
gaaccagauacggcuuuuaguu

SEQ ID NO: 20330 - RNA, 22 nt, Leptospira interrogans serovar lai str. 56601
gaagauauucgaguggauuauu

SEQ ID NO: 20331 - RNA, 22 nt, Leptospira interrogans serovar lai str. 56601
gaaguuuacuccggauuuuagg

SEQ ID NO: 20332 - RNA, 22 nt, Leptospira interrogans serovar lai str. 56601
gaauucuuccuugggaaaugua

SEQ ID NO: 20333 - RNA, 22 nt, Leptospira interrogans serovar lai str. 56601
gacaaguuagaucgaauucgaa

SEQ ID NO: 20334 - RNA, 17 nt, Leptospira interrogans serovar lai str. 56601
gacuuuaauagguugag

SEQ ID NO: 20335 - RNA, 16 nt, Leptospira interrogans serovar lai str. 56601
gagauucuagaucuua

SEQ ID NO: 20336 - RNA, 22 nt, Leptospira interrogans serovar lai str. 56601
gagcagcgcugauauuuuccuc

SEQ ID NO: 20337 - RNA, 22 nt, Leptospira interrogans serovar lai str. 56601
gagcauccauguuuccaacuga

SEQ ID NO: 20338 - RNA, 22 nt, Leptospira interrogans serovar lai str. 56601
gagcuacucuggauuauuauua

SEQ ID NO: 20339 - RNA, 22 nt, Leptospira interrogans serovar lai str. 56601
gaggaguuucguugcaaagaua

SEQ ID NO: 20340 - RNA, 22 nt, Leptospira interrogans serovar lai str. 56601
gaucgauuacaauuuggaaaua

SEQ ID NO: 20341 - RNA, 22 nt, Leptospira interrogans serovar lai str. 56601
gaugacuuuugaaaccgaaggu

SEQ ID NO: 20342 - RNA, 23 nt, Leptospira interrogans serovar lai str. 56601
gaugcaauuuauauagaagcagc

SEQ ID NO: 20343 - RNA, 22 nt, Leptospira interrogans serovar lai str. 56601
gauucugacucuuuuucuggau

SEQ ID NO: 20344 - RNA, 22 nt, Leptospira interrogans serovar lai str. 56601
gauuucuauggaucacguuuua

SEQ ID NO: 20345 - RNA, 23 nt, Leptospira interrogans serovar lai str. 56601
ggaacuugauaaccacaauucac

SEQ ID NO: 20346 - RNA, 22 nt, Leptospira interrogans serovar lai str. 56601
ggaauugaaaagaucaccuucu

SEQ ID NO: 20347 - RNA, 20 nt, Leptospira interrogans serovar lai str. 56601
ggaguuccaacuuauuuagu

SEQ ID NO: 20348 - RNA, 18 nt, Leptospira interrogans serovar lai str. 56601
ggaguucccacauuucaa

SEQ ID NO: 20349 - RNA, 22 nt, Leptospira interrogans serovar lai str. 56601
ggucauaucaaaguauuuggag

SEQ ID NO: 20350 - RNA, 22 nt, Leptospira interrogans serovar lai str. 56601
guaaucaaaucguuuugaacug

SEQ ID NO: 20351 - RNA, 22 nt, Leptospira interrogans serovar lai str. 56601
guaugaguuccuacaauuuuag

SEQ ID NO: 20352 - RNA, 22 nt, Leptospira interrogans serovar lai str. 56601
gucaaguuauuggcaaccuagg

SEQ ID NO: 20353 - RNA, 22 nt, Leptospira interrogans serovar lai str. 56601
gucggaacaauugauuucguuu

SEQ ID NO: 20354 - RNA, 22 nt, Leptospira interrogans serovar lai str. 56601
gucguugaaaaauuccauaguu

SEQ ID NO: 20355 - RNA, 22 nt, Leptospira interrogans serovar lai str. 56601
gucuaaaugcgaaguaugcgga

SEQ ID NO: 20356 - RNA, 22 nt, Leptospira interrogans serovar lai str. 56601
gucuauaucaaguccggaauca

SEQ ID NO: 20357 - RNA, 22 nt, Leptospira interrogans serovar lai str. 56601
gucucagauggacuuuguacuu

SEQ ID NO: 20358 - RNA, 22 nt, Leptospira interrogans serovar lai str. 56601
guggauaaauuuguuuggaauu

SEQ ID NO: 20359 - RNA, 22 nt, Leptospira interrogans serovar lai str. 56601
guggauucggaaucaggggauc

SEQ ID NO: 20360 - RNA, 22 nt, Leptospira interrogans serovar lai str. 56601
guucaggauuauauuuuucuaa

SEQ ID NO: 20361 - RNA, 22 nt, Leptospira interrogans serovar lai str. 56601
guuccggacucugccaacauag

SEQ ID NO: 20362 - RNA, 22 nt, Leptospira interrogans serovar lai str. 56601
guucgggauuauauuuuucuaa

SEQ ID NO: 20363 - RNA, 22 nt, Leptospira interrogans serovar lai str. 56601
guugaaguuuuagaucuucguu

SEQ ID NO: 20364 - RNA, 22 nt, Leptospira interrogans serovar lai str. 56601
guugggaauuuuacuucuucau

SEQ ID NO: 20365 - RNA, 22 nt, Leptospira interrogans serovar lai str. 56601
guuuaagucuucuuugucgauu

SEQ ID NO: 20366 - RNA, 22 nt, Leptospira interrogans serovar lai str. 56601
guuuccauuugcaacguugauu

SEQ ID NO: 20367 - RNA, 22 nt, Leptospira interrogans serovar lai str. 56601
guuuggaaacucgccuuggccc

SEQ ID NO: 20368 - RNA, 22 nt, Leptospira interrogans serovar lai str. 56601
uaaagaacauauuagagcggau

SEQ ID NO: 20369 - RNA, 22 nt, Leptospira interrogans serovar lai str. 56601
uaaagguuugagcaauucuugg

SEQ ID NO: 20370 - RNA, 22 nt, Leptospira interrogans serovar lai str. 56601
uaaaugugggaacucccacaau

SEQ ID NO: 20371 - RNA, 22 nt, Leptospira interrogans serovar lai str. 56601
uaacguuucguuugauuggaga

SEQ ID NO: 20372 - RNA, 22 nt, Leptospira interrogans serovar lai str. 56601
uacaaagaaagaaauucuaccc

SEQ ID NO: 20373 - RNA, 22 nt, Leptospira interrogans serovar lai str. 56601
uacaaagaggcagaaauuuuca

SEQ ID NO: 20374 - RNA, 22 nt, Leptospira interrogans serovar lai str. 56601
uacaaguucuggaggacuugcu

SEQ ID NO: 20375 - RNA, 22 nt, Leptospira interrogans serovar lai str. 56601
uaccgaagauaauccuuuagga

SEQ ID NO: 20376 - RNA, 23 nt, Leptospira interrogans serovar lai str. 56601
uaccggaaaauguuggugauucc

SEQ ID NO: 20377 - RNA, 22 nt, Leptospira interrogans serovar lai str. 56601
uacgaaugucuuuuuguaugau

SEQ ID NO: 20378 - RNA, 22 nt, Leptospira interrogans serovar lai str. 56601
uacucucaauagaccucuacaa

SEQ ID NO: 20379 - RNA, 21 nt, Leptospira interrogans serovar lai str. 56601
uacuuuaccagaugaauuuca

SEQ ID NO: 20380 - RNA, 22 nt, Leptospira interrogans serovar lai str. 56601
uagagauuaugucuauuuuagg

SEQ ID NO: 20381 - RNA, 22 nt, Leptospira interrogans serovar lai str. 56601
uagaguuguucguaaaaucgug

SEQ ID NO: 20382 - RNA, 21 nt, Leptospira interrogans serovar lai str. 56601
uagaucaauaggaaagaauuu

SEQ ID NO: 20383 - RNA, 22 nt, Leptospira interrogans serovar lai str. 56601
uagaucuuuaucaaacacauug

SEQ ID NO: 20384 - RNA, 22 nt, Leptospira interrogans serovar lai str. 56601
uagcuuucuggaacgaaugaaa

SEQ ID NO: 20385 - RNA, 22 nt, Leptospira interrogans serovar lai str. 56601
uagguucucuuuugauuucagu

SEQ ID NO: 20386 - RNA, 22 nt, Leptospira interrogans serovar lai str. 56601
uaguuucuacaagcucgagcuu

SEQ ID NO: 20387 - RNA, 22 nt, Leptospira interrogans serovar lai str. 56601
uaucaaaguaagaaauuucuuc

SEQ ID NO: 20388 - RNA, 22 nt, Leptospira interrogans serovar lai str. 56601
uaugagaaaaaugaaucgaucg

SEQ ID NO: 20389 - RNA, 22 nt, Leptospira interrogans serovar lai str. 56601
uaugggauucuggaacaacucu

SEQ ID NO: 20390 - RNA, 22 nt, Leptospira interrogans serovar lai str. 56601
uauucuguagugaucggagguu

SEQ ID NO: 20391 - RNA, 22 nt, Leptospira interrogans serovar lai str. 56601
uauuuccgaagaaagauuuaaa

SEQ ID NO: 20392 - RNA, 22 nt, Leptospira interrogans serovar lai str. 56601
ucaaacggcgguucuugcuucu

SEQ ID NO: 20393 - RNA, 22 nt, Leptospira interrogans serovar lai str. 56601
ucaaacucauagucuuuuucgu

SEQ ID NO: 20394 - RNA, 22 nt, Leptospira interrogans serovar lai str. 56601
ucaaagcggaaugugaagcgga

SEQ ID NO: 20395 - RNA, 22 nt, Leptospira interrogans serovar lai str. 56601
ucacgaauuucuugaaauuggu

SEQ ID NO: 20396 - RNA, 22 nt, Leptospira interrogans serovar lai str. 56601
ucagauuucucaaaacaagaaa

SEQ ID NO: 20397 - RNA, 20 nt, Leptospira interrogans serovar lai str. 56601
ucauuucauucgcuucucca

SEQ ID NO: 20398 - RNA, 23 nt, Leptospira interrogans serovar lai str. 56601
uccaauucuaucauauuccuccg

SEQ ID NO: 20399 - RNA, 23 nt, Leptospira interrogans serovar lai str. 56601
uccguagaaaaaguuucaaguga

SEQ ID NO: 20400 - RNA, 22 nt, Leptospira interrogans serovar lai str. 56601
uccuacgguccacgcuuuuuga

SEQ ID NO: 20401 - RNA, 22 nt, Leptospira interrogans serovar lai str. 56601
ucgaaucggcggaccuucguag

SEQ ID NO: 20402 - RNA, 22 nt, Leptospira interrogans serovar lai str. 56601
ucgaauuagaaggguacuuucu

SEQ ID NO: 20403 - RNA, 23 nt, Leptospira interrogans serovar lai str. 56601
ucgacuuauacuccuaucgauuc

SEQ ID NO: 20404 - RNA, 22 nt, Leptospira interrogans serovar lai str. 56601
ucgcgaucgauuacgagaggau

SEQ ID NO: 20405 - RNA, 22 nt, Leptospira interrogans serovar lai str. 56601
ucggaagagauuuuaauucuuu

SEQ ID NO: 20406 - RNA, 22 nt, Leptospira interrogans serovar lai str. 56601
ucguaagauugugcgagaugau

SEQ ID NO: 20407 - RNA, 22 nt, Leptospira interrogans serovar lai str. 56601
ucguagcgacguuguauuuugu

SEQ ID NO: 20408 - RNA, 22 nt, Leptospira interrogans serovar lai str. 56601
ucuaaagucaaagguaucgaau

SEQ ID NO: 20409 - RNA, 22 nt, Leptospira interrogans serovar lai str. 56601
ucucauugcacucaguuuguug

SEQ ID NO: 20410 - RNA, 19 nt, Leptospira interrogans serovar lai str. 56601
ucugagcaagauuuugaug

SEQ ID NO: 20411 - RNA, 20 nt, Leptospira interrogans serovar lai str. 56601
ucugauucugguuuuagagc

SEQ ID NO: 20412 - RNA, 22 nt, Leptospira interrogans serovar lai str. 56601
ucugucggaauuacgacaaagc

SEQ ID NO: 20413 - RNA, 22 nt, Leptospira interrogans serovar lai str. 56601
ucuguuauauuucaaguguggg

SEQ ID NO: 20414 - RNA, 22 nt, Leptospira interrogans serovar lai str. 56601
ucuuagauaaacaaauuguaag

SEQ ID NO: 20415 - RNA, 22 nt, Leptospira interrogans serovar lai str. 56601
ucuuggaaauuuuuaucauagc

SEQ ID NO: 20416 - RNA, 22 nt, Leptospira interrogans serovar lai str. 56601
ugaauacaauuuuuugaccaga

SEQ ID NO: 20417 - RNA, 22 nt, Leptospira interrogans serovar lai str. 56601
ugacaaagaugucagcaaacaa

SEQ ID NO: 20418 - RNA, 18 nt, Leptospira interrogans serovar lai str. 56601
ugaguucgacguaaggaa

SEQ ID NO: 20419 - RNA, 22 nt, Leptospira interrogans serovar lai str. 56601
ugaguucuauaaggauuccaga

SEQ ID NO: 20420 - RNA, 22 nt, Leptospira interrogans serovar lai str. 56601
ugauccguaaaaaaccugugga

SEQ ID NO: 20421 - RNA, 22 nt, Leptospira interrogans serovar lai str. 56601
ugcaauuggagcaguaggaguu

SEQ ID NO: 20422 - RNA, 22 nt, Leptospira interrogans serovar lai str. 56601
ugcagcucagguauuagauuua

SEQ ID NO: 20423 - RNA, 22 nt, Leptospira interrogans serovar lai str. 56601
ugcucuaaaauucuucuagaau

SEQ ID NO: 20424 - RNA, 22 nt, Leptospira interrogans serovar lai str. 56601
uggaaauuagaagaugauucug

SEQ ID NO: 20425 - RNA, 22 nt, Leptospira interrogans serovar lai str. 56601
uggaagauuacaaacacuucgg

SEQ ID NO: 20426 - RNA, 22 nt, Leptospira interrogans serovar lai str. 56601
uggaaguaggucuagguuauau

SEQ ID NO: 20427 - RNA, 22 nt, Leptospira interrogans serovar lai str. 56601
uggaauacguuagacgcucaau

SEQ ID NO: 20428 - RNA, 23 nt, Leptospira interrogans serovar lai str. 56601
uggaauuucacaauaacuugacc

SEQ ID NO: 20429 - RNA, 22 nt, Leptospira interrogans serovar lai str. 56601
uggauauuuuagaaucucuucc

SEQ ID NO: 20430 - RNA, 22 nt, Leptospira interrogans serovar lai str. 56601
ugggaacuagagucuugguuuc

SEQ ID NO: 20431 - RNA, 22 nt, Leptospira interrogans serovar lai str. 56601
ugucuuagaauuuaugauacuu

SEQ ID NO: 20432 - RNA, 22 nt, Leptospira interrogans serovar lai str. 56601
ugucuuuaguuacaauuuagaa

SEQ ID NO: 20433 - RNA, 22 nt, Leptospira interrogans serovar lai str. 56601
uuacaguugucgcagacuguuu

SEQ ID NO: 20434 - RNA, 22 nt, Leptospira interrogans serovar lai str. 56601
uuagaguuguuccagaauccca

SEQ ID NO: 20435 - RNA, 22 nt, Leptospira interrogans serovar lai str. 56601
uuagauggaaagauucuuuguu

SEQ ID NO: 20436 - RNA, 22 nt, Leptospira interrogans serovar lai str. 56601
uuaggacgauucaagauuggaa

SEQ ID NO: 20437 - RNA, 22 nt, Leptospira interrogans serovar lai str. 56601
uucaaucugaaguggagcguua

SEQ ID NO: 20438 - RNA, 22 nt, Leptospira interrogans serovar lai str. 56601
uucagagagccaagugcgaaga

SEQ ID NO: 20439 - RNA, 22 nt, Leptospira interrogans serovar lai str. 56601
uucagcuuauaaaagucguucg

SEQ ID NO: 20440 - RNA, 22 nt, Leptospira interrogans serovar lai str. 56601
uucaggaaaaauguuugcuggu

SEQ ID NO: 20441 - RNA, 22 nt, Leptospira interrogans serovar lai str. 56601
uuccaagugguuuuacaaguac

SEQ ID NO: 20442 - RNA, 22 nt, Leptospira interrogans serovar lai str. 56601
uuccagaagguuauuucugcga

SEQ ID NO: 20443 - RNA, 22 nt, Leptospira interrogans serovar lai str. 56601
uuccagaagugaucgauccgau

SEQ ID NO: 20444 - RNA, 22 nt, Leptospira interrogans serovar lai str. 56601
uuccgaaacgguuuacgcuaac

SEQ ID NO: 20445 - RNA, 22 nt, Leptospira interrogans serovar lai str. 56601
uuccggaauaucuuucaaaugc

SEQ ID NO: 20446 - RNA, 22 nt, Leptospira interrogans serovar lai str. 56601
uuccggaugcgguauuuauaga

SEQ ID NO: 20447 - RNA, 21 nt, Leptospira interrogans serovar lai str. 56601
uuccggguugauuucuauaag

SEQ ID NO: 20448 - RNA, 22 nt, Leptospira interrogans serovar lai str. 56601
uucgauuguagaaguuuagggu

SEQ ID NO: 20449 - RNA, 22 nt, Leptospira interrogans serovar lai str. 56601
uucgucuagcuuucucucaguu

SEQ ID NO: 20450 - RNA, 22 nt, Leptospira interrogans serovar lai str. 56601
uucuucggugcacgaucacggu

SEQ ID NO: 20451 - RNA, 22 nt, Leptospira interrogans serovar lai str. 56601
uugaaagauucuugggcaagag

SEQ ID NO: 20452 - RNA, 22 nt, Leptospira interrogans serovar lai str. 56601
uugaagcguaugggaacuuagc

SEQ ID NO: 20453 - RNA, 22 nt, Leptospira interrogans serovar lai str. 56601
uugaaucucuuucgaacucgcg

SEQ ID NO: 20454 - RNA, 22 nt, Leptospira interrogans serovar lai str. 56601
uugauucggaucuugaaaaaaa

SEQ ID NO: 20455 - RNA, 22 nt, Leptospira interrogans serovar lai str. 56601
uugcgauuguacgagagaauaa

SEQ ID NO: 20456 - RNA, 21 nt, Leptospira interrogans serovar lai str. 56601
uuguagcuaacuugaaaguag

SEQ ID NO: 20457 - RNA, 22 nt, Leptospira interrogans serovar lai str. 56601
uuuaagagauuuaaacguaggu

SEQ ID NO: 20458 - RNA, 22 nt, Leptospira interrogans serovar lai str. 56601
uuuacguucucuaacucuuuca

SEQ ID NO: 20459 - RNA, 22 nt, Leptospira interrogans serovar lai str. 56601
uuuacuuggagcuucuuuggaa

SEQ ID NO: 20460 - RNA, 22 nt, Leptospira interrogans serovar lai str. 56601
uuuauccgagaaaucaaucaua

SEQ ID NO: 20461 - RNA, 21 nt, Leptospira interrogans serovar lai str. 56601
uuuaugacagguucuuacuuu

SEQ ID NO: 20462 - RNA, 23 nt, Leptospira interrogans serovar lai str. 56601
uuucaagaggacuucuauauuuu

SEQ ID NO: 20463 - RNA, 22 nt, Leptospira interrogans serovar lai str. 56601
uuucacaaaaugugggaacuac

SEQ ID NO: 20464 - RNA, 22 nt, Leptospira interrogans serovar lai str. 56601
uuuccgaagaagagaacuuuag

SEQ ID NO: 20465 - RNA, 20 nt, Leptospira interrogans serovar lai str. 56601
uuugaagaauaggagcgauu

SEQ ID NO: 20466 - RNA, 22 nt, Leptospira interrogans serovar lai str. 56601
uuugaaucguauuuacuggauc

SEQ ID NO: 20467 - RNA, 22 nt, Leptospira interrogans serovar lai str. 56601
uuugacagccagaaugauaaau

SEQ ID NO: 20468 - RNA, 22 nt, Leptospira interrogans serovar lai str. 56601
uuugcggaaaaucuucgauaga

SEQ ID NO: 20469 - RNA, 22 nt, Leptospira interrogans serovar lai str. 56601
uuuggaauuucacaauaacuug

SEQ ID NO: 20470 - RNA, 22 nt, Leptospira interrogans serovar lai str. 56601
uuuggcaaagguuaggaacuuc

SEQ ID NO: 20471 - RNA, 22 nt, Leptospira interrogans serovar lai str. 56601
aauaguacaucagaagaacguc

SEQ ID NO: 20472 - RNA, 20 nt, Leptospira interrogans serovar lai str. 56601
aaucagcuuggaaauauuuc

SEQ ID NO: 20473 - RNA, 22 nt, Leptospira interrogans serovar lai str. 56601
aaucggaagcggaggaaucgua

SEQ ID NO: 20474 - RNA, 22 nt, Leptospira interrogans serovar lai str. 56601
aaucuucuaaaaggaggaaucu

SEQ ID NO: 20475 - RNA, 22 nt, Leptospira interrogans serovar lai str. 56601
aauguugacgguuuuuguagga

SEQ ID NO: 20476 - RNA, 22 nt, Leptospira interrogans serovar lai str. 56601
aauuacacaagagauuuugauu

SEQ ID NO: 20477 - RNA, 22 nt, Leptospira interrogans serovar lai str. 56601
aauucgacccguaaaaauacgu

SEQ ID NO: 20478 - RNA, 22 nt, Leptospira interrogans serovar lai str. 56601
aauugcaagauugguuaguucu

SEQ ID NO: 20479 - RNA, 23 nt, Leptospira interrogans serovar lai str. 56601
aauuucggacgcaaaaugaaucg

SEQ ID NO: 20480 - RNA, 22 nt, Leptospira interrogans serovar lai str. 56601
acaacguugugcuugaauacaa

SEQ ID NO: 20481 - RNA, 22 nt, Leptospira interrogans serovar lai str. 56601
acaaucucaauccgaaacaagg

SEQ ID NO: 20482 - RNA, 22 nt, Leptospira interrogans serovar lai str. 56601
acauagaauuuccgaacgaucu

SEQ ID NO: 20483 - RNA, 22 nt, Leptospira interrogans serovar lai str. 56601
acauaucuugcaaaaggagauu

SEQ ID NO: 20484 - RNA, 20 nt, Leptospira interrogans serovar lai str. 56601
accuuucaaaucgaagagcc

SEQ ID NO: 20485 - RNA, 23 nt, Leptospira interrogans serovar lai str. 56601
acgaauaucguccuaccgguauc

SEQ ID NO: 20486 - RNA, 22 nt, Leptospira interrogans serovar lai str. 56601
acgcgugauaaguagacauauu

SEQ ID NO: 20487 - RNA, 22 nt, Leptospira interrogans serovar lai str. 56601
acguuuccggaagaauaaucua

SEQ ID NO: 20488 - RNA, 22 nt, Leptospira interrogans serovar lai str. 56601
acuaagagaauucagccaaagg

SEQ ID NO: 20489 - RNA, 22 nt, Leptospira interrogans serovar lai str. 56601
acucaaugcugcuucucuacag

SEQ ID NO: 20490 - RNA, 22 nt, Leptospira interrogans serovar lai str. 56601
acucagcgaacgucucuaugga

SEQ ID NO: 20491 - RNA, 22 nt, Leptospira interrogans serovar lai str. 56601
acugaaaucaaaagagaaccua

SEQ ID NO: 20492 - RNA, 22 nt, Leptospira interrogans serovar lai str. 56601
acuguaauugauauaguagugu

SEQ ID NO: 20493 - RNA, 22 nt, Leptospira interrogans serovar lai str. 56601
acuucgaaguuuuuaaaugaua

SEQ ID NO: 20494 - RNA, 22 nt, Leptospira interrogans serovar lai str. 56601
acuuguucacguuaaauacauu

SEQ ID NO: 20495 - RNA, 22 nt, Leptospira interrogans serovar lai str. 56601
acuuguuucaaguagacgaacu

SEQ ID NO: 20496 - RNA, 22 nt, Leptospira interrogans serovar lai str. 56601
agaaauugauagaauccugaac

SEQ ID NO: 20497 - RNA, 22 nt, Leptospira interrogans serovar lai str. 56601
agaacgaucggauccaaauugu

SEQ ID NO: 20498 - RNA, 22 nt, Leptospira interrogans serovar lai str. 56601
agaaguucccgaaguacugguu

SEQ ID NO: 20499 - RNA, 22 nt, Leptospira interrogans serovar lai str. 56601
agaauaugagauccuuuuaaaa

SEQ ID NO: 20500 - RNA, 22 nt, Leptospira interrogans serovar lai str. 56601
agaaugcugucugcuugcucuc

SEQ ID NO: 20501 - RNA, 22 nt, Leptospira interrogans serovar lai str. 56601
agacauucagagcguggaauau

SEQ ID NO: 20502 - RNA, 21 nt, Leptospira interrogans serovar lai str. 56601
agagcgaucaaucugccaccg

SEQ ID NO: 20503 - RNA, 22 nt, Leptospira interrogans serovar lai str. 56601
agaguucuuaccgaauugauuu

SEQ ID NO: 20504 - RNA, 22 nt, Leptospira interrogans serovar lai str. 56601
agaguugagaucaaaaaacuuc

SEQ ID NO: 20505 - RNA, 22 nt, Leptospira interrogans serovar lai str. 56601
agauucuuauguuguuugauaa

SEQ ID NO: 20506 - RNA, 22 nt, Leptospira interrogans serovar lai str. 56601
agcagauuuauugguugcuuug

SEQ ID NO: 20507 - RNA, 22 nt, Leptospira interrogans serovar lai str. 56601
agcauucaccgcugaguuuucc

SEQ ID NO: 20508 - RNA, 22 nt, Leptospira interrogans serovar lai str. 56601
aggauucgauucuuugauccac

SEQ ID NO: 20509 - RNA, 22 nt, Leptospira interrogans serovar lai str. 56601
aggucaaguuauugguauuuua

SEQ ID NO: 20510 - RNA, 22 nt, Leptospira interrogans serovar lai str. 56601
agguuccuauguauuuucuuuc

SEQ ID NO: 20511 - RNA, 20 nt, Leptospira interrogans serovar lai str. 56601
aguaguuguaacagauguag

SEQ ID NO: 20512 - RNA, 22 nt, Leptospira interrogans serovar lai str. 56601
agucuuacguaacaugggauau

SEQ ID NO: 20513 - RNA, 22 nt, Leptospira interrogans serovar lai str. 56601
agugaucgaucaauuuguugau

SEQ ID NO: 20514 - RNA, 22 nt, Leptospira interrogans serovar lai str. 56601
aguggacacguugcaauuaccg

SEQ ID NO: 20515 - RNA, 22 nt, Leptospira interrogans serovar lai str. 56601
aguucaaggaacucuuuaucgc

SEQ ID NO: 20516 - RNA, 22 nt, Leptospira interrogans serovar lai str. 56601
aguuccuacaauuuuagaauuu

SEQ ID NO: 20517 - RNA, 22 nt, Leptospira interrogans serovar lai str. 56601
aguugguaggagauuauucuga

SEQ ID NO: 20518 - RNA, 19 nt, Leptospira interrogans serovar lai str. 56601
aguuucuccccuuugacgg

SEQ ID NO: 20519 - RNA, 21 nt, Leptospira interrogans serovar lai str. 56601
aucaggaaaugcaaaaggauc

SEQ ID NO: 20520 - RNA, 22 nt, Leptospira interrogans serovar lai str. 56601
auccgguuugacguuucauagc

SEQ ID NO: 20521 - RNA, 22 nt, Leptospira interrogans serovar lai str. 56601
auccuuuaaaaauggcauucca

SEQ ID NO: 20522 - RNA, 22 nt, Leptospira interrogans serovar lai str. 56601
aucgauauuccuuuccggcuuc

SEQ ID NO: 20523 - RNA, 22 nt, Leptospira interrogans serovar lai str. 56601
aucgcauugauacgauucccuu

SEQ ID NO: 20524 - RNA, 22 nt, Leptospira interrogans serovar lai str. 56601
aucuaaaggagaucuugcguuu

SEQ ID NO: 20525 - RNA, 22 nt, Leptospira interrogans serovar lai str. 56601
aucuggacuuuacagaucgauu

SEQ ID NO: 20526 - RNA, 22 nt, Leptospira interrogans serovar lai str. 56601
aucuguuucuugauccaauagc

SEQ ID NO: 20527 - RNA, 22 nt, Leptospira interrogans serovar lai str. 56601
augauuccaugagaaagaucuu

SEQ ID NO: 20528 - RNA, 22 nt, Leptospira interrogans serovar lai str. 56601
augcaguuccacguuuugauuu

SEQ ID NO: 20529 - RNA, 22 nt, Leptospira interrogans serovar lai str. 56601
auggauucguauuuuucuagga

SEQ ID NO: 20530 - RNA, 20 nt, Leptospira interrogans serovar lai str. 56601
augugaacgauuuaaauuuu

SEQ ID NO: 20531 - RNA, 22 nt, Leptospira interrogans serovar lai str. 56601
auguuccaucuuuaaauuagga

SEQ ID NO: 20532 - RNA, 22 nt, Leptospira interrogans serovar lai str. 56601
auuccaguuccaggagcgacua

SEQ ID NO: 20533 - RNA, 22 nt, Leptospira interrogans serovar lai str. 56601
auucccgagaucaauuuuagaa

SEQ ID NO: 20534 - RNA, 22 nt, Leptospira interrogans serovar lai str. 56601
auuccguucaugggagaaauuu

SEQ ID NO: 20535 - RNA, 22 nt, Leptospira interrogans serovar lai str. 56601
auuccuaagaugaaauuggacg

SEQ ID NO: 20536 - RNA, 22 nt, Leptospira interrogans serovar lai str. 56601
auucuucaaucgucucccgggc

SEQ ID NO: 20537 - RNA, 22 nt, Leptospira interrogans serovar lai str. 56601
auucuugcaaugauuucucgua

SEQ ID NO: 20538 - RNA, 22 nt, Leptospira interrogans serovar lai str. 56601
auugaagaagaauuucuuuuag

SEQ ID NO: 20539 - RNA, 22 nt, Leptospira interrogans serovar lai str. 56601
auuggauacuggaaacgaauau

SEQ ID NO: 20540 - RNA, 18 nt, Leptospira interrogans serovar lai str. 56601
auuuaggaagaauuuuag

SEQ ID NO: 20541 - RNA, 22 nt, Leptospira interrogans serovar lai str. 56601
auuucaacacggagaguuugau

SEQ ID NO: 20542 - RNA, 22 nt, Leptospira interrogans serovar lai str. 56601
auuucgucaaagacgaauucua

SEQ ID NO: 20543 - RNA, 22 nt, Leptospira interrogans serovar lai str. 56601
auuugcaaauauuugucacggu

SEQ ID NO: 20544 - RNA, 22 nt, Leptospira interrogans serovar lai str. 56601
auuuggaucggcuugcacuuag

SEQ ID NO: 20545 - RNA, 22 nt, Leptospira interrogans serovar lai str. 56601
caagcuuugauauauauucuaa

SEQ ID NO: 20546 - RNA, 22 nt, Leptospira interrogans serovar lai str. 56601
caaucagguucgucauuuuacg

SEQ ID NO: 20547 - RNA, 21 nt, Leptospira interrogans serovar lai str. 56601
caaucgaaauucuuuuugaga

SEQ ID NO: 20548 - RNA, 22 nt, Leptospira interrogans serovar lai str. 56601
cacguugaaauaauuaugaagu

SEQ ID NO: 20549 - RNA, 22 nt, Leptospira interrogans serovar lai str. 56601
cagaaauaaaaucaacuuaucu

SEQ ID NO: 20550 - RNA, 22 nt, Leptospira interrogans serovar lai str. 56601
caucugaauauaaaagaauucu

SEQ ID NO: 20551 - RNA, 22 nt, Leptospira interrogans serovar lai str. 56601
caucuucgucaggaaacuucug

SEQ ID NO: 20552 - RNA, 20 nt, Leptospira interrogans serovar lai str. 56601
ccaacauugcaggaauauug

SEQ ID NO: 20553 - RNA, 22 nt, Leptospira interrogans serovar lai str. 56601
ccacaagguucuacuuccaauc

SEQ ID NO: 20554 - RNA, 22 nt, Leptospira interrogans serovar lai str. 56601
ccgauaugauaagaaaauuuua

SEQ ID NO: 20555 - RNA, 22 nt, Leptospira interrogans serovar lai str. 56601
ccugaaguuuacaaacaucuag

SEQ ID NO: 20556 - RNA, 22 nt, Leptospira interrogans serovar lai str. 56601
ccuguaaauucggcguuucaau

SEQ ID NO: 20557 - RNA, 22 nt, Leptospira interrogans serovar lai str. 56601
ccuuuagaugguuuggguuuau

SEQ ID NO: 20558 - RNA, 19 nt, Leptospira interrogans serovar lai str. 56601
cgacuguuuauaauacucu

SEQ ID NO: 20559 - RNA, 22 nt, Leptospira interrogans serovar lai str. 56601
cgauuggaaaguuaaucgcuuc

SEQ ID NO: 20560 - RNA, 22 nt, Leptospira interrogans serovar lai str. 56601
cggaaauuaugaaagagaucau

SEQ ID NO: 20561 - RNA, 19 nt, Leptospira interrogans serovar lai str. 56601
cggauugagucuuuguauu

SEQ ID NO: 20562 - RNA, 20 nt, Leptospira interrogans serovar lai str. 56601
cgguaaagguuauguugucc

SEQ ID NO: 20563 - RNA, 22 nt, Leptospira interrogans serovar lai str. 56601
cguauagauugaucgguaaaaa

SEQ ID NO: 20564 - RNA, 22 nt, Leptospira interrogans serovar lai str. 56601
cuaaaguuuuuugccaauucau

SEQ ID NO: 20565 - RNA, 22 nt, Leptospira interrogans serovar lai str. 56601
cuaugaaaaggacgaauggaua

SEQ ID NO: 20566 - RNA, 22 nt, Leptospira interrogans serovar lai str. 56601
cucaagaacaaucuuuucuuaa

SEQ ID NO: 20567 - RNA, 22 nt, Leptospira interrogans serovar lai str. 56601
cucauacaaaaacuacaauguu

SEQ ID NO: 20568 - RNA, 22 nt, Leptospira interrogans serovar lai str. 56601
cucuagagcagccaaucucguu

SEQ ID NO: 20569 - RNA, 22 nt, Leptospira interrogans serovar lai str. 56601
cugcgucuauugcagaaugaga

SEQ ID NO: 20570 - RNA, 22 nt, Leptospira interrogans serovar lai str. 56601
cuggaauuccuuugguguagac

SEQ ID NO: 20571 - RNA, 22 nt, Leptospira interrogans serovar lai str. 56601
cuuauugaucuuagaagaaaga

SEQ ID NO: 20572 - RNA, 22 nt, Leptospira interrogans serovar lai str. 56601
cuuccauaggauuucuggaucg

SEQ ID NO: 20573 - RNA, 22 nt, Leptospira interrogans serovar lai str. 56601
cuucgggaagagucaguucuuu

SEQ ID NO: 20574 - RNA, 22 nt, Leptospira interrogans serovar lai str. 56601
cuucguauucuuuugagaauuu

SEQ ID NO: 20575 - RNA, 22 nt, Leptospira interrogans serovar lai str. 56601
cuucugaauuuuuagcaacuuc

SEQ ID NO: 20576 - RNA, 22 nt, Leptospira interrogans serovar lai str. 56601
cuugaguucucgaacggaaaau

SEQ ID NO: 20577 - RNA, 22 nt, Leptospira interrogans serovar lai str. 56601
cuuucgguuggccuuguagucu

SEQ ID NO: 20578 - RNA, 22 nt, Leptospira interrogans serovar lai str. 56601
gaaauacaauuuaccccugcua

SEQ ID NO: 20579 - RNA, 22 nt, Leptospira interrogans serovar lai str. 56601
gaaaucaggagaauauguuaua

SEQ ID NO: 20580 - RNA, 22 nt, Leptospira interrogans serovar lai str. 56601
gaaccagugacugacuuagauu

SEQ ID NO: 20581 - RNA, 22 nt, Leptospira interrogans serovar lai str. 56601
gaaccguuucuuguagacauga

SEQ ID NO: 20582 - RNA, 22 nt, Leptospira interrogans serovar lai str. 56601
gaagccaaugcaguccacgguu

SEQ ID NO: 20583 - RNA, 22 nt, Leptospira interrogans serovar lai str. 56601
gaauacaaggaaaauucuuugg

SEQ ID NO: 20584 - RNA, 22 nt, Leptospira interrogans serovar lai str. 56601
gaauagauucaaucgaaaguuc

SEQ ID NO: 20585 - RNA, 22 nt, Leptospira interrogans serovar lai str. 56601
gaaucuugagagaaauuuuacu

SEQ ID NO: 20586 - RNA, 22 nt, Leptospira interrogans serovar lai str. 56601
gaauuacguuugcaagugaaac

SEQ ID NO: 20587 - RNA, 22 nt, Leptospira interrogans serovar lai str. 56601
gacaaucauaccuacguagucg

SEQ ID NO: 20588 - RNA, 22 nt, Leptospira interrogans serovar lai str. 56601
gaccauggauucuacgaucgga

SEQ ID NO: 20589 - RNA, 22 nt, Leptospira interrogans serovar lai str. 56601
gacgauuuuaaaucccucauua

SEQ ID NO: 20590 - RNA, 22 nt, Leptospira interrogans serovar lai str. 56601
gacuuagaaugaacuauuuaaa

SEQ ID NO: 20591 - RNA, 22 nt, Leptospira interrogans serovar lai str. 56601
gagaauccaagaaucgguuuau

SEQ ID NO: 20592 - RNA, 22 nt, Leptospira interrogans serovar lai str. 56601
gagcucgacuaaaaucauccau

SEQ ID NO: 20593 - RNA, 22 nt, Leptospira interrogans serovar lai str. 56601
gaggaguuaaucauauaacuuu

SEQ ID NO: 20594 - RNA, 22 nt, Leptospira interrogans serovar lai str. 56601
gagugcaaaauacugaauaucu

SEQ ID NO: 20595 - RNA, 22 nt, Leptospira interrogans serovar lai str. 56601
gaguuggaaagacgaaaucgga

SEQ ID NO: 20596 - RNA, 22 nt, Leptospira interrogans serovar lai str. 56601
gaguuuccaccgaaccgugaga

SEQ ID NO: 20597 - RNA, 22 nt, Leptospira interrogans serovar lai str. 56601
gauacaaagauuacaauuucgu

SEQ ID NO: 20598 - RNA, 22 nt, Leptospira interrogans serovar lai str. 56601
gaucaauuugaauccgauuguu

SEQ ID NO: 20599 - RNA, 22 nt, Leptospira interrogans serovar lai str. 56601
gauccgaauuuggauacguuuc

SEQ ID NO: 20600 - RNA, 22 nt, Leptospira interrogans serovar lai str. 56601
gaugaacaaauugaauuuagga

SEQ ID NO: 20601 - RNA, 22 nt, Leptospira interrogans serovar lai str. 56601
gaugcagauucauauuuaaccu

SEQ ID NO: 20602 - RNA, 22 nt, Leptospira interrogans serovar lai str. 56601
gauggauuuagagcgcucuuac

SEQ ID NO: 20603 - RNA, 22 nt, Leptospira interrogans serovar lai str. 56601
gauucggaagguauuucacuuu

SEQ ID NO: 20604 - RNA, 19 nt, Leptospira interrogans serovar lai str. 56601
gccucuacuucuucugugg

SEQ ID NO: 20605 - RNA, 21 nt, Leptospira interrogans serovar lai str. 56601
gcgaauuucggaacggaccga

SEQ ID NO: 20606 - RNA, 22 nt, Leptospira interrogans serovar lai str. 56601
gcgggaacuaaguuuuacagaa

SEQ ID NO: 20607 - RNA, 22 nt, Leptospira interrogans serovar lai str. 56601
gcgguuccuauguuaguuagaa

SEQ ID NO: 20608 - RNA, 22 nt, Leptospira interrogans serovar lai str. 56601
gcguauuauuguuucgguuucu

SEQ ID NO: 20609 - RNA, 21 nt, Leptospira interrogans serovar lai str. 56601
gcugaguuuugugggucgcuc

SEQ ID NO: 20610 - RNA, 22 nt, Leptospira interrogans serovar lai str. 56601
gcuuggaggaaggcagguugga

SEQ ID NO: 20611 - RNA, 22 nt, Leptospira interrogans serovar lai str. 56601
uggaauuucacaauaacuugac

SEQ ID NO: 20612 - RNA, 22 nt, Leptospira interrogans serovar lai str. 56601
uggaauuuuacaauaacuugac

SEQ ID NO: 20613 - RNA, 22 nt, Leptospira interrogans serovar lai str. 56601
uggagaaugaaaucaagaauuu

SEQ ID NO: 20614 - RNA, 22 nt, Leptospira interrogans serovar lai str. 56601
uggauaaagcuucugaaauaga

SEQ ID NO: 20615 - RNA, 17 nt, Leptospira interrogans serovar lai str. 56601
ugggaacaaugcaaucc

SEQ ID NO: 20616 - RNA, 22 nt, Leptospira interrogans serovar lai str. 56601
ugggaaugaucuuauggguagg

SEQ ID NO: 20617 - RNA, 22 nt, Leptospira interrogans serovar lai str. 56601
ugggaauucuuuuaggauauaa

SEQ ID NO: 20618 - RNA, 22 nt, Leptospira interrogans serovar lai str. 56601
uguagaucgauucuuaaaaugu

SEQ ID NO: 20619 - RNA, 22 nt, Leptospira interrogans serovar lai str. 56601
ugugagaguucccacagauuaa

SEQ ID NO: 20620 - RNA, 22 nt, Listeria monocytogenes EGD-e
aaagcauuguuuagggcuuugu

SEQ ID NO: 20621 - RNA, 22 nt, Listeria monocytogenes EGD-e
aaagcguugauccgcaaaaccu

SEQ ID NO: 20622 - RNA, 22 nt, Listeria monocytogenes EGD-e
aaaucgcuuuuuccuauuuagc

SEQ ID NO: 20623 - RNA, 22 nt, Listeria monocytogenes EGD-e
aacagauagugggaaagcaggu

SEQ ID NO: 20624 - RNA, 22 nt, Listeria monocytogenes EGD-e
aacauucagucuccaagcucca

SEQ ID NO: 20625 - RNA, 22 nt, Listeria monocytogenes EGD-e
aacuagaacggauuuuagcaau

SEQ ID NO: 20626 - RNA, 22 nt, Listeria monocytogenes EGD-e
aaggaacugauuucacucgcaa

SEQ ID NO: 20627 - RNA, 22 nt, Listeria monocytogenes EGD-e
aaguaagcguggcguuuuuuag

SEQ ID NO: 20628 - RNA, 22 nt, Listeria monocytogenes EGD-e
acaugccaguuacggcagaagu

SEQ ID NO: 20629 - RNA, 22 nt, Listeria monocytogenes EGD-e
acauugaaacagcugcaaaaua

SEQ ID NO: 20630 - RNA, 21 nt, Listeria monocytogenes EGD-e
acgaaugaaguuaaugcuuca

SEQ ID NO: 20631 - RNA, 22 nt, Listeria monocytogenes EGD-e
acgagugacagaaauuauuacg

SEQ ID NO: 20632 - RNA, 20 nt, Listeria monocytogenes EGD-e
acgugcuuuguucguuauuu

SEQ ID NO: 20633 - RNA, 22 nt, Listeria monocytogenes EGD-e
agauuugaagggcaugagcauu

SEQ ID NO: 20634 - RNA, 22 nt, Listeria monocytogenes EGD-e
agcauauuaggcgcagaauuau

SEQ ID NO: 20635 - RNA, 22 nt, Listeria monocytogenes EGD-e
agccgaguuguucaucgacgcg

SEQ ID NO: 20636 - RNA, 22 nt, Listeria monocytogenes EGD-e
agcggauuuucgaaacgaugga

SEQ ID NO: 20637 - RNA, 20 nt, Listeria monocytogenes EGD-e
agcugcugccgauuuuguug

SEQ ID NO: 20638 - RNA, 22 nt, Listeria monocytogenes EGD-e
aguaagauguuacuggguaagg

SEQ ID NO: 20639 - RNA, 22 nt, Listeria monocytogenes EGD-e
aguagaugccguucuuaucgcg

SEQ ID NO: 20640 - RNA, 22 nt, Listeria monocytogenes EGD-e
aguaggugcuaaaguauacuua

SEQ ID NO: 20641 - RNA, 22 nt, Listeria monocytogenes EGD-e
aguaucaaaaaagugcgaggaa

SEQ ID NO: 20642 - RNA, 22 nt, Listeria monocytogenes EGD-e
aguccgcugcguguuuuuauua

SEQ ID NO: 20643 - RNA, 22 nt, Listeria monocytogenes EGD-e
aucaucuggauuaacaagcacu

SEQ ID NO: 20644 - RNA, 21 nt, Listeria monocytogenes EGD-e
aucggguguuucaaguucuaa

SEQ ID NO: 20645 - RNA, 22 nt, Listeria monocytogenes EGD-e
auggaugcacguuuuuuaugca

SEQ ID NO: 20646 - RNA, 22 nt, Listeria monocytogenes EGD-e
auggcagaagggcacaugacaa

SEQ ID NO: 20647 - RNA, 22 nt, Listeria monocytogenes EGD-e
auucacuuaguacacugauuua

SEQ ID NO: 20648 - RNA, 22 nt, Listeria monocytogenes EGD-e
auucauugcccaugauuuauca

SEQ ID NO: 20649 - RNA, 22 nt, Listeria monocytogenes EGD-e
auugaagcaggaacauuuauga

SEQ ID NO: 20650 - RNA, 22 nt, Listeria monocytogenes EGD-e
auuucuugaacggcauuuguau

SEQ ID NO: 20651 - RNA, 22 nt, Listeria monocytogenes EGD-e
caaauuguaucaaguuauucca

SEQ ID NO: 20652 - RNA, 22 nt, Listeria monocytogenes EGD-e
caaguaaagcgcgauacuuucu

SEQ ID NO: 20653 - RNA, 22 nt, Listeria monocytogenes EGD-e
caaguagcuaacuguauuugau

SEQ ID NO: 20654 - RNA, 22 nt, Listeria monocytogenes EGD-e
caggaacuucgagugcaauucc

SEQ ID NO: 20655 - RNA, 22 nt, Listeria monocytogenes EGD-e
ccaagauucccuugcaacaagu

SEQ ID NO: 20656 - RNA, 22 nt, Listeria monocytogenes EGD-e
uuaucggaaauacuuauuuaaa

SEQ ID NO: 20657 - RNA, 22 nt, Listeria monocytogenes EGD-e
uucaauagcaauuuuacggcuu

SEQ ID NO: 20658 - RNA, 22 nt, Listeria monocytogenes EGD-e
uucgauuacgcaugauuuggau

SEQ ID NO: 20659 - RNA, 22 nt, Listeria monocytogenes EGD-e
uucguauuuuaccuggagauaa

SEQ ID NO: 20660 - RNA, 22 nt, Listeria monocytogenes EGD-e
uugaagcgguaaacgagucuga

SEQ ID NO: 20661 - RNA, 21 nt, Listeria monocytogenes EGD-e
uugaaguuccuugcggcgguu

SEQ ID NO: 20662 - RNA, 22 nt, Listeria monocytogenes EGD-e
uugaucgacgccguuugagcgu

SEQ ID NO: 20663 - RNA, 22 nt, Listeria monocytogenes EGD-e
uugcacaucguacaguuuucag

SEQ ID NO: 20664 - RNA, 22 nt, Listeria monocytogenes EGD-e
uugcucaucggcaacgauaaca

SEQ ID NO: 20665 - RNA, 22 nt, Listeria monocytogenes EGD-e
uugucgcaugcauuuucauucc

SEQ ID NO: 20666 - RNA, 22 nt, Listeria monocytogenes EGD-e
uuuggaaauaacaacuacuuaa

SEQ ID NO: 20667 - RNA, 22 nt, Listeria monocytogenes EGD-e
aaagugauugcgaguggcuuuu

SEQ ID NO: 20668 - RNA, 22 nt, Listeria monocytogenes EGD-e
aacagucacagcuucaauaugu

SEQ ID NO: 20669 - RNA, 22 nt, Listeria monocytogenes EGD-e
aacaugugaaaaauuccuuugc

SEQ ID NO: 20670 - RNA, 22 nt, Listeria monocytogenes EGD-e
aacauuuccaucgacgggaaaa

SEQ ID NO: 20671 - RNA, 22 nt, Listeria monocytogenes EGD-e
aagcagugguuuuauauggugc

SEQ ID NO: 20672 - RNA, 22 nt, Listeria monocytogenes EGD-e
aagcgcacgagauguagaagca

SEQ ID NO: 20673 - RNA, 22 nt, Listeria monocytogenes EGD-e
aagcuauucucaagugcggcga

SEQ ID NO: 20674 - RNA, 22 nt, Listeria monocytogenes EGD-e
aaguagauccagaaaucuugga

SEQ ID NO: 20675 - RNA, 22 nt, Listeria monocytogenes EGD-e
aaguccguaguuagaaacaucu

SEQ ID NO: 20676 - RNA, 22 nt, Listeria monocytogenes EGD-e
aagugcuucuguuacauauuca

SEQ ID NO: 20677 - RNA, 22 nt, Listeria monocytogenes EGD-e
aaguuuccguugaauaaugugg

SEQ ID NO: 20678 - RNA, 22 nt, Listeria monocytogenes EGD-e
aaucgguucuaucguuuaguga

SEQ ID NO: 20679 - RNA, 22 nt, Listeria monocytogenes EGD-e
aaugugauacgcuuauuaugga

SEQ ID NO: 20680 - RNA, 22 nt, Listeria monocytogenes EGD-e
acaaaugacuauccaguuauua

SEQ ID NO: 20681 - RNA, 22 nt, Listeria monocytogenes EGD-e
acaauuucuucgcgcucaaaaa

SEQ ID NO: 20682 - RNA, 22 nt, Listeria monocytogenes EGD-e
accgauuuaauauucggauuua

SEQ ID NO: 20683 - RNA, 22 nt, Listeria monocytogenes EGD-e
accgcaguuauaguaucugcac

SEQ ID NO: 20684 - RNA, 21 nt, Listeria monocytogenes EGD-e
acgauuuacuugaauagauug

SEQ ID NO: 20685 - RNA, 20 nt, Listeria monocytogenes EGD-e
acuaguuaugauuuuggagu

SEQ ID NO: 20686 - RNA, 22 nt, Listeria monocytogenes EGD-e
acuauucucgcaaccagcuuuu

SEQ ID NO: 20687 - RNA, 22 nt, Listeria monocytogenes EGD-e
acuuaguuacaggaaacaacaa

SEQ ID NO: 20688 - RNA, 20 nt, Listeria monocytogenes EGD-e
agaaaucaaaaagcacuugc

SEQ ID NO: 20689 - RNA, 22 nt, Listeria monocytogenes EGD-e
agaugcuuuaguugcgauggau

SEQ ID NO: 20690 - RNA, 22 nt, Listeria monocytogenes EGD-e
agcaagcaugugaaaggaagua

SEQ ID NO: 20691 - RNA, 22 nt, Listeria monocytogenes EGD-e
agcaagcauuuugucaaaguca

SEQ ID NO: 20692 - RNA, 22 nt, Listeria monocytogenes EGD-e
agcagaugcuacuuuugauccg

SEQ ID NO: 20693 - RNA, 22 nt, Listeria monocytogenes EGD-e
agcaguauauuguuuacgaucu

SEQ ID NO: 20694 - RNA, 22 nt, Listeria monocytogenes EGD-e
agcauauugacgcuaucguuug

SEQ ID NO: 20695 - RNA, 22 nt, Listeria monocytogenes EGD-e
agcgcaauagguugaauauuag

SEQ ID NO: 20696 - RNA, 22 nt, Listeria monocytogenes EGD-e
agucguucauauugaucaagag

SEQ ID NO: 20697 - RNA, 22 nt, Listeria monocytogenes EGD-e
auaaacgaacggaacaaauucu

SEQ ID NO: 20698 - RNA, 22 nt, Listeria monocytogenes EGD-e
auacauuguagcuaaggcgacu

SEQ ID NO: 20699 - RNA, 22 nt, Listeria monocytogenes EGD-e
auauucgccguaucaaagaaau

SEQ ID NO: 20700 - RNA, 22 nt, Listeria monocytogenes EGD-e
augauuugcguuauuuguuaga

SEQ ID NO: 20701 - RNA, 22 nt, Listeria monocytogenes EGD-e
augcauuaagucaaacaaauau

SEQ ID NO: 20702 - RNA, 22 nt, Listeria monocytogenes EGD-e
auguaacagagcgccaguugug

SEQ ID NO: 20703 - RNA, 22 nt, Listeria monocytogenes EGD-e
auguugacuuuaaagauguuua

SEQ ID NO: 20704 - RNA, 22 nt, Listeria monocytogenes EGD-e
auucgccuucuucaauagcuuu

SEQ ID NO: 20705 - RNA, 22 nt, Listeria monocytogenes EGD-e
cacuuauccaagcagaagaugg

SEQ ID NO: 20706 - RNA, 22 nt, Listeria monocytogenes EGD-e
cagucgauaugggugaugaaug

SEQ ID NO: 20707 - RNA, 22 nt, Listeria monocytogenes EGD-e
cauuauguuuggcgugaaagaa

SEQ ID NO: 20708 - RNA, 22 nt, Listeria monocytogenes EGD-e
ccaucacuuauagcuaugaugg

SEQ ID NO: 20709 - RNA, 22 nt, Listeria monocytogenes EGD-e
ccugaaauuguugacuuggcaa

SEQ ID NO: 20710 - RNA, 22 nt, Listeria monocytogenes EGD-e
cgagcuuguguacgggaaagca

SEQ ID NO: 20711 - RNA, 22 nt, Listeria monocytogenes EGD-e
cgcgaaaucauucucuggcauu

SEQ ID NO: 20712 - RNA, 22 nt, Listeria monocytogenes EGD-e
cgugaaaguaggauuuucaagu

SEQ ID NO: 20713 - RNA, 19 nt, Listeria monocytogenes EGD-e
cuaacggagguguuucuau

SEQ ID NO: 20714 - RNA, 22 nt, Listeria monocytogenes EGD-e
cuaggaaugauugcauuguuua

SEQ ID NO: 20715 - RNA, 22 nt, Listeria monocytogenes EGD-e
cuauuacagaaaaaguaauucc

SEQ ID NO: 20716 - RNA, 22 nt, Listeria monocytogenes EGD-e
cugguauugguagucaauucgu

SEQ ID NO: 20717 - RNA, 22 nt, Listeria monocytogenes EGD-e
cuguuaaaacugcauuuugaac

SEQ ID NO: 20718 - RNA, 22 nt, Listeria monocytogenes EGD-e
cuuguauaagaaaacaaaucau

SEQ ID NO: 20719 - RNA, 22 nt, Listeria monocytogenes EGD-e
gaacuuugggaguugaaagaag

SEQ ID NO: 20720 - RNA, 22 nt, Listeria monocytogenes EGD-e
gaagucaagccuuggauuuaga

SEQ ID NO: 20721 - RNA, 20 nt, Listeria monocytogenes EGD-e
gcgacaagauuuaucuaacg

SEQ ID NO: 20722 - RNA, 18 nt, Listeria monocytogenes EGD-e
ggcaacuuuccuuguuua

SEQ ID NO: 20723 - RNA, 22 nt, Listeria monocytogenes EGD-e
gguagcuguuucacucguuugg

SEQ ID NO: 20724 - RNA, 22 nt, Listeria monocytogenes EGD-e
guaucguuauccaauuugauuu

SEQ ID NO: 20725 - RNA, 18 nt, Listeria monocytogenes EGD-e
guggaacacggcauuuau

SEQ ID NO: 20726 - RNA, 22 nt, Listeria monocytogenes EGD-e
guuucauuuggucgucgcuuag

SEQ ID NO: 20727 - RNA, 22 nt, Listeria monocytogenes EGD-e
uaaaguugaagcaauuuaugga

SEQ ID NO: 20728 - RNA, 23 nt, Listeria monocytogenes EGD-e
uaaauggcuguuuuuucacgccu

SEQ ID NO: 20729 - RNA, 22 nt, Listeria monocytogenes EGD-e
uaauggaaaacggaaaaguugu

SEQ ID NO: 20730 - RNA, 23 nt, Listeria monocytogenes EGD-e
uacaucugggugauuauguaaug

SEQ ID NO: 20731 - RNA, 22 nt, Listeria monocytogenes EGD-e
uacuaacuauuacuuaugauga

SEQ ID NO: 20732 - RNA, 22 nt, Listeria monocytogenes EGD-e
uagaaguagcucuugaaaagau

SEQ ID NO: 20733 - RNA, 22 nt, Listeria monocytogenes EGD-e
uagccguuugagagagccuuca

SEQ ID NO: 20734 - RNA, 22 nt, Listeria monocytogenes EGD-e
uaguaacaguucuaucuugaug

SEQ ID NO: 20735 - RNA, 22 nt, Listeria monocytogenes EGD-e
uagugacagaagcuggauuugg

SEQ ID NO: 20736 - RNA, 22 nt, Listeria monocytogenes EGD-e
uaucacuuagacgaaucgcuaa

SEQ ID NO: 20737 - RNA, 22 nt, Listeria monocytogenes EGD-e
uaucguuacacaugaucacacu

SEQ ID NO: 20738 - RNA, 22 nt, Listeria monocytogenes EGD-e
uauuugaccgguauuauuuuga

SEQ ID NO: 20739 - RNA, 22 nt, Listeria monocytogenes EGD-e
uauuugcaggagaaaucagcgg

SEQ ID NO: 20740 - RNA, 22 nt, Listeria monocytogenes EGD-e
ucccauguaaccaguuuuuacg

SEQ ID NO: 20741 - RNA, 22 nt, Listeria monocytogenes EGD-e
ucgcuugaauuaauuuuucgcc

SEQ ID NO: 20742 - RNA, 21 nt, Listeria monocytogenes EGD-e
ucugauacaucuuguauuucu

SEQ ID NO: 20743 - RNA, 22 nt, Listeria monocytogenes EGD-e
ugaacgcaaaaauuaguugcgu

SEQ ID NO: 20744 - RNA, 22 nt, Listeria monocytogenes EGD-e
ugaaguguuacuggauucugua

SEQ ID NO: 20745 - RNA, 22 nt, Listeria monocytogenes EGD-e
ugauuacuauagcuuuacagaa

SEQ ID NO: 20746 - RNA, 22 nt, Listeria monocytogenes EGD-e
uggcagauuuucaccguguaaa

SEQ ID NO: 20747 - RNA, 18 nt, Listeria monocytogenes EGD-e
ugggauagauacuucggu

SEQ ID NO: 20748 - RNA, 22 nt, Listeria monocytogenes EGD-e
uggugaauaagcauaucauuaa

SEQ ID NO: 20749 - RNA, 22 nt, Listeria monocytogenes EGD-e
ugguuauauugaagcaacugcu

SEQ ID NO: 20750 - RNA, 22 nt, Listeria monocytogenes EGD-e
uguagcuuuuagaaguauuagc

SEQ ID NO: 20751 - RNA, 22 nt, Listeria monocytogenes EGD-e
ugucgguauuagguggaauuua

SEQ ID NO: 20752 - RNA, 22 nt, Listeria monocytogenes EGD-e
ugugcauuccuugugaaauguu

SEQ ID NO: 20753 - RNA, 22 nt, Listeria monocytogenes EGD-e
uuacugguggaaauguuuuaau

SEQ ID NO: 20754 - RNA, 21 nt, Listeria monocytogenes EGD-e
uuagaagugaagcgucugacu

SEQ ID NO: 20755 - RNA, 20 nt, Listeria monocytogenes EGD-e
uucaauggcauuacguaaug

SEQ ID NO: 20756 - RNA, 22 nt, Listeria monocytogenes EGD-e
uucgccuaaguguuauaauuua

SEQ ID NO: 20757 - RNA, 22 nt, Listeria monocytogenes EGD-e
uucgcuuaugaaaugauagaca

SEQ ID NO: 20758 - RNA, 22 nt, Listeria monocytogenes EGD-e
uugagagcaucccauccauccu

SEQ ID NO: 20759 - RNA, 22 nt, Listeria monocytogenes EGD-e
uuggaaguauuacgauugauuc

SEQ ID NO: 20760 - RNA, 22 nt, Listeria monocytogenes EGD-e
uuggucaugcauauauuuauaa

SEQ ID NO: 20761 - RNA, 22 nt, Listeria monocytogenes EGD-e
uuguucaauuguuucgauaauu

SEQ ID NO: 20762 - RNA, 22 nt, Listeria monocytogenes EGD-e
uuguuucagaguuaccaugguc

SEQ ID NO: 20763 - RNA, 22 nt, Listeria monocytogenes EGD-e
uuugaacuuugcuuguccggaa

SEQ ID NO: 20764 - RNA, 22 nt, Listeria monocytogenes EGD-e
uuugaugaagcaagugcucguu

SEQ ID NO: 20765 - RNA, 22 nt, Listeria monocytogenes EGD-e
uuuggaaaguaaaguucggagg

SEQ ID NO: 20766 - RNA, 22 nt, Listeria monocytogenes EGD-e
cggauaacuuuuauaguaguaa

SEQ ID NO: 20767 - RNA, 22 nt, Listeria monocytogenes EGD-e
cgugaugagucuauguuguuug

SEQ ID NO: 20768 - RNA, 22 nt, Listeria monocytogenes EGD-e
cuaguagcuuauucucuaaagu

SEQ ID NO: 20769 - RNA, 22 nt, Listeria monocytogenes EGD-e
cugaaagugauuuuuggacuug

SEQ ID NO: 20770 - RNA, 22 nt, Listeria monocytogenes EGD-e
cuggaauuuuugaugugguuaa

SEQ ID NO: 20771 - RNA, 22 nt, Listeria monocytogenes EGD-e
gaaauguuaggauuaucucuua

SEQ ID NO: 20772 - RNA, 22 nt, Listeria monocytogenes EGD-e
gaaguuguguaguaugaaauuu

SEQ ID NO: 20773 - RNA, 22 nt, Listeria monocytogenes EGD-e
gacaaguacagcacuucgacua

SEQ ID NO: 20774 - RNA, 22 nt, Listeria monocytogenes EGD-e
gcauauggagguauuggauuug

SEQ ID NO: 20775 - RNA, 22 nt, Listeria monocytogenes EGD-e
gccaaacgaauccgauuuuagu

SEQ ID NO: 20776 - RNA, 22 nt, Listeria monocytogenes EGD-e
gccaauuaauaaauuuguugcu

SEQ ID NO: 20777 - RNA, 20 nt, Listeria monocytogenes EGD-e
gccauauucguaauacaaga

SEQ ID NO: 20778 - RNA, 22 nt, Listeria monocytogenes EGD-e
gcggaauuuuugguggaaguga

SEQ ID NO: 20779 - RNA, 19 nt, Listeria monocytogenes EGD-e
gcuauucgaggaggugaug

SEQ ID NO: 20780 - RNA, 22 nt, Listeria monocytogenes EGD-e
ggaaugcuuuuauugaauuaaa

SEQ ID NO: 20781 - RNA, 22 nt, Listeria monocytogenes EGD-e
ggacuauuaaucacuucaucaa

SEQ ID NO: 20782 - RNA, 22 nt, Listeria monocytogenes EGD-e
guagaacagaaugcaaguaaaa

SEQ ID NO: 20783 - RNA, 22 nt, Listeria monocytogenes EGD-e
guauacauuaguagcaaauuua

SEQ ID NO: 20784 - RNA, 22 nt, Listeria monocytogenes EGD-e
guucuuaugaaauucuuaccug

SEQ ID NO: 20785 - RNA, 22 nt, Listeria monocytogenes EGD-e
uaagacaagggaaugucacguu

SEQ ID NO: 20786 - RNA, 23 nt, Listeria monocytogenes EGD-e
uaagaguaaguuuuaauaauucc

SEQ ID NO: 20787 - RNA, 22 nt, Listeria monocytogenes EGD-e
uacaacuggcuuucgguauaua

SEQ ID NO: 20788 - RNA, 22 nt, Listeria monocytogenes EGD-e
uagaaacacuacaaaaagcuau

SEQ ID NO: 20789 - RNA, 22 nt, Listeria monocytogenes EGD-e
uaggauuuucuuaugaaauuca

SEQ ID NO: 20790 - RNA, 22 nt, Listeria monocytogenes EGD-e
uagugcuugguauugcuuugau

SEQ ID NO: 20791 - RNA, 22 nt, Listeria monocytogenes EGD-e
uaguucuuaugccaauguaucu

SEQ ID NO: 20792 - RNA, 22 nt, Listeria monocytogenes EGD-e
uaucauuguacuuuuagucgug

SEQ ID NO: 20793 - RNA, 22 nt, Listeria monocytogenes EGD-e
uauccauugguuuacuucucua

SEQ ID NO: 20794 - RNA, 22 nt, Listeria monocytogenes EGD-e
uaucgggacauguuauugggaa

SEQ ID NO: 20795 - RNA, 22 nt, Listeria monocytogenes EGD-e
ucaagggauaguuuuuuaguaa

SEQ ID NO: 20796 - RNA, 22 nt, Listeria monocytogenes EGD-e
ucauaaugcccuuugacaaaau

SEQ ID NO: 20797 - RNA, 21 nt, Listeria monocytogenes EGD-e
ucgguauuugauuguugcgcu

SEQ ID NO: 20798 - RNA, 22 nt, Listeria monocytogenes EGD-e
ucuggaaugacaggaagaccug

SEQ ID NO: 20799 - RNA, 22 nt, Listeria monocytogenes EGD-e
ucuggcauuaguuccaaacgaa

SEQ ID NO: 20800 - RNA, 22 nt, Listeria monocytogenes EGD-e
ugaaccugcuuguaguugauua

SEQ ID NO: 20801 - RNA, 22 nt, Listeria monocytogenes EGD-e
ugaguuagauuggauggaaggu

SEQ ID NO: 20802 - RNA, 19 nt, Listeria monocytogenes EGD-e
ugcuagcuucuugauuuua

SEQ ID NO: 20803 - RNA, 22 nt, Listeria monocytogenes EGD-e
ugcuuuaucgcagauugaaauu

SEQ ID NO: 20804 - RNA, 20 nt, Listeria monocytogenes EGD-e
ugguagaauaggauuugugg

SEQ ID NO: 20805 - RNA, 22 nt, Listeria monocytogenes EGD-e
ugucccagcugaacgaacaucu

SEQ ID NO: 20806 - RNA, 22 nt, Listeria monocytogenes EGD-e
ugugcgaaaaauaaauuggcgg

SEQ ID NO: 20807 - RNA, 22 nt, Listeria monocytogenes EGD-e
uguuagaagaaaaauucgguga

SEQ ID NO: 20808 - RNA, 22 nt, Listeria monocytogenes EGD-e
uuacaagucuuuuucuauuaau

SEQ ID NO: 20809 - RNA, 22 nt, Listeria monocytogenes EGD-e
uuacaggaauuagaauccagaa

SEQ ID NO: 20810 - RNA, 22 nt, Listeria monocytogenes EGD-e
uuacugucagaccauucuuuga

SEQ ID NO: 20811 - RNA, 22 nt, Listeria monocytogenes EGD-e
uuaguugaauuagaggacuuag

SEQ ID NO: 20812 - RNA, 23 nt, Mycobacterium avium subsp. paratuberculosis
aaggcggcaccgaucaccgcggc

SEQ ID NO: 20813 - RNA, 22 nt, Mycobacterium avium subsp. paratuberculosis
aaguccgggcuguaguacugau

SEQ ID NO: 20814 - RNA, 22 nt, Mycobacterium avium subsp. paratuberculosis
aaguucgggucgcgggcgucca

SEQ ID NO: 20815 - RNA, 22 nt, Mycobacterium avium subsp. paratuberculosis
aauccggacgucaugcccaugc

SEQ ID NO: 20816 - RNA, 22 nt, Mycobacterium avium subsp. paratuberculosis
aaucgccagaaggccguucugc

SEQ ID NO: 20817 - RNA, 22 nt, Mycobacterium avium subsp. paratuberculosis
aaucgcgcaauagagucgacgu

SEQ ID NO: 20818 - RNA, 22 nt, Mycobacterium avium subsp. paratuberculosis
aaucgugcucggugagccacga

SEQ ID NO: 20819 - RNA, 22 nt, Mycobacterium avium subsp. paratuberculosis
aauuggugacgacggcgcucaa

SEQ ID NO: 20820 - RNA, 22 nt, Mycobacterium avium subsp. paratuberculosis
acagccggugaccccgguggug

SEQ ID NO: 20821 - RNA, 22 nt, Mycobacterium avium subsp. paratuberculosis
acagcuggcccuugugcagcuc

SEQ ID NO: 20822 - RNA, 22 nt, Mycobacterium avium subsp. paratuberculosis
acagguucgacgugcccgcggc

SEQ ID NO: 20823 - RNA, 22 nt, Mycobacterium avium subsp. paratuberculosis
acaucaccgucgccgggcggau

SEQ ID NO: 20824 - RNA, 22 nt, Mycobacterium avium subsp. paratuberculosis
acaugcgugcgcgaggaggcgu

SEQ ID NO: 20825 - RNA, 18 nt, Mycobacterium avium subsp. paratuberculosis
accacccaggagaucguc

SEQ ID NO: 20826 - RNA, 22 nt, Mycobacterium avium subsp. paratuberculosis
accaccgcucggugucgaucgg

SEQ ID NO: 20827 - RNA, 22 nt, Mycobacterium avium subsp. paratuberculosis
accacgaggaccagcgucgcga

SEQ ID NO: 20828 - RNA, 19 nt, Mycobacterium avium subsp. paratuberculosis
accagauggaucggaugcg

SEQ ID NO: 20829 - RNA, 22 nt, Mycobacterium avium subsp. paratuberculosis
accagcaguaugggcgccgguu

SEQ ID NO: 20830 - RNA, 22 nt, Mycobacterium avium subsp. paratuberculosis
accagcuugggcagcagcgcgc

SEQ ID NO: 20831 - RNA, 20 nt, Mycobacterium avium subsp. paratuberculosis
accaggacgcgcucgcgguc

SEQ ID NO: 20832 - RNA, 21 nt, Mycobacterium avium subsp. paratuberculosis
accaggucggucagcgagcuc

SEQ ID NO: 20833 - RNA, 22 nt, Mycobacterium avium subsp. paratuberculosis
accaucgcgaugucggugacgc

SEQ ID NO: 20834 - RNA, 22 nt, Mycobacterium avium subsp. paratuberculosis
acccccgacgaguugauccugu

SEQ ID NO: 20835 - RNA, 22 nt, Mycobacterium avium subsp. paratuberculosis
acccgacgcagguggucggauu

SEQ ID NO: 20836 - RNA, 22 nt, Mycobacterium avium subsp. paratuberculosis
acccgcagcggacggguggugc

SEQ ID NO: 20837 - RNA, 22 nt, Mycobacterium avium subsp. paratuberculosis
acccggcaaacgauggugcgcc

SEQ ID NO: 20838 - RNA, 22 nt, Mycobacterium avium subsp. paratuberculosis
acccggcgucacgccagcgugg

SEQ ID NO: 20839 - RNA, 22 nt, Mycobacterium avium subsp. paratuberculosis
acccggcugaucgcgucggugg

SEQ ID NO: 20840 - RNA, 22 nt, Mycobacterium avium subsp. paratuberculosis
acccggcuggcgaccugggugg

SEQ ID NO: 20841 - RNA, 22 nt, Mycobacterium avium subsp. paratuberculosis
acccggcugggcgccuacgcgc

SEQ ID NO: 20842 - RNA, 22 nt, Mycobacterium avium subsp. paratuberculosis
accgaacgugcacucacgguga

SEQ ID NO: 20843 - RNA, 22 nt, Mycobacterium avium subsp. paratuberculosis
accgacgccgcgaucggcgaca

SEQ ID NO: 20844 - RNA, 22 nt, Mycobacterium avium subsp. paratuberculosis
accgacgccgcggugugcgcca

SEQ ID NO: 20845 - RNA, 22 nt, Mycobacterium avium subsp. paratuberculosis
accgccguggacgugcucgacu

SEQ ID NO: 20846 - RNA, 20 nt, Mycobacterium avium subsp. paratuberculosis
accgccuucuggaagaccug

SEQ ID NO: 20847 - RNA, 22 nt, Mycobacterium avium subsp. paratuberculosis
accgcgacgccgagcccacgug

SEQ ID NO: 20848 - RNA, 22 nt, Mycobacterium avium subsp. paratuberculosis
accgcgagcagacgcaaaaacc

SEQ ID NO: 20849 - RNA, 22 nt, Mycobacterium avium subsp. paratuberculosis
accgcgcgguucgugugcccgu

SEQ ID NO: 20850 - RNA, 22 nt, Mycobacterium avium subsp. paratuberculosis
accgcggcgccuugaccaccac

SEQ ID NO: 20851 - RNA, 22 nt, Mycobacterium avium subsp. paratuberculosis
accggaaucgcugcgugaccgg

SEQ ID NO: 20852 - RNA, 22 nt, Mycobacterium avium subsp. paratuberculosis
accggcaucaccacggcgaugg

SEQ ID NO: 20853 - RNA, 22 nt, Mycobacterium avium subsp. paratuberculosis
accggcgacgagcagcccggca

SEQ ID NO: 20854 - RNA, 22 nt, Mycobacterium avium subsp. paratuberculosis
accggcgcgggcuggugagcga

SEQ ID NO: 20855 - RNA, 22 nt, Mycobacterium avium subsp. paratuberculosis
accggcgucacgaucgggacga

SEQ ID NO: 20856 - RNA, 22 nt, Mycobacterium avium subsp. paratuberculosis
accggcguugccgcccauauca

SEQ ID NO: 20857 - RNA, 22 nt, Mycobacterium avium subsp. paratuberculosis
accgggcacgggucgccgccac

SEQ ID NO: 20858 - RNA, 22 nt, Mycobacterium avium subsp. paratuberculosis
accggggccaagaccgucaguc

SEQ ID NO: 20859 - RNA, 22 nt, Mycobacterium avium subsp. paratuberculosis
accggugagccgggaauggcga

SEQ ID NO: 20860 - RNA, 22 nt, Mycobacterium avium subsp. paratuberculosis
accgucacaugggcccggcuuc

SEQ ID NO: 20861 - RNA, 22 nt, Mycobacterium avium subsp. paratuberculosis
accgucgaguacgccaucggca

SEQ ID NO: 20862 - RNA, 22 nt, Mycobacterium avium subsp. paratuberculosis
accgucucugucgccgguuccu

SEQ ID NO: 20863 - RNA, 22 nt, Mycobacterium avium subsp. paratuberculosis
accgugaagcuaacuucacgcu

SEQ ID NO: 20864 - RNA, 22 nt, Mycobacterium avium subsp. paratuberculosis
accucgauggugagccgggugg

SEQ ID NO: 20865 - RNA, 20 nt, Mycobacterium avium subsp. paratuberculosis
accugcacgcuguccgcgug

SEQ ID NO: 20866 - RNA, 22 nt, Mycobacterium avium subsp. paratuberculosis
accugcacuucucgcugcugcc

SEQ ID NO: 20867 - RNA, 22 nt, Mycobacterium avium subsp. paratuberculosis
accugcccggcagugucgacga

SEQ ID NO: 20868 - RNA, 20 nt, Mycobacterium avium subsp. paratuberculosis
acgacgcguacaucagcgcg

SEQ ID NO: 20869 - RNA, 22 nt, Mycobacterium avium subsp. paratuberculosis
acgagcgagggccaggcgcgcu

SEQ ID NO: 20870 - RNA, 22 nt, Mycobacterium avium subsp. paratuberculosis
acgagguugucgcugugaggcg

SEQ ID NO: 20871 - RNA, 22 nt, Mycobacterium avium subsp. paratuberculosis
acgaucacccaccugggugccg

SEQ ID NO: 20872 - RNA, 22 nt, Mycobacterium avium subsp. paratuberculosis
acgaucgacggggugcgggugc

SEQ ID NO: 20873 - RNA, 22 nt, Mycobacterium avium subsp. paratuberculosis
acgauggcgaucacccagcgcc

SEQ ID NO: 20874 - RNA, 22 nt, Mycobacterium avium subsp. paratuberculosis
acgauggcguccccaccggccc

SEQ ID NO: 20875 - RNA, 22 nt, Mycobacterium avium subsp. paratuberculosis
acgaugucgaacgaugaguccg

SEQ ID NO: 20876 - RNA, 22 nt, Mycobacterium avium subsp. paratuberculosis
acgaugugcuugcgguccgcgc

SEQ ID NO: 20877 - RNA, 22 nt, Mycobacterium avium subsp. paratuberculosis
acgcccuugauccgccugagau

SEQ ID NO: 20878 - RNA, 22 nt, Mycobacterium avium subsp. paratuberculosis
acgccgacgagaacuagcgcgc

SEQ ID NO: 20879 - RNA, 22 nt, Mycobacterium avium subsp. paratuberculosis
acgccgagcugcugucgcugcu

SEQ ID NO: 20880 - RNA, 22 nt, Mycobacterium avium subsp. paratuberculosis
acgcgaaagugcaacugccgac

SEQ ID NO: 20881 - RNA, 22 nt, Mycobacterium avium subsp. paratuberculosis
acgcgcguaaccccacggcgaa

SEQ ID NO: 20882 - RNA, 22 nt, Mycobacterium avium subsp. paratuberculosis
acgcgcuccuucucguaggcgg

SEQ ID NO: 20883 - RNA, 22 nt, Mycobacterium avium subsp. paratuberculosis
acgcugggcgccaccgcgcugg

SEQ ID NO: 20884 - RNA, 21 nt, Mycobacterium avium subsp. paratuberculosis
acggaagcggugauggcgucg

SEQ ID NO: 20885 - RNA, 22 nt, Mycobacterium avium subsp. paratuberculosis
acggcgaccauccacucgggcc

SEQ ID NO: 20886 - RNA, 22 nt, Mycobacterium avium subsp. paratuberculosis
acggcgcccgggccagcaguug

SEQ ID NO: 20887 - RNA, 22 nt, Mycobacterium avium subsp. paratuberculosis
acggcggugcugacggcgacgc

SEQ ID NO: 20888 - RNA, 22 nt, Mycobacterium avium subsp. paratuberculosis
acggcugguucccgacgcgcga

SEQ ID NO: 20889 - RNA, 22 nt, Mycobacterium avium subsp. paratuberculosis
acgggcgcgccgguugauuccg

SEQ ID NO: 20890 - RNA, 22 nt, Mycobacterium avium subsp. paratuberculosis
acgggcugaucgugucgaugcg

SEQ ID NO: 20891 - RNA, 22 nt, Mycobacterium avium subsp. paratuberculosis
acguagcuggggaucugcucgc

SEQ ID NO: 20892 - RNA, 22 nt, Mycobacterium avium subsp. paratuberculosis
acguccaucaccaugucggcgu

SEQ ID NO: 20893 - RNA, 22 nt, Mycobacterium avium subsp. paratuberculosis
acgucgaccagcagcgcggugg

SEQ ID NO: 20894 - RNA, 21 nt, Mycobacterium avium subsp. paratuberculosis
acgucgacccggccgaucggc

SEQ ID NO: 20895 - RNA, 19 nt, Mycobacterium avium subsp. paratuberculosis
acgucggccgaccguucgg

SEQ ID NO: 20896 - RNA, 22 nt, Mycobacterium avium subsp. paratuberculosis
acgucggcggguucagcggucg

SEQ ID NO: 20897 - RNA, 22 nt, Mycobacterium avium subsp. paratuberculosis
acguggacagaauagucgguac

SEQ ID NO: 20898 - RNA, 22 nt, Mycobacterium avium subsp. paratuberculosis
acguggcccgggccgccggcau

SEQ ID NO: 20899 - RNA, 22 nt, Mycobacterium avium subsp. paratuberculosis
acucccgacgaccuggucggca

SEQ ID NO: 20900 - RNA, 22 nt, Mycobacterium avium subsp. paratuberculosis
acucgaugucaucgucguccaa

SEQ ID NO: 20901 - RNA, 22 nt, Mycobacterium avium subsp. paratuberculosis
acucggagucgagcgucguggg

SEQ ID NO: 20902 - RNA, 22 nt, Mycobacterium avium subsp. paratuberculosis
acucggugucguugucgaacga

SEQ ID NO: 20903 - RNA, 19 nt, Mycobacterium avium subsp. paratuberculosis
acugcgacgaucaaccggc

SEQ ID NO: 20904 - RNA, 22 nt, Mycobacterium avium subsp. paratuberculosis
acuggcgugcggcggcgaccgg

SEQ ID NO: 20905 - RNA, 22 nt, Mycobacterium avium subsp. paratuberculosis
acugggcgcuggacucgaccag

SEQ ID NO: 20906 - RNA, 20 nt, Mycobacterium avium subsp. paratuberculosis
acuucggcaugcgcacccgc

SEQ ID NO: 20907 - RNA, 22 nt, Mycobacterium avium subsp. paratuberculosis
agaagcucggcgcugacguggu

SEQ ID NO: 20908 - RNA, 22 nt, Mycobacterium avium subsp. paratuberculosis
agaaggggcugcacgacgucau

SEQ ID NO: 20909 - RNA, 22 nt, Mycobacterium avium subsp. paratuberculosis
agaccgccaucgccaucagcgc

SEQ ID NO: 20910 - RNA, 22 nt, Mycobacterium avium subsp. paratuberculosis
agacucacgcgauggcccucua

SEQ ID NO: 20911 - RNA, 22 nt, Mycobacterium avium subsp. paratuberculosis
agaggaacaucgcgauggcccu

SEQ ID NO: 20912 - RNA, 22 nt, Mycobacterium avium subsp. paratuberculosis
agagucucaugggcaucaucgg

SEQ ID NO: 20913 - RNA, 22 nt, Mycobacterium avium subsp. paratuberculosis
agaugcggccguugaucuucag

SEQ ID NO: 20914 - RNA, 22 nt, Mycobacterium avium subsp. paratuberculosis
agcacgacguccgucgcgccgg

SEQ ID NO: 20915 - RNA, 22 nt, Mycobacterium avium subsp. paratuberculosis
agcagacgcaaaagccccucga

SEQ ID NO: 20916 - RNA, 22 nt, Mycobacterium avium subsp. paratuberculosis
agcagcaugccgucgcggcgaa

SEQ ID NO: 20917 - RNA, 21 nt, Mycobacterium avium subsp. paratuberculosis
agcagcucgccgagaugggcg

SEQ ID NO: 20918 - RNA, 22 nt, Mycobacterium avium subsp. paratuberculosis
agcagguggugcgcugcagcga

SEQ ID NO: 20919 - RNA, 22 nt, Mycobacterium avium subsp. paratuberculosis
agcaucgcgaagaugccgucga

SEQ ID NO: 20920 - RNA, 22 nt, Mycobacterium avium subsp. paratuberculosis
agccaaaacgacgccgucgugg

SEQ ID NO: 20921 - RNA, 22 nt, Mycobacterium avium subsp. paratuberculosis
agccaaccugucagccugggca

SEQ ID NO: 20922 - RNA, 22 nt, Mycobacterium avium subsp. paratuberculosis
agccacggcagcacguagugca

SEQ ID NO: 20923 - RNA, 22 nt, Mycobacterium avium subsp. paratuberculosis
aucgccgacgaccuucaugccc

SEQ ID NO: 20924 - RNA, 22 nt, Mycobacterium avium subsp. paratuberculosis
aucgccugguggaugccgucca

SEQ ID NO: 20925 - RNA, 22 nt, Mycobacterium avium subsp. paratuberculosis
aucgcggaucuggcgcucgacc

SEQ ID NO: 20926 - RNA, 22 nt, Mycobacterium avium subsp. paratuberculosis
aucgcggccgacuuggagucga

SEQ ID NO: 20927 - RNA, 22 nt, Mycobacterium avium subsp. paratuberculosis
aucgcggcgugcccgcugaccu

SEQ ID NO: 20928 - RNA, 22 nt, Mycobacterium avium subsp. paratuberculosis
aucggcgcagcugaccugguuc

SEQ ID NO: 20929 - RNA, 22 nt, Mycobacterium avium subsp. paratuberculosis
aucggcgcccggccgcuggauu

SEQ ID NO: 20930 - RNA, 22 nt, Mycobacterium avium subsp. paratuberculosis
aucgggauggcgccgucgccgg

SEQ ID NO: 20931 - RNA, 22 nt, Mycobacterium avium subsp. paratuberculosis
aucggguucacccgcgccggcg

SEQ ID NO: 20932 - RNA, 22 nt, Mycobacterium avium subsp. paratuberculosis
aucggguugacucacgcggcgc

SEQ ID NO: 20933 - RNA, 22 nt, Mycobacterium avium subsp. paratuberculosis
aucgugcugauccugcuggugc

SEQ ID NO: 20934 - RNA, 22 nt, Mycobacterium avium subsp. paratuberculosis
aucguguacgcggcggcccggg

SEQ ID NO: 20935 - RNA, 22 nt, Mycobacterium avium subsp. paratuberculosis
aucucgccaugaguacacacuc

SEQ ID NO: 20936 - RNA, 22 nt, Mycobacterium avium subsp. paratuberculosis
aucucgcugcagaaccgaggcg

SEQ ID NO: 20937 - RNA, 22 nt, Mycobacterium avium subsp. paratuberculosis
aucuggaccagcgcgaugucgg

SEQ ID NO: 20938 - RNA, 22 nt, Mycobacterium avium subsp. paratuberculosis
aucuuggcguacugcgccucuu

SEQ ID NO: 20939 - RNA, 22 nt, Mycobacterium avium subsp. paratuberculosis
augaccucgugguggaaaccgg

SEQ ID NO: 20940 - RNA, 22 nt, Mycobacterium avium subsp. paratuberculosis
augacggcgucgcugcguagua

SEQ ID NO: 20941 - RNA, 22 nt, Mycobacterium avium subsp. paratuberculosis
augacgucgagcgccgacuucc

SEQ ID NO: 20942 - RNA, 22 nt, Mycobacterium avium subsp. paratuberculosis
augacgucgugcagccccuucu

SEQ ID NO: 20943 - RNA, 22 nt, Mycobacterium avium subsp. paratuberculosis
augaucgccuggccgccgcggc

SEQ ID NO: 20944 - RNA, 22 nt, Mycobacterium avium subsp. paratuberculosis
augcccucgcgcagggcgauga

SEQ ID NO: 20945 - RNA, 22 nt, Mycobacterium avium subsp. paratuberculosis
augccgaccacguaccggccca

SEQ ID NO: 20946 - RNA, 20 nt, Mycobacterium avium subsp. paratuberculosis
augccgagccgggcaaaccc

SEQ ID NO: 20947 - RNA, 22 nt, Mycobacterium avium subsp. paratuberculosis
augccgauugacgccagugcga

SEQ ID NO: 20948 - RNA, 22 nt, Mycobacterium avium subsp. paratuberculosis
augcgccucgacggcgucgggg

SEQ ID NO: 20949 - RNA, 22 nt, Mycobacterium avium subsp. paratuberculosis
augcgguuggacgcgugcguga

SEQ ID NO: 20950 - RNA, 22 nt, Mycobacterium avium subsp. paratuberculosis
auggccgcgguguggcugagcg

SEQ ID NO: 20951 - RNA, 22 nt, Mycobacterium avium subsp. paratuberculosis
cccgcagggcauugggcagguc

SEQ ID NO: 20952 - RNA, 22 nt, Mycobacterium avium subsp. paratuberculosis
cccgccucugagcgacaacgac

SEQ ID NO: 20953 - RNA, 22 nt, Mycobacterium avium subsp. paratuberculosis
cccgggguguacgcccgcuuuc

SEQ ID NO: 20954 - RNA, 22 nt, Mycobacterium avium subsp. paratuberculosis
cccggucuggaacgcgacgugg

SEQ ID NO: 20955 - RNA, 22 nt, Mycobacterium avium subsp. paratuberculosis
cccggugggccggaccguuggu

SEQ ID NO: 20956 - RNA, 22 nt, Mycobacterium avium subsp. paratuberculosis
cccuccagcaacucgcgcgccu

SEQ ID NO: 20957 - RNA, 22 nt, Mycobacterium avium subsp. paratuberculosis
ccgaacuucugcagcgucgcgc

SEQ ID NO: 20958 - RNA, 20 nt, Mycobacterium avium subsp. paratuberculosis
ccgaaucgucguugugcggc

SEQ ID NO: 20959 - RNA, 22 nt, Mycobacterium avium subsp. paratuberculosis
ccgacaugccaguugccggugc

SEQ ID NO: 20960 - RNA, 22 nt, Mycobacterium avium subsp. paratuberculosis
ccgaccacccgcacgagcgggc

SEQ ID NO: 20961 - RNA, 22 nt, Mycobacterium avium subsp. paratuberculosis
ccgaccagauacaucagggcga

SEQ ID NO: 20962 - RNA, 22 nt, Mycobacterium avium subsp. paratuberculosis
ccgacgaguucggccuguucga

SEQ ID NO: 20963 - RNA, 22 nt, Mycobacterium avium subsp. paratuberculosis
ccgacgauuucgucggugcggu

SEQ ID NO: 20964 - RNA, 22 nt, Mycobacterium avium subsp. paratuberculosis
ccgacgucggcgacgauggcca

SEQ ID NO: 20965 - RNA, 22 nt, Mycobacterium avium subsp. paratuberculosis
ccgagacguagcccaccaacug

SEQ ID NO: 20966 - RNA, 22 nt, Mycobacterium avium subsp. paratuberculosis
ccgagcgcgccaccguguucga

SEQ ID NO: 20967 - RNA, 22 nt, Mycobacterium avium subsp. paratuberculosis
ccgagcgugacgguaguuucac

SEQ ID NO: 20968 - RNA, 22 nt, Mycobacterium avium subsp. paratuberculosis
ccgagcgugggggcuguguagg

SEQ ID NO: 20969 - RNA, 22 nt, Mycobacterium avium subsp. paratuberculosis
ccgaggagaucggcgcgccgcc

SEQ ID NO: 20970 - RNA, 22 nt, Mycobacterium avium subsp. paratuberculosis
ccgaggaucgcuaucugaugac

SEQ ID NO: 20971 - RNA, 22 nt, Mycobacterium avium subsp. paratuberculosis
ccgaggucaaucuggcgcggcg

SEQ ID NO: 20972 - RNA, 21 nt, Mycobacterium avium subsp. paratuberculosis
ccgaucgcgauggcguugagc

SEQ ID NO: 20973 - RNA, 22 nt, Mycobacterium avium subsp. paratuberculosis
ccgauggccggcgggcccggca

SEQ ID NO: 20974 - RNA, 22 nt, Mycobacterium avium subsp. paratuberculosis
ccgauggcgcuggugcuggcgc

SEQ ID NO: 20975 - RNA, 22 nt, Mycobacterium avium subsp. paratuberculosis
ccgccaacaagauucgccgcuc

SEQ ID NO: 20976 - RNA, 22 nt, Mycobacterium avium subsp. paratuberculosis
ccgccaguucggcgacaccgug

SEQ ID NO: 20977 - RNA, 22 nt, Mycobacterium avium subsp. paratuberculosis
ccgccgacccgaggugggugac

SEQ ID NO: 20978 - RNA, 22 nt, Mycobacterium avium subsp. paratuberculosis
ccgccgagcaaaacgccgccaa

SEQ ID NO: 20979 - RNA, 22 nt, Mycobacterium avium subsp. paratuberculosis
ccgccgcgaugggggugacgcu

SEQ ID NO: 20980 - RNA, 22 nt, Mycobacterium avium subsp. paratuberculosis
ccgccggguggucgagccgguc

SEQ ID NO: 20981 - RNA, 22 nt, Mycobacterium avium subsp. paratuberculosis
ccgccucacagcgacaacgcgu

SEQ ID NO: 20982 - RNA, 23 nt, Mycobacterium avium subsp. paratuberculosis
ccgccucgucgauaucgcugacg

SEQ ID NO: 20983 - RNA, 22 nt, Mycobacterium avium subsp. paratuberculosis
ccgcgacggcgccgaccagcac

SEQ ID NO: 20984 - RNA, 22 nt, Mycobacterium avium subsp. paratuberculosis
ccgcgagcagacacaaaagccc

SEQ ID NO: 20985 - RNA, 22 nt, Mycobacterium avium subsp. paratuberculosis
ccgcgcaaucaaaaaccccgcu

SEQ ID NO: 20986 - RNA, 19 nt, Mycobacterium avium subsp. paratuberculosis
ccgcgccauccugcgggug

SEQ ID NO: 20987 - RNA, 22 nt, Mycobacterium avium subsp. paratuberculosis
ccgcgccgacgagcagcccgug

SEQ ID NO: 20988 - RNA, 22 nt, Mycobacterium avium subsp. paratuberculosis
ccgcgcggccgaugaucagccg

SEQ ID NO: 20989 - RNA, 22 nt, Mycobacterium avium subsp. paratuberculosis
ccgcggaauggcacaccgcguu

SEQ ID NO: 20990 - RNA, 22 nt, Mycobacterium avium subsp. paratuberculosis
ccgcguucaccgaucccggcua

SEQ ID NO: 20991 - RNA, 23 nt, Mycobacterium avium subsp. paratuberculosis
ccgcuaccgacgguucgucguua

SEQ ID NO: 20992 - RNA, 22 nt, Mycobacterium avium subsp. paratuberculosis
ccgcuacuacgugagcaugaac

SEQ ID NO: 20993 - RNA, 22 nt, Mycobacterium avium subsp. paratuberculosis
ccgcucugaugagaucagcggc

SEQ ID NO: 20994 - RNA, 22 nt, Mycobacterium avium subsp. paratuberculosis
ccgcugauccgcugcugcacga

SEQ ID NO: 20995 - RNA, 22 nt, Mycobacterium avium subsp. paratuberculosis
ccgcuguacgcggcaugccugg

SEQ ID NO: 20996 - RNA, 22 nt, Mycobacterium avium subsp. paratuberculosis
ccgcuguuggacaggcuggccg

SEQ ID NO: 20997 - RNA, 22 nt, Mycobacterium avium subsp. paratuberculosis
ccggaucagaaaccacgcgucg

SEQ ID NO: 20998 - RNA, 23 nt, Mycobacterium avium subsp. paratuberculosis
ccggcaugaccuggucgaaugug

SEQ ID NO: 20999 - RNA, 22 nt, Mycobacterium avium subsp. paratuberculosis
ccggccauguucagcaugcaca

SEQ ID NO: 21000 - RNA, 22 nt, Mycobacterium avium subsp. paratuberculosis
ccggccuucgacugcagcagga

SEQ ID NO: 21001 - RNA, 21 nt, Mycobacterium avium subsp. paratuberculosis
ccggcgagcggacugccgcag

SEQ ID NO: 21002 - RNA, 22 nt, Mycobacterium avium subsp. paratuberculosis
ccggcgcggucagcucgccggg

SEQ ID NO: 21003 - RNA, 22 nt, Mycobacterium avium subsp. paratuberculosis
ccggcgucacggaucugucggu

SEQ ID NO: 21004 - RNA, 22 nt, Mycobacterium avium subsp. paratuberculosis
ccggcguggagguguccagggc

SEQ ID NO: 21005 - RNA, 22 nt, Mycobacterium avium subsp. paratuberculosis
ccggcuggcaggucgcgccgga

SEQ ID NO: 21006 - RNA, 22 nt, Mycobacterium avium subsp. paratuberculosis
ccgggcuucgacguggccaagg

SEQ ID NO: 21007 - RNA, 22 nt, Mycobacterium avium subsp. paratuberculosis
ccgggugaugcgcgaccagcug

SEQ ID NO: 21008 - RNA, 22 nt, Mycobacterium avium subsp. paratuberculosis
ccggucaugaucugguccaugg

SEQ ID NO: 21009 - RNA, 18 nt, Mycobacterium avium subsp. paratuberculosis
ccgguccgcgcgcugucc

SEQ ID NO: 21010 - RNA, 22 nt, Mycobacterium avium subsp. paratuberculosis
ccggugagguuggacggcgccu

SEQ ID NO: 21011 - RNA, 22 nt, Mycobacterium avium subsp. paratuberculosis
ccggugccggugccgcugggcg

SEQ ID NO: 21012 - RNA, 22 nt, Mycobacterium avium subsp. paratuberculosis
ccgguggugacggcgcccuguu

SEQ ID NO: 21013 - RNA, 22 nt, Mycobacterium avium subsp. paratuberculosis
ccgguugccccaccguugcagc

SEQ ID NO: 21014 - RNA, 20 nt, Mycobacterium avium subsp. paratuberculosis
ccgucacgccggugucgccg

SEQ ID NO: 21015 - RNA, 22 nt, Mycobacterium avium subsp. paratuberculosis
ccgucgaacguggaguuguugc

SEQ ID NO: 21016 - RNA, 22 nt, Mycobacterium avium subsp. paratuberculosis
ccgucgucgacgccgcgcaguu

SEQ ID NO: 21017 - RNA, 22 nt, Mycobacterium avium subsp. paratuberculosis
ccgugcaucugcccggcaucgc

SEQ ID NO: 21018 - RNA, 22 nt, Mycobacterium avium subsp. paratuberculosis
ccguuguugugcagcgucgguc

SEQ ID NO: 21019 - RNA, 22 nt, Mycobacterium avium subsp. paratuberculosis
ccguuugauguuucggacuugg

SEQ ID NO: 21020 - RNA, 22 nt, Mycobacterium avium subsp. paratuberculosis
ccucacggucggcguccagcgc

SEQ ID NO: 21021 - RNA, 22 nt, Mycobacterium avium subsp. paratuberculosis
ccucggugucaccgcuagcacc

SEQ ID NO: 21022 - RNA, 22 nt, Mycobacterium avium subsp. paratuberculosis
ccugaccaccgguuugccgagu

SEQ ID NO: 21023 - RNA, 22 nt, Mycobacterium avium subsp. paratuberculosis
ccugccuggccacguggucgcu

SEQ ID NO: 21024 - RNA, 22 nt, Mycobacterium avium subsp. paratuberculosis
ccugcgccggguguucggcacu

SEQ ID NO: 21025 - RNA, 22 nt, Mycobacterium avium subsp. paratuberculosis
ccugcugagcgaccuugagguu

SEQ ID NO: 21026 - RNA, 22 nt, Mycobacterium avium subsp. paratuberculosis
ccuggacgcugaucccggcgcu

SEQ ID NO: 21027 - RNA, 22 nt, Mycobacterium avium subsp. paratuberculosis
ccuggccgacaccaaccccgaa

SEQ ID NO: 21028 - RNA, 22 nt, Mycobacterium avium subsp. paratuberculosis
ccuggcugcacacugaacgccg

SEQ ID NO: 21029 - RNA, 22 nt, Mycobacterium avium subsp. paratuberculosis
ccugguucugcagcgugcggau

SEQ ID NO: 21030 - RNA, 22 nt, Mycobacterium avium subsp. paratuberculosis
ccuucgccuccggcauggccgc

SEQ ID NO: 21031 - RNA, 22 nt, Mycobacterium avium subsp. paratuberculosis
ccuuggccuugcucaucacgac

SEQ ID NO: 21032 - RNA, 22 nt, Mycobacterium avium subsp. paratuberculosis
cgaacacgccggucugcgaucc

SEQ ID NO: 21033 - RNA, 22 nt, Mycobacterium avium subsp. paratuberculosis
cgaaccugaucgagcuggugga

SEQ ID NO: 21034 - RNA, 22 nt, Mycobacterium avium subsp. paratuberculosis
cgaacucggcaucaccugccag

SEQ ID NO: 21035 - RNA, 22 nt, Mycobacterium avium subsp. paratuberculosis
cgacacagcucgcugauccgca

SEQ ID NO: 21036 - RNA, 22 nt, Mycobacterium avium subsp. paratuberculosis
cgacgaauccgacgcucaacuc

SEQ ID NO: 21037 - RNA, 22 nt, Mycobacterium avium subsp. paratuberculosis
cgacgacaccccgguggccucg

SEQ ID NO: 21038 - RNA, 22 nt, Mycobacterium avium subsp. paratuberculosis
cgacgacauggacguguuccug

SEQ ID NO: 21039 - RNA, 20 nt, Mycobacterium avium subsp. paratuberculosis
cgacgacugcguggcggcga

SEQ ID NO: 21040 - RNA, 22 nt, Mycobacterium avium subsp. paratuberculosis
cgacgaugcgguuccggccguu

SEQ ID NO: 21041 - RNA, 19 nt, Mycobacterium avium subsp. paratuberculosis
cgacgcccaucguggcgac

SEQ ID NO: 21042 - RNA, 22 nt, Mycobacterium avium subsp. paratuberculosis
cgacgccgagacgcuggcacaa

SEQ ID NO: 21043 - RNA, 22 nt, Mycobacterium avium subsp. paratuberculosis
cgacggucgccugggcgggaac

SEQ ID NO: 21044 - RNA, 22 nt, Mycobacterium avium subsp. paratuberculosis
cgacggugagcgugucgaugac

SEQ ID NO: 21045 - RNA, 23 nt, Mycobacterium avium subsp. paratuberculosis
cgacgucgacgccgaccaccugg

SEQ ID NO: 21046 - RNA, 22 nt, Mycobacterium avium subsp. paratuberculosis
cgacuugcguuccgagggcgca

SEQ ID NO: 21047 - RNA, 22 nt, Mycobacterium avium subsp. paratuberculosis
cgagaauccgaccgccuggacc

SEQ ID NO: 21048 - RNA, 22 nt, Mycobacterium avium subsp. paratuberculosis
cgagagugcaucuaccgacgcu

SEQ ID NO: 21049 - RNA, 22 nt, Mycobacterium avium subsp. paratuberculosis
cgagccgaauccaccagccgcg

SEQ ID NO: 21050 - RNA, 22 nt, Mycobacterium avium subsp. paratuberculosis
cgagccuggccggacgcgcggu

SEQ ID NO: 21051 - RNA, 22 nt, Mycobacterium avium subsp. paratuberculosis
cgagcgccuccucgaccagaug

SEQ ID NO: 21052 - RNA, 22 nt, Mycobacterium avium subsp. paratuberculosis
cgagcgucacgccagcguggcg

SEQ ID NO: 21053 - RNA, 22 nt, Mycobacterium avium subsp. paratuberculosis
cgagcgucacgcuggcgugacc

SEQ ID NO: 21054 - RNA, 22 nt, Mycobacterium avium subsp. paratuberculosis
cgagggcugcucguucaucaac

SEQ ID NO: 21055 - RNA, 22 nt, Mycobacterium avium subsp. paratuberculosis
cgaggugaucggccgccggcuc

SEQ ID NO: 21056 - RNA, 22 nt, Mycobacterium avium subsp. paratuberculosis
cgaguugcccaccgcccugcug

SEQ ID NO: 21057 - RNA, 20 nt, Mycobacterium avium subsp. paratuberculosis
cgauacgucaccgagcgcga

SEQ ID NO: 21058 - RNA, 22 nt, Mycobacterium avium subsp. paratuberculosis
cgauccgcauggugaagacggu

SEQ ID NO: 21059 - RNA, 22 nt, Mycobacterium avium subsp. paratuberculosis
cgauccgguugcacaccaucgc

SEQ ID NO: 21060 - RNA, 22 nt, Mycobacterium avium subsp. paratuberculosis
cgaucgacgguguugacgagau

SEQ ID NO: 21061 - RNA, 22 nt, Mycobacterium avium subsp. paratuberculosis
cgaucgggaugaucgcgcucac

SEQ ID NO: 21062 - RNA, 22 nt, Mycobacterium avium subsp. paratuberculosis
cgaucgggcucugguuggcgca

SEQ ID NO: 21063 - RNA, 23 nt, Mycobacterium avium subsp. paratuberculosis
cgaugccgccggccaauucggcg

SEQ ID NO: 21064 - RNA, 22 nt, Mycobacterium avium subsp. paratuberculosis
cgaugcucacgaaggcauucuu

SEQ ID NO: 21065 - RNA, 22 nt, Mycobacterium avium subsp. paratuberculosis
cgauggucuggcgcacgcccag

SEQ ID NO: 21066 - RNA, 18 nt, Mycobacterium avium subsp. paratuberculosis
cgauguggccgacguggu

SEQ ID NO: 21067 - RNA, 19 nt, Mycobacterium avium subsp. paratuberculosis
cgauuccaucgggcugggu

SEQ ID NO: 21068 - RNA, 22 nt, Mycobacterium avium subsp. paratuberculosis
cgcaccacgucgaucuccuugc

SEQ ID NO: 21069 - RNA, 21 nt, Mycobacterium avium subsp. paratuberculosis
cgcaccagcacaccggcgugc

SEQ ID NO: 21070 - RNA, 22 nt, Mycobacterium avium subsp. paratuberculosis
cgcaccaucgacgggguggaca

SEQ ID NO: 21071 - RNA, 22 nt, Mycobacterium avium subsp. paratuberculosis
cgcacgccgccccgaccagaga

SEQ ID NO: 21072 - RNA, 22 nt, Mycobacterium avium subsp. paratuberculosis
cgcagcagauuacggcggucca

SEQ ID NO: 21073 - RNA, 22 nt, Mycobacterium avium subsp. paratuberculosis
cgcagcauuucuucgaucgcgg

SEQ ID NO: 21074 - RNA, 22 nt, Mycobacterium avium subsp. paratuberculosis
cgcagcgucgccccgguggugu

SEQ ID NO: 21075 - RNA, 22 nt, Mycobacterium avium subsp. paratuberculosis
cgccaacgucgacuuguugucg

SEQ ID NO: 21076 - RNA, 22 nt, Mycobacterium avium subsp. paratuberculosis
cgccacgcuggcgugacgcuga

SEQ ID NO: 21077 - RNA, 22 nt, Mycobacterium avium subsp. paratuberculosis
cgccaggucggccucgucgcgg

SEQ ID NO: 21078 - RNA, 22 nt, Mycobacterium avium subsp. paratuberculosis
cgccaugaagcugacguauugc

SEQ ID NO: 21079 - RNA, 22 nt, Mycobacterium avium subsp. paratuberculosis
cgcccagccgaaccuguugcug

SEQ ID NO: 21080 - RNA, 22 nt, Mycobacterium avium subsp. paratuberculosis
cgccccgacgguguggcugugu

SEQ ID NO: 21081 - RNA, 22 nt, Mycobacterium avium subsp. paratuberculosis
cgccccgggcauggcuccgccg

SEQ ID NO: 21082 - RNA, 22 nt, Mycobacterium avium subsp. paratuberculosis
cgcccgcacccuggacaccugg

SEQ ID NO: 21083 - RNA, 22 nt, Mycobacterium avium subsp. paratuberculosis
cgcccuguguacacacucgacg

SEQ ID NO: 21084 - RNA, 22 nt, Mycobacterium avium subsp. paratuberculosis
cgccgagcgucacgccagcgug

SEQ ID NO: 21085 - RNA, 22 nt, Mycobacterium avium subsp. paratuberculosis
cgccgagcgugggcccugugca

SEQ ID NO: 21086 - RNA, 22 nt, Mycobacterium avium subsp. paratuberculosis
cgccgcaagcucggucucgucg

SEQ ID NO: 21087 - RNA, 22 nt, Mycobacterium avium subsp. paratuberculosis
cgccgcaggaggcgucgcccgu

SEQ ID NO: 21088 - RNA, 22 nt, Mycobacterium avium subsp. paratuberculosis
cgccgccagcaggucggcgacc

SEQ ID NO: 21089 - RNA, 22 nt, Mycobacterium avium subsp. paratuberculosis
cgccggaccguggagccgcggc

SEQ ID NO: 21090 - RNA, 21 nt, Mycobacterium avium subsp. paratuberculosis
cgccggccucggagccgucgg

SEQ ID NO: 21091 - RNA, 22 nt, Mycobacterium avium subsp. paratuberculosis
cgccggcgucagagguuggcga

SEQ ID NO: 21092 - RNA, 22 nt, Mycobacterium avium subsp. paratuberculosis
cgccggugcuggugcucaccug

SEQ ID NO: 21093 - RNA, 22 nt, Mycobacterium avium subsp. paratuberculosis
cgguggucugcucggccugacg

SEQ ID NO: 21094 - RNA, 22 nt, Mycobacterium avium subsp. paratuberculosis
cggugugcagcgggugcaggcg

SEQ ID NO: 21095 - RNA, 22 nt, Mycobacterium avium subsp. paratuberculosis
cgucaccgaccggucgcaggua

SEQ ID NO: 21096 - RNA, 22 nt, Mycobacterium avium subsp. paratuberculosis
cgucaccggugaggacgucacc

SEQ ID NO: 21097 - RNA, 22 nt, Mycobacterium avium subsp. paratuberculosis
cgucacgccagcgugacgccgc

SEQ ID NO: 21098 - RNA, 22 nt, Mycobacterium avium subsp. paratuberculosis
cgucacgcuggcgugacgcucg

SEQ ID NO: 21099 - RNA, 23 nt, Mycobacterium avium subsp. paratuberculosis
cgucacgcuggcgugacgcucgg

SEQ ID NO: 21100 - RNA, 22 nt, Mycobacterium avium subsp. paratuberculosis
cgucacggcgcaggucagcgcg

SEQ ID NO: 21101 - RNA, 22 nt, Mycobacterium avium subsp. paratuberculosis
cgucagcgauuucgugggcggc

SEQ ID NO: 21102 - RNA, 22 nt, Mycobacterium avium subsp. paratuberculosis
cgucgacgacgacuucuuccug

SEQ ID NO: 21103 - RNA, 22 nt, Mycobacterium avium subsp. paratuberculosis
cgucgacggcgaacuugggcuu

SEQ ID NO: 21104 - RNA, 22 nt, Mycobacterium avium subsp. paratuberculosis
cgucgacguggccgucuuuccg

SEQ ID NO: 21105 - RNA, 22 nt, Mycobacterium avium subsp. paratuberculosis
cgucgccaguugcacuuucggc

SEQ ID NO: 21106 - RNA, 23 nt, Mycobacterium avium subsp. paratuberculosis
cgucgccuucuacucgugcugcg

SEQ ID NO: 21107 - RNA, 22 nt, Mycobacterium avium subsp. paratuberculosis
cgucgcgaccaguggcggcguu

SEQ ID NO: 21108 - RNA, 22 nt, Mycobacterium avium subsp. paratuberculosis
cgucgggauuggguugcauguu

SEQ ID NO: 21109 - RNA, 23 nt, Mycobacterium avium subsp. paratuberculosis
cgucgggcauuggaucgucgacc

SEQ ID NO: 21110 - RNA, 22 nt, Mycobacterium avium subsp. paratuberculosis
cgucggugcugguggcccacgg

SEQ ID NO: 21111 - RNA, 22 nt, Mycobacterium avium subsp. paratuberculosis
cgucgucgaccaucucguagua

SEQ ID NO: 21112 - RNA, 22 nt, Mycobacterium avium subsp. paratuberculosis
cgugaaauuaguuucacgcucg

SEQ ID NO: 21113 - RNA, 22 nt, Mycobacterium avium subsp. paratuberculosis
cgugaagcuaguuucacgcucg

SEQ ID NO: 21114 - RNA, 23 nt, Mycobacterium avium subsp. paratuberculosis
cgugcccaccagucgcggucggc

SEQ ID NO: 21115 - RNA, 22 nt, Mycobacterium avium subsp. paratuberculosis
cgugcugauguacgccguggug

SEQ ID NO: 21116 - RNA, 22 nt, Mycobacterium avium subsp. paratuberculosis
cguggccgagaucgcgccgcug

SEQ ID NO: 21117 - RNA, 22 nt, Mycobacterium avium subsp. paratuberculosis
cguggcgauccuggcagugcuc

SEQ ID NO: 21118 - RNA, 22 nt, Mycobacterium avium subsp. paratuberculosis
cguggcggccgagcccaugcug

SEQ ID NO: 21119 - RNA, 22 nt, Mycobacterium avium subsp. paratuberculosis
cguguugccgacgaucgugccg

SEQ ID NO: 21120 - RNA, 22 nt, Mycobacterium avium subsp. paratuberculosis
cguucgaggaguucgaccgcga

SEQ ID NO: 21121 - RNA, 22 nt, Mycobacterium avium subsp. paratuberculosis
cguugccaguugcacuuucgcg

SEQ ID NO: 21122 - RNA, 22 nt, Mycobacterium avium subsp. paratuberculosis
cguugcugccgucaaugagccg

SEQ ID NO: 21123 - RNA, 22 nt, Mycobacterium avium subsp. paratuberculosis
cuagcacacgaauacccuccgg

SEQ ID NO: 21124 - RNA, 22 nt, Mycobacterium avium subsp. paratuberculosis
cucacgccgucggugcugggcc

SEQ ID NO: 21125 - RNA, 22 nt, Mycobacterium avium subsp. paratuberculosis
cucacucugcaggaacucgggg

SEQ ID NO: 21126 - RNA, 22 nt, Mycobacterium avium subsp. paratuberculosis
cuccagcgucacgccggcgugg

SEQ ID NO: 21127 - RNA, 22 nt, Mycobacterium avium subsp. paratuberculosis
cuccagggugagcgugacgcug

SEQ ID NO: 21128 - RNA, 22 nt, Mycobacterium avium subsp. paratuberculosis
cuccgaucuggccgaccggcug

SEQ ID NO: 21129 - RNA, 22 nt, Mycobacterium avium subsp. paratuberculosis
cuccgccgagggcaucgaccag

SEQ ID NO: 21130 - RNA, 22 nt, Mycobacterium avium subsp. paratuberculosis
cuccggucggcgggaccgcgca

SEQ ID NO: 21131 - RNA, 22 nt, Mycobacterium avium subsp. paratuberculosis
cuccuggaagccggccgcgacg

SEQ ID NO: 21132 - RNA, 22 nt, Mycobacterium avium subsp. paratuberculosis
cucgacacgcuguaugucacgc

SEQ ID NO: 21133 - RNA, 22 nt, Mycobacterium avium subsp. paratuberculosis
cucgaucguccgggacgcgauc

SEQ ID NO: 21134 - RNA, 22 nt, Mycobacterium avium subsp. paratuberculosis
cucgcgguugccggccuggugg

SEQ ID NO: 21135 - RNA, 22 nt, Mycobacterium avium subsp. paratuberculosis
cucgcugguggccgcggugcug

SEQ ID NO: 21136 - RNA, 21 nt, Mycobacterium avium subsp. paratuberculosis
cucgggcaguguucugaccgc

SEQ ID NO: 21137 - RNA, 22 nt, Mycobacterium avium subsp. paratuberculosis
cucgggggugcccgaacggcag

SEQ ID NO: 21138 - RNA, 22 nt, Mycobacterium avium subsp. paratuberculosis
cucggugauguagaucggcgcc

SEQ ID NO: 21139 - RNA, 22 nt, Mycobacterium avium subsp. paratuberculosis
cucgucgacgaccaccaccaag

SEQ ID NO: 21140 - RNA, 19 nt, Mycobacterium avium subsp. paratuberculosis
cucgucgagucguacccgc

SEQ ID NO: 21141 - RNA, 22 nt, Mycobacterium avium subsp. paratuberculosis
cucgucgucgcgggccgggcug

SEQ ID NO: 21142 - RNA, 22 nt, Mycobacterium avium subsp. paratuberculosis
gagcuggccaaggaagugcccg

SEQ ID NO: 21143 - RNA, 22 nt, Mycobacterium avium subsp. paratuberculosis
gagcuuggccugggucagcugg

SEQ ID NO: 21144 - RNA, 22 nt, Mycobacterium avium subsp. paratuberculosis
gaggauggcgacgucggcgccg

SEQ ID NO: 21145 - RNA, 22 nt, Mycobacterium avium subsp. paratuberculosis
gaggccgccguggacgugguga

SEQ ID NO: 21146 - RNA, 22 nt, Mycobacterium avium subsp. paratuberculosis
gaggggucggccugggugauga

SEQ ID NO: 21147 - RNA, 22 nt, Mycobacterium avium subsp. paratuberculosis
gagggugucggggaacugcacc

SEQ ID NO: 21148 - RNA, 22 nt, Mycobacterium avium subsp. paratuberculosis
gaggugcugcgcggccugggcg

SEQ ID NO: 21149 - RNA, 22 nt, Mycobacterium avium subsp. paratuberculosis
gaguccgccccggccgacaccu

SEQ ID NO: 21150 - RNA, 22 nt, Mycobacterium avium subsp. paratuberculosis
gaguucuuggaacgggucucgc

SEQ ID NO: 21151 - RNA, 22 nt, Mycobacterium avium subsp. paratuberculosis
gaucccguucguggcguucgcg

SEQ ID NO: 21152 - RNA, 22 nt, Mycobacterium avium subsp. paratuberculosis
gauccugguguugcugcgggcc

SEQ ID NO: 21153 - RNA, 22 nt, Mycobacterium avium subsp. paratuberculosis
gaucgcccucgaugcccugcag

SEQ ID NO: 21154 - RNA, 22 nt, Mycobacterium avium subsp. paratuberculosis
gaucgcggugugcuucuugauc

SEQ ID NO: 21155 - RNA, 22 nt, Mycobacterium avium subsp. paratuberculosis
gaucggcgacggccucggcauu

SEQ ID NO: 21156 - RNA, 22 nt, Mycobacterium avium subsp. paratuberculosis
gaucuccggcugggcggacuga

SEQ ID NO: 21157 - RNA, 22 nt, Mycobacterium avium subsp. paratuberculosis
gaugaucagggucagcgccgca

SEQ ID NO: 21158 - RNA, 22 nt, Mycobacterium avium subsp. paratuberculosis
gaugccuucgacaaggcgaaga

SEQ ID NO: 21159 - RNA, 22 nt, Mycobacterium avium subsp. paratuberculosis
gaugcgaacguucggcggacag

SEQ ID NO: 21160 - RNA, 22 nt, Mycobacterium avium subsp. paratuberculosis
gaugcggcaccgcggcuucggc

SEQ ID NO: 21161 - RNA, 22 nt, Mycobacterium avium subsp. paratuberculosis
gaugcggcugccgucgguggac

SEQ ID NO: 21162 - RNA, 22 nt, Mycobacterium avium subsp. paratuberculosis
gaugcugcugaaagccggucug

SEQ ID NO: 21163 - RNA, 22 nt, Mycobacterium avium subsp. paratuberculosis
gauggcgacggauucgcggguc

SEQ ID NO: 21164 - RNA, 22 nt, Mycobacterium avium subsp. paratuberculosis
gaugguguggcacaucgcgcgg

SEQ ID NO: 21165 - RNA, 22 nt, Mycobacterium avium subsp. paratuberculosis
gauugacggccucccgggcguc

SEQ ID NO: 21166 - RNA, 22 nt, Mycobacterium avium subsp. paratuberculosis
gcaacaaccccacguucggcgu

SEQ ID NO: 21167 - RNA, 22 nt, Mycobacterium avium subsp. paratuberculosis
gcaacugcucagccacuccuug

SEQ ID NO: 21168 - RNA, 23 nt, Mycobacterium avium subsp. paratuberculosis
gcaaucaccggggugugacaagc

SEQ ID NO: 21169 - RNA, 22 nt, Mycobacterium avium subsp. paratuberculosis
gcaauguggcagaucgccgaau

SEQ ID NO: 21170 - RNA, 22 nt, Mycobacterium avium subsp. paratuberculosis
gcaccccguacucgcgcggcgu

SEQ ID NO: 21171 - RNA, 22 nt, Mycobacterium avium subsp. paratuberculosis
gcacccgcaccacggccuccuu

SEQ ID NO: 21172 - RNA, 19 nt, Mycobacterium avium subsp. paratuberculosis
gcaccgcagucuuguugac

SEQ ID NO: 21173 - RNA, 22 nt, Mycobacterium avium subsp. paratuberculosis
gcaccgccggcuaucuggccau

SEQ ID NO: 21174 - RNA, 19 nt, Mycobacterium avium subsp. paratuberculosis
gcaccgcgucgaucccgcc

SEQ ID NO: 21175 - RNA, 22 nt, Mycobacterium avium subsp. paratuberculosis
gcaccggcaucccgccgcugua

SEQ ID NO: 21176 - RNA, 22 nt, Mycobacterium avium subsp. paratuberculosis
gcaccgucgagaucagcgugug

SEQ ID NO: 21177 - RNA, 22 nt, Mycobacterium avium subsp. paratuberculosis
gcacgcugucggccacccggcg

SEQ ID NO: 21178 - RNA, 22 nt, Mycobacterium avium subsp. paratuberculosis
gcacuugaagcugaagcggccc

SEQ ID NO: 21179 - RNA, 22 nt, Mycobacterium avium subsp. paratuberculosis
gcagcauguccugccggcgggu

SEQ ID NO: 21180 - RNA, 22 nt, Mycobacterium avium subsp. paratuberculosis
gcagcgacagcagcucggcgua

SEQ ID NO: 21181 - RNA, 22 nt, Mycobacterium avium subsp. paratuberculosis
gcagcgacggcccgguugccgg

SEQ ID NO: 21182 - RNA, 22 nt, Mycobacterium avium subsp. paratuberculosis
gcagcgcacgguuggucauguc

SEQ ID NO: 21183 - RNA, 22 nt, Mycobacterium avium subsp. paratuberculosis
gcagcgucgguagaugcacucu

SEQ ID NO: 21184 - RNA, 22 nt, Mycobacterium avium subsp. paratuberculosis
gcagcuuguccaagagccggcc

SEQ ID NO: 21185 - RNA, 22 nt, Mycobacterium avium subsp. paratuberculosis
gcagggccucaucgcggucgcc

SEQ ID NO: 21186 - RNA, 19 nt, Mycobacterium avium subsp. paratuberculosis
gcaguaccggcggaucgcc

SEQ ID NO: 21187 - RNA, 22 nt, Mycobacterium avium subsp. paratuberculosis
gcaguacuacuucgacgccgac

SEQ ID NO: 21188 - RNA, 22 nt, Mycobacterium avium subsp. paratuberculosis
gcaguccagcgccucggcgaug

SEQ ID NO: 21189 - RNA, 22 nt, Mycobacterium avium subsp. paratuberculosis
gcagucgcugguggacaucgcc

SEQ ID NO: 21190 - RNA, 22 nt, Mycobacterium avium subsp. paratuberculosis
gcauggucggcuuccugaccau

SEQ ID NO: 21191 - RNA, 22 nt, Mycobacterium avium subsp. paratuberculosis
gccaccacggcaguagcaucgg

SEQ ID NO: 21192 - RNA, 22 nt, Mycobacterium avium subsp. paratuberculosis
gccaccgacgggaucgucgucg

SEQ ID NO: 21193 - RNA, 22 nt, Mycobacterium avium subsp. paratuberculosis
gccacgcuggccgcgguggagg

SEQ ID NO: 21194 - RNA, 21 nt, Mycobacterium avium subsp. paratuberculosis
gcccggguggcgaccagccgc

SEQ ID NO: 21195 - RNA, 22 nt, Mycobacterium avium subsp. paratuberculosis
gcccggugccgguggcucgggc

SEQ ID NO: 21196 - RNA, 22 nt, Mycobacterium avium subsp. paratuberculosis
gcccgucgucguucgggugcgc

SEQ ID NO: 21197 - RNA, 22 nt, Mycobacterium avium subsp. paratuberculosis
gcccugcagcaggaugaacaug

SEQ ID NO: 21198 - RNA, 22 nt, Mycobacterium avium subsp. paratuberculosis
gcccuguucgucgacgcccucg

SEQ ID NO: 21199 - RNA, 22 nt, Mycobacterium avium subsp. paratuberculosis
gccgaacgucgaguuguugggc

SEQ ID NO: 21200 - RNA, 22 nt, Mycobacterium avium subsp. paratuberculosis
gccgaauuagaguccauggcaa

SEQ ID NO: 21201 - RNA, 22 nt, Mycobacterium avium subsp. paratuberculosis
gccgaccaggucgucgggaguu

SEQ ID NO: 21202 - RNA, 22 nt, Mycobacterium avium subsp. paratuberculosis
gccgacuggaggccgcccggca

SEQ ID NO: 21203 - RNA, 22 nt, Mycobacterium avium subsp. paratuberculosis
gccgagcgucacgccagcgugg

SEQ ID NO: 21204 - RNA, 22 nt, Mycobacterium avium subsp. paratuberculosis
gccgagcgucacgcuggcguga

SEQ ID NO: 21205 - RNA, 22 nt, Mycobacterium avium subsp. paratuberculosis
gccgagcgugcacugagcgcga

SEQ ID NO: 21206 - RNA, 22 nt, Mycobacterium avium subsp. paratuberculosis
gccgcagcugaacaucggcgcg

SEQ ID NO: 21207 - RNA, 22 nt, Mycobacterium avium subsp. paratuberculosis
gccgccggugcugaccaccggc

SEQ ID NO: 21208 - RNA, 22 nt, Mycobacterium avium subsp. paratuberculosis
gccgccguggaaguacauguug

SEQ ID NO: 21209 - RNA, 22 nt, Mycobacterium avium subsp. paratuberculosis
gccgccuguaacgccaugacga

SEQ ID NO: 21210 - RNA, 22 nt, Mycobacterium avium subsp. paratuberculosis
gccgcgccgagcccgcucagua

SEQ ID NO: 21211 - RNA, 22 nt, Mycobacterium avium subsp. paratuberculosis
gccgcgcugaccgagcucgucg

SEQ ID NO: 21212 - RNA, 22 nt, Mycobacterium avium subsp. paratuberculosis
gccgcggcaccgaugguguuga

SEQ ID NO: 21213 - RNA, 22 nt, Mycobacterium avium subsp. paratuberculosis
gccgcggccugcccgucuagau

SEQ ID NO: 21214 - RNA, 22 nt, Mycobacterium avium subsp. paratuberculosis
gccgcgggugauggcggccgcc

SEQ ID NO: 21215 - RNA, 22 nt, Mycobacterium avium subsp. paratuberculosis
gccgcgucgaugccgcugggga

SEQ ID NO: 21216 - RNA, 22 nt, Mycobacterium avium subsp. paratuberculosis
gccgcucguaacggcagggcgc

SEQ ID NO: 21217 - RNA, 22 nt, Mycobacterium avium subsp. paratuberculosis
gccgcuuacgcccagcugucgg

SEQ ID NO: 21218 - RNA, 20 nt, Mycobacterium avium subsp. paratuberculosis
gccggaccgcacgaucgccg

SEQ ID NO: 21219 - RNA, 22 nt, Mycobacterium avium subsp. paratuberculosis
gccggcaugcggaucggcuuca

SEQ ID NO: 21220 - RNA, 22 nt, Mycobacterium avium subsp. paratuberculosis
gccggccgcguucugggcgauc

SEQ ID NO: 21221 - RNA, 22 nt, Mycobacterium avium subsp. paratuberculosis
gccggccgucacgcuggcguga

SEQ ID NO: 21222 - RNA, 22 nt, Mycobacterium avium subsp. paratuberculosis
gccggcgccaagucgccggugu

SEQ ID NO: 21223 - RNA, 22 nt, Mycobacterium avium subsp. paratuberculosis
gccggcgucgccgaguugaccc

SEQ ID NO: 21224 - RNA, 22 nt, Mycobacterium avium subsp. paratuberculosis
gccgggcgguugggcaucgagc

SEQ ID NO: 21225 - RNA, 22 nt, Mycobacterium avium subsp. paratuberculosis
gccgggcguaacgccacggcga

SEQ ID NO: 21226 - RNA, 22 nt, Mycobacterium avium subsp. paratuberculosis
gccgggcuggucggcagcgccc

SEQ ID NO: 21227 - RNA, 22 nt, Mycobacterium avium subsp. paratuberculosis
gccggggucaggcaugcgggua

SEQ ID NO: 21228 - RNA, 22 nt, Mycobacterium avium subsp. paratuberculosis
gccggucggucucguggccgcg

SEQ ID NO: 21229 - RNA, 22 nt, Mycobacterium avium subsp. paratuberculosis
gccggugacaccuucccgacug

SEQ ID NO: 21230 - RNA, 22 nt, Mycobacterium avium subsp. paratuberculosis
gccgucauccacgacgcgucgu

SEQ ID NO: 21231 - RNA, 22 nt, Mycobacterium avium subsp. paratuberculosis
gccguccuugcgggccuguucg

SEQ ID NO: 21232 - RNA, 22 nt, Mycobacterium avium subsp. paratuberculosis
gccgucgucaccggugucggag

SEQ ID NO: 21233 - RNA, 22 nt, Mycobacterium avium subsp. paratuberculosis
gccgucugcagcgugcccgagu

SEQ ID NO: 21234 - RNA, 22 nt, Mycobacterium avium subsp. paratuberculosis
gccguggacgugcaccgagaug

SEQ ID NO: 21235 - RNA, 22 nt, Mycobacterium avium subsp. paratuberculosis
gccguggcguuacacgcgcgag

SEQ ID NO: 21236 - RNA, 21 nt, Mycobacterium avium subsp. paratuberculosis
gccguggcguuacgagcgagc

SEQ ID NO: 21237 - RNA, 22 nt, Mycobacterium avium subsp. paratuberculosis
gccgugguggcgcugaaaucga

SEQ ID NO: 21238 - RNA, 22 nt, Mycobacterium avium subsp. paratuberculosis
gccguggugguuagcggcauga

SEQ ID NO: 21239 - RNA, 22 nt, Mycobacterium avium subsp. paratuberculosis
gccgugugccgugaacgccgcg

SEQ ID NO: 21240 - RNA, 21 nt, Mycobacterium avium subsp. paratuberculosis
gccguugcggaaauucuuguu

SEQ ID NO: 21241 - RNA, 22 nt, Mycobacterium avium subsp. paratuberculosis
gccuaccucacuugucugacug

SEQ ID NO: 21242 - RNA, 22 nt, Mycobacterium avium subsp. paratuberculosis
gccuccagcgccaucaccagcu

SEQ ID NO: 21243 - RNA, 22 nt, Mycobacterium avium subsp. paratuberculosis
gccucgaggaccuggauucggc

SEQ ID NO: 21244 - RNA, 22 nt, Mycobacterium avium subsp. paratuberculosis
gccucgcagcugaucaggacgc

SEQ ID NO: 21245 - RNA, 21 nt, Mycobacterium avium subsp. paratuberculosis
gccugggcaccaggucgacga

SEQ ID NO: 21246 - RNA, 22 nt, Mycobacterium avium subsp. paratuberculosis
gccuucuggucgaugacgcgcc

SEQ ID NO: 21247 - RNA, 22 nt, Mycobacterium avium subsp. paratuberculosis
gccuugggcugcaccuuggcca

SEQ ID NO: 21248 - RNA, 22 nt, Mycobacterium avium subsp. paratuberculosis
gcgaaagugcaacuggcgacgc

SEQ ID NO: 21249 - RNA, 22 nt, Mycobacterium avium subsp. paratuberculosis
gcgaagucaucaccggggauca

SEQ ID NO: 21250 - RNA, 22 nt, Mycobacterium avium subsp. paratuberculosis
gcgaccugcuguucgcccggcu

SEQ ID NO: 21251 - RNA, 22 nt, Mycobacterium avium subsp. paratuberculosis
gcguagaacgauacucucgugu

SEQ ID NO: 21252 - RNA, 22 nt, Mycobacterium avium subsp. paratuberculosis
gcgucaccggucgucuugguga

SEQ ID NO: 21253 - RNA, 22 nt, Mycobacterium avium subsp. paratuberculosis
gcguccaauccccgguucucgg

SEQ ID NO: 21254 - RNA, 22 nt, Mycobacterium avium subsp. paratuberculosis
gcgucgacguccucgucggugg

SEQ ID NO: 21255 - RNA, 22 nt, Mycobacterium avium subsp. paratuberculosis
gcgucgagugugcgggugcugc

SEQ ID NO: 21256 - RNA, 22 nt, Mycobacterium avium subsp. paratuberculosis
gcgucgugauccgcgggcagac

SEQ ID NO: 21257 - RNA, 22 nt, Mycobacterium avium subsp. paratuberculosis
gcgugccgacuauguggugacc

SEQ ID NO: 21258 - RNA, 23 nt, Mycobacterium avium subsp. paratuberculosis
gcgugguccggugacgcggccgc

SEQ ID NO: 21259 - RNA, 22 nt, Mycobacterium avium subsp. paratuberculosis
gcguggugaucguguuccccgg

SEQ ID NO: 21260 - RNA, 22 nt, Mycobacterium avium subsp. paratuberculosis
gcguguucucgucggugugaua

SEQ ID NO: 21261 - RNA, 22 nt, Mycobacterium avium subsp. paratuberculosis
gcguuucagugugcauccuggg

SEQ ID NO: 21262 - RNA, 23 nt, Mycobacterium avium subsp. paratuberculosis
gcuaccuguaccgcaccaugauc

SEQ ID NO: 21263 - RNA, 22 nt, Mycobacterium avium subsp. paratuberculosis
gcucaucgagagcgaccggggu

SEQ ID NO: 21264 - RNA, 22 nt, Mycobacterium avium subsp. paratuberculosis
gcucgacgguaaccgugacggc

SEQ ID NO: 21265 - RNA, 22 nt, Mycobacterium avium subsp. paratuberculosis
gcucggcgaugguguuggccaa

SEQ ID NO: 21266 - RNA, 22 nt, Mycobacterium avium subsp. paratuberculosis
gcugaacaugucccaggucgcc

SEQ ID NO: 21267 - RNA, 22 nt, Mycobacterium avium subsp. paratuberculosis
gcugacagcgcgggcaccacag

SEQ ID NO: 21268 - RNA, 22 nt, Mycobacterium avium subsp. paratuberculosis
gcugaccaaccugucgcgggca

SEQ ID NO: 21269 - RNA, 22 nt, Mycobacterium avium subsp. paratuberculosis
gcugacuguugcgccggccugg

SEQ ID NO: 21270 - RNA, 22 nt, Mycobacterium avium subsp. paratuberculosis
gcugaucggcgggucgaacguc

SEQ ID NO: 21271 - RNA, 22 nt, Mycobacterium avium subsp. paratuberculosis
gcugcaucgcgaaccggucgcc

SEQ ID NO: 21272 - RNA, 22 nt, Mycobacterium avium subsp. paratuberculosis
gcugccgguaggugaugccggc

SEQ ID NO: 21273 - RNA, 22 nt, Mycobacterium avium subsp. paratuberculosis
gcugcgcgagcucgacgugcug

SEQ ID NO: 21274 - RNA, 22 nt, Mycobacterium avium subsp. paratuberculosis
gcugcgcgcgcacuucgacacc

SEQ ID NO: 21275 - RNA, 22 nt, Mycobacterium avium subsp. paratuberculosis
gcugcgcggcuugcugcgguag

SEQ ID NO: 21276 - RNA, 21 nt, Mycobacterium avium subsp. paratuberculosis
gcugcucggcgaucuccuuga

SEQ ID NO: 21277 - RNA, 22 nt, Mycobacterium avium subsp. paratuberculosis
gcuggccuaccggcuuuccggc

SEQ ID NO: 21278 - RNA, 23 nt, Mycobacterium avium subsp. paratuberculosis
gcuggcgaugcaccuggccgccg

SEQ ID NO: 21279 - RNA, 22 nt, Mycobacterium avium subsp. paratuberculosis
gcuggcgguggucuuggccggg

SEQ ID NO: 21280 - RNA, 22 nt, Mycobacterium avium subsp. paratuberculosis
gcuggcguggaucgaccgcuga

SEQ ID NO: 21281 - RNA, 22 nt, Mycobacterium avium subsp. paratuberculosis
gcuggguggcgaccaucgccgg

SEQ ID NO: 21282 - RNA, 22 nt, Mycobacterium avium subsp. paratuberculosis
gcuggucucgagcugcacccgc

SEQ ID NO: 21283 - RNA, 22 nt, Mycobacterium avium subsp. paratuberculosis
gcuggugcaaagcggcgccggc

SEQ ID NO: 21284 - RNA, 22 nt, Mycobacterium avium subsp. paratuberculosis
gcuguacgaccugcccaucguc

SEQ ID NO: 21285 - RNA, 22 nt, Mycobacterium avium subsp. paratuberculosis
gcugucgcucgguugcugauga

SEQ ID NO: 21286 - RNA, 22 nt, Mycobacterium avium subsp. paratuberculosis
gcugucgcuggaggagaaaccc

SEQ ID NO: 21287 - RNA, 22 nt, Mycobacterium avium subsp. paratuberculosis
gcugucgcuguucggggugcau

SEQ ID NO: 21288 - RNA, 22 nt, Mycobacterium avium subsp. paratuberculosis
gcugucggagucggugucggug

SEQ ID NO: 21289 - RNA, 22 nt, Mycobacterium avium subsp. paratuberculosis
gcugugggggcucgagcuggac

SEQ ID NO: 21290 - RNA, 22 nt, Mycobacterium avium subsp. paratuberculosis
gcuguuuuugugcaucuggauc

SEQ ID NO: 21291 - RNA, 21 nt, Mycobacterium avium subsp. paratuberculosis
gcuuccugcaugcccucgauc

SEQ ID NO: 21292 - RNA, 20 nt, Mycobacterium avium subsp. paratuberculosis
gcuuuugcgucugcucgcgc

SEQ ID NO: 21293 - RNA, 22 nt, Mycobacterium avium subsp. paratuberculosis
gcuuuugugacugcucgcgcug

SEQ ID NO: 21294 - RNA, 22 nt, Mycobacterium avium subsp. paratuberculosis
gcuuuugugucugcucgcggua

SEQ ID NO: 21295 - RNA, 22 nt, Mycobacterium avium subsp. paratuberculosis
ggaacaccuugccgaugugcug

SEQ ID NO: 21296 - RNA, 22 nt, Mycobacterium avium subsp. paratuberculosis
ggaagucggcgcucgacgucau

SEQ ID NO: 21297 - RNA, 22 nt, Mycobacterium avium subsp. paratuberculosis
ggaccacggucuacgagaucga

SEQ ID NO: 21298 - RNA, 22 nt, Mycobacterium avium subsp. paratuberculosis
ggaccucggcguggacgcugau

SEQ ID NO: 21299 - RNA, 22 nt, Mycobacterium avium subsp. paratuberculosis
ggacgucggcgcgcucggugcu

SEQ ID NO: 21300 - RNA, 22 nt, Mycobacterium avium subsp. paratuberculosis
ggagccguccagaucgacggca

SEQ ID NO: 21301 - RNA, 22 nt, Mycobacterium avium subsp. paratuberculosis
ggaucggagacguccucggcga

SEQ ID NO: 21302 - RNA, 22 nt, Mycobacterium avium subsp. paratuberculosis
ggcaacucaggcaccaacgcgc

SEQ ID NO: 21303 - RNA, 22 nt, Mycobacterium avium subsp. paratuberculosis
ggcacauccugugcggcgucga

SEQ ID NO: 21304 - RNA, 22 nt, Mycobacterium avium subsp. paratuberculosis
ggcaccgguuuccgagcugcgc

SEQ ID NO: 21305 - RNA, 22 nt, Mycobacterium avium subsp. paratuberculosis
ggcaccgugggucagggcgcgg

SEQ ID NO: 21306 - RNA, 18 nt, Mycobacterium avium subsp. paratuberculosis
ggcacggcuucgggacag

SEQ ID NO: 21307 - RNA, 22 nt, Mycobacterium avium subsp. paratuberculosis
ggcagcgacuacgacccgaugc

SEQ ID NO: 21308 - RNA, 22 nt, Mycobacterium avium subsp. paratuberculosis
ggcaugugucggcggccagcgc

SEQ ID NO: 21309 - RNA, 21 nt, Mycobacterium avium subsp. paratuberculosis
ggccacgucgucaugugagcg

SEQ ID NO: 21310 - RNA, 22 nt, Mycobacterium avium subsp. paratuberculosis
ggccauguucgggguggccuac

SEQ ID NO: 21311 - RNA, 22 nt, Mycobacterium avium subsp. paratuberculosis
ggcccgaucugcgcggaguugu

SEQ ID NO: 21312 - RNA, 22 nt, Mycobacterium avium subsp. paratuberculosis
ggccgaccuggguuguuucggc

SEQ ID NO: 21313 - RNA, 22 nt, Mycobacterium avium subsp. paratuberculosis
ggccgccgaacggcggguggcc

SEQ ID NO: 21314 - RNA, 22 nt, Mycobacterium avium subsp. paratuberculosis
ggccgcgucgucacccaguggc

SEQ ID NO: 21315 - RNA, 22 nt, Mycobacterium avium subsp. paratuberculosis
ggccgcuaaggaacucagcgcg

SEQ ID NO: 21316 - RNA, 22 nt, Mycobacterium avium subsp. paratuberculosis
ggccggcgaccugucgaucugg

SEQ ID NO: 21317 - RNA, 20 nt, Mycobacterium avium subsp. paratuberculosis
ggccggcgguguggucgccu

SEQ ID NO: 21318 - RNA, 22 nt, Mycobacterium avium subsp. paratuberculosis
ggccggggucugggcguugagg

SEQ ID NO: 21319 - RNA, 22 nt, Mycobacterium avium subsp. paratuberculosis
ggccgucguccuguguuaucca

SEQ ID NO: 21320 - RNA, 22 nt, Mycobacterium avium subsp. paratuberculosis
ggccgucucguagccgaugccg

SEQ ID NO: 21321 - RNA, 22 nt, Mycobacterium avium subsp. paratuberculosis
ggccuggucaucgagcuggcgg

SEQ ID NO: 21322 - RNA, 22 nt, Mycobacterium avium subsp. paratuberculosis
cucuucgaucuguuugccguag

SEQ ID NO: 21323 - RNA, 22 nt, Mycobacterium avium subsp. paratuberculosis
cugaccaggaagaugccgauca

SEQ ID NO: 21324 - RNA, 22 nt, Mycobacterium avium subsp. paratuberculosis
cugacgcucguuucgcauggca

SEQ ID NO: 21325 - RNA, 22 nt, Mycobacterium avium subsp. paratuberculosis
cugauuguguucgcggcggccu

SEQ ID NO: 21326 - RNA, 22 nt, Mycobacterium avium subsp. paratuberculosis
cugcaccgacgcggacggcgag

SEQ ID NO: 21327 - RNA, 22 nt, Mycobacterium avium subsp. paratuberculosis
cugccgaucggcaccguggugc

SEQ ID NO: 21328 - RNA, 22 nt, Mycobacterium avium subsp. paratuberculosis
cugccguggauuugcgcgccgc

SEQ ID NO: 21329 - RNA, 22 nt, Mycobacterium avium subsp. paratuberculosis
cugcgcaucccaggugaaugac

SEQ ID NO: 21330 - RNA, 22 nt, Mycobacterium avium subsp. paratuberculosis
cugcgccggcuucggcugagcc

SEQ ID NO: 21331 - RNA, 22 nt, Mycobacterium avium subsp. paratuberculosis
cugcgcggcggaguguugcugc

SEQ ID NO: 21332 - RNA, 17 nt, Mycobacterium avium subsp. paratuberculosis
cugcggcagcgccucga

SEQ ID NO: 21333 - RNA, 22 nt, Mycobacterium avium subsp. paratuberculosis
cugcuggaccggguggaccugc

SEQ ID NO: 21334 - RNA, 22 nt, Mycobacterium avium subsp. paratuberculosis
cugcuggucgaucugguggacc

SEQ ID NO: 21335 - RNA, 21 nt, Mycobacterium avium subsp. paratuberculosis
cuggauguacgccggcggcgc

SEQ ID NO: 21336 - RNA, 22 nt, Mycobacterium avium subsp. paratuberculosis
cuggccggcuucgcgggcgugg

SEQ ID NO: 21337 - RNA, 22 nt, Mycobacterium avium subsp. paratuberculosis
cuggcgaucgagcucgucacgc

SEQ ID NO: 21338 - RNA, 22 nt, Mycobacterium avium subsp. paratuberculosis
cuggcgauuccgcguggcgccg

SEQ ID NO: 21339 - RNA, 22 nt, Mycobacterium avium subsp. paratuberculosis
cuggcgccguugggucuggugu

SEQ ID NO: 21340 - RNA, 22 nt, Mycobacterium avium subsp. paratuberculosis
cugggcaccgugccgugaugcu

SEQ ID NO: 21341 - RNA, 22 nt, Mycobacterium avium subsp. paratuberculosis
cugggcgcggugguggccgcca

SEQ ID NO: 21342 - RNA, 22 nt, Mycobacterium avium subsp. paratuberculosis
cuggucagguacaguguuuaga

SEQ ID NO: 21343 - RNA, 22 nt, Mycobacterium avium subsp. paratuberculosis
ggccuggugacgggcgucugcu

SEQ ID NO: 21344 - RNA, 21 nt, Mycobacterium avium subsp. paratuberculosis
ggcgaccgccauguccgccga

SEQ ID NO: 21345 - RNA, 22 nt, Mycobacterium avium subsp. paratuberculosis
ggcgagcucaaggucgaacugg

SEQ ID NO: 21346 - RNA, 22 nt, Mycobacterium avium subsp. paratuberculosis
ggcgaugcgcgggagccgcuug

SEQ ID NO: 21347 - RNA, 22 nt, Mycobacterium avium subsp. paratuberculosis
ggcgaugcuggccuucacguuc

SEQ ID NO: 21348 - RNA, 22 nt, Mycobacterium avium subsp. paratuberculosis
ggcgcaggcggucgagcugcag

SEQ ID NO: 21349 - RNA, 22 nt, Mycobacterium avium subsp. paratuberculosis
ggcgccgcgaucgugagccuga

SEQ ID NO: 21350 - RNA, 22 nt, Mycobacterium avium subsp. paratuberculosis
ggcgcgauuccccagcgcgcca

SEQ ID NO: 21351 - RNA, 22 nt, Mycobacterium avium subsp. paratuberculosis
ggcgcgggcgucccgguggugc

SEQ ID NO: 21352 - RNA, 22 nt, Mycobacterium avium subsp. paratuberculosis
ggcgcguucggcgaucacgucg

SEQ ID NO: 21353 - RNA, 22 nt, Mycobacterium avium subsp. paratuberculosis
ggcgcugcaacgcgacgucguc

SEQ ID NO: 21354 - RNA, 22 nt, Mycobacterium avium subsp. paratuberculosis
ggcgcugcuguuuucgcggucg

SEQ ID NO: 21355 - RNA, 22 nt, Mycobacterium avium subsp. paratuberculosis
ggcggccgugcuguggcaggau

SEQ ID NO: 21356 - RNA, 22 nt, Mycobacterium avium subsp. paratuberculosis
ggcggcgaccgacucgcccgga

SEQ ID NO: 21357 - RNA, 22 nt, Mycobacterium avium subsp. paratuberculosis
ggcggcucguacuagagggccu

SEQ ID NO: 21358 - RNA, 19 nt, Mycobacterium avium subsp. paratuberculosis
ggcggcugaccgucgagug

SEQ ID NO: 21359 - RNA, 22 nt, Mycobacterium avium subsp. paratuberculosis
ggcggggagaaggugacgcugc

SEQ ID NO: 21360 - RNA, 22 nt, Mycobacterium avium subsp. paratuberculosis
ggcgggguugagcagcggaugc

SEQ ID NO: 21361 - RNA, 22 nt, Mycobacterium avium subsp. paratuberculosis
ggcggucggcucguccaccacc

SEQ ID NO: 21362 - RNA, 22 nt, Mycobacterium avium subsp. paratuberculosis
ggcgucgagcauguauucgggu

SEQ ID NO: 21363 - RNA, 22 nt, Mycobacterium avium subsp. paratuberculosis
ggcgucgaguacgacagcccgu

SEQ ID NO: 21364 - RNA, 22 nt, Mycobacterium avium subsp. paratuberculosis
ggcgucgaugugcucgucggcg

SEQ ID NO: 21365 - RNA, 20 nt, Mycobacterium avium subsp. paratuberculosis
ggcgucguccaucacgucgc

SEQ ID NO: 21366 - RNA, 22 nt, Mycobacterium avium subsp. paratuberculosis
ggcuacucgcugaucgucgacg

SEQ ID NO: 21367 - RNA, 22 nt, Mycobacterium avium subsp. paratuberculosis
ggcucaccauuuguuugcccgg

SEQ ID NO: 21368 - RNA, 22 nt, Mycobacterium avium subsp. paratuberculosis
ggcucgacggcuggccggaagc

SEQ ID NO: 21369 - RNA, 22 nt, Mycobacterium avium subsp. paratuberculosis
ggcucggugcugcccgccauca

SEQ ID NO: 21370 - RNA, 23 nt, Mycobacterium avium subsp. paratuberculosis
ggcucgguggcgaguuggcggac

SEQ ID NO: 21371 - RNA, 22 nt, Mycobacterium avium subsp. paratuberculosis
ggcugcagguggugccgggcga

SEQ ID NO: 21372 - RNA, 21 nt, Mycobacterium avium subsp. paratuberculosis
ggcugcgcgggagucgcccgc

SEQ ID NO: 21373 - RNA, 22 nt, Mycobacterium avium subsp. paratuberculosis
ggcugcugaccgaauccgacgu

SEQ ID NO: 21374 - RNA, 22 nt, Mycobacterium avium subsp. paratuberculosis
ggcugcugccgucgcugugcgg

SEQ ID NO: 21375 - RNA, 22 nt, Mycobacterium avium subsp. paratuberculosis
ggcuggcgaccgacugguccac

SEQ ID NO: 21376 - RNA, 22 nt, Mycobacterium avium subsp. paratuberculosis
ggcuggugcccgagcgcggcua

SEQ ID NO: 21377 - RNA, 22 nt, Mycobacterium avium subsp. paratuberculosis
ggcuguugcgcggcagcggccu

SEQ ID NO: 21378 - RNA, 22 nt, Mycobacterium avium subsp. paratuberculosis
ggcuucgcccgccgagcgucac

SEQ ID NO: 21379 - RNA, 22 nt, Mycobacterium avium subsp. paratuberculosis
ggcuugacaucuauuccggacu

SEQ ID NO: 21380 - RNA, 22 nt, Mycobacterium avium subsp. paratuberculosis
ggcuugaggucgucgcggucac

SEQ ID NO: 21381 - RNA, 20 nt, Mycobacterium avium subsp. paratuberculosis
gggcaugcaucgggcgacac

SEQ ID NO: 21382 - RNA, 22 nt, Mycobacterium avium subsp. paratuberculosis
gggccgacggugagaauuugcg

SEQ ID NO: 21383 - RNA, 22 nt, Mycobacterium avium subsp. paratuberculosis
gggccgcacucccgagauggcg

SEQ ID NO: 21384 - RNA, 22 nt, Mycobacterium avium subsp. paratuberculosis
gggcgacgacgucagcacgcug

SEQ ID NO: 21385 - RNA, 22 nt, Mycobacterium avium subsp. paratuberculosis
gggcgcuggcgcuggacagcga

SEQ ID NO: 21386 - RNA, 22 nt, Mycobacterium avium subsp. paratuberculosis
gggcggcacggugacggccagg

SEQ ID NO: 21387 - RNA, 22 nt, Mycobacterium avium subsp. paratuberculosis
gggcuggacgaacccgugggug

SEQ ID NO: 21388 - RNA, 22 nt, Mycobacterium avium subsp. paratuberculosis
gggcuuggcgcagcgccgcaua

SEQ ID NO: 21389 - RNA, 20 nt, Mycobacterium avium subsp. paratuberculosis
gggcuuuugcgucugcucgc

SEQ ID NO: 21390 - RNA, 22 nt, Mycobacterium avium subsp. paratuberculosis
ggggauccacgcggcgccgugc

SEQ ID NO: 21391 - RNA, 22 nt, Mycobacterium avium subsp. paratuberculosis
ggggcguugguugcggccccgc

SEQ ID NO: 21392 - RNA, 22 nt, Mycobacterium avium subsp. paratuberculosis
ggggcuacuggcgcgacguggg

SEQ ID NO: 21393 - RNA, 22 nt, Mycobacterium avium subsp. paratuberculosis
ggggcuuuugcgucugcucgcg

SEQ ID NO: 21394 - RNA, 20 nt, Mycobacterium avium subsp. paratuberculosis
gggggcuuuugcgucugcuc

SEQ ID NO: 21395 - RNA, 22 nt, Mycobacterium avium subsp. paratuberculosis
gggguucaucuccgcggcgucg

SEQ ID NO: 21396 - RNA, 22 nt, Mycobacterium avium subsp. paratuberculosis
gggucaccggauggucgaugac

SEQ ID NO: 21397 - RNA, 22 nt, Mycobacterium avium subsp. paratuberculosis
gggucuggucgucgacaucgug

SEQ ID NO: 21398 - RNA, 22 nt, Mycobacterium avium subsp. paratuberculosis
gggugagcaggauguuggccgg

SEQ ID NO: 21399 - RNA, 22 nt, Mycobacterium avium subsp. paratuberculosis
gggugcuuucgcgucugcucgc

SEQ ID NO: 21400 - RNA, 22 nt, Mycobacterium avium subsp. paratuberculosis
ggguggagugguugaccgacga

SEQ ID NO: 21401 - RNA, 22 nt, Mycobacterium avium subsp. paratuberculosis
ggguggggcuggucgccgccac

SEQ ID NO: 21402 - RNA, 22 nt, Mycobacterium avium subsp. paratuberculosis
ggguucgucccuggccgccgcg

SEQ ID NO: 21403 - RNA, 22 nt, Mycobacterium avium subsp. paratuberculosis
ggguuugcccgccucggcaucg

SEQ ID NO: 21404 - RNA, 22 nt, Mycobacterium avium subsp. paratuberculosis
ggucaggcucacgaucgcggcg

SEQ ID NO: 21405 - RNA, 22 nt, Mycobacterium avium subsp. paratuberculosis
ggucaucgggcaggugggcacc

SEQ ID NO: 21406 - RNA, 22 nt, Mycobacterium avium subsp. paratuberculosis
ggucaucucguccgacggguug

SEQ ID NO: 21407 - RNA, 22 nt, Mycobacterium avium subsp. paratuberculosis
ggucccagccgcggucggcggg

SEQ ID NO: 21408 - RNA, 22 nt, Mycobacterium avium subsp. paratuberculosis
ggucccgacggggagaucgagg

SEQ ID NO: 21409 - RNA, 22 nt, Mycobacterium avium subsp. paratuberculosis
gguccggcgcgguggacugcaa

SEQ ID NO: 21410 - RNA, 22 nt, Mycobacterium avium subsp. paratuberculosis
ggucgagcaugcguccggucug

SEQ ID NO: 21411 - RNA, 22 nt, Mycobacterium avium subsp. paratuberculosis
ggucgcgaugaucucccgccgc

SEQ ID NO: 21412 - RNA, 22 nt, Mycobacterium avium subsp. paratuberculosis
ggucggaaauucgugcgccugg

SEQ ID NO: 21413 - RNA, 22 nt, Mycobacterium avium subsp. paratuberculosis
ggucggcgaggcagacgugcaa

SEQ ID NO: 21414 - RNA, 22 nt, Mycobacterium avium subsp. paratuberculosis
ggugcggcagggcgacugaccg

SEQ ID NO: 21415 - RNA, 22 nt, Mycobacterium avium subsp. paratuberculosis
ggugcguaguugcagugucgcg

SEQ ID NO: 21416 - RNA, 22 nt, Mycobacterium avium subsp. paratuberculosis
ggugcugagccuggacgccgcc

SEQ ID NO: 21417 - RNA, 22 nt, Mycobacterium avium subsp. paratuberculosis
ggugcuggcgcuggacgccgau

SEQ ID NO: 21418 - RNA, 22 nt, Mycobacterium avium subsp. paratuberculosis
gguggacaaggaccucgccgcg

SEQ ID NO: 21419 - RNA, 22 nt, Mycobacterium avium subsp. paratuberculosis
ggugggcgcuggcggucaucgu

SEQ ID NO: 21420 - RNA, 22 nt, Mycobacterium avium subsp. paratuberculosis
gguggugaucccggccgagcgg

SEQ ID NO: 21421 - RNA, 22 nt, Mycobacterium avium subsp. paratuberculosis
ggugucacuccugcgugacgcu

SEQ ID NO: 21422 - RNA, 22 nt, Mycobacterium avium subsp. paratuberculosis
gguguucgccgccacgauggcc

SEQ ID NO: 21423 - RNA, 19 nt, Mycobacterium avium subsp. paratuberculosis
gguuccuccgucgguggug

SEQ ID NO: 21424 - RNA, 22 nt, Mycobacterium avium subsp. paratuberculosis
gguucgagcucgaucgugguga

SEQ ID NO: 21425 - RNA, 22 nt, Mycobacterium avium subsp. paratuberculosis
gguucggugucgccguaugucu

SEQ ID NO: 21426 - RNA, 20 nt, Mycobacterium avium subsp. paratuberculosis
gguugcggacgaucgccagc

SEQ ID NO: 21427 - RNA, 22 nt, Mycobacterium avium subsp. paratuberculosis
gguugucgaaguaccggaagcc

SEQ ID NO: 21428 - RNA, 22 nt, Mycobacterium avium subsp. paratuberculosis
guaccagcggccgucgcgcagc

SEQ ID NO: 21429 - RNA, 22 nt, Mycobacterium avium subsp. paratuberculosis
guaccggucaguccguccgcgg

SEQ ID NO: 21430 - RNA, 22 nt, Mycobacterium avium subsp. paratuberculosis
guagguguugaaaucgcaguaa

SEQ ID NO: 21431 - RNA, 22 nt, Mycobacterium avium subsp. paratuberculosis
guaguuggucuggccgcgguug

SEQ ID NO: 21432 - RNA, 22 nt, Mycobacterium avium subsp. paratuberculosis
guaucgacuacccaccaaguuu

SEQ ID NO: 21433 - RNA, 22 nt, Mycobacterium avium subsp. paratuberculosis
gucaccaaccaucaggcguuca

SEQ ID NO: 21434 - RNA, 22 nt, Mycobacterium avium subsp. paratuberculosis
gucaccaucaguugccacgacg

SEQ ID NO: 21435 - RNA, 22 nt, Mycobacterium avium subsp. paratuberculosis
gucacgcuagcgugacgcucgc

SEQ ID NO: 21436 - RNA, 22 nt, Mycobacterium avium subsp. paratuberculosis
gucagcccgccggccgauucuc

SEQ ID NO: 21437 - RNA, 22 nt, Mycobacterium avium subsp. paratuberculosis
gucagcgucaagccggccggcu

SEQ ID NO: 21438 - RNA, 22 nt, Mycobacterium avium subsp. paratuberculosis
gucaucuuggccugaccggacu

SEQ ID NO: 21439 - RNA, 22 nt, Mycobacterium avium subsp. paratuberculosis
gucauguccgggugcgcguggc

SEQ ID NO: 21440 - RNA, 22 nt, Mycobacterium avium subsp. paratuberculosis
guccaucuucgccagcucgcgc

SEQ ID NO: 21441 - RNA, 22 nt, Mycobacterium avium subsp. paratuberculosis
gucccggaugcgggugggcacc

SEQ ID NO: 21442 - RNA, 22 nt, Mycobacterium avium subsp. paratuberculosis
guccgaggucgcugcgccgacg

SEQ ID NO: 21443 - RNA, 22 nt, Mycobacterium avium subsp. paratuberculosis
guccgcaacgucgacuccgagu

SEQ ID NO: 21444 - RNA, 22 nt, Mycobacterium avium subsp. paratuberculosis
guccggcucguacaagcgguuc

SEQ ID NO: 21445 - RNA, 22 nt, Mycobacterium avium subsp. paratuberculosis
gucgacgaggacgacuuucggu

SEQ ID NO: 21446 - RNA, 22 nt, Mycobacterium avium subsp. paratuberculosis
gucgacgcgcucucggcguuca

SEQ ID NO: 21447 - RNA, 22 nt, Mycobacterium avium subsp. paratuberculosis
gucgaucucguguugcaggucg

SEQ ID NO: 21448 - RNA, 22 nt, Mycobacterium avium subsp. paratuberculosis
gucgccagcuugccgggccgcg

SEQ ID NO: 21449 - RNA, 20 nt, Mycobacterium avium subsp. paratuberculosis
gucgcccggcuugaucggcg

SEQ ID NO: 21450 - RNA, 22 nt, Mycobacterium avium subsp. paratuberculosis
gucgcccuugccgacgccgacg

SEQ ID NO: 21451 - RNA, 22 nt, Mycobacterium avium subsp. paratuberculosis
gucgccggagguggcgaagccg

SEQ ID NO: 21452 - RNA, 22 nt, Mycobacterium avium subsp. paratuberculosis
gucgccgugccgguggcugauc

SEQ ID NO: 21453 - RNA, 22 nt, Mycobacterium avium subsp. paratuberculosis
gucgccuaucaggccaccacga

SEQ ID NO: 21454 - RNA, 22 nt, Mycobacterium avium subsp. paratuberculosis
gucgcgcaggucggcagggugg

SEQ ID NO: 21455 - RNA, 22 nt, Mycobacterium avium subsp. paratuberculosis
gucgcgcugcagcagucggugc

SEQ ID NO: 21456 - RNA, 22 nt, Mycobacterium avium subsp. paratuberculosis
gucgcggcggugccgguagugg

SEQ ID NO: 21457 - RNA, 22 nt, Mycobacterium avium subsp. paratuberculosis
gucgcggugcgcaggaaugccg

SEQ ID NO: 21458 - RNA, 22 nt, Mycobacterium avium subsp. paratuberculosis
gucgcugaggcugcgggugggg

SEQ ID NO: 21459 - RNA, 22 nt, Mycobacterium avium subsp. paratuberculosis
gucggagaucugcgaggccgac

SEQ ID NO: 21460 - RNA, 22 nt, Mycobacterium avium subsp. paratuberculosis
gucggcaagcuuuuugcggcgc

SEQ ID NO: 21461 - RNA, 22 nt, Mycobacterium avium subsp. paratuberculosis
gucggcaugggccgggcgcuga

SEQ ID NO: 21462 - RNA, 22 nt, Mycobacterium avium subsp. paratuberculosis
gucggccggcccgaucggcgau

SEQ ID NO: 21463 - RNA, 22 nt, Mycobacterium avium subsp. paratuberculosis
gucggcgacgaguucguggugc

SEQ ID NO: 21464 - RNA, 22 nt, Mycobacterium avium subsp. paratuberculosis
gucggcggaugcugccaggugc

SEQ ID NO: 21465 - RNA, 22 nt, Mycobacterium avium subsp. paratuberculosis
gucggcuucgucucgguguuga

SEQ ID NO: 21466 - RNA, 22 nt, Mycobacterium avium subsp. paratuberculosis
gucgggcaccuccaguugcgac

SEQ ID NO: 21467 - RNA, 22 nt, Mycobacterium avium subsp. paratuberculosis
gucgggcugauggaugccgacc

SEQ ID NO: 21468 - RNA, 22 nt, Mycobacterium avium subsp. paratuberculosis
gucggucaccgucgucggaccg

SEQ ID NO: 21469 - RNA, 22 nt, Mycobacterium avium subsp. paratuberculosis
gucgguggugcaggccauggug

SEQ ID NO: 21470 - RNA, 22 nt, Mycobacterium avium subsp. paratuberculosis
gucggugucggugaaccgcacc

SEQ ID NO: 21471 - RNA, 19 nt, Mycobacterium avium subsp. paratuberculosis
gucgucgaauuucccggcc

SEQ ID NO: 21472 - RNA, 22 nt, Mycobacterium avium subsp. paratuberculosis
gucgucguccggcaccgcgaac

SEQ ID NO: 21473 - RNA, 22 nt, Mycobacterium avium subsp. paratuberculosis
gucgucgucgaaguccggcgcc

SEQ ID NO: 21474 - RNA, 22 nt, Mycobacterium avium subsp. paratuberculosis
gucgugaauuuguucaccaucg

SEQ ID NO: 21475 - RNA, 22 nt, Mycobacterium avium subsp. paratuberculosis
gugacacgcugauuucucguac

SEQ ID NO: 21476 - RNA, 22 nt, Mycobacterium avium subsp. paratuberculosis
gugaccgcgcgagagcaguacg

SEQ ID NO: 21477 - RNA, 18 nt, Mycobacterium avium subsp. paratuberculosis
gugacgagcucgaucgcc

SEQ ID NO: 21478 - RNA, 22 nt, Mycobacterium avium subsp. paratuberculosis
gugacgaucacgucgccggggc

SEQ ID NO: 21479 - RNA, 22 nt, Mycobacterium avium subsp. paratuberculosis
gugacucgcggggugcgcgagu

SEQ ID NO: 21480 - RNA, 22 nt, Mycobacterium avium subsp. paratuberculosis
gugaucgguagcagguccgaca

SEQ ID NO: 21481 - RNA, 22 nt, Mycobacterium avium subsp. paratuberculosis
gugauucggauucgccgcgcag

SEQ ID NO: 21482 - RNA, 22 nt, Mycobacterium avium subsp. paratuberculosis
gugauugguugcggcgguggcg

SEQ ID NO: 21483 - RNA, 20 nt, Mycobacterium avium subsp. paratuberculosis
gugcacaucgacccggcgga

SEQ ID NO: 21484 - RNA, 22 nt, Mycobacterium avium subsp. paratuberculosis
gugcaggucguguucccaggug

SEQ ID NO: 21485 - RNA, 22 nt, Mycobacterium avium subsp. paratuberculosis
gugcauccuggcgggcgucguc

SEQ ID NO: 21486 - RNA, 22 nt, Mycobacterium avium subsp. paratuberculosis
gugccccagcagcucggugagc

SEQ ID NO: 21487 - RNA, 22 nt, Mycobacterium avium subsp. paratuberculosis
gugccgcaugucgccgacgaug

SEQ ID NO: 21488 - RNA, 22 nt, Mycobacterium avium subsp. paratuberculosis
gugcggauugcgauacaugucg

SEQ ID NO: 21489 - RNA, 22 nt, Mycobacterium avium subsp. paratuberculosis
gugcgggccggcucguuaccgc

SEQ ID NO: 21490 - RNA, 22 nt, Mycobacterium avium subsp. paratuberculosis
gugcgggggcuuuugcgucuuc

SEQ ID NO: 21491 - RNA, 22 nt, Mycobacterium avium subsp. paratuberculosis
gugcgggucgacucgucgcugc

SEQ ID NO: 21492 - RNA, 22 nt, Mycobacterium avium subsp. paratuberculosis
gugcgguguggggugacgacgu

SEQ ID NO: 21493 - RNA, 22 nt, Mycobacterium avium subsp. paratuberculosis
gugcucgcugaccuaccccggc

SEQ ID NO: 21494 - RNA, 17 nt, Mycobacterium avium subsp. paratuberculosis
gugcucggcucgcccgc

SEQ ID NO: 21495 - RNA, 22 nt, Mycobacterium avium subsp. paratuberculosis
guggacagcccgaccagcgugc

SEQ ID NO: 21496 - RNA, 22 nt, Mycobacterium avium subsp. paratuberculosis
guggaguuccugcucgacgaac

SEQ ID NO: 21497 - RNA, 22 nt, Mycobacterium avium subsp. paratuberculosis
guggcacucuuggccgcgacga

SEQ ID NO: 21498 - RNA, 22 nt, Mycobacterium avium subsp. paratuberculosis
guggccucgggaugcaugccga

SEQ ID NO: 21499 - RNA, 22 nt, Mycobacterium avium subsp. paratuberculosis
guggcgcuggauccuggcgccc

SEQ ID NO: 21500 - RNA, 22 nt, Mycobacterium avium subsp. paratuberculosis
guggcggccgacgucaugcugg

SEQ ID NO: 21501 - RNA, 22 nt, Mycobacterium avium subsp. paratuberculosis
guggcggucuugaauucgauca

SEQ ID NO: 21502 - RNA, 22 nt, Mycobacterium avium subsp. paratuberculosis
guggcggugcacaggucccagc

SEQ ID NO: 21503 - RNA, 22 nt, Mycobacterium avium subsp. paratuberculosis
guggcgguucgucgcguaucug

SEQ ID NO: 21504 - RNA, 22 nt, Mycobacterium avium subsp. paratuberculosis
gugggcgccgucaaugguguag

SEQ ID NO: 21505 - RNA, 22 nt, Mycobacterium avium subsp. paratuberculosis
gugggcugucggugaccuggcu

SEQ ID NO: 21506 - RNA, 22 nt, Mycobacterium avium subsp. paratuberculosis
guggggccgagcuggcgcagga

SEQ ID NO: 21507 - RNA, 22 nt, Mycobacterium avium subsp. paratuberculosis
guggggucaguucccggcgacg

SEQ ID NO: 21508 - RNA, 22 nt, Mycobacterium avium subsp. paratuberculosis
guggguguagccgcgccugcca

SEQ ID NO: 21509 - RNA, 22 nt, Mycobacterium avium subsp. paratuberculosis
guggugaccuacgugcgggugg

SEQ ID NO: 21510 - RNA, 22 nt, Mycobacterium avium subsp. paratuberculosis
guguacccgggccgcagccagu

SEQ ID NO: 21511 - RNA, 22 nt, Mycobacterium avium subsp. paratuberculosis
gugucacgcuggcgugacguuc

SEQ ID NO: 21512 - RNA, 21 nt, Mycobacterium avium subsp. paratuberculosis
guguccugucucaaggcguug

SEQ ID NO: 21513 - RNA, 22 nt, Mycobacterium avium subsp. paratuberculosis
gugucgguagaugcacuuucgu

SEQ ID NO: 21514 - RNA, 22 nt, Mycobacterium avium subsp. paratuberculosis
gugugcgugauuuaagugucgc

SEQ ID NO: 21515 - RNA, 22 nt, Mycobacterium avium subsp. paratuberculosis
gugugcuccgccgggacaccgg

SEQ ID NO: 21516 - RNA, 22 nt, Mycobacterium avium subsp. paratuberculosis
guucccgguguggcugucggug

SEQ ID NO: 21517 - RNA, 22 nt, Mycobacterium avium subsp. paratuberculosis
guucgguauucgacaacgucgu

SEQ ID NO: 21518 - RNA, 20 nt, Mycobacterium avium subsp. paratuberculosis
guucgucgcugaccgggguc

SEQ ID NO: 21519 - RNA, 22 nt, Mycobacterium avium subsp. paratuberculosis
guucgugccgaccgucaucgcg

SEQ ID NO: 21520 - RNA, 22 nt, Mycobacterium avium subsp. paratuberculosis
guugacccgcucgugcguucgg

SEQ ID NO: 21521 - RNA, 22 nt, Mycobacterium avium subsp. paratuberculosis
guugaucggcuugacuugccgc

SEQ ID NO: 21522 - RNA, 22 nt, Mycobacterium avium subsp. paratuberculosis
guugccgacguuguucaccacc

SEQ ID NO: 21523 - RNA, 22 nt, Mycobacterium avium subsp. paratuberculosis
guugccgucgggccggcgccgg

SEQ ID NO: 21524 - RNA, 22 nt, Mycobacterium avium subsp. paratuberculosis
guuggagguggccgccagcacg

SEQ ID NO: 21525 - RNA, 22 nt, Mycobacterium avium subsp. paratuberculosis
guugggguugacccugcugguc

SEQ ID NO: 21526 - RNA, 22 nt, Mycobacterium avium subsp. paratuberculosis
uaaccgacgugacggcgccgac

SEQ ID NO: 21527 - RNA, 22 nt, Mycobacterium avium subsp. paratuberculosis
uaacggcacccccagcgauuug

SEQ ID NO: 21528 - RNA, 22 nt, Mycobacterium avium subsp. paratuberculosis
uaacuggugauguugcgggcga

SEQ ID NO: 21529 - RNA, 22 nt, Mycobacterium avium subsp. paratuberculosis
uacaccgacgaggcguccagcg

SEQ ID NO: 21530 - RNA, 20 nt, Mycobacterium avium subsp. paratuberculosis
uacaccgccgcgcagguggc

SEQ ID NO: 21531 - RNA, 22 nt, Mycobacterium avium subsp. paratuberculosis
uacaccguuucggcggacuggg

SEQ ID NO: 21532 - RNA, 22 nt, Mycobacterium avium subsp. paratuberculosis
uacauggugcgcagcaccaucg

SEQ ID NO: 21533 - RNA, 22 nt, Mycobacterium avium subsp. paratuberculosis
uaccccagcuucgcgcacgugg

SEQ ID NO: 21534 - RNA, 22 nt, Mycobacterium avium subsp. paratuberculosis
uaccggaucaccuaugacgggu

SEQ ID NO: 21535 - RNA, 22 nt, Mycobacterium avium subsp. paratuberculosis
uaccggugaccgcgaaccaacc

SEQ ID NO: 21536 - RNA, 22 nt, Mycobacterium avium subsp. paratuberculosis
uaccgguugccgaucaggucga

SEQ ID NO: 21537 - RNA, 22 nt, Mycobacterium avium subsp. paratuberculosis
uaccuggugcgccugcacgagg

SEQ ID NO: 21538 - RNA, 22 nt, Mycobacterium avium subsp. paratuberculosis
uacgccgaauucgcggucucgu

SEQ ID NO: 21539 - RNA, 22 nt, Mycobacterium avium subsp. paratuberculosis
uacggcgugauggcggugacga

SEQ ID NO: 21540 - RNA, 22 nt, Mycobacterium avium subsp. paratuberculosis
uacgggaugcucagcucgcgga

SEQ ID NO: 21541 - RNA, 22 nt, Mycobacterium avium subsp. paratuberculosis
uacuccggcucaccgguguggg

SEQ ID NO: 21542 - RNA, 22 nt, Mycobacterium avium subsp. paratuberculosis
uagacacgaauacccuucggcc

SEQ ID NO: 21543 - RNA, 22 nt, Mycobacterium avium subsp. paratuberculosis
uagcccgcgagcgucgaguugu

SEQ ID NO: 21544 - RNA, 22 nt, Mycobacterium avium subsp. paratuberculosis
uagcgcaccacggcguugucca

SEQ ID NO: 21545 - RNA, 22 nt, Mycobacterium avium subsp. paratuberculosis
uagcugcguucgucgucgguga

SEQ ID NO: 21546 - RNA, 22 nt, Mycobacterium avium subsp. paratuberculosis
uaggcgccggucagcgacgcca

SEQ ID NO: 21547 - RNA, 22 nt, Mycobacterium avium subsp. paratuberculosis
ucacuauucgcgucucucgacc

SEQ ID NO: 21548 - RNA, 22 nt, Mycobacterium avium subsp. paratuberculosis
ucacugcuggucgcgcggcuga

SEQ ID NO: 21549 - RNA, 22 nt, Mycobacterium avium subsp. paratuberculosis
ucagcgguccugcugcaugguc

SEQ ID NO: 21550 - RNA, 22 nt, Mycobacterium avium subsp. paratuberculosis
ucaggcuggaagugcucggcuu

SEQ ID NO: 21551 - RNA, 22 nt, Mycobacterium avium subsp. paratuberculosis
ucaggugaacgauucguucggc

SEQ ID NO: 21552 - RNA, 22 nt, Mycobacterium avium subsp. paratuberculosis
uccaccacccgcaugggcgccu

SEQ ID NO: 21553 - RNA, 22 nt, Mycobacterium avium subsp. paratuberculosis
uccaccucgcugaagucgcugu

SEQ ID NO: 21554 - RNA, 22 nt, Mycobacterium avium subsp. paratuberculosis
uccacgacagcaccgcgccgcu

SEQ ID NO: 21555 - RNA, 22 nt, Mycobacterium avium subsp. paratuberculosis
uccagcgcgggucggugccguc

SEQ ID NO: 21556 - RNA, 22 nt, Mycobacterium avium subsp. paratuberculosis
uccagcggccgaucccggugug

SEQ ID NO: 21557 - RNA, 17 nt, Mycobacterium avium subsp. paratuberculosis
uccaggucggccgcggu

SEQ ID NO: 21558 - RNA, 22 nt, Mycobacterium avium subsp. paratuberculosis
uccauucucggccgggugcaca

SEQ ID NO: 21559 - RNA, 21 nt, Mycobacterium avium subsp. paratuberculosis
ucccaacgagaucauguuggc

SEQ ID NO: 21560 - RNA, 22 nt, Mycobacterium avium subsp. paratuberculosis
ucccagccggccaucgcccggu

SEQ ID NO: 21561 - RNA, 22 nt, Mycobacterium avium subsp. paratuberculosis
ucccgccgcgcugcagacugcg

SEQ ID NO: 21562 - RNA, 22 nt, Mycobacterium avium subsp. paratuberculosis
uccgaagcgcccgaagagguuu

SEQ ID NO: 21563 - RNA, 22 nt, Mycobacterium avium subsp. paratuberculosis
uccgaccugcgcgggaaggcga

SEQ ID NO: 21564 - RNA, 22 nt, Mycobacterium avium subsp. paratuberculosis
uccgcaccgcggugaagccggc

SEQ ID NO: 21565 - RNA, 22 nt, Mycobacterium avium subsp. paratuberculosis
uccgccagucccgcaggaucgc

SEQ ID NO: 21566 - RNA, 22 nt, Mycobacterium avium subsp. paratuberculosis
uccgcccuggcguuacgagcgg

SEQ ID NO: 21567 - RNA, 23 nt, Mycobacterium avium subsp. paratuberculosis
uccgccgcaaugccguccaccac

SEQ ID NO: 21568 - RNA, 22 nt, Mycobacterium avium subsp. paratuberculosis
uccgccggcgacaucgaugguc

SEQ ID NO: 21569 - RNA, 22 nt, Mycobacterium avium subsp. paratuberculosis
uccgccguggcguuacgagcgc

SEQ ID NO: 21570 - RNA, 22 nt, Mycobacterium avium subsp. paratuberculosis
uccgcgaauacgguuaccugau

SEQ ID NO: 21571 - RNA, 22 nt, Mycobacterium avium subsp. paratuberculosis
uccgcgacacugcaacuacgca

SEQ ID NO: 21572 - RNA, 22 nt, Mycobacterium avium subsp. paratuberculosis
uccgcgccaggucggcccgcga

SEQ ID NO: 21573 - RNA, 21 nt, Mycobacterium avium subsp. paratuberculosis
uccgcguccggucugaucgag

SEQ ID NO: 21574 - RNA, 23 nt, Mycobacterium avium subsp. paratuberculosis
uccggccggucaucaggccccuc

SEQ ID NO: 21575 - RNA, 22 nt, Mycobacterium avium subsp. paratuberculosis
uccgggaaccucgaccucgugg

SEQ ID NO: 21576 - RNA, 22 nt, Mycobacterium avium subsp. paratuberculosis
uccgggaucuggaauacgugcg

SEQ ID NO: 21577 - RNA, 22 nt, Mycobacterium avium subsp. paratuberculosis
uccggggugaucgucgggccga

SEQ ID NO: 21578 - RNA, 22 nt, Mycobacterium avium subsp. paratuberculosis
uccggugugggcgcggaccacg

SEQ ID NO: 21579 - RNA, 22 nt, Mycobacterium avium subsp. paratuberculosis
uccgguucgucugggucuggcu

SEQ ID NO: 21580 - RNA, 22 nt, Mycobacterium avium subsp. paratuberculosis
uccguccaggguggcgagcacg

SEQ ID NO: 21581 - RNA, 22 nt, Mycobacterium avium subsp. paratuberculosis
uccgucgacgcggugcugggcg

SEQ ID NO: 21582 - RNA, 22 nt, Mycobacterium avium subsp. paratuberculosis
uccucgcggaugggcucgcgcg

SEQ ID NO: 21583 - RNA, 22 nt, Mycobacterium avium subsp. paratuberculosis
uccuggucgugacgggcaucga

SEQ ID NO: 21584 - RNA, 20 nt, Mycobacterium avium subsp. paratuberculosis
uccuggugaucggcuucucg

SEQ ID NO: 21585 - RNA, 22 nt, Mycobacterium avium subsp. paratuberculosis
uccuucgccgacuaucugaugu

SEQ ID NO: 21586 - RNA, 22 nt, Mycobacterium avium subsp. paratuberculosis
ucgaacaucguuguggcacagc

SEQ ID NO: 21587 - RNA, 22 nt, Mycobacterium avium subsp. paratuberculosis
ucgaacuuuucgaggaucacca

SEQ ID NO: 21588 - RNA, 22 nt, Mycobacterium avium subsp. paratuberculosis
ucgaagcuggcgcuggucaggc

SEQ ID NO: 21589 - RNA, 22 nt, Mycobacterium avium subsp. paratuberculosis
ucgacaccgacaccguggugau

SEQ ID NO: 21590 - RNA, 21 nt, Mycobacterium avium subsp. paratuberculosis
ucgaccacggggugugccugc

SEQ ID NO: 21591 - RNA, 22 nt, Mycobacterium avium subsp. paratuberculosis
ucgaccagccggccgggccguc

SEQ ID NO: 21592 - RNA, 22 nt, Mycobacterium avium subsp. paratuberculosis
ucgaccaucuccgcguugagau

SEQ ID NO: 21593 - RNA, 22 nt, Mycobacterium avium subsp. paratuberculosis
ucgaccgccgccuucugcagga

SEQ ID NO: 21594 - RNA, 22 nt, Mycobacterium avium subsp. paratuberculosis
ucgacgaaauggccgagcagcg

SEQ ID NO: 21595 - RNA, 22 nt, Mycobacterium avium subsp. paratuberculosis
ucgacgaacaccagcaccgggg

SEQ ID NO: 21596 - RNA, 22 nt, Mycobacterium avium subsp. paratuberculosis
ucgacgacggcgaugucggcgc

SEQ ID NO: 21597 - RNA, 19 nt, Mycobacterium avium subsp. paratuberculosis
ucgacgacgucgaucaccu

SEQ ID NO: 21598 - RNA, 22 nt, Mycobacterium avium subsp. paratuberculosis
ucgacgaguucuacgagugguu

SEQ ID NO: 21599 - RNA, 23 nt, Mycobacterium avium subsp. paratuberculosis
ucgacgaugugacgcggccagcg

SEQ ID NO: 21600 - RNA, 22 nt, Mycobacterium avium subsp. paratuberculosis
ucgacgcggcguuuccaggcuu

SEQ ID NO: 21601 - RNA, 22 nt, Mycobacterium avium subsp. paratuberculosis
ucgacggccaucucggcggugg

SEQ ID NO: 21602 - RNA, 22 nt, Mycobacterium avium subsp. paratuberculosis
ucgacucgguucuugauccgca

SEQ ID NO: 21603 - RNA, 20 nt, Mycobacterium avium subsp. paratuberculosis
ucgacuugcccgagccggac

SEQ ID NO: 21604 - RNA, 22 nt, Mycobacterium avium subsp. paratuberculosis
ucgagacuuaaaccacgcacac

SEQ ID NO: 21605 - RNA, 22 nt, Mycobacterium avium subsp. paratuberculosis
ucgaggccgcaccguuuugcgu

SEQ ID NO: 21606 - RNA, 20 nt, Mycobacterium avium subsp. paratuberculosis
ucgaucgcggucuggggugg

SEQ ID NO: 21607 - RNA, 22 nt, Mycobacterium avium subsp. paratuberculosis
ucgaugaugccccgcacgauuu

SEQ ID NO: 21608 - RNA, 22 nt, Mycobacterium avium subsp. paratuberculosis
ugugggcgggcacguggcuuug

SEQ ID NO: 21609 - RNA, 22 nt, Mycobacterium avium subsp. paratuberculosis
uguggugcacgaacggcacguu

SEQ ID NO: 21610 - RNA, 22 nt, Mycobacterium avium subsp. paratuberculosis
uguucgacaccaccgcgagcag

SEQ ID NO: 21611 - RNA, 22 nt, Mycobacterium avium subsp. paratuberculosis
uguucggucaacgcggcguggc

SEQ ID NO: 21612 - RNA, 17 nt, Mycobacterium avium subsp. paratuberculosis
uguuggcggcacugauc

SEQ ID NO: 21613 - RNA, 22 nt, Mycobacterium avium subsp. paratuberculosis
uguugugcgagaugggcagcgg

SEQ ID NO: 21614 - RNA, 22 nt, Mycobacterium avium subsp. paratuberculosis
uucccgcgucgucgacggcggc

SEQ ID NO: 21615 - RNA, 22 nt, Mycobacterium avium subsp. paratuberculosis
uucgagugcggcacgcacccag

SEQ ID NO: 21616 - RNA, 22 nt, Mycobacterium avium subsp. paratuberculosis
uucgaguuggcggcuacgaccu

SEQ ID NO: 21617 - RNA, 22 nt, Mycobacterium avium subsp. paratuberculosis
uucgaucaggaucggguguucg

SEQ ID NO: 21618 - RNA, 22 nt, Mycobacterium avium subsp. paratuberculosis
uucgauguggugaccaucgcgg

SEQ ID NO: 21619 - RNA, 22 nt, Mycobacterium avium subsp. paratuberculosis
uucgccgugagugcacguucgg

SEQ ID NO: 21620 - RNA, 22 nt, Mycobacterium avium subsp. paratuberculosis
uucgcguguccaggaugcaucg

SEQ ID NO: 21621 - RNA, 22 nt, Mycobacterium avium subsp. paratuberculosis
uucggcggcuggaugcucgccg

SEQ ID NO: 21622 - RNA, 22 nt, Mycobacterium avium subsp. paratuberculosis
uucggcuggccggugcgcaccu

SEQ ID NO: 21623 - RNA, 22 nt, Mycobacterium avium subsp. paratuberculosis
uucggcuucggcgucaucuucg

SEQ ID NO: 21624 - RNA, 22 nt, Mycobacterium avium subsp. paratuberculosis
uucgggaucccacggaucggug

SEQ ID NO: 21625 - RNA, 22 nt, Mycobacterium avium subsp. paratuberculosis
uucggguucuucgucauccugc

SEQ ID NO: 21626 - RNA, 22 nt, Mycobacterium avium subsp. paratuberculosis
uucggugaccuggucgccccgc

SEQ ID NO: 21627 - RNA, 22 nt, Mycobacterium avium subsp. paratuberculosis
uucgucauggcguuacaggcgg

SEQ ID NO: 21628 - RNA, 22 nt, Mycobacterium avium subsp. paratuberculosis
uucgucgacguggugcuggcgc

SEQ ID NO: 21629 - RNA, 22 nt, Mycobacterium avium subsp. paratuberculosis
uucgugagcgauuucugcgcga

SEQ ID NO: 21630 - RNA, 22 nt, Mycobacterium avium subsp. paratuberculosis
uucucgggccucaugguuccgc

SEQ ID NO: 21631 - RNA, 22 nt, Mycobacterium avium subsp. paratuberculosis
uucugcucgacgaccucgccga

SEQ ID NO: 21632 - RNA, 22 nt, Mycobacterium avium subsp. paratuberculosis
uucuucgauuucaucgucacgc

SEQ ID NO: 21633 - RNA, 22 nt, Mycobacterium avium subsp. paratuberculosis
uugagcgguuacacgcgggccg

SEQ ID NO: 21634 - RNA, 22 nt, Mycobacterium avium subsp. paratuberculosis
uugaucaccgcgguuuccagcu

SEQ ID NO: 21635 - RNA, 22 nt, Mycobacterium avium subsp. paratuberculosis
uugaucgccgacgacgucacca

SEQ ID NO: 21636 - RNA, 22 nt, Mycobacterium avium subsp. paratuberculosis
uugauggcugaggccuacucgg

SEQ ID NO: 21637 - RNA, 22 nt, Mycobacterium avium subsp. paratuberculosis
uugccgaggcuguuggaucgcg

SEQ ID NO: 21638 - RNA, 22 nt, Mycobacterium avium subsp. paratuberculosis
uugcgccggaucgucggcuggu

SEQ ID NO: 21639 - RNA, 22 nt, Mycobacterium avium subsp. paratuberculosis
uugcggugcguuggccgccgag

SEQ ID NO: 21640 - RNA, 22 nt, Mycobacterium avium subsp. paratuberculosis
uugcucagccagcucgcgguga

SEQ ID NO: 21641 - RNA, 22 nt, Mycobacterium avium subsp. paratuberculosis
uugcuguuccugcucaccggca

SEQ ID NO: 21642 - RNA, 22 nt, Mycobacterium avium subsp. paratuberculosis
uuggcccgcgcccaggcgaugg

SEQ ID NO: 21643 - RNA, 22 nt, Mycobacterium avium subsp. paratuberculosis
uuggccgccuucucgaccgcgg

SEQ ID NO: 21644 - RNA, 22 nt, Mycobacterium avium subsp. paratuberculosis
uuggccggcagcucaccgcgcu

SEQ ID NO: 21645 - RNA, 22 nt, Mycobacterium avium subsp. paratuberculosis
uuggcgaucagguugcccagca

SEQ ID NO: 21646 - RNA, 22 nt, Mycobacterium avium subsp. paratuberculosis
uugggcccacggugaccuaagc

SEQ ID NO: 21647 - RNA, 22 nt, Mycobacterium avium subsp. paratuberculosis
uugggcggcaacgccgcucggc

SEQ ID NO: 21648 - RNA, 22 nt, Mycobacterium avium subsp. paratuberculosis
uuggucguugucggccagggca

SEQ ID NO: 21649 - RNA, 22 nt, Mycobacterium avium subsp. paratuberculosis
uuggugacggcgggauaggcga

SEQ ID NO: 21650 - RNA, 22 nt, Mycobacterium avium subsp. paratuberculosis
uuguaugaccucgguugaugcu

SEQ ID NO: 21651 - RNA, 21 nt, Mycobacterium avium subsp. paratuberculosis
uuguccgcggugccgcgcagc

SEQ ID NO: 21652 - RNA, 22 nt, Mycobacterium avium subsp. paratuberculosis
uugucgcucaaaggcgggcacu

SEQ ID NO: 21653 - RNA, 20 nt, Mycobacterium avium subsp. paratuberculosis
uugucugcuuuggguugucg

SEQ ID NO: 21654 - RNA, 22 nt, Mycobacterium avium subsp. paratuberculosis
uuguuuuuggccggauggccgu

SEQ ID NO: 21655 - RNA, 22 nt, Mycobacterium avium subsp. paratuberculosis
uuuccgccccggcgcugaacaa

SEQ ID NO: 21656 - RNA, 22 nt, Mycobacterium avium subsp. paratuberculosis
uuucgccgugggguuacgcgcg

SEQ ID NO: 21657 - RNA, 22 nt, Mycobacterium avium subsp. paratuberculosis
uuucgggcuggucaccggcgcg

SEQ ID NO: 21658 - RNA, 22 nt, Mycobacterium avium subsp. paratuberculosis
uuugcaggguggucagguugga

SEQ ID NO: 21659 - RNA, 22 nt, Mycobacterium avium subsp. paratuberculosis
uuuucgcaaccacugcacgcuc

SEQ ID NO: 21660 - RNA, 22 nt, Mycobacterium avium subsp. paratuberculosis
uuuucgcagugguugcacgcuc

SEQ ID NO: 21661 - RNA, 22 nt, Mycobacterium avium subsp. paratuberculosis
uuuucucggcgaccaugcggca

SEQ ID NO: 21662 - RNA, 17 nt, Mycobacterium avium subsp. paratuberculosis
uuuugcgucugcucgcg

SEQ ID NO: 21663 - RNA, 22 nt, Mycobacterium avium subsp. paratuberculosis
agcuggugaccaccuaucgcgg

SEQ ID NO: 21664 - RNA, 22 nt, Mycobacterium avium subsp. paratuberculosis
agcuguccggcucgcugcugcc

SEQ ID NO: 21665 - RNA, 22 nt, Mycobacterium avium subsp. paratuberculosis
aggaggcggugcugcccuucca

SEQ ID NO: 21666 - RNA, 22 nt, Mycobacterium avium subsp. paratuberculosis
aggccgauuggcugaucgucgg

SEQ ID NO: 21667 - RNA, 21 nt, Mycobacterium avium subsp. paratuberculosis
aggccgccgaugaugccgccg

SEQ ID NO: 21668 - RNA, 22 nt, Mycobacterium avium subsp. paratuberculosis
aggccggugucggugaggaugu

SEQ ID NO: 21669 - RNA, 22 nt, Mycobacterium avium subsp. paratuberculosis
aggccguucggacggcgcagcc

SEQ ID NO: 21670 - RNA, 22 nt, Mycobacterium avium subsp. paratuberculosis
aggcgcugggcgcggugcucga

SEQ ID NO: 21671 - RNA, 22 nt, Mycobacterium avium subsp. paratuberculosis
aggcgggugacgcuccagccgg

SEQ ID NO: 21672 - RNA, 22 nt, Mycobacterium avium subsp. paratuberculosis
aggcgucgacccggcuggccca

SEQ ID NO: 21673 - RNA, 22 nt, Mycobacterium avium subsp. paratuberculosis
aggcgugugcgccgccgucgac

SEQ ID NO: 21674 - RNA, 22 nt, Mycobacterium avium subsp. paratuberculosis
agggccaucgcgauguuccucu

SEQ ID NO: 21675 - RNA, 22 nt, Mycobacterium avium subsp. paratuberculosis
agggucacgguuacuccguacg

SEQ ID NO: 21676 - RNA, 22 nt, Mycobacterium avium subsp. paratuberculosis
agggucuaguugaacgagucgc

SEQ ID NO: 21677 - RNA, 22 nt, Mycobacterium avium subsp. paratuberculosis
agguaggcgccuuucgggaccg

SEQ ID NO: 21678 - RNA, 22 nt, Mycobacterium avium subsp. paratuberculosis
aggucgauguugccgaugguga

SEQ ID NO: 21679 - RNA, 22 nt, Mycobacterium avium subsp. paratuberculosis
aggucggccggcaccaguucgg

SEQ ID NO: 21680 - RNA, 22 nt, Mycobacterium avium subsp. paratuberculosis
aggucgucacggucgucgacga

SEQ ID NO: 21681 - RNA, 22 nt, Mycobacterium avium subsp. paratuberculosis
aggucguccucgccgaccucga

SEQ ID NO: 21682 - RNA, 22 nt, Mycobacterium avium subsp. paratuberculosis
aggucgucguaggcgucguuga

SEQ ID NO: 21683 - RNA, 20 nt, Mycobacterium avium subsp. paratuberculosis
aggucgugaacucgccgauc

SEQ ID NO: 21684 - RNA, 22 nt, Mycobacterium avium subsp. paratuberculosis
aggugaccgcggucgacgucgg

SEQ ID NO: 21685 - RNA, 21 nt, Mycobacterium avium subsp. paratuberculosis
aggugagugaacgagaucuug

SEQ ID NO: 21686 - RNA, 22 nt, Mycobacterium avium subsp. paratuberculosis
aggugcgcaccgucagcgagga

SEQ ID NO: 21687 - RNA, 22 nt, Mycobacterium avium subsp. paratuberculosis
aggugcucgucaagcagauuca

SEQ ID NO: 21688 - RNA, 19 nt, Mycobacterium avium subsp. paratuberculosis
aggugugggacucgccgaa

SEQ ID NO: 21689 - RNA, 22 nt, Mycobacterium avium subsp. paratuberculosis
agguucccgcgcucagcgcggu

SEQ ID NO: 21690 - RNA, 22 nt, Mycobacterium avium subsp. paratuberculosis
aguacgucgacuggcugaucga

SEQ ID NO: 21691 - RNA, 22 nt, Mycobacterium avium subsp. paratuberculosis
agucgaccgggguggauucgcu

SEQ ID NO: 21692 - RNA, 22 nt, Mycobacterium avium subsp. paratuberculosis
agucgcggacggcgccggccac

SEQ ID NO: 21693 - RNA, 22 nt, Mycobacterium avium subsp. paratuberculosis
agucgggcaccucgcgguccag

SEQ ID NO: 21694 - RNA, 22 nt, Mycobacterium avium subsp. paratuberculosis
aguggguggauuccgagcgccc

SEQ ID NO: 21695 - RNA, 22 nt, Mycobacterium avium subsp. paratuberculosis
aguggguggccagauccguuug

SEQ ID NO: 21696 - RNA, 22 nt, Mycobacterium avium subsp. paratuberculosis
aguucgacguugucgcgcugca

SEQ ID NO: 21697 - RNA, 22 nt, Mycobacterium avium subsp. paratuberculosis
aucaggucgucgccgggccgcu

SEQ ID NO: 21698 - RNA, 22 nt, Mycobacterium avium subsp. paratuberculosis
aucauggcgaugacggugcgcg

SEQ ID NO: 21699 - RNA, 22 nt, Mycobacterium avium subsp. paratuberculosis
auccagacguguacgccgaggu

SEQ ID NO: 21700 - RNA, 22 nt, Mycobacterium avium subsp. paratuberculosis
aucccgcaugucgcucuucgac

SEQ ID NO: 21701 - RNA, 22 nt, Mycobacterium avium subsp. paratuberculosis
auccgcgacuucgguggugugc

SEQ ID NO: 21702 - RNA, 22 nt, Mycobacterium avium subsp. paratuberculosis
auccgcucugccgucgaccccg

SEQ ID NO: 21703 - RNA, 22 nt, Mycobacterium avium subsp. paratuberculosis
auccgggcgucgaggcgcggau

SEQ ID NO: 21704 - RNA, 22 nt, Mycobacterium avium subsp. paratuberculosis
aucgacacgaucacccgcacgu

SEQ ID NO: 21705 - RNA, 22 nt, Mycobacterium avium subsp. paratuberculosis
aucgagguggccgucagcgcgu

SEQ ID NO: 21706 - RNA, 22 nt, Mycobacterium avium subsp. paratuberculosis
aaaagaucuucaccagcgagcu

SEQ ID NO: 21707 - RNA, 22 nt, Mycobacterium avium subsp. paratuberculosis
aacaggauuccgacaccgccgc

SEQ ID NO: 21708 - RNA, 22 nt, Mycobacterium avium subsp. paratuberculosis
aacaggcggugggggccauucg

SEQ ID NO: 21709 - RNA, 22 nt, Mycobacterium avium subsp. paratuberculosis
aacaugcaggucgagcugguga

SEQ ID NO: 21710 - RNA, 22 nt, Mycobacterium avium subsp. paratuberculosis
aaccaaggcgucuacgguuugc

SEQ ID NO: 21711 - RNA, 22 nt, Mycobacterium avium subsp. paratuberculosis
aaccggugccgccgccgacgag

SEQ ID NO: 21712 - RNA, 22 nt, Mycobacterium avium subsp. paratuberculosis
aaccugaucccggaguggaaug

SEQ ID NO: 21713 - RNA, 22 nt, Mycobacterium avium subsp. paratuberculosis
cgcuaccuggugcuacaccgaa

SEQ ID NO: 21714 - RNA, 22 nt, Mycobacterium avium subsp. paratuberculosis
cgcucagcgcgccggugagguc

SEQ ID NO: 21715 - RNA, 22 nt, Mycobacterium avium subsp. paratuberculosis
cgcugcgggcgcugaucaugga

SEQ ID NO: 21716 - RNA, 22 nt, Mycobacterium avium subsp. paratuberculosis
cgcugcuggugcccuaccugcu

SEQ ID NO: 21717 - RNA, 22 nt, Mycobacterium avium subsp. paratuberculosis
cgcuggaagucgugcggccggu

SEQ ID NO: 21718 - RNA, 22 nt, Mycobacterium avium subsp. paratuberculosis
cgcuguccaucaucaccgggcu

SEQ ID NO: 21719 - RNA, 22 nt, Mycobacterium avium subsp. paratuberculosis
cgcuuuccaccgucaccucggg

SEQ ID NO: 21720 - RNA, 22 nt, Mycobacterium avium subsp. paratuberculosis
cggaccgcuggugcuggccguc

SEQ ID NO: 21721 - RNA, 22 nt, Mycobacterium avium subsp. paratuberculosis
cggacgcgacgcugucggcaug

SEQ ID NO: 21722 - RNA, 18 nt, Mycobacterium avium subsp. paratuberculosis
cggagccggcugaugcuc

SEQ ID NO: 21723 - RNA, 22 nt, Mycobacterium avium subsp. paratuberculosis
cggauccaccggguggcgcacu

SEQ ID NO: 21724 - RNA, 22 nt, Mycobacterium avium subsp. paratuberculosis
cggcacggugcacacgccgagg

SEQ ID NO: 21725 - RNA, 22 nt, Mycobacterium avium subsp. paratuberculosis
cggcagcccaccgcggugcugc

SEQ ID NO: 21726 - RNA, 21 nt, Mycobacterium avium subsp. paratuberculosis
cggcaggacauggcgaacggc

SEQ ID NO: 21727 - RNA, 22 nt, Mycobacterium avium subsp. paratuberculosis
cggcaucgagaagccguccggg

SEQ ID NO: 21728 - RNA, 22 nt, Mycobacterium avium subsp. paratuberculosis
cggccaccuuguccggcggcgc

SEQ ID NO: 21729 - RNA, 22 nt, Mycobacterium avium subsp. paratuberculosis
cggccagaccguugaugucggu

SEQ ID NO: 21730 - RNA, 21 nt, Mycobacterium avium subsp. paratuberculosis
cggcccgcaggucuuucucgg

SEQ ID NO: 21731 - RNA, 22 nt, Mycobacterium avium subsp. paratuberculosis
cggcccgccgcccugcgugguc

SEQ ID NO: 21732 - RNA, 23 nt, Mycobacterium avium subsp. paratuberculosis
cggccgaaccgcuuucggcgguc

SEQ ID NO: 21733 - RNA, 22 nt, Mycobacterium avium subsp. paratuberculosis
cggccgaggacgggaccgucgu

SEQ ID NO: 21734 - RNA, 20 nt, Mycobacterium avium subsp. paratuberculosis
cggccgagguuccggcgcug

SEQ ID NO: 21735 - RNA, 22 nt, Mycobacterium avium subsp. paratuberculosis
cggccgcaccggcgaugacggc

SEQ ID NO: 21736 - RNA, 22 nt, Mycobacterium avium subsp. paratuberculosis
cggccggcccguggccggccag

SEQ ID NO: 21737 - RNA, 22 nt, Mycobacterium avium subsp. paratuberculosis
cggcgaggccugcccgcccgag

SEQ ID NO: 21738 - RNA, 22 nt, Mycobacterium avium subsp. paratuberculosis
cggcgaggucgucgaggucggc

SEQ ID NO: 21739 - RNA, 22 nt, Mycobacterium avium subsp. paratuberculosis
cggcgcacgucggucacuuugg

SEQ ID NO: 21740 - RNA, 20 nt, Mycobacterium avium subsp. paratuberculosis
cggcgcugaauucguguccc

SEQ ID NO: 21741 - RNA, 22 nt, Mycobacterium avium subsp. paratuberculosis
cggcgcuggcgcgucccauucc

SEQ ID NO: 21742 - RNA, 22 nt, Mycobacterium avium subsp. paratuberculosis
cggcggaccgcgaucaccggcg

SEQ ID NO: 21743 - RNA, 22 nt, Mycobacterium avium subsp. paratuberculosis
cggcggcagcacaucgguggcg

SEQ ID NO: 21744 - RNA, 22 nt, Mycobacterium avium subsp. paratuberculosis
cggcggccaucugcaugccgua

SEQ ID NO: 21745 - RNA, 22 nt, Mycobacterium avium subsp. paratuberculosis
cggcggcccaaaagguuugggc

SEQ ID NO: 21746 - RNA, 22 nt, Mycobacterium avium subsp. paratuberculosis
cggcggcgagcugucccgggug

SEQ ID NO: 21747 - RNA, 22 nt, Mycobacterium avium subsp. paratuberculosis
cggcggcugcagccggauuggu

SEQ ID NO: 21748 - RNA, 22 nt, Mycobacterium avium subsp. paratuberculosis
cggcggucacgcuggcgugacg

SEQ ID NO: 21749 - RNA, 22 nt, Mycobacterium avium subsp. paratuberculosis
cggcgucgaugcgggccagcgu

SEQ ID NO: 21750 - RNA, 22 nt, Mycobacterium avium subsp. paratuberculosis
cggcucgcgaucgcuggccgug

SEQ ID NO: 21751 - RNA, 22 nt, Mycobacterium avium subsp. paratuberculosis
cggcugagauucgguacggucc

SEQ ID NO: 21752 - RNA, 22 nt, Mycobacterium avium subsp. paratuberculosis
cggcugauggcaacccggucac

SEQ ID NO: 21753 - RNA, 22 nt, Mycobacterium avium subsp. paratuberculosis
cgggaucagcggcagcgugauc

SEQ ID NO: 21754 - RNA, 22 nt, Mycobacterium avium subsp. paratuberculosis
cgggauccccccgcagacgcug

SEQ ID NO: 21755 - RNA, 22 nt, Mycobacterium avium subsp. paratuberculosis
cgggaugaaccuggucgccaag

SEQ ID NO: 21756 - RNA, 22 nt, Mycobacterium avium subsp. paratuberculosis
cgggauuggucgcuggccgacc

SEQ ID NO: 21757 - RNA, 22 nt, Mycobacterium avium subsp. paratuberculosis
cgggccgacgacgugguguuca

SEQ ID NO: 21758 - RNA, 22 nt, Mycobacterium avium subsp. paratuberculosis
cgggccgccuggcgaucgguga

SEQ ID NO: 21759 - RNA, 22 nt, Mycobacterium avium subsp. paratuberculosis
cgggccgucgccgaggcauucg

SEQ ID NO: 21760 - RNA, 22 nt, Mycobacterium avium subsp. paratuberculosis
cgggcggagcagcuucgccggg

SEQ ID NO: 21761 - RNA, 22 nt, Mycobacterium avium subsp. paratuberculosis
cgggcguguucggcgagcugac

SEQ ID NO: 21762 - RNA, 22 nt, Mycobacterium avium subsp. paratuberculosis
cgggcuguuccgcacccggcgg

SEQ ID NO: 21763 - RNA, 22 nt, Mycobacterium avium subsp. paratuberculosis
cggggcacaaccucccugucac

SEQ ID NO: 21764 - RNA, 22 nt, Mycobacterium avium subsp. paratuberculosis
cggggcauucggugacgguauc

SEQ ID NO: 21765 - RNA, 22 nt, Mycobacterium avium subsp. paratuberculosis
cgggggguaggagguuaugcca

SEQ ID NO: 21766 - RNA, 22 nt, Mycobacterium avium subsp. paratuberculosis
cggguccaacgccaggguggcg

SEQ ID NO: 21767 - RNA, 21 nt, Mycobacterium avium subsp. paratuberculosis
cggguccggcaccgcgugcgg

SEQ ID NO: 21768 - RNA, 22 nt, Mycobacterium avium subsp. paratuberculosis
cgggugagugccgggcuggcgg

SEQ ID NO: 21769 - RNA, 22 nt, Mycobacterium avium subsp. paratuberculosis
cgggugaucguguugcaucgga

SEQ ID NO: 21770 - RNA, 21 nt, Mycobacterium avium subsp. paratuberculosis
cgggugcuuuugugucugcuc

SEQ ID NO: 21771 - RNA, 22 nt, Mycobacterium avium subsp. paratuberculosis
cggguggagaaguggcugguca

SEQ ID NO: 21772 - RNA, 22 nt, Mycobacterium avium subsp. paratuberculosis
cggguggccgagaucgacgucg

SEQ ID NO: 21773 - RNA, 22 nt, Mycobacterium avium subsp. paratuberculosis
cgggugggcggauucaggacac

SEQ ID NO: 21774 - RNA, 22 nt, Mycobacterium avium subsp. paratuberculosis
cgggugucggcgugcucgguca

SEQ ID NO: 21775 - RNA, 22 nt, Mycobacterium avium subsp. paratuberculosis
cggguguugcagccgugcggga

SEQ ID NO: 21776 - RNA, 22 nt, Mycobacterium avium subsp. paratuberculosis
cggguugcuguccgggaugccg

SEQ ID NO: 21777 - RNA, 22 nt, Mycobacterium avium subsp. paratuberculosis
cggucggcgggucaggcgagca

SEQ ID NO: 21778 - RNA, 22 nt, Mycobacterium avium subsp. paratuberculosis
cggucuuguugucgucggcccg

SEQ ID NO: 21779 - RNA, 22 nt, Mycobacterium avium subsp. paratuberculosis
cggugaugacgacgacgcggcc

SEQ ID NO: 21780 - RNA, 22 nt, Mycobacterium avium subsp. paratuberculosis
cggugccgaucuacgagccggc

SEQ ID NO: 21781 - RNA, 22 nt, Mycobacterium avium subsp. paratuberculosis
cggugcucgccaaggaggugau

SEQ ID NO: 21782 - RNA, 22 nt, Mycobacterium avium subsp. paratuberculosis
cggugcuggccacgcuggcgcu

SEQ ID NO: 21783 - RNA, 23 nt, Mycobacterium avium subsp. paratuberculosis
cggugcuguaccaggccgugguc

SEQ ID NO: 21784 - RNA, 23 nt, Mycobacterium avium subsp. paratuberculosis
cgguggccauccacgacggccug

SEQ ID NO: 21785 - RNA, 22 nt, Mycobacterium avium subsp. paratuberculosis
cgguggccgaccugggcauggc

SEQ ID NO: 21786 - RNA, 22 nt, Mycobacterium avium subsp. paratuberculosis
cgguggucgggugaccucaccg

SEQ ID NO: 21787 - RNA, 22 nt, Mycobacterium avium subsp. paratuberculosis
cgguggugggcucggugcucga

SEQ ID NO: 21788 - RNA, 20 nt, Mycobacterium avium subsp. paratuberculosis
cggugucgaccgagucgcgg

SEQ ID NO: 21789 - RNA, 22 nt, Mycobacterium avium subsp. paratuberculosis
cgguuauccacaggucgcgguc

SEQ ID NO: 21790 - RNA, 22 nt, Mycobacterium avium subsp. paratuberculosis
cgguugccucguuuacgaaccg

SEQ ID NO: 21791 - RNA, 21 nt, Mycobacterium avium subsp. paratuberculosis
cguagcccccacgcucggcgc

SEQ ID NO: 21792 - RNA, 20 nt, Mycobacterium avium subsp. paratuberculosis
cguagcguuacgagagcggc

SEQ ID NO: 21793 - RNA, 22 nt, Mycobacterium avium subsp. paratuberculosis
cgucaagaaguuccugcgcuac

SEQ ID NO: 21794 - RNA, 22 nt, Mycobacterium avium subsp. paratuberculosis
cgucaaggcggucgccggcggc

SEQ ID NO: 21795 - RNA, 22 nt, Mycobacterium avium subsp. paratuberculosis
cgucacgaccaccgccgcgauc

SEQ ID NO: 21796 - RNA, 22 nt, Mycobacterium avium subsp. paratuberculosis
cgucaggugaccaagcagaucg

SEQ ID NO: 21797 - RNA, 22 nt, Mycobacterium avium subsp. paratuberculosis
cgucaucacgguggagaucgcg

SEQ ID NO: 21798 - RNA, 22 nt, Mycobacterium avium subsp. paratuberculosis
cgucaucuucuccagcgagucc

SEQ ID NO: 21799 - RNA, 22 nt, Mycobacterium avium subsp. paratuberculosis
cgucccgggcggcaucgaggug

SEQ ID NO: 21800 - RNA, 22 nt, Mycobacterium avium subsp. paratuberculosis
cguccggguggcuuuccaggua

SEQ ID NO: 21801 - RNA, 22 nt, Mycobacterium avium subsp. paratuberculosis
cguccucgccgaccggccgcug

SEQ ID NO: 21802 - RNA, 19 nt, Mycobacterium avium subsp. paratuberculosis
cgucgaccugaucaacgug

SEQ ID NO: 21803 - RNA, 22 nt, Mycobacterium avium subsp. paratuberculosis
cgucgacgaccaggagcucgga

SEQ ID NO: 21804 - RNA, 22 nt, Mycobacterium avium subsp. paratuberculosis
cgucgaggguuccagcgggcgc

SEQ ID NO: 21805 - RNA, 22 nt, Mycobacterium avium subsp. paratuberculosis
cgucgagugugcacugguggcg

SEQ ID NO: 21806 - RNA, 18 nt, Mycobacterium avium subsp. paratuberculosis
cgucgcccgcaucaccuc

SEQ ID NO: 21807 - RNA, 22 nt, Mycobacterium avium subsp. paratuberculosis
cgucgccgugcaucacggugug

SEQ ID NO: 21808 - RNA, 22 nt, Mycobacterium avium subsp. paratuberculosis
cgucgcgcuggaagugcugucg

SEQ ID NO: 21809 - RNA, 22 nt, Mycobacterium avium subsp. paratuberculosis
cgucgcggcccucgaccggcag

SEQ ID NO: 21810 - RNA, 22 nt, Mycobacterium avium subsp. paratuberculosis
cgucgcgguugccgaaccggug

SEQ ID NO: 21811 - RNA, 22 nt, Mycobacterium avium subsp. paratuberculosis
cgucggcugcacuugcacgacu

SEQ ID NO: 21812 - RNA, 22 nt, Mycobacterium avium subsp. paratuberculosis
cgucgggcgcuucauggugacc

SEQ ID NO: 21813 - RNA, 22 nt, Mycobacterium avium subsp. paratuberculosis
cgugaagcuaauuucacgcucg

SEQ ID NO: 21814 - RNA, 22 nt, Mycobacterium avium subsp. paratuberculosis
cgugaucgcguccgagcaggcc

SEQ ID NO: 21815 - RNA, 22 nt, Mycobacterium avium subsp. paratuberculosis
cgugcacaucucgcaggccgag

SEQ ID NO: 21816 - RNA, 22 nt, Mycobacterium avium subsp. paratuberculosis
cgugcggcgugaucuugucgau

SEQ ID NO: 21817 - RNA, 22 nt, Mycobacterium avium subsp. paratuberculosis
cgugcugcgcgagcugcagcag

SEQ ID NO: 21818 - RNA, 22 nt, Mycobacterium avium subsp. paratuberculosis
cguggccgggcugcuugggcuu

SEQ ID NO: 21819 - RNA, 22 nt, Mycobacterium avium subsp. paratuberculosis
cguggugcuggccgaggcgcgu

SEQ ID NO: 21820 - RNA, 22 nt, Mycobacterium avium subsp. paratuberculosis
cguguugcccccggugagccgc

SEQ ID NO: 21821 - RNA, 22 nt, Mycobacterium avium subsp. paratuberculosis
cguucccgcugcaggaugguga

SEQ ID NO: 21822 - RNA, 22 nt, Mycobacterium avium subsp. paratuberculosis
cguucgccuaucugcggcccgg

SEQ ID NO: 21823 - RNA, 22 nt, Mycobacterium avium subsp. paratuberculosis
cguucggaacgcacaccgugcu

SEQ ID NO: 21824 - RNA, 22 nt, Mycobacterium avium subsp. paratuberculosis
cguugagcgucuugcgcgaaaa

SEQ ID NO: 21825 - RNA, 22 nt, Mycobacterium avium subsp. paratuberculosis
cguuggcgugggcgacgcccga

SEQ ID NO: 21826 - RNA, 22 nt, Mycobacterium avium subsp. paratuberculosis
cguugucgaucagcucggcgaa

SEQ ID NO: 21827 - RNA, 22 nt, Mycobacterium avium subsp. paratuberculosis
cuacacagcccccacgcucggc

SEQ ID NO: 21828 - RNA, 22 nt, Mycobacterium avium subsp. paratuberculosis
cuacaucgcgacgcugauggug

SEQ ID NO: 21829 - RNA, 22 nt, Mycobacterium avium subsp. paratuberculosis
cuaccccggcuggauuuugcga

SEQ ID NO: 21830 - RNA, 22 nt, Mycobacterium avium subsp. paratuberculosis
cuaccgcuacugcaccuacguc

SEQ ID NO: 21831 - RNA, 22 nt, Mycobacterium avium subsp. paratuberculosis
cuacgucaucaacgggucgaag

SEQ ID NO: 21832 - RNA, 23 nt, Mycobacterium avium subsp. paratuberculosis
cucacggugaucagccggccguu

SEQ ID NO: 21833 - RNA, 22 nt, Mycobacterium avium subsp. paratuberculosis
cuccaucggguuggccggaucg

SEQ ID NO: 21834 - RNA, 23 nt, Mycobacterium avium subsp. paratuberculosis
cuccgguucgggaugcgagcuga

SEQ ID NO: 21835 - RNA, 22 nt, Mycobacterium avium subsp. paratuberculosis
cuccuggucguccugcggaucc

SEQ ID NO: 21836 - RNA, 22 nt, Mycobacterium avium subsp. paratuberculosis
cuccugguggucgucgccgugg

SEQ ID NO: 21837 - RNA, 22 nt, Mycobacterium avium subsp. paratuberculosis
cucgacaugcggcagcuguucg

SEQ ID NO: 21838 - RNA, 20 nt, Mycobacterium avium subsp. paratuberculosis
cucgacgucggccggcgcgg

SEQ ID NO: 21839 - RNA, 22 nt, Mycobacterium avium subsp. paratuberculosis
cucgagcagacgcaaaagcccc

SEQ ID NO: 21840 - RNA, 22 nt, Mycobacterium avium subsp. paratuberculosis
cucgagccagggcgcaacgguu

SEQ ID NO: 21841 - RNA, 22 nt, Mycobacterium avium subsp. paratuberculosis
cucgcucacccgcacgaacaga

SEQ ID NO: 21842 - RNA, 22 nt, Mycobacterium avium subsp. paratuberculosis
cucggcggccugggcgugcuca

SEQ ID NO: 21843 - RNA, 22 nt, Mycobacterium avium subsp. paratuberculosis
cucggcggcgagaucgguggcc

SEQ ID NO: 21844 - RNA, 22 nt, Mycobacterium avium subsp. paratuberculosis
cucggcguggccgaccggcguu

SEQ ID NO: 21845 - RNA, 22 nt, Mycobacterium avium subsp. paratuberculosis
cucggggcuauggcgcagcugg

SEQ ID NO: 21846 - RNA, 22 nt, Mycobacterium avium subsp. paratuberculosis
cucgggucaaccaucggguggu

SEQ ID NO: 21847 - RNA, 22 nt, Mycobacterium avium subsp. paratuberculosis
cucggugcacuucgcgcccggg

SEQ ID NO: 21848 - RNA, 22 nt, Mycobacterium avium subsp. paratuberculosis
cucgguggugauccgcgcgacc

SEQ ID NO: 21849 - RNA, 22 nt, Mycobacterium avium subsp. paratuberculosis
cucgucgagcugcacccacugc

SEQ ID NO: 21850 - RNA, 22 nt, Mycobacterium avium subsp. paratuberculosis
cucgugguggacggucagcgcg

SEQ ID NO: 21851 - RNA, 22 nt, Mycobacterium avium subsp. paratuberculosis
cucguuggacggcgcgcagucc

SEQ ID NO: 21852 - RNA, 22 nt, Mycobacterium avium subsp. paratuberculosis
cucucccgcgagcacgcggugg

SEQ ID NO: 21853 - RNA, 22 nt, Mycobacterium avium subsp. paratuberculosis
cugaccucggcccgacugauca

SEQ ID NO: 21854 - RNA, 22 nt, Mycobacterium avium subsp. paratuberculosis
cugaucugaacccggcgcacca

SEQ ID NO: 21855 - RNA, 22 nt, Mycobacterium avium subsp. paratuberculosis
cgacucuucguaauacggcuuc

SEQ ID NO: 21856 - RNA, 22 nt, Mycobacterium avium subsp. paratuberculosis
cgacuggaccgacggcgucggc

SEQ ID NO: 21857 - RNA, 22 nt, Mycobacterium avium subsp. paratuberculosis
cgagcagacgcaaaaccacccg

SEQ ID NO: 21858 - RNA, 22 nt, Mycobacterium avium subsp. paratuberculosis
cgagcagacgugaaaucccccg

SEQ ID NO: 21859 - RNA, 22 nt, Mycobacterium avium subsp. paratuberculosis
cgagccgaugaagguguccugg

SEQ ID NO: 21860 - RNA, 22 nt, Mycobacterium avium subsp. paratuberculosis
cgagcgucacgcuggcgugacg

SEQ ID NO: 21861 - RNA, 22 nt, Mycobacterium avium subsp. paratuberculosis
cgagcgugaaguuaguuucacg

SEQ ID NO: 21862 - RNA, 22 nt, Mycobacterium avium subsp. paratuberculosis
cgagcgugcacucaccgcgaua

SEQ ID NO: 21863 - RNA, 22 nt, Mycobacterium avium subsp. paratuberculosis
cgagcgugcagcuaccgcgaga

SEQ ID NO: 21864 - RNA, 22 nt, Mycobacterium avium subsp. paratuberculosis
cgaggccggggugcuggcgucg

SEQ ID NO: 21865 - RNA, 22 nt, Mycobacterium avium subsp. paratuberculosis
cgaggguucggcguccgcggcc

SEQ ID NO: 21866 - RNA, 22 nt, Mycobacterium avium subsp. paratuberculosis
cgagucagcgucggcgagucgg

SEQ ID NO: 21867 - RNA, 23 nt, Mycobacterium avium subsp. paratuberculosis
cgaucgacaaugcgucgccguca

SEQ ID NO: 21868 - RNA, 22 nt, Mycobacterium avium subsp. paratuberculosis
cgaucuggucgggcaaggugcu

SEQ ID NO: 21869 - RNA, 22 nt, Mycobacterium avium subsp. paratuberculosis
cgaugaccggugccaguugauc

SEQ ID NO: 21870 - RNA, 22 nt, Mycobacterium avium subsp. paratuberculosis
cgaugccgaccgggaccgcgcc

SEQ ID NO: 21871 - RNA, 22 nt, Mycobacterium avium subsp. paratuberculosis
cgaugccgccgaucagugcgug

SEQ ID NO: 21872 - RNA, 22 nt, Mycobacterium avium subsp. paratuberculosis
cgauggucggcagcuuggccag

SEQ ID NO: 21873 - RNA, 22 nt, Mycobacterium avium subsp. paratuberculosis
cgauguccgacggcccggucca

SEQ ID NO: 21874 - RNA, 19 nt, Mycobacterium avium subsp. paratuberculosis
cgcaacaacuccacguucg

SEQ ID NO: 21875 - RNA, 22 nt, Mycobacterium avium subsp. paratuberculosis
cgcaccccgcgcaucgccaggc

SEQ ID NO: 21876 - RNA, 22 nt, Mycobacterium avium subsp. paratuberculosis
cgcaccgagcgucgcgacaaga

SEQ ID NO: 21877 - RNA, 22 nt, Mycobacterium avium subsp. paratuberculosis
cgcaccguccgacugcuggguc

SEQ ID NO: 21878 - RNA, 22 nt, Mycobacterium avium subsp. paratuberculosis
cgcaccguucacccggccgacg

SEQ ID NO: 21879 - RNA, 22 nt, Mycobacterium avium subsp. paratuberculosis
cgcacgugcagccacgccccgc

SEQ ID NO: 21880 - RNA, 22 nt, Mycobacterium avium subsp. paratuberculosis
cgcaguucaucuaucugcuuuc

SEQ ID NO: 21881 - RNA, 20 nt, Mycobacterium avium subsp. paratuberculosis
cgccacgaagacggugccgc

SEQ ID NO: 21882 - RNA, 22 nt, Mycobacterium avium subsp. paratuberculosis
cgcccgcaccgacgucgcgauc

SEQ ID NO: 21883 - RNA, 22 nt, Mycobacterium avium subsp. paratuberculosis
cgcccguuuuccguugaugcgc

SEQ ID NO: 21884 - RNA, 22 nt, Mycobacterium avium subsp. paratuberculosis
cgcccugggucuggaucagcgc

SEQ ID NO: 21885 - RNA, 22 nt, Mycobacterium avium subsp. paratuberculosis
cgccgaccugcugauccugccg

SEQ ID NO: 21886 - RNA, 22 nt, Mycobacterium avium subsp. paratuberculosis
cgccgacgugucuugguccgac

SEQ ID NO: 21887 - RNA, 22 nt, Mycobacterium avium subsp. paratuberculosis
cgccgagcgugggccguaugga

SEQ ID NO: 21888 - RNA, 23 nt, Mycobacterium avium subsp. paratuberculosis
cgccgagucgacggguguggccc

SEQ ID NO: 21889 - RNA, 22 nt, Mycobacterium avium subsp. paratuberculosis
cgccgaucaccugcccggcgcu

SEQ ID NO: 21890 - RNA, 22 nt, Mycobacterium avium subsp. paratuberculosis
cgccgaucggggugcgcagcug

SEQ ID NO: 21891 - RNA, 22 nt, Mycobacterium avium subsp. paratuberculosis
cgccgcagauacacacgcaagg

SEQ ID NO: 21892 - RNA, 22 nt, Mycobacterium avium subsp. paratuberculosis
cgccgccaaucccguuggccgu

SEQ ID NO: 21893 - RNA, 22 nt, Mycobacterium avium subsp. paratuberculosis
cgccgccgucacgcuggcguga

SEQ ID NO: 21894 - RNA, 22 nt, Mycobacterium avium subsp. paratuberculosis
cgccgccgugguggucacgaug

SEQ ID NO: 21895 - RNA, 22 nt, Mycobacterium avium subsp. paratuberculosis
cgccgcgaacacgacauccugg

SEQ ID NO: 21896 - RNA, 22 nt, Mycobacterium avium subsp. paratuberculosis
cgccgcggccgagguguucgcc

SEQ ID NO: 21897 - RNA, 22 nt, Mycobacterium avium subsp. paratuberculosis
cgccgcgucgauguucacuucg

SEQ ID NO: 21898 - RNA, 22 nt, Mycobacterium avium subsp. paratuberculosis
cgccgcugcccggucuggauga

SEQ ID NO: 21899 - RNA, 22 nt, Mycobacterium avium subsp. paratuberculosis
cgccggcuucgugauccugauu

SEQ ID NO: 21900 - RNA, 22 nt, Mycobacterium avium subsp. paratuberculosis
cgccgggcugagcugccgcccg

SEQ ID NO: 21901 - RNA, 22 nt, Mycobacterium avium subsp. paratuberculosis
cgccggugaucgcgguccgccg

SEQ ID NO: 21902 - RNA, 22 nt, Mycobacterium avium subsp. paratuberculosis
cgccgguggugcgcaccugcag

SEQ ID NO: 21903 - RNA, 22 nt, Mycobacterium avium subsp. paratuberculosis
cgccguggguggugaccuccca

SEQ ID NO: 21904 - RNA, 22 nt, Mycobacterium avium subsp. paratuberculosis
cgccguugcugcugugcccgua

SEQ ID NO: 21905 - RNA, 22 nt, Mycobacterium avium subsp. paratuberculosis
cgccucgacgucggcaccuccg

SEQ ID NO: 21906 - RNA, 19 nt, Mycobacterium avium subsp. paratuberculosis
cgccucgcccaccaccggc

SEQ ID NO: 21907 - RNA, 22 nt, Mycobacterium avium subsp. paratuberculosis
cgccuucgugucggggucgcug

SEQ ID NO: 21908 - RNA, 22 nt, Mycobacterium avium subsp. paratuberculosis
cgccuuggacaaaugacccgag

SEQ ID NO: 21909 - RNA, 22 nt, Mycobacterium avium subsp. paratuberculosis
cgcgaaccgaugcugacgcucg

SEQ ID NO: 21910 - RNA, 22 nt, Mycobacterium avium subsp. paratuberculosis
cgcgagagugcaacuaccgacg

SEQ ID NO: 21911 - RNA, 22 nt, Mycobacterium avium subsp. paratuberculosis
cgcgagagugcaacuagcgacg

SEQ ID NO: 21912 - RNA, 22 nt, Mycobacterium avium subsp. paratuberculosis
cgcgaucuucuucgucggccgu

SEQ ID NO: 21913 - RNA, 22 nt, Mycobacterium avium subsp. paratuberculosis
cgcgcggguaggucgccgccuc

SEQ ID NO: 21914 - RNA, 22 nt, Mycobacterium avium subsp. paratuberculosis
cgcggccaggcucagcagccag

SEQ ID NO: 21915 - RNA, 22 nt, Mycobacterium avium subsp. paratuberculosis
cgcggcgucacgcuggcgugac

SEQ ID NO: 21916 - RNA, 22 nt, Mycobacterium avium subsp. paratuberculosis
cgcggcugaccacgcugucuug

SEQ ID NO: 21917 - RNA, 22 nt, Mycobacterium avium subsp. paratuberculosis
cgcgggcccgcugguguucacc

SEQ ID NO: 21918 - RNA, 23 nt, Mycobacterium avium subsp. paratuberculosis
cgcgggucuccgagcuggacggc

SEQ ID NO: 21919 - RNA, 22 nt, Mycobacterium avium subsp. paratuberculosis
cgcggucaacggcccgacggcg

SEQ ID NO: 21920 - RNA, 22 nt, Mycobacterium avium subsp. paratuberculosis
cgcggucggucagaucggcccg

SEQ ID NO: 21921 - RNA, 22 nt, Mycobacterium avium subsp. paratuberculosis
cgcggugcuggccuuguguucg

SEQ ID NO: 21922 - RNA, 22 nt, Mycobacterium avium subsp. paratuberculosis
cgcggugggcucggcucggcug

SEQ ID NO: 21923 - RNA, 22 nt, Mycobacterium avium subsp. paratuberculosis
cgcguccaagccgauccgguug

SEQ ID NO: 21924 - RNA, 22 nt, Mycobacterium avium subsp. paratuberculosis
cgcgugucgcgccauucucgag

SEQ ID NO: 21925 - RNA, 19 nt, Mycobacterium avium subsp. paratuberculosis
cgcguugauggucucggug

SEQ ID NO: 21926 - RNA, 22 nt, Mycobacterium avium subsp. paratuberculosis
caucgaucguggcggcgacccg

SEQ ID NO: 21927 - RNA, 21 nt, Mycobacterium avium subsp. paratuberculosis
caucgccggcgcgauguugug

SEQ ID NO: 21928 - RNA, 22 nt, Mycobacterium avium subsp. paratuberculosis
caucgccguguacagcggcgca

SEQ ID NO: 21929 - RNA, 22 nt, Mycobacterium avium subsp. paratuberculosis
caucggcaucgcggugcuggug

SEQ ID NO: 21930 - RNA, 22 nt, Mycobacterium avium subsp. paratuberculosis
caucgucggcgucgguaacugc

SEQ ID NO: 21931 - RNA, 22 nt, Mycobacterium avium subsp. paratuberculosis
caucugcacgcaggccugcacg

SEQ ID NO: 21932 - RNA, 22 nt, Mycobacterium avium subsp. paratuberculosis
caugaaccgcccgucggguuca

SEQ ID NO: 21933 - RNA, 22 nt, Mycobacterium avium subsp. paratuberculosis
cauggccgccgaguucggguug

SEQ ID NO: 21934 - RNA, 22 nt, Mycobacterium avium subsp. paratuberculosis
ccaaccgcaucggcagcgccac

SEQ ID NO: 21935 - RNA, 22 nt, Mycobacterium avium subsp. paratuberculosis
ccaaccuugaccaggaucauug

SEQ ID NO: 21936 - RNA, 22 nt, Mycobacterium avium subsp. paratuberculosis
ccacagagacucacgcgauggc

SEQ ID NO: 21937 - RNA, 22 nt, Mycobacterium avium subsp. paratuberculosis
ccaccccgaugaucuggcggga

SEQ ID NO: 21938 - RNA, 22 nt, Mycobacterium avium subsp. paratuberculosis
ccacccggacaccgcgauccug

SEQ ID NO: 21939 - RNA, 22 nt, Mycobacterium avium subsp. paratuberculosis
ccacccuggccagcgccggguu

SEQ ID NO: 21940 - RNA, 22 nt, Mycobacterium avium subsp. paratuberculosis
ccaccgacgcacgcuugcgcug

SEQ ID NO: 21941 - RNA, 22 nt, Mycobacterium avium subsp. paratuberculosis
ccaccgggcgcggagcgaucgg

SEQ ID NO: 21942 - RNA, 22 nt, Mycobacterium avium subsp. paratuberculosis
ccacgacggcgucguuuuggcu

SEQ ID NO: 21943 - RNA, 22 nt, Mycobacterium avium subsp. paratuberculosis
ccacgcaguccuucgccgacau

SEQ ID NO: 21944 - RNA, 22 nt, Mycobacterium avium subsp. paratuberculosis
ccacgcuggcgugacgccgggu

SEQ ID NO: 21945 - RNA, 22 nt, Mycobacterium avium subsp. paratuberculosis
ccacggcguuguggccggcguc

SEQ ID NO: 21946 - RNA, 22 nt, Mycobacterium avium subsp. paratuberculosis
ccacguguucgucgagaauccc

SEQ ID NO: 21947 - RNA, 22 nt, Mycobacterium avium subsp. paratuberculosis
ccagccaacggguuuggcgcga

SEQ ID NO: 21948 - RNA, 22 nt, Mycobacterium avium subsp. paratuberculosis
ccagcucuuggucaccgcgauc

SEQ ID NO: 21949 - RNA, 22 nt, Mycobacterium avium subsp. paratuberculosis
ccagcugguccagcacgucggg

SEQ ID NO: 21950 - RNA, 23 nt, Mycobacterium avium subsp. paratuberculosis
ccaguucgaccuugagcucgccc

SEQ ID NO: 21951 - RNA, 22 nt, Mycobacterium avium subsp. paratuberculosis
ccaucgacgaaaggccgacgau

SEQ ID NO: 21952 - RNA, 22 nt, Mycobacterium avium subsp. paratuberculosis
ccaucgccguggugaugccggu

SEQ ID NO: 21953 - RNA, 21 nt, Mycobacterium avium subsp. paratuberculosis
ccaucguguugagccgcccgc

SEQ ID NO: 21954 - RNA, 19 nt, Mycobacterium avium subsp. paratuberculosis
ccaugcgggccaccgacgu

SEQ ID NO: 21955 - RNA, 22 nt, Mycobacterium avium subsp. paratuberculosis
cccaacgugcacucagcgcgaa

SEQ ID NO: 21956 - RNA, 22 nt, Mycobacterium avium subsp. paratuberculosis
cccacgaccagcaggaaggcgc

SEQ ID NO: 21957 - RNA, 22 nt, Mycobacterium avium subsp. paratuberculosis
cccagcuccuuggcccggucgu

SEQ ID NO: 21958 - RNA, 22 nt, Mycobacterium avium subsp. paratuberculosis
cccaucacgaucgggucgggcg

SEQ ID NO: 21959 - RNA, 22 nt, Mycobacterium avium subsp. paratuberculosis
ccccgcaagacccgcagcaugc

SEQ ID NO: 21960 - RNA, 22 nt, Mycobacterium avium subsp. paratuberculosis
ccccgcgagcagacgcaaaagc

SEQ ID NO: 21961 - RNA, 22 nt, Mycobacterium avium subsp. paratuberculosis
ccccgguggaaugcggucgcag

SEQ ID NO: 21962 - RNA, 22 nt, Mycobacterium avium subsp. paratuberculosis
cccgcguuguugaccaggacgu

SEQ ID NO: 21963 - RNA, 22 nt, Mycobacterium avium subsp. paratuberculosis
cccgcuggucggcgucuucgag

SEQ ID NO: 21964 - RNA, 22 nt, Mycobacterium avium subsp. paratuberculosis
cccggcgcuggccagggugguc

SEQ ID NO: 21965 - RNA, 22 nt, Mycobacterium avium subsp. paratuberculosis
cccggcgucacgcuggcgugac

SEQ ID NO: 21966 - RNA, 22 nt, Mycobacterium avium subsp. paratuberculosis
cccggugaucaugcucaccacg

SEQ ID NO: 21967 - RNA, 22 nt, Mycobacterium avium subsp. paratuberculosis
cccgguucaaggccuggcgcgu

SEQ ID NO: 21968 - RNA, 22 nt, Mycobacterium avium subsp. paratuberculosis
cccgguucgcgaauucggcggc

SEQ ID NO: 21969 - RNA, 22 nt, Mycobacterium avium subsp. paratuberculosis
cccguaguggccggcgacgucg

SEQ ID NO: 21970 - RNA, 22 nt, Mycobacterium avium subsp. paratuberculosis
cccucaucuggugcacgcgaug

SEQ ID NO: 21971 - RNA, 22 nt, Mycobacterium avium subsp. paratuberculosis
cccucccgcgaggagcaggcgc

SEQ ID NO: 21972 - RNA, 22 nt, Mycobacterium avium subsp. paratuberculosis
cccugaucgccagcgaucgcgu

SEQ ID NO: 21973 - RNA, 22 nt, Mycobacterium avium subsp. paratuberculosis
cccuguucgcgaugagcuugcu

SEQ ID NO: 21974 - RNA, 22 nt, Mycobacterium avium subsp. paratuberculosis
ccgaacaguuugcucauaguua

SEQ ID NO: 21975 - RNA, 22 nt, Mycobacterium avium subsp. paratuberculosis
ccgaacgugcacuggcagcgaa

SEQ ID NO: 21976 - RNA, 22 nt, Mycobacterium avium subsp. paratuberculosis
ccgaagaucagcgccgccgucg

SEQ ID NO: 21977 - RNA, 21 nt, Mycobacterium avium subsp. paratuberculosis
ccgaaggguauucgugucuag

SEQ ID NO: 21978 - RNA, 19 nt, Mycobacterium avium subsp. paratuberculosis
ccgaaucgcugcugugcga

SEQ ID NO: 21979 - RNA, 22 nt, Mycobacterium avium subsp. paratuberculosis
ccgaccagaucacgucgaacca

SEQ ID NO: 21980 - RNA, 22 nt, Mycobacterium avium subsp. paratuberculosis
ccgaccgcaucgauccggcguu

SEQ ID NO: 21981 - RNA, 22 nt, Mycobacterium avium subsp. paratuberculosis
ccgacgacguucaccaggaauu

SEQ ID NO: 21982 - RNA, 22 nt, Mycobacterium avium subsp. paratuberculosis
ccgacgauguuccacaccacga

SEQ ID NO: 21983 - RNA, 22 nt, Mycobacterium avium subsp. paratuberculosis
ccgacgccagccagugcgcggc

SEQ ID NO: 21984 - RNA, 22 nt, Mycobacterium avium subsp. paratuberculosis
ccgacggguuggggcugccggu

SEQ ID NO: 21985 - RNA, 22 nt, Mycobacterium avium subsp. paratuberculosis
ccgacguguaaaucacauaggc

SEQ ID NO: 21986 - RNA, 22 nt, Mycobacterium avium subsp. paratuberculosis
ccgagcagaucccggcggugcu

SEQ ID NO: 21987 - RNA, 22 nt, Mycobacterium avium subsp. paratuberculosis
ccgagcaggucggcggcgucgu

SEQ ID NO: 21988 - RNA, 22 nt, Mycobacterium avium subsp. paratuberculosis
ccgagcgagucggcgaaccggg

SEQ ID NO: 21989 - RNA, 22 nt, Mycobacterium avium subsp. paratuberculosis
ccgagcgucacgcuggcgugac

SEQ ID NO: 21990 - RNA, 22 nt, Mycobacterium avium subsp. paratuberculosis
ccgagcgugggggccauguacg

SEQ ID NO: 21991 - RNA, 22 nt, Mycobacterium avium subsp. paratuberculosis
ccgagcguguacucaccgcgaa

SEQ ID NO: 21992 - RNA, 19 nt, Mycobacterium avium subsp. paratuberculosis
ccgaggccgaacucgcggc

SEQ ID NO: 21993 - RNA, 22 nt, Mycobacterium avium subsp. paratuberculosis
ccgaggugauaucgcacggcuu

SEQ ID NO: 21994 - RNA, 22 nt, Mycobacterium avium subsp. paratuberculosis
ccgauccacagcggccgccggc

SEQ ID NO: 21995 - RNA, 22 nt, Mycobacterium avium subsp. paratuberculosis
ccgaugccguugguggugcgcu

SEQ ID NO: 21996 - RNA, 22 nt, Mycobacterium avium subsp. paratuberculosis
ccgaugucgacgaguuccucga

SEQ ID NO: 21997 - RNA, 22 nt, Mycobacterium avium subsp. paratuberculosis
ccgccaggugagcgccgagcac

SEQ ID NO: 21998 - RNA, 22 nt, Mycobacterium avium subsp. paratuberculosis
ccgcccggcggaugcgggucga

SEQ ID NO: 21999 - RNA, 22 nt, Mycobacterium avium subsp. paratuberculosis
ccgccgaaggugauugggcggc

SEQ ID NO: 22000 - RNA, 22 nt, Mycobacterium avium subsp. paratuberculosis
ccgccgaggugcacgucgaagc

SEQ ID NO: 22001 - RNA, 22 nt, Mycobacterium avium subsp. paratuberculosis
ccgccgcgccaaagagccguuc

SEQ ID NO: 22002 - RNA, 22 nt, Mycobacterium avium subsp. paratuberculosis
ccgccggcaggacaugcugcgc

SEQ ID NO: 22003 - RNA, 22 nt, Mycobacterium avium subsp. paratuberculosis
ccgccgucagguccggcuggug

SEQ ID NO: 22004 - RNA, 22 nt, Mycobacterium avium subsp. paratuberculosis
ccgcgagcagacacaaaagcgc

SEQ ID NO: 22005 - RNA, 22 nt, Mycobacterium avium subsp. paratuberculosis
ccgcgcguucgucaaccggccg

SEQ ID NO: 22006 - RNA, 22 nt, Mycobacterium avium subsp. paratuberculosis
ccgcgcugguggccgugcacgu

SEQ ID NO: 22007 - RNA, 18 nt, Mycobacterium avium subsp. paratuberculosis
ccgcggcggggucgaacc

SEQ ID NO: 22008 - RNA, 22 nt, Mycobacterium avium subsp. paratuberculosis
ccgcgggauggaucggcugccg

SEQ ID NO: 22009 - RNA, 22 nt, Mycobacterium avium subsp. paratuberculosis
ccgcgggccaggucgucaccgc

SEQ ID NO: 22010 - RNA, 22 nt, Mycobacterium avium subsp. paratuberculosis
ccgcggucgacgucaccggcgg

SEQ ID NO: 22011 - RNA, 22 nt, Mycobacterium avium subsp. paratuberculosis
ccgcggucgagaaggcggccaa

SEQ ID NO: 22012 - RNA, 22 nt, Mycobacterium avium subsp. paratuberculosis
ccgcucguaacgccagggcgga

SEQ ID NO: 22013 - RNA, 22 nt, Mycobacterium avium subsp. paratuberculosis
ccgcugugggagcgcauggauu

SEQ ID NO: 22014 - RNA, 22 nt, Mycobacterium avium subsp. paratuberculosis
ccgcuucaugucgggcgagaac

SEQ ID NO: 22015 - RNA, 22 nt, Mycobacterium avium subsp. paratuberculosis
ccggauccuggccggccgaauu

SEQ ID NO: 22016 - RNA, 22 nt, Mycobacterium avium subsp. paratuberculosis
ccggccagcgucgaguuguugg

SEQ ID NO: 22017 - RNA, 22 nt, Mycobacterium avium subsp. paratuberculosis
ccggcccgauccagcaccgcgc

SEQ ID NO: 22018 - RNA, 22 nt, Mycobacterium avium subsp. paratuberculosis
ccggcccggugauccagucgau

SEQ ID NO: 22019 - RNA, 22 nt, Mycobacterium avium subsp. paratuberculosis
ccggccgcagcauguauccgac

SEQ ID NO: 22020 - RNA, 22 nt, Mycobacterium avium subsp. paratuberculosis
ccggcgcggucacccgguggac

SEQ ID NO: 22021 - RNA, 22 nt, Mycobacterium avium subsp. paratuberculosis
ccggcggucccguucucggcgc

SEQ ID NO: 22022 - RNA, 22 nt, Mycobacterium avium subsp. paratuberculosis
ccggcggugaccgcgccggcca

SEQ ID NO: 22023 - RNA, 22 nt, Mycobacterium avium subsp. paratuberculosis
ccggcggugaucgguagggccg

SEQ ID NO: 22024 - RNA, 22 nt, Mycobacterium avium subsp. paratuberculosis
ccggcgucgacgccgucgaacu

SEQ ID NO: 22025 - RNA, 22 nt, Mycobacterium avium subsp. paratuberculosis
ccggcgucgucgugacgcgaca

SEQ ID NO: 22026 - RNA, 22 nt, Mycobacterium avium subsp. paratuberculosis
ccgggaaugcuuuccggccagc

SEQ ID NO: 22027 - RNA, 22 nt, Mycobacterium avium subsp. paratuberculosis
ccgggagacggcggaguuauuu

SEQ ID NO: 22028 - RNA, 22 nt, Mycobacterium avium subsp. paratuberculosis
ccgggcacuggccgcgguggcc

SEQ ID NO: 22029 - RNA, 22 nt, Mycobacterium avium subsp. paratuberculosis
ccgggugagcaaguacgcguug

SEQ ID NO: 22030 - RNA, 22 nt, Mycobacterium avium subsp. paratuberculosis
ccgguaccaacuggugggccuu

SEQ ID NO: 22031 - RNA, 22 nt, Mycobacterium avium subsp. paratuberculosis
ccgguccgggcaaccgcuggcc

SEQ ID NO: 22032 - RNA, 22 nt, Mycobacterium avium subsp. paratuberculosis
ccggucgaggugagcgaugagc

SEQ ID NO: 22033 - RNA, 22 nt, Mycobacterium avium subsp. paratuberculosis
ccguacauggcccccacgcucg

SEQ ID NO: 22034 - RNA, 22 nt, Mycobacterium avium subsp. paratuberculosis
ccgucgacgacgugcaccagca

SEQ ID NO: 22035 - RNA, 22 nt, Mycobacterium avium subsp. paratuberculosis
ccgucgcccuuggugagaaugu

SEQ ID NO: 22036 - RNA, 22 nt, Mycobacterium avium subsp. paratuberculosis
ccgucgcugauggccugggcca

SEQ ID NO: 22037 - RNA, 22 nt, Mycobacterium avium subsp. paratuberculosis
ccgugcccgccgaucgccauca

SEQ ID NO: 22038 - RNA, 20 nt, Mycobacterium avium subsp. paratuberculosis
ccguggcguuacacgcgcgg

SEQ ID NO: 22039 - RNA, 22 nt, Mycobacterium avium subsp. paratuberculosis
ccguggcguuacgcccgcggau

SEQ ID NO: 22040 - RNA, 22 nt, Mycobacterium avium subsp. paratuberculosis
ccguucgaugauccucagggcg

SEQ ID NO: 22041 - RNA, 22 nt, Mycobacterium avium subsp. paratuberculosis
ccucaugagguggccgcgccca

SEQ ID NO: 22042 - RNA, 22 nt, Mycobacterium avium subsp. paratuberculosis
ccucgcaggagagcaccgacgu

SEQ ID NO: 22043 - RNA, 23 nt, Mycobacterium avium subsp. paratuberculosis
ccugaccgcccacgagaaccacg

SEQ ID NO: 22044 - RNA, 22 nt, Mycobacterium avium subsp. paratuberculosis
ccugaucaucagcgccggcggg

SEQ ID NO: 22045 - RNA, 22 nt, Mycobacterium avium subsp. paratuberculosis
ccugcgacaaaugcgcggaauu

SEQ ID NO: 22046 - RNA, 21 nt, Mycobacterium avium subsp. paratuberculosis
ccuugcgauucggcggacucg

SEQ ID NO: 22047 - RNA, 22 nt, Mycobacterium avium subsp. paratuberculosis
ccuuggugaccagcggcuggcc

SEQ ID NO: 22048 - RNA, 22 nt, Mycobacterium avium subsp. paratuberculosis
ccuugugaccgcgcuguacguc

SEQ ID NO: 22049 - RNA, 20 nt, Mycobacterium avium subsp. paratuberculosis
cgaacgcacgagcggucagc

SEQ ID NO: 22050 - RNA, 22 nt, Mycobacterium avium subsp. paratuberculosis
cgaacgugggguuguugcgcgg

SEQ ID NO: 22051 - RNA, 22 nt, Mycobacterium avium subsp. paratuberculosis
cgaagaagccuggggccgguac

SEQ ID NO: 22052 - RNA, 22 nt, Mycobacterium avium subsp. paratuberculosis
cgacaucgaaagcgagggccug

SEQ ID NO: 22053 - RNA, 22 nt, Mycobacterium avium subsp. paratuberculosis
cgaccauuggucggcgggugug

SEQ ID NO: 22054 - RNA, 22 nt, Mycobacterium avium subsp. paratuberculosis
cgacccggucgaggucggcgag

SEQ ID NO: 22055 - RNA, 22 nt, Mycobacterium avium subsp. paratuberculosis
cgaccggccgcacgacuuccag

SEQ ID NO: 22056 - RNA, 22 nt, Mycobacterium avium subsp. paratuberculosis
cgaccugagauuuguuggcuga

SEQ ID NO: 22057 - RNA, 22 nt, Mycobacterium avium subsp. paratuberculosis
cgaccugcggccgucggaugcg

SEQ ID NO: 22058 - RNA, 20 nt, Mycobacterium avium subsp. paratuberculosis
cgaccuguuggugaucgugg

SEQ ID NO: 22059 - RNA, 19 nt, Mycobacterium avium subsp. paratuberculosis
cgacgcccuggugaccuuu

SEQ ID NO: 22060 - RNA, 20 nt, Mycobacterium avium subsp. paratuberculosis
cgacgcgucgaagcucugac

SEQ ID NO: 22061 - RNA, 22 nt, Mycobacterium avium subsp. paratuberculosis
cgacggcgaacucggucucggu

SEQ ID NO: 22062 - RNA, 20 nt, Mycobacterium avium subsp. paratuberculosis
cgacggcgaggcuuggcucg

SEQ ID NO: 22063 - RNA, 22 nt, Mycobacterium avium subsp. paratuberculosis
cgacggcuccaagcggacgauc

SEQ ID NO: 22064 - RNA, 22 nt, Mycobacterium avium subsp. paratuberculosis
cgacggcugccguagcggcggu

SEQ ID NO: 22065 - RNA, 22 nt, Mycobacterium avium subsp. paratuberculosis
cgacgggcuggaggccauguau

SEQ ID NO: 22066 - RNA, 22 nt, Mycobacterium avium subsp. paratuberculosis
cgacgucgcgauggaggugacc

SEQ ID NO: 22067 - RNA, 21 nt, Mycobacterium avium subsp. paratuberculosis
cgacuacguguugccgggcgg

SEQ ID NO: 22068 - RNA, 22 nt, Mycobacterium avium subsp. paratuberculosis
acgacguaccgggcgcugggca

SEQ ID NO: 22069 - RNA, 21 nt, Mycobacterium avium subsp. paratuberculosis
acgagccgacgaugucggccc

SEQ ID NO: 22070 - RNA, 22 nt, Mycobacterium avium subsp. paratuberculosis
acgagcuguggguuuccaggua

SEQ ID NO: 22071 - RNA, 22 nt, Mycobacterium avium subsp. paratuberculosis
acgccgccgaagaucgugcuga

SEQ ID NO: 22072 - RNA, 22 nt, Mycobacterium avium subsp. paratuberculosis
acgccgccgagccgcuguugua

SEQ ID NO: 22073 - RNA, 22 nt, Mycobacterium avium subsp. paratuberculosis
acgccgugguacuccggcgcga

SEQ ID NO: 22074 - RNA, 22 nt, Mycobacterium avium subsp. paratuberculosis
acgccguguggcagcgcugguu

SEQ ID NO: 22075 - RNA, 21 nt, Mycobacterium avium subsp. paratuberculosis
acgcggccaagagugaucgac

SEQ ID NO: 22076 - RNA, 22 nt, Mycobacterium avium subsp. paratuberculosis
acgcggccccgccgucggggaa

SEQ ID NO: 22077 - RNA, 21 nt, Mycobacterium avium subsp. paratuberculosis
acgcugcuggccggcgauccg

SEQ ID NO: 22078 - RNA, 20 nt, Mycobacterium avium subsp. paratuberculosis
acgcuggcgugacgcucggc

SEQ ID NO: 22079 - RNA, 22 nt, Mycobacterium avium subsp. paratuberculosis
acgcuggucgacgccugccccu

SEQ ID NO: 22080 - RNA, 22 nt, Mycobacterium avium subsp. paratuberculosis
acggcccggucuugguccauug

SEQ ID NO: 22081 - RNA, 22 nt, Mycobacterium avium subsp. paratuberculosis
acgggcaccacgcgguggugcg

SEQ ID NO: 22082 - RNA, 22 nt, Mycobacterium avium subsp. paratuberculosis
acgggccagcaggucggcggug

SEQ ID NO: 22083 - RNA, 19 nt, Mycobacterium avium subsp. paratuberculosis
acgggccguggcgccaucu

SEQ ID NO: 22084 - RNA, 22 nt, Mycobacterium avium subsp. paratuberculosis
acgggcuugccgaggguggugc

SEQ ID NO: 22085 - RNA, 22 nt, Mycobacterium avium subsp. paratuberculosis
acgggcuugguucucgaucuga

SEQ ID NO: 22086 - RNA, 22 nt, Mycobacterium avium subsp. paratuberculosis
acggggccggugucgaccugcu

SEQ ID NO: 22087 - RNA, 22 nt, Mycobacterium avium subsp. paratuberculosis
acggggugaccacgguggugau

SEQ ID NO: 22088 - RNA, 22 nt, Mycobacterium avium subsp. paratuberculosis
acggugacgcugauggucgcgu

SEQ ID NO: 22089 - RNA, 21 nt, Mycobacterium avium subsp. paratuberculosis
acggugagccguucgugcugc

SEQ ID NO: 22090 - RNA, 22 nt, Mycobacterium avium subsp. paratuberculosis
acgguggugaagcccuugauga

SEQ ID NO: 22091 - RNA, 22 nt, Mycobacterium avium subsp. paratuberculosis
acggugugcugggggugcgcga

SEQ ID NO: 22092 - RNA, 22 nt, Mycobacterium avium subsp. paratuberculosis
acguacaagaacaccggcgaac

SEQ ID NO: 22093 - RNA, 20 nt, Mycobacterium avium subsp. paratuberculosis
acgucccaauccugcuggug

SEQ ID NO: 22094 - RNA, 22 nt, Mycobacterium avium subsp. paratuberculosis
acgucgaccgcaguggugauga

SEQ ID NO: 22095 - RNA, 22 nt, Mycobacterium avium subsp. paratuberculosis
acgucgccgaacugaucuccgu

SEQ ID NO: 22096 - RNA, 22 nt, Mycobacterium avium subsp. paratuberculosis
acgucgcugguugcacuuucgc

SEQ ID NO: 22097 - RNA, 21 nt, Mycobacterium avium subsp. paratuberculosis
acgucucggagaagaccguuc

SEQ ID NO: 22098 - RNA, 22 nt, Mycobacterium avium subsp. paratuberculosis
acgugauggacgagugguuccg

SEQ ID NO: 22099 - RNA, 22 nt, Mycobacterium avium subsp. paratuberculosis
acgugcacgccaugugcguggg

SEQ ID NO: 22100 - RNA, 21 nt, Mycobacterium avium subsp. paratuberculosis
acgugccagcgcgcgcuggug

SEQ ID NO: 22101 - RNA, 22 nt, Mycobacterium avium subsp. paratuberculosis
acgugcgggguauccucggugg

SEQ ID NO: 22102 - RNA, 22 nt, Mycobacterium avium subsp. paratuberculosis
acgugcugggcuggccgucgau

SEQ ID NO: 22103 - RNA, 22 nt, Mycobacterium avium subsp. paratuberculosis
acgugcuggucgcauucggccg

SEQ ID NO: 22104 - RNA, 18 nt, Mycobacterium avium subsp. paratuberculosis
acguucgacccgccgauc

SEQ ID NO: 22105 - RNA, 22 nt, Mycobacterium avium subsp. paratuberculosis
acuacggguaccgccggcugcg

SEQ ID NO: 22106 - RNA, 22 nt, Mycobacterium avium subsp. paratuberculosis
acucgcccuggcugagcgucag

SEQ ID NO: 22107 - RNA, 22 nt, Mycobacterium avium subsp. paratuberculosis
acugccacaacgacucccgcgu

SEQ ID NO: 22108 - RNA, 22 nt, Mycobacterium avium subsp. paratuberculosis
acuggucuuguagcccggcagg

SEQ ID NO: 22109 - RNA, 22 nt, Mycobacterium avium subsp. paratuberculosis
agaccgggaaccguggcacugu

SEQ ID NO: 22110 - RNA, 22 nt, Mycobacterium avium subsp. paratuberculosis
agagcuccagcgagaacgggcc

SEQ ID NO: 22111 - RNA, 22 nt, Mycobacterium avium subsp. paratuberculosis
agauggcgccgccggauccguc

SEQ ID NO: 22112 - RNA, 22 nt, Mycobacterium avium subsp. paratuberculosis
agcaccgagaagcccagcgugu

SEQ ID NO: 22113 - RNA, 22 nt, Mycobacterium avium subsp. paratuberculosis
agcacgaaggccgccggguccu

SEQ ID NO: 22114 - RNA, 22 nt, Mycobacterium avium subsp. paratuberculosis
agcagcccgcaauucucccgca

SEQ ID NO: 22115 - RNA, 21 nt, Mycobacterium avium subsp. paratuberculosis
agcaugaagccggugcucagc

SEQ ID NO: 22116 - RNA, 22 nt, Mycobacterium avium subsp. paratuberculosis
agcaugucgcugaucuugucga

SEQ ID NO: 22117 - RNA, 22 nt, Mycobacterium avium subsp. paratuberculosis
agcccggccgcagccuggagcg

SEQ ID NO: 22118 - RNA, 22 nt, Mycobacterium avium subsp. paratuberculosis
agccgcaccgccacgguguggc

SEQ ID NO: 22119 - RNA, 21 nt, Mycobacterium avium subsp. paratuberculosis
agccgcccggcgccaguaacc

SEQ ID NO: 22120 - RNA, 22 nt, Mycobacterium avium subsp. paratuberculosis
agccgcgcgaccacacgguaac

SEQ ID NO: 22121 - RNA, 22 nt, Mycobacterium avium subsp. paratuberculosis
agccgcggcgaauggucgguca

SEQ ID NO: 22122 - RNA, 22 nt, Mycobacterium avium subsp. paratuberculosis
agccgggcgugcucguuggcgu

SEQ ID NO: 22123 - RNA, 20 nt, Mycobacterium avium subsp. paratuberculosis
agccggucagcaccgccgcc

SEQ ID NO: 22124 - RNA, 22 nt, Mycobacterium avium subsp. paratuberculosis
agccggucaggagacuuucguc

SEQ ID NO: 22125 - RNA, 22 nt, Mycobacterium avium subsp. paratuberculosis
agccgguggaucgggucgaugc

SEQ ID NO: 22126 - RNA, 22 nt, Mycobacterium avium subsp. paratuberculosis
ucaggaucagcucggccgucgg

SEQ ID NO: 22127 - RNA, 22 nt, Mycobacterium avium subsp. paratuberculosis
ucagguugguggcucccaguau

SEQ ID NO: 22128 - RNA, 19 nt, Mycobacterium avium subsp. paratuberculosis
ucagucgcgcgcuucgauc

SEQ ID NO: 22129 - RNA, 22 nt, Mycobacterium avium subsp. paratuberculosis
ucaucacguugucggccaucga

SEQ ID NO: 22130 - RNA, 22 nt, Mycobacterium avium subsp. paratuberculosis
ucaucgccaccgaugagcgccg

SEQ ID NO: 22131 - RNA, 22 nt, Mycobacterium avium subsp. paratuberculosis
ucaucgccgacagcgccggaac

SEQ ID NO: 22132 - RNA, 21 nt, Mycobacterium avium subsp. paratuberculosis
ucaucgccuggcuggcguggc

SEQ ID NO: 22133 - RNA, 22 nt, Mycobacterium avium subsp. paratuberculosis
ucaucggcgugaccuggaacga

SEQ ID NO: 22134 - RNA, 22 nt, Mycobacterium avium subsp. paratuberculosis
ucaugcucgacaccgcgcuggg

SEQ ID NO: 22135 - RNA, 22 nt, Mycobacterium avium subsp. paratuberculosis
uccacccgcagagaucccaagg

SEQ ID NO: 22136 - RNA, 22 nt, Mycobacterium avium subsp. paratuberculosis
uccaccgcccaggucgaugcgc

SEQ ID NO: 22137 - RNA, 22 nt, Mycobacterium avium subsp. paratuberculosis
uccacgaucgcgcggugccagu

SEQ ID NO: 22138 - RNA, 22 nt, Mycobacterium avium subsp. paratuberculosis
uccauucccaucgcccgcagca

SEQ ID NO: 22139 - RNA, 22 nt, Mycobacterium avium subsp. paratuberculosis
ucccaaccugguucgggugcaa

SEQ ID NO: 22140 - RNA, 22 nt, Mycobacterium avium subsp. paratuberculosis
uccccggugggccuggcgacac

SEQ ID NO: 22141 - RNA, 22 nt, Mycobacterium avium subsp. paratuberculosis
ucccgagcgucacgcuggcgcu

SEQ ID NO: 22142 - RNA, 22 nt, Mycobacterium avium subsp. paratuberculosis
ucccgcaaccggcucgccgacc

SEQ ID NO: 22143 - RNA, 20 nt, Mycobacterium avium subsp. paratuberculosis
ucccgcagcuggucccacuc

SEQ ID NO: 22144 - RNA, 21 nt, Mycobacterium avium subsp. paratuberculosis
ucccgccgggguggucagacu

SEQ ID NO: 22145 - RNA, 18 nt, Mycobacterium avium subsp. paratuberculosis
ucccggaucggcacggug

SEQ ID NO: 22146 - RNA, 22 nt, Mycobacterium avium subsp. paratuberculosis
ucccggugcggucgggcgcguc

SEQ ID NO: 22147 - RNA, 22 nt, Mycobacterium avium subsp. paratuberculosis
ucccgguuggggcccgcgagcg

SEQ ID NO: 22148 - RNA, 22 nt, Mycobacterium avium subsp. paratuberculosis
ucccgugugcacccucguagcc

SEQ ID NO: 22149 - RNA, 20 nt, Mycobacterium avium subsp. paratuberculosis
uccgacagcagcaucucgug

SEQ ID NO: 22150 - RNA, 22 nt, Mycobacterium avium subsp. paratuberculosis
uccgcaggauucgcagcacgga

SEQ ID NO: 22151 - RNA, 22 nt, Mycobacterium avium subsp. paratuberculosis
uccgccggcucugagucgccgu

SEQ ID NO: 22152 - RNA, 22 nt, Mycobacterium avium subsp. paratuberculosis
uccgcgcgggugugccgacguc

SEQ ID NO: 22153 - RNA, 22 nt, Mycobacterium avium subsp. paratuberculosis
uccggaccgcaggcccaggucu

SEQ ID NO: 22154 - RNA, 22 nt, Mycobacterium avium subsp. paratuberculosis
uccggcaguacgguggaaagcc

SEQ ID NO: 22155 - RNA, 22 nt, Mycobacterium avium subsp. paratuberculosis
uccggcgcgcgucagcugcagu

SEQ ID NO: 22156 - RNA, 22 nt, Mycobacterium avium subsp. paratuberculosis
uccgggcgaucgauuccacccu

SEQ ID NO: 22157 - RNA, 19 nt, Mycobacterium avium subsp. paratuberculosis
uccgggucgcucauccgcg

SEQ ID NO: 22158 - RNA, 22 nt, Mycobacterium avium subsp. paratuberculosis
uccgggugcccuaccgggcgcg

SEQ ID NO: 22159 - RNA, 22 nt, Mycobacterium avium subsp. paratuberculosis
uccguaccggccgcgcuggugc

SEQ ID NO: 22160 - RNA, 18 nt, Mycobacterium avium subsp. paratuberculosis
uccguccagguagcgccg

SEQ ID NO: 22161 - RNA, 22 nt, Mycobacterium avium subsp. paratuberculosis
uccuuggccucgccagucguca

SEQ ID NO: 22162 - RNA, 22 nt, Mycobacterium avium subsp. paratuberculosis
ucgaacagcgccugcugggugg

SEQ ID NO: 22163 - RNA, 22 nt, Mycobacterium avium subsp. paratuberculosis
ucgacacccgggccgccaccau

SEQ ID NO: 22164 - RNA, 22 nt, Mycobacterium avium subsp. paratuberculosis
ucgacccaggugcccgacaccg

SEQ ID NO: 22165 - RNA, 22 nt, Mycobacterium avium subsp. paratuberculosis
ucgacccggcgucgcgggcgug

SEQ ID NO: 22166 - RNA, 22 nt, Mycobacterium avium subsp. paratuberculosis
ucgacgacgagggcuaccuguu

SEQ ID NO: 22167 - RNA, 22 nt, Mycobacterium avium subsp. paratuberculosis
ucgacgaucgcguccaggucgg

SEQ ID NO: 22168 - RNA, 18 nt, Mycobacterium avium subsp. paratuberculosis
ucgacgcagccuucgauc

SEQ ID NO: 22169 - RNA, 22 nt, Mycobacterium avium subsp. paratuberculosis
ucgacgccgaugacgccggcgg

SEQ ID NO: 22170 - RNA, 22 nt, Mycobacterium avium subsp. paratuberculosis
ucgacggccugguugugcggca

SEQ ID NO: 22171 - RNA, 23 nt, Mycobacterium avium subsp. paratuberculosis
ucgacgugacguuccccugcccg

SEQ ID NO: 22172 - RNA, 22 nt, Mycobacterium avium subsp. paratuberculosis
ucgagcacggcuaucccgccgc

SEQ ID NO: 22173 - RNA, 22 nt, Mycobacterium avium subsp. paratuberculosis
ucgagcagccgaccagcgucac

SEQ ID NO: 22174 - RNA, 22 nt, Mycobacterium avium subsp. paratuberculosis
ucgagcgucacgcuggcguggc

SEQ ID NO: 22175 - RNA, 23 nt, Mycobacterium avium subsp. paratuberculosis
ucgagcuggccguugauggaagc

SEQ ID NO: 22176 - RNA, 22 nt, Mycobacterium avium subsp. paratuberculosis
ucguugaucagcccgccggugu

SEQ ID NO: 22177 - RNA, 22 nt, Mycobacterium avium subsp. paratuberculosis
ucucagugccgagcggcaguuc

SEQ ID NO: 22178 - RNA, 22 nt, Mycobacterium avium subsp. paratuberculosis
ucucauuccugagacuuucuug

SEQ ID NO: 22179 - RNA, 22 nt, Mycobacterium avium subsp. paratuberculosis
ucucccggaauccgucgauguu

SEQ ID NO: 22180 - RNA, 22 nt, Mycobacterium avium subsp. paratuberculosis
ucucccggauuugcgccgaucu

SEQ ID NO: 22181 - RNA, 20 nt, Mycobacterium avium subsp. paratuberculosis
ucuccggugaccaccacggc

SEQ ID NO: 22182 - RNA, 22 nt, Mycobacterium avium subsp. paratuberculosis
ucuccugcgagcugccgcugca

SEQ ID NO: 22183 - RNA, 22 nt, Mycobacterium avium subsp. paratuberculosis
ucucgcgguagcugcacgcucg

SEQ ID NO: 22184 - RNA, 22 nt, Mycobacterium avium subsp. paratuberculosis
ucucggcgguguaggcguucag

SEQ ID NO: 22185 - RNA, 22 nt, Mycobacterium avium subsp. paratuberculosis
ucucgguguccagcgcgcuggu

SEQ ID NO: 22186 - RNA, 20 nt, Mycobacterium avium subsp. paratuberculosis
ucucgguguggguccacggc

SEQ ID NO: 22187 - RNA, 19 nt, Mycobacterium avium subsp. paratuberculosis
ucugcaggguggcccaguu

SEQ ID NO: 22188 - RNA, 22 nt, Mycobacterium avium subsp. paratuberculosis
ucugcauucgaaaguacuauuu

SEQ ID NO: 22189 - RNA, 22 nt, Mycobacterium avium subsp. paratuberculosis
ucugccaacauaagagccgacg

SEQ ID NO: 22190 - RNA, 20 nt, Mycobacterium avium subsp. paratuberculosis
ucugccacagcccgaagauc

SEQ ID NO: 22191 - RNA, 23 nt, Mycobacterium avium subsp. paratuberculosis
ucuggccucggagccgccgagcc

SEQ ID NO: 22192 - RNA, 22 nt, Mycobacterium avium subsp. paratuberculosis
ucugggcgauccugugcaccgu

SEQ ID NO: 22193 - RNA, 22 nt, Mycobacterium avium subsp. paratuberculosis
ucuggucgaggucgucggcgaa

SEQ ID NO: 22194 - RNA, 22 nt, Mycobacterium avium subsp. paratuberculosis
ugaccacgaugcucuaccccga

SEQ ID NO: 22195 - RNA, 22 nt, Mycobacterium avium subsp. paratuberculosis
ugaccugcgaccaggaccgguc

SEQ ID NO: 22196 - RNA, 21 nt, Mycobacterium avium subsp. paratuberculosis
ugacgccgacgaguuucuuca

SEQ ID NO: 22197 - RNA, 22 nt, Mycobacterium avium subsp. paratuberculosis
ugcuggguguuccgcaggagga

SEQ ID NO: 22198 - RNA, 22 nt, Mycobacterium avium subsp. paratuberculosis
ugcuggucgagcggaugcaguc

SEQ ID NO: 22199 - RNA, 22 nt, Mycobacterium avium subsp. paratuberculosis
ugcuggugaagucgaggaagcc

SEQ ID NO: 22200 - RNA, 17 nt, Mycobacterium avium subsp. paratuberculosis
ugcugguggugcuccug

SEQ ID NO: 22201 - RNA, 22 nt, Mycobacterium avium subsp. paratuberculosis
ugcugucggcccgcagcucggu

SEQ ID NO: 22202 - RNA, 22 nt, Mycobacterium avium subsp. paratuberculosis
uggaaaagauggguccgguccg

SEQ ID NO: 22203 - RNA, 22 nt, Mycobacterium avium subsp. paratuberculosis
uggacgagaucuucgcgacccg

SEQ ID NO: 22204 - RNA, 22 nt, Mycobacterium avium subsp. paratuberculosis
uggacgauuuguucguugcugg

SEQ ID NO: 22205 - RNA, 22 nt, Mycobacterium avium subsp. paratuberculosis
uggaggaagagcaggugugcac

SEQ ID NO: 22206 - RNA, 22 nt, Mycobacterium avium subsp. paratuberculosis
uggaggaguucgacagucagcu

SEQ ID NO: 22207 - RNA, 21 nt, Mycobacterium avium subsp. paratuberculosis
uggcaggucgucgacgccacc

SEQ ID NO: 22208 - RNA, 22 nt, Mycobacterium avium subsp. paratuberculosis
uggccaggucgccgacgaccug

SEQ ID NO: 22209 - RNA, 22 nt, Mycobacterium avium subsp. paratuberculosis
uggcccgcaccgucgucgcgcu

SEQ ID NO: 22210 - RNA, 22 nt, Mycobacterium avium subsp. paratuberculosis
uggccgaaccggguucggacga

SEQ ID NO: 22211 - RNA, 20 nt, Mycobacterium avium subsp. paratuberculosis
uggccgacccgaccgucguc

SEQ ID NO: 22212 - RNA, 22 nt, Mycobacterium avium subsp. paratuberculosis
uggccgccgcucggcaaaccau

SEQ ID NO: 22213 - RNA, 22 nt, Mycobacterium avium subsp. paratuberculosis
uggccgcgcuggcgcccuggaa

SEQ ID NO: 22214 - RNA, 22 nt, Mycobacterium avium subsp. paratuberculosis
uggccgguggcgcugucgacgg

SEQ ID NO: 22215 - RNA, 19 nt, Mycobacterium avium subsp. paratuberculosis
uggccgucgaugauguuga

SEQ ID NO: 22216 - RNA, 21 nt, Mycobacterium avium subsp. paratuberculosis
uggccugcagguggucgcggg

SEQ ID NO: 22217 - RNA, 22 nt, Mycobacterium avium subsp. paratuberculosis
uggcgaugaugcuggucggguu

SEQ ID NO: 22218 - RNA, 22 nt, Mycobacterium avium subsp. paratuberculosis
uggcgauucgguugcucgacgc

SEQ ID NO: 22219 - RNA, 22 nt, Mycobacterium avium subsp. paratuberculosis
uggcgccgugcaugaccgccug

SEQ ID NO: 22220 - RNA, 22 nt, Mycobacterium avium subsp. paratuberculosis
uggcgcugcaacugguagcgga

SEQ ID NO: 22221 - RNA, 22 nt, Mycobacterium avium subsp. paratuberculosis
uggcggcauacagcggcccgau

SEQ ID NO: 22222 - RNA, 22 nt, Mycobacterium avium subsp. paratuberculosis
uggcggcccugcuguccgccgc

SEQ ID NO: 22223 - RNA, 22 nt, Mycobacterium avium subsp. paratuberculosis
uggcggcgcuggccgugcuggu

SEQ ID NO: 22224 - RNA, 23 nt, Mycobacterium avium subsp. paratuberculosis
uggcgggucgggcucgcauucac

SEQ ID NO: 22225 - RNA, 22 nt, Mycobacterium avium subsp. paratuberculosis
uggcgguggaccugccggcccu

SEQ ID NO: 22226 - RNA, 22 nt, Mycobacterium avium subsp. paratuberculosis
uggcguccagcagcgccgagac

SEQ ID NO: 22227 - RNA, 22 nt, Mycobacterium avium subsp. paratuberculosis
uggcgucgaucucgcgguucgc

SEQ ID NO: 22228 - RNA, 22 nt, Mycobacterium avium subsp. paratuberculosis
uggcgugaucgaguuggcccgu

SEQ ID NO: 22229 - RNA, 22 nt, Mycobacterium avium subsp. paratuberculosis
uggcucgaaauccgcagugugg

SEQ ID NO: 22230 - RNA, 22 nt, Mycobacterium avium subsp. paratuberculosis
uggcugaccagaaagucgacca

SEQ ID NO: 22231 - RNA, 21 nt, Mycobacterium avium subsp. paratuberculosis
uggcugaugucgcucugcguc

SEQ ID NO: 22232 - RNA, 22 nt, Mycobacterium avium subsp. paratuberculosis
uggcugcgagacgggcuggucg

SEQ ID NO: 22233 - RNA, 22 nt, Mycobacterium avium subsp. paratuberculosis
uggcugcuguacgccgugccgg

SEQ ID NO: 22234 - RNA, 22 nt, Mycobacterium avium subsp. paratuberculosis
uggcuggccgucaucaccggcg

SEQ ID NO: 22235 - RNA, 22 nt, Mycobacterium avium subsp. paratuberculosis
ugggccaacggaauguagucgg

SEQ ID NO: 22236 - RNA, 22 nt, Mycobacterium avium subsp. paratuberculosis
ugggcccggcgaucgcggaguu

SEQ ID NO: 22237 - RNA, 22 nt, Mycobacterium avium subsp. paratuberculosis
ugggcgaccaccugagcccggu

SEQ ID NO: 22238 - RNA, 22 nt, Mycobacterium avium subsp. paratuberculosis
ugggcgacuucauggcggccac

SEQ ID NO: 22239 - RNA, 22 nt, Mycobacterium avium subsp. paratuberculosis
ugggcgacuugauggcggucgg

SEQ ID NO: 22240 - RNA, 22 nt, Mycobacterium avium subsp. paratuberculosis
ugggcgcagaucuucgccaacg

SEQ ID NO: 22241 - RNA, 22 nt, Mycobacterium avium subsp. paratuberculosis
ugggcugguucggccggugacc

SEQ ID NO: 22242 - RNA, 19 nt, Mycobacterium avium subsp. paratuberculosis
uggguaucacguccaguuc

SEQ ID NO: 22243 - RNA, 23 nt, Mycobacterium avium subsp. paratuberculosis
uggucgcgacgcagaauuucgcc

SEQ ID NO: 22244 - RNA, 22 nt, Mycobacterium avium subsp. paratuberculosis
uggucgcgacgucaugggcgag

SEQ ID NO: 22245 - RNA, 22 nt, Mycobacterium avium subsp. paratuberculosis
uggucgcgauggccgucgcauc

SEQ ID NO: 22246 - RNA, 22 nt, Mycobacterium avium subsp. paratuberculosis
uggucggagguggccggcaucu

SEQ ID NO: 22247 - RNA, 22 nt, Mycobacterium avium subsp. paratuberculosis
uggucggccgacgacguguucu

SEQ ID NO: 22248 - RNA, 20 nt, Mycobacterium avium subsp. paratuberculosis
uggugcacacguugacgccc

SEQ ID NO: 22249 - RNA, 23 nt, Mycobacterium avium subsp. paratuberculosis
uggugcagucgacgccggcgauc

SEQ ID NO: 22250 - RNA, 22 nt, Mycobacterium avium subsp. paratuberculosis
uggugcccagcauuucgggugg

SEQ ID NO: 22251 - RNA, 20 nt, Mycobacterium avium subsp. paratuberculosis
uggugcgggcguucgcccgg

SEQ ID NO: 22252 - RNA, 22 nt, Mycobacterium avium subsp. paratuberculosis
uggugcuuggcuguuacggcgc

SEQ ID NO: 22253 - RNA, 22 nt, Mycobacterium avium subsp. paratuberculosis
ugguggagacggcgacgaaaug

SEQ ID NO: 22254 - RNA, 22 nt, Mycobacterium avium subsp. paratuberculosis
ugguggcggccgaucgugcgcc

SEQ ID NO: 22255 - RNA, 22 nt, Mycobacterium avium subsp. paratuberculosis
ugguggcguuguucugccgcgg

SEQ ID NO: 22256 - RNA, 22 nt, Mycobacterium avium subsp. paratuberculosis
uggugggcaucuccggcucggg

SEQ ID NO: 22257 - RNA, 22 nt, Mycobacterium avium subsp. paratuberculosis
uguccaggugguuggucggcuc

SEQ ID NO: 22258 - RNA, 22 nt, Mycobacterium avium subsp. paratuberculosis
uguccgaaggcacgaaccuggc

SEQ ID NO: 22259 - RNA, 22 nt, Mycobacterium avium subsp. paratuberculosis
uguccgcagaucgagcagccgu

SEQ ID NO: 22260 - RNA, 22 nt, Mycobacterium avium subsp. paratuberculosis
uguccggaauaucagucaugcc

SEQ ID NO: 22261 - RNA, 22 nt, Mycobacterium avium subsp. paratuberculosis
ugucgcggcuguccggcaucgc

SEQ ID NO: 22262 - RNA, 22 nt, Mycobacterium avium subsp. paratuberculosis
ugucgcugccgcggguggagau

SEQ ID NO: 22263 - RNA, 22 nt, Mycobacterium avium subsp. paratuberculosis
ugucgcuggucgaggcgcugcg

SEQ ID NO: 22264 - RNA, 22 nt, Mycobacterium avium subsp. paratuberculosis
ugucggcgacgaggcccuugau

SEQ ID NO: 22265 - RNA, 22 nt, Mycobacterium avium subsp. paratuberculosis
ugucggcgcggaagguggugau

SEQ ID NO: 22266 - RNA, 22 nt, Mycobacterium avium subsp. paratuberculosis
ugucggcgucggucagcgccau

SEQ ID NO: 22267 - RNA, 22 nt, Mycobacterium avium subsp. paratuberculosis
ugucgggcaucgcccgcauccu

SEQ ID NO: 22268 - RNA, 22 nt, Mycobacterium avium subsp. paratuberculosis
ugucggugucgugggcggccgc

SEQ ID NO: 22269 - RNA, 22 nt, Mycobacterium avium subsp. paratuberculosis
ugugcccgggcgcggcggaacu

SEQ ID NO: 22270 - RNA, 22 nt, Mycobacterium avium subsp. paratuberculosis
ugugccgcguacccgggccggu

SEQ ID NO: 22271 - RNA, 22 nt, Mycobacterium avium subsp. paratuberculosis
ugugccugaccgucggcgcggg

SEQ ID NO: 22272 - RNA, 22 nt, Mycobacterium avium subsp. paratuberculosis
ugugccuguccaugcuggugcc

SEQ ID NO: 22273 - RNA, 22 nt, Mycobacterium avium subsp. paratuberculosis
ugugcggacguucggcggugaa

SEQ ID NO: 22274 - RNA, 22 nt, Mycobacterium avium subsp. paratuberculosis
ugugcggugcgaugccgggcag

SEQ ID NO: 22275 - RNA, 22 nt, Mycobacterium avium subsp. paratuberculosis
ugugggaccaaacacaauucgu

SEQ ID NO: 22276 - RNA, 22 nt, Mycobacterium avium subsp. paratuberculosis
uguucgaucaugaugacgucga

SEQ ID NO: 22277 - RNA, 22 nt, Mycobacterium avium subsp. paratuberculosis
uguucgccggcgucgaucagcg

SEQ ID NO: 22278 - RNA, 22 nt, Mycobacterium avium subsp. paratuberculosis
uguucgugaggucccgguggca

SEQ ID NO: 22279 - RNA, 22 nt, Mycobacterium avium subsp. paratuberculosis
uguuucugggcauccgcgccgu

SEQ ID NO: 22280 - RNA, 22 nt, Mycobacterium avium subsp. paratuberculosis
uuacuuaucgguaagucaguua

SEQ ID NO: 22281 - RNA, 22 nt, Mycobacterium avium subsp. paratuberculosis
uucagggucucgccgaucaccc

SEQ ID NO: 22282 - RNA, 22 nt, Mycobacterium avium subsp. paratuberculosis
uucaucaccgcccacccggauu

SEQ ID NO: 22283 - RNA, 19 nt, Mycobacterium avium subsp. paratuberculosis
uucaucgagaugaacccgc

SEQ ID NO: 22284 - RNA, 22 nt, Mycobacterium avium subsp. paratuberculosis
uuccgggcggcuggucugcggg

SEQ ID NO: 22285 - RNA, 22 nt, Mycobacterium avium subsp. paratuberculosis
uuccuggugcgcaccgucaccg

SEQ ID NO: 22286 - RNA, 22 nt, Mycobacterium avium subsp. paratuberculosis
uucgaggucggcgcguugacca

SEQ ID NO: 22287 - RNA, 22 nt, Mycobacterium avium subsp. paratuberculosis
uucgaguagcccugcugcccgu

SEQ ID NO: 22288 - RNA, 20 nt, Mycobacterium avium subsp. paratuberculosis
uucgccgacaucgaccggca

SEQ ID NO: 22289 - RNA, 22 nt, Mycobacterium avium subsp. paratuberculosis
uucgcggaaccacguugcggga

SEQ ID NO: 22290 - RNA, 22 nt, Mycobacterium avium subsp. paratuberculosis
uucgcugccagugcacguucgg

SEQ ID NO: 22291 - RNA, 22 nt, Mycobacterium avium subsp. paratuberculosis
uucggcgaucugcucuacuucg

SEQ ID NO: 22292 - RNA, 22 nt, Mycobacterium avium subsp. paratuberculosis
uucgggcaguagugcgcggccg

SEQ ID NO: 22293 - RNA, 22 nt, Mycobacterium avium subsp. paratuberculosis
uucggggagcgcgacaccguuu

SEQ ID NO: 22294 - RNA, 22 nt, Mycobacterium avium subsp. paratuberculosis
uucggggugaagaaccgggacc

SEQ ID NO: 22295 - RNA, 22 nt, Mycobacterium avium subsp. paratuberculosis
uucgguggcgaucagguggucg

SEQ ID NO: 22296 - RNA, 22 nt, Mycobacterium avium subsp. paratuberculosis
uucggugucggugcgggucggc

SEQ ID NO: 22297 - RNA, 22 nt, Mycobacterium avium subsp. paratuberculosis
uucguccgccagcacgguuugc

SEQ ID NO: 22298 - RNA, 22 nt, Mycobacterium avium subsp. paratuberculosis
uucgucggcgaacggccagucc

SEQ ID NO: 22299 - RNA, 22 nt, Mycobacterium avium subsp. paratuberculosis
uucgugaucggagucgcuaccg

SEQ ID NO: 22300 - RNA, 22 nt, Mycobacterium avium subsp. paratuberculosis
uucguggugucggcggccgcgc

SEQ ID NO: 22301 - RNA, 22 nt, Mycobacterium avium subsp. paratuberculosis
uucguugugcgcgcggaagguu

SEQ ID NO: 22302 - RNA, 18 nt, Mycobacterium avium subsp. paratuberculosis
uucugcgagguggcccgc

SEQ ID NO: 22303 - RNA, 22 nt, Mycobacterium avium subsp. paratuberculosis
uucugguccuucauccggugcg

SEQ ID NO: 22304 - RNA, 22 nt, Mycobacterium avium subsp. paratuberculosis
uucuucgcuaccagugcacgcu

SEQ ID NO: 22305 - RNA, 22 nt, Mycobacterium avium subsp. paratuberculosis
uucuugguggcagcgucgucgu

SEQ ID NO: 22306 - RNA, 22 nt, Mycobacterium avium subsp. paratuberculosis
uugacaccguugaugcgcaugg

SEQ ID NO: 22307 - RNA, 22 nt, Mycobacterium avium subsp. paratuberculosis
uugacgaucgugcccucgacga

SEQ ID NO: 22308 - RNA, 22 nt, Mycobacterium avium subsp. paratuberculosis
uugaggaucagguucagcuggc

SEQ ID NO: 22309 - RNA, 22 nt, Mycobacterium avium subsp. paratuberculosis
uugagguugaacuugccggugc

SEQ ID NO: 22310 - RNA, 22 nt, Mycobacterium avium subsp. paratuberculosis
uugauccgaucgagcacguguu

SEQ ID NO: 22311 - RNA, 22 nt, Mycobacterium avium subsp. paratuberculosis
uugcaccgugggggcgcguuug

SEQ ID NO: 22312 - RNA, 22 nt, Mycobacterium avium subsp. paratuberculosis
uugcccgccgcgcugaccgauu

SEQ ID NO: 22313 - RNA, 22 nt, Mycobacterium avium subsp. paratuberculosis
uugcccgggaucaccgcguugu

SEQ ID NO: 22314 - RNA, 22 nt, Mycobacterium avium subsp. paratuberculosis
uugccgccgaucgcgccggggu

SEQ ID NO: 22315 - RNA, 22 nt, Mycobacterium avium subsp. paratuberculosis
uugccgccggccuccucgacca

SEQ ID NO: 22316 - RNA, 21 nt, Mycobacterium avium subsp. paratuberculosis
uugccggucgggauggcggcg

SEQ ID NO: 22317 - RNA, 22 nt, Mycobacterium avium subsp. paratuberculosis
uugcgcucccaccaggucgucu

SEQ ID NO: 22318 - RNA, 22 nt, Mycobacterium avium subsp. paratuberculosis
uugcgggcgaucaccuggcuuu

SEQ ID NO: 22319 - RNA, 22 nt, Mycobacterium avium subsp. paratuberculosis
uugcuguuggagaaccgcgggu

SEQ ID NO: 22320 - RNA, 22 nt, Mycobacterium avium subsp. paratuberculosis
uuggccggcugcaguucgacgg

SEQ ID NO: 22321 - RNA, 22 nt, Mycobacterium avium subsp. paratuberculosis
uuggcgcgggugaucucggcga

SEQ ID NO: 22322 - RNA, 22 nt, Mycobacterium avium subsp. paratuberculosis
uuggucgagcgggucgaggucg

SEQ ID NO: 22323 - RNA, 22 nt, Mycobacterium avium subsp. paratuberculosis
uuggugauccggaagcgcucga

SEQ ID NO: 22324 - RNA, 22 nt, Mycobacterium avium subsp. paratuberculosis
uuggugcagcaccgcagccggu

SEQ ID NO: 22325 - RNA, 22 nt, Mycobacterium avium subsp. paratuberculosis
uuggugguggucgucgacgagc

SEQ ID NO: 22326 - RNA, 21 nt, Mycobacterium avium subsp. paratuberculosis
uugucaccgccguccggcgac

SEQ ID NO: 22327 - RNA, 22 nt, Mycobacterium avium subsp. paratuberculosis
uuguccaccggcagcgacuccc

SEQ ID NO: 22328 - RNA, 22 nt, Mycobacterium avium subsp. paratuberculosis
uugucccggaacgccgacgucg

SEQ ID NO: 22329 - RNA, 22 nt, Mycobacterium avium subsp. paratuberculosis
uugucgcugcgaggcgggcaca

SEQ ID NO: 22330 - RNA, 22 nt, Mycobacterium avium subsp. paratuberculosis
uuucagcgccgccucgguguag

SEQ ID NO: 22331 - RNA, 22 nt, Mycobacterium avium subsp. paratuberculosis
uuucgcccagcaagucgacguu

SEQ ID NO: 22332 - RNA, 22 nt, Mycobacterium avium subsp. paratuberculosis
uuucggcgaggaccugguggcc

SEQ ID NO: 22333 - RNA, 22 nt, Mycobacterium avium subsp. paratuberculosis
uuucgggugauccaugucguuc

SEQ ID NO: 22334 - RNA, 22 nt, Mycobacterium avium subsp. paratuberculosis
uuugggggacuuucgcgucugc

SEQ ID NO: 22335 - RNA, 22 nt, Mycobacterium avium subsp. paratuberculosis
uuuucgccucguacgacgccgg

SEQ ID NO: 22336 - RNA, 22 nt, Mycobacterium avium subsp. paratuberculosis
uuuucggugccgucgacgaacc

SEQ ID NO: 22337 - RNA, 22 nt, Mycobacterium avium subsp. paratuberculosis
ggguggccuucggugucgaccg

SEQ ID NO: 22338 - RNA, 22 nt, Mycobacterium avium subsp. paratuberculosis
ggguggcgaugcguucggcgac

SEQ ID NO: 22339 - RNA, 19 nt, Mycobacterium avium subsp. paratuberculosis
gggugggcuaacagcggug

SEQ ID NO: 22340 - RNA, 22 nt, Mycobacterium avium subsp. paratuberculosis
gggugguaguagccgccggcgg

SEQ ID NO: 22341 - RNA, 22 nt, Mycobacterium avium subsp. paratuberculosis
gggugucgcccucgggguacuc

SEQ ID NO: 22342 - RNA, 22 nt, Mycobacterium avium subsp. paratuberculosis
gggugugaccgagaccgagguc

SEQ ID NO: 22343 - RNA, 22 nt, Mycobacterium avium subsp. paratuberculosis
ggguuugcccggcucggcaucg

SEQ ID NO: 22344 - RNA, 22 nt, Mycobacterium avium subsp. paratuberculosis
gguaggcgacgugcugcucgcc

SEQ ID NO: 22345 - RNA, 22 nt, Mycobacterium avium subsp. paratuberculosis
ggucaccgcggcggugcucgaa

SEQ ID NO: 22346 - RNA, 22 nt, Mycobacterium avium subsp. paratuberculosis
gguccggcggugucgguaccgc

SEQ ID NO: 22347 - RNA, 22 nt, Mycobacterium avium subsp. paratuberculosis
ggucgacgggugcgccagcuca

SEQ ID NO: 22348 - RNA, 22 nt, Mycobacterium avium subsp. paratuberculosis
ggucgcagccccagcuccggcc

SEQ ID NO: 22349 - RNA, 22 nt, Mycobacterium avium subsp. paratuberculosis
ggucgcccuuggccgggucgcg

SEQ ID NO: 22350 - RNA, 22 nt, Mycobacterium avium subsp. paratuberculosis
ggucgccguuggagugcgugau

SEQ ID NO: 22351 - RNA, 22 nt, Mycobacterium avium subsp. paratuberculosis
ggucggccgccaaugccgaggc

SEQ ID NO: 22352 - RNA, 22 nt, Mycobacterium avium subsp. paratuberculosis
ggucggcgaaguggcuaucguc

SEQ ID NO: 22353 - RNA, 22 nt, Mycobacterium avium subsp. paratuberculosis
ggucuggcugacgccgacgaac

SEQ ID NO: 22354 - RNA, 22 nt, Mycobacterium avium subsp. paratuberculosis
ggucuucaccgagggcgugauc

SEQ ID NO: 22355 - RNA, 22 nt, Mycobacterium avium subsp. paratuberculosis
ggugacgccgcaucugcuggug

SEQ ID NO: 22356 - RNA, 21 nt, Mycobacterium avium subsp. paratuberculosis
ggugacggccugaccgcugga

SEQ ID NO: 22357 - RNA, 22 nt, Mycobacterium avium subsp. paratuberculosis
ggugagggucucgaucggguug

SEQ ID NO: 22358 - RNA, 20 nt, Mycobacterium avium subsp. paratuberculosis
ggugaguugccuggcgaccu

SEQ ID NO: 22359 - RNA, 22 nt, Mycobacterium avium subsp. paratuberculosis
ggugauugucgcucagaggcgg

SEQ ID NO: 22360 - RNA, 22 nt, Mycobacterium avium subsp. paratuberculosis
ggugccgcacgaccagcccggu

SEQ ID NO: 22361 - RNA, 22 nt, Mycobacterium avium subsp. paratuberculosis
ggugcgguucaccgacaccgac

SEQ ID NO: 22362 - RNA, 21 nt, Mycobacterium avium subsp. paratuberculosis
ggugcuggugucgcaugcgcu

SEQ ID NO: 22363 - RNA, 22 nt, Mycobacterium avium subsp. paratuberculosis
gguggggucccaggcgccgucc

SEQ ID NO: 22364 - RNA, 19 nt, Mycobacterium avium subsp. paratuberculosis
gguggucggccuggucgcc

SEQ ID NO: 22365 - RNA, 22 nt, Mycobacterium avium subsp. paratuberculosis
gguggugucggcggccucguug

SEQ ID NO: 22366 - RNA, 22 nt, Mycobacterium avium subsp. paratuberculosis
ggugucggggccggccauggug

SEQ ID NO: 22367 - RNA, 22 nt, Mycobacterium avium subsp. paratuberculosis
ggugucugguacuccgcggaug

SEQ ID NO: 22368 - RNA, 22 nt, Mycobacterium avium subsp. paratuberculosis
gguguguuuggaggucaccgcc

SEQ ID NO: 22369 - RNA, 21 nt, Mycobacterium avium subsp. paratuberculosis
gguuaucggguaccgccggug

SEQ ID NO: 22370 - RNA, 22 nt, Mycobacterium avium subsp. paratuberculosis
gguuuugcgucugcucggcggc

SEQ ID NO: 22371 - RNA, 22 nt, Mycobacterium avium subsp. paratuberculosis
guacuucagguagcccagggcg

SEQ ID NO: 22372 - RNA, 22 nt, Mycobacterium avium subsp. paratuberculosis
guagccggugagccgcggugcg

SEQ ID NO: 22373 - RNA, 22 nt, Mycobacterium avium subsp. paratuberculosis
gucaccaaguucgccgccgggg

SEQ ID NO: 22374 - RNA, 22 nt, Mycobacterium avium subsp. paratuberculosis
gucacgccagcgugacgcucgg

SEQ ID NO: 22375 - RNA, 19 nt, Mycobacterium avium subsp. paratuberculosis
guccaggcccgcguguucg

SEQ ID NO: 22376 - RNA, 22 nt, Mycobacterium avium subsp. paratuberculosis
gucccgaucccggacaccgcgc

SEQ ID NO: 22377 - RNA, 22 nt, Mycobacterium avium subsp. paratuberculosis
gucccggugaugaacgcgccgu

SEQ ID NO: 22378 - RNA, 22 nt, Mycobacterium avium subsp. paratuberculosis
guccgguggcgagcagcagcgg

SEQ ID NO: 22379 - RNA, 22 nt, Mycobacterium avium subsp. paratuberculosis
guccgucagcucuucgcggccg

SEQ ID NO: 22380 - RNA, 22 nt, Mycobacterium avium subsp. paratuberculosis
guccucgaccacgauggugcgu

SEQ ID NO: 22381 - RNA, 22 nt, Mycobacterium avium subsp. paratuberculosis
guccugguuggugaucggcugc

SEQ ID NO: 22382 - RNA, 22 nt, Mycobacterium avium subsp. paratuberculosis
gucgaccacacgccggggcaca

SEQ ID NO: 22383 - RNA, 22 nt, Mycobacterium avium subsp. paratuberculosis
gucgacgucgggcggcuguucu

SEQ ID NO: 22384 - RNA, 22 nt, Mycobacterium avium subsp. paratuberculosis
gucgagcagcacgaugucggcg

SEQ ID NO: 22385 - RNA, 22 nt, Mycobacterium avium subsp. paratuberculosis
gucgagccguugguguggaucg

SEQ ID NO: 22386 - RNA, 22 nt, Mycobacterium avium subsp. paratuberculosis
gucgccgaccugcuggcguccg

SEQ ID NO: 22387 - RNA, 22 nt, Mycobacterium avium subsp. paratuberculosis
gucgccgggguccgccccgaau

SEQ ID NO: 22388 - RNA, 22 nt, Mycobacterium avium subsp. paratuberculosis
gucgcgcugcucgguggggugg

SEQ ID NO: 22389 - RNA, 22 nt, Mycobacterium avium subsp. paratuberculosis
gucggcaguagcacuuucgcgg

SEQ ID NO: 22390 - RNA, 21 nt, Mycobacterium avium subsp. paratuberculosis
gucggcaguugcacuuucgcg

SEQ ID NO: 22391 - RNA, 22 nt, Mycobacterium avium subsp. paratuberculosis
gucggcgagcuuggcgguguuc

SEQ ID NO: 22392 - RNA, 22 nt, Mycobacterium avium subsp. paratuberculosis
gucggcgaugucgugcucggug

SEQ ID NO: 22393 - RNA, 22 nt, Mycobacterium avium subsp. paratuberculosis
gucggcgcaacaagucgacgcu

SEQ ID NO: 22394 - RNA, 22 nt, Mycobacterium avium subsp. paratuberculosis
gucggcgcugauggccgcgugg

SEQ ID NO: 22395 - RNA, 23 nt, Mycobacterium avium subsp. paratuberculosis
gucggcgugcgcggccagguugc

SEQ ID NO: 22396 - RNA, 22 nt, Mycobacterium avium subsp. paratuberculosis
gucgggcggguccuggaaggug

SEQ ID NO: 22397 - RNA, 22 nt, Mycobacterium avium subsp. paratuberculosis
gucggggcugcagcgccgcugg

SEQ ID NO: 22398 - RNA, 22 nt, Mycobacterium avium subsp. paratuberculosis
gucgggguugucgaacgccucg

SEQ ID NO: 22399 - RNA, 22 nt, Mycobacterium avium subsp. paratuberculosis
gucggguccagguggccgcccg

SEQ ID NO: 22400 - RNA, 22 nt, Mycobacterium avium subsp. paratuberculosis
gucggugcccgacaucccgggg

SEQ ID NO: 22401 - RNA, 22 nt, Mycobacterium avium subsp. paratuberculosis
gucguagaugaucugccccuug

SEQ ID NO: 22402 - RNA, 22 nt, Mycobacterium avium subsp. paratuberculosis
gucgucgagcacuucggugaag

SEQ ID NO: 22403 - RNA, 22 nt, Mycobacterium avium subsp. paratuberculosis
gucgucgaucgcggcggccagc

SEQ ID NO: 22404 - RNA, 22 nt, Mycobacterium avium subsp. paratuberculosis
gucgucggcgcccaagccggug

SEQ ID NO: 22405 - RNA, 22 nt, Mycobacterium avium subsp. paratuberculosis
gucguggucaccgucaccgacg

SEQ ID NO: 22406 - RNA, 22 nt, Mycobacterium avium subsp. paratuberculosis
gucucggcggccucgcgcagcu

SEQ ID NO: 22407 - RNA, 22 nt, Mycobacterium avium subsp. paratuberculosis
gucuuccaguuggcgucgaccu

SEQ ID NO: 22408 - RNA, 22 nt, Mycobacterium avium subsp. paratuberculosis
aaagauggacccgaucgagauc

SEQ ID NO: 22409 - RNA, 22 nt, Mycobacterium avium subsp. paratuberculosis
aacacagcgucgucgccgaccc

SEQ ID NO: 22410 - RNA, 22 nt, Mycobacterium avium subsp. paratuberculosis
aacacgcuggaggcgccgaugu

SEQ ID NO: 22411 - RNA, 22 nt, Mycobacterium avium subsp. paratuberculosis
aacccgacgcgcggaugcgggc

SEQ ID NO: 22412 - RNA, 22 nt, Mycobacterium avium subsp. paratuberculosis
aaccgcgcgaccaccgccgugg

SEQ ID NO: 22413 - RNA, 22 nt, Mycobacterium avium subsp. paratuberculosis
aaccugguggccuucggugagc

SEQ ID NO: 22414 - RNA, 22 nt, Mycobacterium avium subsp. paratuberculosis
aacgcagcaccuacguggugcu

SEQ ID NO: 22415 - RNA, 22 nt, Mycobacterium avium subsp. paratuberculosis
aacggcggcaucagcuucggcg

SEQ ID NO: 22416 - RNA, 22 nt, Mycobacterium avium subsp. paratuberculosis
aacgucgacucguggugcggau

SEQ ID NO: 22417 - RNA, 22 nt, Mycobacterium avium subsp. paratuberculosis
aacgucgacuuguugggcgaaa

SEQ ID NO: 22418 - RNA, 22 nt, Mycobacterium avium subsp. paratuberculosis
aacgugaaacuagcuucacguu

SEQ ID NO: 22419 - RNA, 22 nt, Mycobacterium avium subsp. paratuberculosis
aacgugcugcagcaugcgacgg

SEQ ID NO: 22420 - RNA, 22 nt, Mycobacterium avium subsp. paratuberculosis
aacucgcccgcaaccacgacgc

SEQ ID NO: 22421 - RNA, 22 nt, Mycobacterium avium subsp. paratuberculosis
aacucgggacucggcggaucgg

SEQ ID NO: 22422 - RNA, 22 nt, Mycobacterium avium subsp. paratuberculosis
aacucggugcggucgccgagcc

SEQ ID NO: 22423 - RNA, 22 nt, Mycobacterium avium subsp. paratuberculosis
aacugcggaaccgcggcgcggu

SEQ ID NO: 22424 - RNA, 22 nt, Mycobacterium avium subsp. paratuberculosis
aacuucgucggcauccacuucu

SEQ ID NO: 22425 - RNA, 22 nt, Mycobacterium avium subsp. paratuberculosis
aagccggugaagcagcccagca

SEQ ID NO: 22426 - RNA, 22 nt, Mycobacterium avium subsp. paratuberculosis
aagcugcgccgcgcgaagguga

SEQ ID NO: 22427 - RNA, 22 nt, Mycobacterium avium subsp. paratuberculosis
aaggaguugcggcgcaagcuga

SEQ ID NO: 22428 - RNA, 22 nt, Mycobacterium avium subsp. paratuberculosis
aaggcccaccaguugguaccgg

SEQ ID NO: 22429 - RNA, 22 nt, Mycobacterium avium subsp. paratuberculosis
aaggcgcugcuggcccaggacg

SEQ ID NO: 22430 - RNA, 18 nt, Mycobacterium avium subsp. paratuberculosis
agcccccacgcucggcgc

SEQ ID NO: 22431 - RNA, 22 nt, Mycobacterium avium subsp. paratuberculosis
agcccggcgaucugcuggcugc

SEQ ID NO: 22432 - RNA, 22 nt, Mycobacterium avium subsp. paratuberculosis
agccgcaacguuugauuuugug

SEQ ID NO: 22433 - RNA, 22 nt, Mycobacterium avium subsp. paratuberculosis
agccgcauuucguggucauggg

SEQ ID NO: 22434 - RNA, 22 nt, Mycobacterium avium subsp. paratuberculosis
agccgcgcuggacggugugccg

SEQ ID NO: 22435 - RNA, 22 nt, Mycobacterium avium subsp. paratuberculosis
agccgcuggcugcgcaccguca

SEQ ID NO: 22436 - RNA, 22 nt, Mycobacterium avium subsp. paratuberculosis
agcgacaccgaaucggcgcugc

SEQ ID NO: 22437 - RNA, 22 nt, Mycobacterium avium subsp. paratuberculosis
agcgcaccaccaacggcaucgg

SEQ ID NO: 22438 - RNA, 22 nt, Mycobacterium avium subsp. paratuberculosis
agcgccgagcaguacguggccg

SEQ ID NO: 22439 - RNA, 22 nt, Mycobacterium avium subsp. paratuberculosis
agcgccgcggucucggcgaugg

SEQ ID NO: 22440 - RNA, 22 nt, Mycobacterium avium subsp. paratuberculosis
agcgccuacgcccguggcgacg

SEQ ID NO: 22441 - RNA, 22 nt, Mycobacterium avium subsp. paratuberculosis
agcgcgaccgcggugagccggu

SEQ ID NO: 22442 - RNA, 22 nt, Mycobacterium avium subsp. paratuberculosis
agcgcgacgacggugcgggcca

SEQ ID NO: 22443 - RNA, 22 nt, Mycobacterium avium subsp. paratuberculosis
agcgcgacggcgaugguguuca

SEQ ID NO: 22444 - RNA, 22 nt, Mycobacterium avium subsp. paratuberculosis
agcgcugugcggcaacgcguuu

SEQ ID NO: 22445 - RNA, 22 nt, Mycobacterium avium subsp. paratuberculosis
agcggcgcgaucucggccacgg

SEQ ID NO: 22446 - RNA, 22 nt, Mycobacterium avium subsp. paratuberculosis
agcggcgcguagcuuucgaugu

SEQ ID NO: 22447 - RNA, 22 nt, Mycobacterium avium subsp. paratuberculosis
agcgggguuuuugauugcgcgg

SEQ ID NO: 22448 - RNA, 22 nt, Mycobacterium avium subsp. paratuberculosis
agcgugaagcuagcuucacgcu

SEQ ID NO: 22449 - RNA, 22 nt, Mycobacterium avium subsp. paratuberculosis
agcgugaaguuaaguucacgcu

SEQ ID NO: 22450 - RNA, 22 nt, Mycobacterium avium subsp. paratuberculosis
agcgugaaguuagcuucacggu

SEQ ID NO: 22451 - RNA, 22 nt, Mycobacterium avium subsp. paratuberculosis
agcgugcaccuaauuucacgcu

SEQ ID NO: 22452 - RNA, 19 nt, Mycobacterium avium subsp. paratuberculosis
agcgugcgcgacgaacgcc

SEQ ID NO: 22453 - RNA, 22 nt, Mycobacterium avium subsp. paratuberculosis
agcucgccgggugccgucggug

SEQ ID NO: 22454 - RNA, 22 nt, Mycobacterium avium subsp. paratuberculosis
agcucgucaaagagcaccgccu

SEQ ID NO: 22455 - RNA, 22 nt, Mycobacterium avium subsp. paratuberculosis
agcuggaucggcggcaggucga

SEQ ID NO: 22456 - RNA, 23 nt, Mycobacterium avium subsp. paratuberculosis
agcuggaugaucucggugaugag

SEQ ID NO: 22457 - RNA, 22 nt, Mycobacterium avium subsp. paratuberculosis
agcuggauguggugcacggucg

SEQ ID NO: 22458 - RNA, 22 nt, Mycobacterium avium subsp. paratuberculosis
auggcgaucggcgggcacggcc

SEQ ID NO: 22459 - RNA, 22 nt, Mycobacterium avium subsp. paratuberculosis
augggcuucggcuaucaccgcg

SEQ ID NO: 22460 - RNA, 22 nt, Mycobacterium avium subsp. paratuberculosis
auggucaggaugucgaccucga

SEQ ID NO: 22461 - RNA, 22 nt, Mycobacterium avium subsp. paratuberculosis
auggucgugcucggcggcuucg

SEQ ID NO: 22462 - RNA, 22 nt, Mycobacterium avium subsp. paratuberculosis
augguggugacaaggccucgac

SEQ ID NO: 22463 - RNA, 22 nt, Mycobacterium avium subsp. paratuberculosis
augguguugggcggcaagguga

SEQ ID NO: 22464 - RNA, 22 nt, Mycobacterium avium subsp. paratuberculosis
augguucgcgacgccagguauu

SEQ ID NO: 22465 - RNA, 22 nt, Mycobacterium avium subsp. paratuberculosis
auguccgacggauucauccacg

SEQ ID NO: 22466 - RNA, 22 nt, Mycobacterium avium subsp. paratuberculosis
augucgaucuugccgccggugc

SEQ ID NO: 22467 - RNA, 22 nt, Mycobacterium avium subsp. paratuberculosis
augucggcgucgcccacguagg

SEQ ID NO: 22468 - RNA, 22 nt, Mycobacterium avium subsp. paratuberculosis
augucggugagcgccuugaccg

SEQ ID NO: 22469 - RNA, 22 nt, Mycobacterium avium subsp. paratuberculosis
augugcagcgcgucggcgaguu

SEQ ID NO: 22470 - RNA, 22 nt, Mycobacterium avium subsp. paratuberculosis
auucccggguagcucuccggag

SEQ ID NO: 22471 - RNA, 22 nt, Mycobacterium avium subsp. paratuberculosis
auucgagcaccgugucgcgcac

SEQ ID NO: 22472 - RNA, 22 nt, Mycobacterium avium subsp. paratuberculosis
auuggccgaucgcacugccacg

SEQ ID NO: 22473 - RNA, 19 nt, Mycobacterium avium subsp. paratuberculosis
auuucgggacuguugcggg

SEQ ID NO: 22474 - RNA, 22 nt, Mycobacterium avium subsp. paratuberculosis
auuucgggucgagagcggcggc

SEQ ID NO: 22475 - RNA, 22 nt, Mycobacterium avium subsp. paratuberculosis
caacaacucgacguucggcguc

SEQ ID NO: 22476 - RNA, 22 nt, Mycobacterium avium subsp. paratuberculosis
caaccgggucgaggucuacgcg

SEQ ID NO: 22477 - RNA, 22 nt, Mycobacterium avium subsp. paratuberculosis
caacgugcugacgcugacggug

SEQ ID NO: 22478 - RNA, 22 nt, Mycobacterium avium subsp. paratuberculosis
caacuggucgacgacgucgucg

SEQ ID NO: 22479 - RNA, 20 nt, Mycobacterium avium subsp. paratuberculosis
caagggaguauucgggguuc

SEQ ID NO: 22480 - RNA, 23 nt, Mycobacterium avium subsp. paratuberculosis
caaggucuguacugagcggaugc

SEQ ID NO: 22481 - RNA, 22 nt, Mycobacterium avium subsp. paratuberculosis
caauuucuacgugaugcgcaac

SEQ ID NO: 22482 - RNA, 22 nt, Mycobacterium avium subsp. paratuberculosis
cacaacgugucagucaaccggg

SEQ ID NO: 22483 - RNA, 22 nt, Mycobacterium avium subsp. paratuberculosis
cacaccgacggcuucccgcgcg

SEQ ID NO: 22484 - RNA, 22 nt, Mycobacterium avium subsp. paratuberculosis
cacaucgaaaucggacugccca

SEQ ID NO: 22485 - RNA, 22 nt, Mycobacterium avium subsp. paratuberculosis
caccaacagguccgcgggccgc

SEQ ID NO: 22486 - RNA, 22 nt, Mycobacterium avium subsp. paratuberculosis
caccaccgugauguuggugaaa

SEQ ID NO: 22487 - RNA, 22 nt, Mycobacterium avium subsp. paratuberculosis
caccagaucgacgccgcgccgg

SEQ ID NO: 22488 - RNA, 22 nt, Mycobacterium avium subsp. paratuberculosis
caccagcgggcugccgacgccg

SEQ ID NO: 22489 - RNA, 22 nt, Mycobacterium avium subsp. paratuberculosis
caccaggucggccugcuugccc

SEQ ID NO: 22490 - RNA, 22 nt, Mycobacterium avium subsp. paratuberculosis
caccaugaucagacccagcgug

SEQ ID NO: 22491 - RNA, 22 nt, Mycobacterium avium subsp. paratuberculosis
caccgccgucgaccugcggcgc

SEQ ID NO: 22492 - RNA, 22 nt, Mycobacterium avium subsp. paratuberculosis
caccgcgagcagacgcaaaagc

SEQ ID NO: 22493 - RNA, 22 nt, Mycobacterium avium subsp. paratuberculosis
caccgcgaucgcggggucaccg

SEQ ID NO: 22494 - RNA, 22 nt, Mycobacterium avium subsp. paratuberculosis
caccgcgcacgaggccggcugg

SEQ ID NO: 22495 - RNA, 22 nt, Mycobacterium avium subsp. paratuberculosis
caccguguuacgccgggaacgc

SEQ ID NO: 22496 - RNA, 18 nt, Mycobacterium avium subsp. paratuberculosis
caccuccagcccggcgau

SEQ ID NO: 22497 - RNA, 22 nt, Mycobacterium avium subsp. paratuberculosis
caccuccugcaucaggucgaac

SEQ ID NO: 22498 - RNA, 22 nt, Mycobacterium avium subsp. paratuberculosis
caccugcagggcuggacgcugg

SEQ ID NO: 22499 - RNA, 22 nt, Mycobacterium avium subsp. paratuberculosis
caccuguaccccgaucugccca

SEQ ID NO: 22500 - RNA, 22 nt, Mycobacterium avium subsp. paratuberculosis
cacgacuugagcgcagcgacgu

SEQ ID NO: 22501 - RNA, 22 nt, Mycobacterium avium subsp. paratuberculosis
cggcugcggguccgcccgggcc

SEQ ID NO: 22502 - RNA, 22 nt, Mycobacterium avium subsp. paratuberculosis
cggcugguggauucggcucgag

SEQ ID NO: 22503 - RNA, 22 nt, Mycobacterium avium subsp. paratuberculosis
cgggaacuucuugaucgccugc

SEQ ID NO: 22504 - RNA, 22 nt, Mycobacterium avium subsp. paratuberculosis
cgggagagcugaaggccggaau

SEQ ID NO: 22505 - RNA, 22 nt, Mycobacterium avium subsp. paratuberculosis
cgggauggugaccgcggagaug

SEQ ID NO: 22506 - RNA, 22 nt, Mycobacterium avium subsp. paratuberculosis
cgggccaaccggcuggcccggc

SEQ ID NO: 22507 - RNA, 22 nt, Mycobacterium avium subsp. paratuberculosis
cgggccgacgaucacgaugucg

SEQ ID NO: 22508 - RNA, 22 nt, Mycobacterium avium subsp. paratuberculosis
cgggcuggccguauuggccggg

SEQ ID NO: 22509 - RNA, 22 nt, Mycobacterium avium subsp. paratuberculosis
cgggcuggguuaagcgcaucag

SEQ ID NO: 22510 - RNA, 22 nt, Mycobacterium avium subsp. paratuberculosis
cggggcgaagauccgcaaggcg

SEQ ID NO: 22511 - RNA, 23 nt, Mycobacterium avium subsp. paratuberculosis
cgggggcuuuugcgucugcucgc

SEQ ID NO: 22512 - RNA, 22 nt, Mycobacterium avium subsp. paratuberculosis
cggggguugagcccggccgagg

SEQ ID NO: 22513 - RNA, 22 nt, Mycobacterium avium subsp. paratuberculosis
cggggucggccagcaccaccca

SEQ ID NO: 22514 - RNA, 22 nt, Mycobacterium avium subsp. paratuberculosis
cgggugugcgggaccgccaucg

SEQ ID NO: 22515 - RNA, 21 nt, Mycobacterium avium subsp. paratuberculosis
cggguugacccagcccggcgg

SEQ ID NO: 22516 - RNA, 22 nt, Mycobacterium avium subsp. paratuberculosis
cggucacgcuggcgugacgcuc

SEQ ID NO: 22517 - RNA, 22 nt, Mycobacterium avium subsp. paratuberculosis
cggucgaagccacgucgacgcg

SEQ ID NO: 22518 - RNA, 20 nt, Mycobacterium avium subsp. paratuberculosis
cggucuggcggaccugggug

SEQ ID NO: 22519 - RNA, 22 nt, Mycobacterium avium subsp. paratuberculosis
cggugacagccucgucgcgacc

SEQ ID NO: 22520 - RNA, 22 nt, Mycobacterium avium subsp. paratuberculosis
cggugcgcagcgcaugcgacac

SEQ ID NO: 22521 - RNA, 21 nt, Mycobacterium avium subsp. paratuberculosis
cggugcucagccggugcccgc

SEQ ID NO: 22522 - RNA, 21 nt, Mycobacterium avium subsp. paratuberculosis
cgguggucaugagccgcuugu

SEQ ID NO: 22523 - RNA, 22 nt, Mycobacterium avium subsp. paratuberculosis
cgccuacccgccgccgagcuuc

SEQ ID NO: 22524 - RNA, 23 nt, Mycobacterium avium subsp. paratuberculosis
cgccucgagaucgcgcccgaacg

SEQ ID NO: 22525 - RNA, 22 nt, Mycobacterium avium subsp. paratuberculosis
cgccugcucgcugggcaugcug

SEQ ID NO: 22526 - RNA, 22 nt, Mycobacterium avium subsp. paratuberculosis
cgccuuggugagcaggaaggug

SEQ ID NO: 22527 - RNA, 22 nt, Mycobacterium avium subsp. paratuberculosis
cgcgaaagugcuacugccgacg

SEQ ID NO: 22528 - RNA, 22 nt, Mycobacterium avium subsp. paratuberculosis
cgcgagcagacgcaaaagcucc

SEQ ID NO: 22529 - RNA, 22 nt, Mycobacterium avium subsp. paratuberculosis
cgcgagccgucgguggugauga

SEQ ID NO: 22530 - RNA, 22 nt, Mycobacterium avium subsp. paratuberculosis
cgcgaggugucgcuguuccgcg

SEQ ID NO: 22531 - RNA, 22 nt, Mycobacterium avium subsp. paratuberculosis
cgcgaucaggccggccaccagg

SEQ ID NO: 22532 - RNA, 22 nt, Mycobacterium avium subsp. paratuberculosis
cgcgaucgggagccggacuggg

SEQ ID NO: 22533 - RNA, 22 nt, Mycobacterium avium subsp. paratuberculosis
cgcgaugagggaggccaccgcg

SEQ ID NO: 22534 - RNA, 22 nt, Mycobacterium avium subsp. paratuberculosis
cgcgauggcgaugaucagguga

SEQ ID NO: 22535 - RNA, 22 nt, Mycobacterium avium subsp. paratuberculosis
cgcgccggugaucguguugucc

SEQ ID NO: 22536 - RNA, 22 nt, Mycobacterium avium subsp. paratuberculosis
cgcgccggugcugguggucggc

SEQ ID NO: 22537 - RNA, 22 nt, Mycobacterium avium subsp. paratuberculosis
cgcgccggugguggcgguggcc

SEQ ID NO: 22538 - RNA, 22 nt, Mycobacterium avium subsp. paratuberculosis
cgcgcgcucgagcuuggaucgu

SEQ ID NO: 22539 - RNA, 22 nt, Mycobacterium avium subsp. paratuberculosis
cgcgcggugugggugaccgcgg

SEQ ID NO: 22540 - RNA, 22 nt, Mycobacterium avium subsp. paratuberculosis
cgcgcucugggauaucgccaau

SEQ ID NO: 22541 - RNA, 22 nt, Mycobacterium avium subsp. paratuberculosis
cgcgcugggcgaugucgugggu

SEQ ID NO: 22542 - RNA, 22 nt, Mycobacterium avium subsp. paratuberculosis
cgcgcuggugcggccgucguug

SEQ ID NO: 22543 - RNA, 22 nt, Mycobacterium avium subsp. paratuberculosis
cgcgcuggugucggucguggcg

SEQ ID NO: 22544 - RNA, 22 nt, Mycobacterium avium subsp. paratuberculosis
cgcggcaagcacgugcggaucg

SEQ ID NO: 22545 - RNA, 22 nt, Mycobacterium avium subsp. paratuberculosis
cgcggccagccgcugaucgggg

SEQ ID NO: 22546 - RNA, 22 nt, Mycobacterium avium subsp. paratuberculosis
cgcggcgaugacguugaucacc

SEQ ID NO: 22547 - RNA, 22 nt, Mycobacterium avium subsp. paratuberculosis
cgcggcugaaguuccuggucaa

SEQ ID NO: 22548 - RNA, 22 nt, Mycobacterium avium subsp. paratuberculosis
cgcggcugcuggucgaguacug

SEQ ID NO: 22549 - RNA, 22 nt, Mycobacterium avium subsp. paratuberculosis
cgcggcuuucaggccgaauggc

SEQ ID NO: 22550 - RNA, 22 nt, Mycobacterium avium subsp. paratuberculosis
cgcggugaugcccagcucggcg

SEQ ID NO: 22551 - RNA, 22 nt, Mycobacterium avium subsp. paratuberculosis
cgcguucgaaagugacgucgug

SEQ ID NO: 22552 - RNA, 22 nt, Mycobacterium avium subsp. paratuberculosis
cgcuacgugacggggguggcca

SEQ ID NO: 22553 - RNA, 22 nt, Mycobacterium avium subsp. paratuberculosis
cgcucggccagggccgggugga

SEQ ID NO: 22554 - RNA, 22 nt, Mycobacterium avium subsp. paratuberculosis
cgcucgggugugccugcagcga

SEQ ID NO: 22555 - RNA, 22 nt, Mycobacterium avium subsp. paratuberculosis
cgcucguugcgaaggggcuggg

SEQ ID NO: 22556 - RNA, 22 nt, Mycobacterium avium subsp. paratuberculosis
cgcugaugccguccuugucgcg

SEQ ID NO: 22557 - RNA, 22 nt, Mycobacterium avium subsp. paratuberculosis
cgcugccuggaaugcggcaccu

SEQ ID NO: 22558 - RNA, 22 nt, Mycobacterium avium subsp. paratuberculosis
cgcugguugucgacgcugcagg

SEQ ID NO: 22559 - RNA, 22 nt, Mycobacterium avium subsp. paratuberculosis
cgcuguacuucgcugcugccgc

SEQ ID NO: 22560 - RNA, 22 nt, Mycobacterium avium subsp. paratuberculosis
cggaccuggugguggucgugcc

SEQ ID NO: 22561 - RNA, 22 nt, Mycobacterium avium subsp. paratuberculosis
cggacgaaguccucggcguucu

SEQ ID NO: 22562 - RNA, 22 nt, Mycobacterium avium subsp. paratuberculosis
cggacgccucggccagguugag

SEQ ID NO: 22563 - RNA, 22 nt, Mycobacterium avium subsp. paratuberculosis
cggacggccggcaccgccguca

SEQ ID NO: 22564 - RNA, 22 nt, Mycobacterium avium subsp. paratuberculosis
cggagcuguucgccggggucac

SEQ ID NO: 22565 - RNA, 22 nt, Mycobacterium avium subsp. paratuberculosis
cggaugcuccggaggcgcugug

SEQ ID NO: 22566 - RNA, 22 nt, Mycobacterium avium subsp. paratuberculosis
cggcaccgcgcucggcuggcug

SEQ ID NO: 22567 - RNA, 19 nt, Mycobacterium avium subsp. paratuberculosis
cggcagucgggaagguguc

SEQ ID NO: 22568 - RNA, 22 nt, Mycobacterium avium subsp. paratuberculosis
cggccaccgacaccucgaacaa

SEQ ID NO: 22569 - RNA, 22 nt, Mycobacterium avium subsp. paratuberculosis
cggccagcagcgcgugggaguu

SEQ ID NO: 22570 - RNA, 22 nt, Mycobacterium avium subsp. paratuberculosis
cggccaucuggucgcucagcag

SEQ ID NO: 22571 - RNA, 22 nt, Mycobacterium avium subsp. paratuberculosis
cggcccaacaacucgacguugg

SEQ ID NO: 22572 - RNA, 22 nt, Mycobacterium avium subsp. paratuberculosis
cggccccggccagcacacgccg

SEQ ID NO: 22573 - RNA, 22 nt, Mycobacterium avium subsp. paratuberculosis
cggcccgguauccgcggucacg

SEQ ID NO: 22574 - RNA, 22 nt, Mycobacterium avium subsp. paratuberculosis
cggccgaaauagaugauguuca

SEQ ID NO: 22575 - RNA, 22 nt, Mycobacterium avium subsp. paratuberculosis
cggccgaagccgagcaccgccc

SEQ ID NO: 22576 - RNA, 22 nt, Mycobacterium avium subsp. paratuberculosis
cggccgccuucaccugaugcuc

SEQ ID NO: 22577 - RNA, 22 nt, Mycobacterium avium subsp. paratuberculosis
cggccgcgacuggucggcggug

SEQ ID NO: 22578 - RNA, 22 nt, Mycobacterium avium subsp. paratuberculosis
cggccgucgccguagagcaguc

SEQ ID NO: 22579 - RNA, 22 nt, Mycobacterium avium subsp. paratuberculosis
cggccuggugacggaagugguu

SEQ ID NO: 22580 - RNA, 22 nt, Mycobacterium avium subsp. paratuberculosis
cggcgagguugcgcaggaacgc

SEQ ID NO: 22581 - RNA, 22 nt, Mycobacterium avium subsp. paratuberculosis
cggcgaucauguucaucaggug

SEQ ID NO: 22582 - RNA, 22 nt, Mycobacterium avium subsp. paratuberculosis
cggcgcgcaccagcauccaguc

SEQ ID NO: 22583 - RNA, 22 nt, Mycobacterium avium subsp. paratuberculosis
cggcgcgcgguuccucgucgac

SEQ ID NO: 22584 - RNA, 21 nt, Mycobacterium avium subsp. paratuberculosis
cggcgcucgccgauguggugc

SEQ ID NO: 22585 - RNA, 22 nt, Mycobacterium avium subsp. paratuberculosis
cggcggcgaucaggagaaacgc

SEQ ID NO: 22586 - RNA, 20 nt, Mycobacterium avium subsp. paratuberculosis
cggcgggacagguacggcug

SEQ ID NO: 22587 - RNA, 22 nt, Mycobacterium avium subsp. paratuberculosis
cggcgggcuggacugggccguc

SEQ ID NO: 22588 - RNA, 22 nt, Mycobacterium avium subsp. paratuberculosis
cggcgguguucuucgagacgcc

SEQ ID NO: 22589 - RNA, 22 nt, Mycobacterium avium subsp. paratuberculosis
cggcgguugugauaggcgaugg

SEQ ID NO: 22590 - RNA, 22 nt, Mycobacterium avium subsp. paratuberculosis
cggcgucagcuucgcguucgug

SEQ ID NO: 22591 - RNA, 22 nt, Mycobacterium avium subsp. paratuberculosis
cggcgugucagccgggcccgug

SEQ ID NO: 22592 - RNA, 22 nt, Mycobacterium avium subsp. paratuberculosis
cggcgugugcuggccggggccg

SEQ ID NO: 22593 - RNA, 22 nt, Mycobacterium avium subsp. paratuberculosis
cggcuccgcgaucaccgccgac

SEQ ID NO: 22594 - RNA, 22 nt, Mycobacterium avium subsp. paratuberculosis
cacgcacugaccgggcugcagg

SEQ ID NO: 22595 - RNA, 22 nt, Mycobacterium avium subsp. paratuberculosis
cacggggcgcagcccgccugca

SEQ ID NO: 22596 - RNA, 22 nt, Mycobacterium avium subsp. paratuberculosis
cacgucgaggccgggccgcauc

SEQ ID NO: 22597 - RNA, 22 nt, Mycobacterium avium subsp. paratuberculosis
cacgugcgcgguggcggcgaga

SEQ ID NO: 22598 - RNA, 22 nt, Mycobacterium avium subsp. paratuberculosis
cacguugggaaucguuggcgug

SEQ ID NO: 22599 - RNA, 20 nt, Mycobacterium avium subsp. paratuberculosis
cacucaccucggagguccuc

SEQ ID NO: 22600 - RNA, 22 nt, Mycobacterium avium subsp. paratuberculosis
cacucgccggaucagcauccgg

SEQ ID NO: 22601 - RNA, 22 nt, Mycobacterium avium subsp. paratuberculosis
cacucgcgaccagugagugcua

SEQ ID NO: 22602 - RNA, 22 nt, Mycobacterium avium subsp. paratuberculosis
cagacgcaaaggcaccgcuuuu

SEQ ID NO: 22603 - RNA, 22 nt, Mycobacterium avium subsp. paratuberculosis
cagauggacaagccggacgugg

SEQ ID NO: 22604 - RNA, 22 nt, Mycobacterium avium subsp. paratuberculosis
cagcagcaugcggcaccacuug

SEQ ID NO: 22605 - RNA, 22 nt, Mycobacterium avium subsp. paratuberculosis
cagcaggagcuucccccgggcg

SEQ ID NO: 22606 - RNA, 22 nt, Mycobacterium avium subsp. paratuberculosis
cagcaugcccucggccgacccg

SEQ ID NO: 22607 - RNA, 22 nt, Mycobacterium avium subsp. paratuberculosis
cagcaugucgaucgaccagguc

SEQ ID NO: 22608 - RNA, 22 nt, Mycobacterium avium subsp. paratuberculosis
cagccgauuggugccgaccacc

SEQ ID NO: 22609 - RNA, 22 nt, Mycobacterium avium subsp. paratuberculosis
cagccgccucgacgacgaagcc

SEQ ID NO: 22610 - RNA, 22 nt, Mycobacterium avium subsp. paratuberculosis
cagccgguaggugacgcugcug

SEQ ID NO: 22611 - RNA, 22 nt, Mycobacterium avium subsp. paratuberculosis
cagccggucgaguucggugacg

SEQ ID NO: 22612 - RNA, 22 nt, Mycobacterium avium subsp. paratuberculosis
cagcgcgucgagcaggucgcug

SEQ ID NO: 22613 - RNA, 22 nt, Mycobacterium avium subsp. paratuberculosis
cagcgggucggcgccgauccgc

SEQ ID NO: 22614 - RNA, 22 nt, Mycobacterium avium subsp. paratuberculosis
cagcgucgcggacggcaccgac

SEQ ID NO: 22615 - RNA, 22 nt, Mycobacterium avium subsp. paratuberculosis
cagcgucuuggcccccugcucg

SEQ ID NO: 22616 - RNA, 22 nt, Mycobacterium avium subsp. paratuberculosis
cagcguguugaccgaggagcga

SEQ ID NO: 22617 - RNA, 22 nt, Mycobacterium avium subsp. paratuberculosis
cagcugaucgccucgggcuaca

SEQ ID NO: 22618 - RNA, 22 nt, Mycobacterium avium subsp. paratuberculosis
caggccgccaucgggcccgggc

SEQ ID NO: 22619 - RNA, 22 nt, Mycobacterium avium subsp. paratuberculosis
caggccguugacgggggccgcg

SEQ ID NO: 22620 - RNA, 22 nt, Mycobacterium avium subsp. paratuberculosis
caggcguagugauaccggaccu

SEQ ID NO: 22621 - RNA, 22 nt, Mycobacterium avium subsp. paratuberculosis
cagggccagcacgucacgcgcg

SEQ ID NO: 22622 - RNA, 22 nt, Mycobacterium avium subsp. paratuberculosis
cagggguaguugcgcgcgccgc

SEQ ID NO: 22623 - RNA, 22 nt, Mycobacterium avium subsp. paratuberculosis
caggucgccgaugcgguagccg

SEQ ID NO: 22624 - RNA, 22 nt, Mycobacterium avium subsp. paratuberculosis
caggucuuccagaaggcggucg

SEQ ID NO: 22625 - RNA, 22 nt, Mycobacterium avium subsp. paratuberculosis
cagucuggacgagaucgcggag

SEQ ID NO: 22626 - RNA, 22 nt, Mycobacterium avium subsp. paratuberculosis
cagugguggaaguucgccggug

SEQ ID NO: 22627 - RNA, 22 nt, Mycobacterium avium subsp. paratuberculosis
caguguguacucacggcgggau

SEQ ID NO: 22628 - RNA, 22 nt, Mycobacterium avium subsp. paratuberculosis
caguuccucgucgcagucggcg

SEQ ID NO: 22629 - RNA, 22 nt, Mycobacterium avium subsp. paratuberculosis
caucaccuacggcauucagccc

SEQ ID NO: 22630 - RNA, 22 nt, Mycobacterium avium subsp. paratuberculosis
caucaucugcggauuggagccc

SEQ ID NO: 22631 - RNA, 23 nt, Mycobacterium avium subsp. paratuberculosis
caucaugaaggccggugccgguu

SEQ ID NO: 22632 - RNA, 22 nt, Mycobacterium avium subsp. paratuberculosis
cauccgaccaucccggccgcuc

SEQ ID NO: 22633 - RNA, 21 nt, Mycobacterium avium subsp. paratuberculosis
cauccggucgacgguggucgg

SEQ ID NO: 22634 - RNA, 22 nt, Mycobacterium avium subsp. paratuberculosis
caucuggccaccgggaugcgga

SEQ ID NO: 22635 - RNA, 22 nt, Mycobacterium avium subsp. paratuberculosis
caugaggugacguucgaauccg

SEQ ID NO: 22636 - RNA, 22 nt, Mycobacterium avium subsp. paratuberculosis
caugaucugcgagcgguucacc

SEQ ID NO: 22637 - RNA, 22 nt, Mycobacterium avium subsp. paratuberculosis
caugcgcgccacuccggccgca

SEQ ID NO: 22638 - RNA, 18 nt, Mycobacterium avium subsp. paratuberculosis
caugcgcugcacggccac

SEQ ID NO: 22639 - RNA, 22 nt, Mycobacterium avium subsp. paratuberculosis
caugucguggugcugcggcagc

SEQ ID NO: 22640 - RNA, 22 nt, Mycobacterium avium subsp. paratuberculosis
cauguugucgguguugaugccg

SEQ ID NO: 22641 - RNA, 22 nt, Mycobacterium avium subsp. paratuberculosis
ccaacaacucgacguucggcgg

SEQ ID NO: 22642 - RNA, 20 nt, Mycobacterium avium subsp. paratuberculosis
ccaacaagucgacguucggc

SEQ ID NO: 22643 - RNA, 22 nt, Mycobacterium avium subsp. paratuberculosis
ccacaccgugaccgcggcggga

SEQ ID NO: 22644 - RNA, 22 nt, Mycobacterium avium subsp. paratuberculosis
ccaccgcuucaucugcaggaag

SEQ ID NO: 22645 - RNA, 22 nt, Mycobacterium avium subsp. paratuberculosis
ccacgacuggucggcgaccgag

SEQ ID NO: 22646 - RNA, 22 nt, Mycobacterium avium subsp. paratuberculosis
ccacgccggcgugacgcuggag

SEQ ID NO: 22647 - RNA, 22 nt, Mycobacterium avium subsp. paratuberculosis
ccacgcuggcgugacgcucggc

SEQ ID NO: 22648 - RNA, 22 nt, Mycobacterium avium subsp. paratuberculosis
ccacgucguggaugucgggcac

SEQ ID NO: 22649 - RNA, 22 nt, Mycobacterium avium subsp. paratuberculosis
ccagcacgaucaggucggccag

SEQ ID NO: 22650 - RNA, 22 nt, Mycobacterium avium subsp. paratuberculosis
ccagcagacgcaaaagcccccg

SEQ ID NO: 22651 - RNA, 22 nt, Mycobacterium avium subsp. paratuberculosis
ccagcgcgguggcgcccagcgu

SEQ ID NO: 22652 - RNA, 20 nt, Mycobacterium avium subsp. paratuberculosis
ccagcgcgucgacgacguug

SEQ ID NO: 22653 - RNA, 22 nt, Mycobacterium avium subsp. paratuberculosis
ccagcggguuucgccgcccgcu

SEQ ID NO: 22654 - RNA, 22 nt, Mycobacterium avium subsp. paratuberculosis
ccagggugucggcgagccgguc

SEQ ID NO: 22655 - RNA, 22 nt, Mycobacterium avium subsp. paratuberculosis
ccagguggccguaauggauggg

SEQ ID NO: 22656 - RNA, 22 nt, Mycobacterium avium subsp. paratuberculosis
ccaguucgacggcgucgacgcc

SEQ ID NO: 22657 - RNA, 22 nt, Mycobacterium avium subsp. paratuberculosis
ccaucgacgcggugcugccgau

SEQ ID NO: 22658 - RNA, 22 nt, Mycobacterium avium subsp. paratuberculosis
ccaugguggcguccaggaugcg

SEQ ID NO: 22659 - RNA, 22 nt, Mycobacterium avium subsp. paratuberculosis
cccagcacguccacggcggcau

SEQ ID NO: 22660 - RNA, 22 nt, Mycobacterium avium subsp. paratuberculosis
cccagcucguugccggcggcca

SEQ ID NO: 22661 - RNA, 22 nt, Mycobacterium avium subsp. paratuberculosis
cccaggcuggccaggaugccca

SEQ ID NO: 22662 - RNA, 22 nt, Mycobacterium avium subsp. paratuberculosis
ccccgacgccgugcuggccacc

SEQ ID NO: 22663 - RNA, 22 nt, Mycobacterium avium subsp. paratuberculosis
ccccggcguccacgccguguug

SEQ ID NO: 22664 - RNA, 22 nt, Mycobacterium avium subsp. paratuberculosis
cccgaugcgccguccuggccga

SEQ ID NO: 22665 - RNA, 22 nt, Mycobacterium avium subsp. paratuberculosis
gacggugucggcguuggcgguc

SEQ ID NO: 22666 - RNA, 22 nt, Mycobacterium avium subsp. paratuberculosis
gacgucggcguccuggcggcga

SEQ ID NO: 22667 - RNA, 22 nt, Mycobacterium avium subsp. paratuberculosis
gacguucgacggagagcugcug

SEQ ID NO: 22668 - RNA, 22 nt, Mycobacterium avium subsp. paratuberculosis
gacguugagcgcgaugugggcg

SEQ ID NO: 22669 - RNA, 22 nt, Mycobacterium avium subsp. paratuberculosis
gagaagccgaucaccaggauca

SEQ ID NO: 22670 - RNA, 22 nt, Mycobacterium avium subsp. paratuberculosis
gagacggucggggugggccagu

SEQ ID NO: 22671 - RNA, 22 nt, Mycobacterium avium subsp. paratuberculosis
gagcaugugcugucccuggucg

SEQ ID NO: 22672 - RNA, 18 nt, Mycobacterium avium subsp. paratuberculosis
gagccagcugcugccgau

SEQ ID NO: 22673 - RNA, 22 nt, Mycobacterium avium subsp. paratuberculosis
gagcccaucgacgagaucucgg

SEQ ID NO: 22674 - RNA, 22 nt, Mycobacterium avium subsp. paratuberculosis
gagccggcuucggcggccggcu

SEQ ID NO: 22675 - RNA, 21 nt, Mycobacterium avium subsp. paratuberculosis
gagccgguagaccuggcuggc

SEQ ID NO: 22676 - RNA, 22 nt, Mycobacterium avium subsp. paratuberculosis
gagcgggcguccucggcgguca

SEQ ID NO: 22677 - RNA, 22 nt, Mycobacterium avium subsp. paratuberculosis
gagcggguggaacaucagcggc

SEQ ID NO: 22678 - RNA, 22 nt, Mycobacterium avium subsp. paratuberculosis
gagcgugcaaccacugcgaaaa

SEQ ID NO: 22679 - RNA, 22 nt, Mycobacterium avium subsp. paratuberculosis
gagcgugcacugguagcgaaga

SEQ ID NO: 22680 - RNA, 22 nt, Mycobacterium avium subsp. paratuberculosis
gagcgugcagugguugcgaaaa

SEQ ID NO: 22681 - RNA, 22 nt, Mycobacterium avium subsp. paratuberculosis
gagcgugggggguaugcacgau

SEQ ID NO: 22682 - RNA, 22 nt, Mycobacterium avium subsp. paratuberculosis
gagcucacccggcucgccgugc

SEQ ID NO: 22683 - RNA, 22 nt, Mycobacterium avium subsp. paratuberculosis
gagcuggaucucgcgggugccc

SEQ ID NO: 22684 - RNA, 22 nt, Mycobacterium avium subsp. paratuberculosis
gccacgcuggcgugacgcucgg

SEQ ID NO: 22685 - RNA, 22 nt, Mycobacterium avium subsp. paratuberculosis
gccagcacccgcaacagcuguu

SEQ ID NO: 22686 - RNA, 22 nt, Mycobacterium avium subsp. paratuberculosis
gccagcauccgcagucuggucg

SEQ ID NO: 22687 - RNA, 22 nt, Mycobacterium avium subsp. paratuberculosis
gccagccacccggugacgucga

SEQ ID NO: 22688 - RNA, 22 nt, Mycobacterium avium subsp. paratuberculosis
gccaggcaucgucgggccgccc

SEQ ID NO: 22689 - RNA, 22 nt, Mycobacterium avium subsp. paratuberculosis
gccauuuucccgagucccggca

SEQ ID NO: 22690 - RNA, 22 nt, Mycobacterium avium subsp. paratuberculosis
gcccaacaacucgacgcuggcc

SEQ ID NO: 22691 - RNA, 22 nt, Mycobacterium avium subsp. paratuberculosis
gcccaacguggacuuguugggc

SEQ ID NO: 22692 - RNA, 22 nt, Mycobacterium avium subsp. paratuberculosis
gcccgccgagggcgacgauguu

SEQ ID NO: 22693 - RNA, 22 nt, Mycobacterium avium subsp. paratuberculosis
gcccgcgacgacggugucggcg

SEQ ID NO: 22694 - RNA, 22 nt, Mycobacterium avium subsp. paratuberculosis
gcccggaggguauucgugugcu

SEQ ID NO: 22695 - RNA, 22 nt, Mycobacterium avium subsp. paratuberculosis
gcccggccuggucacgcuggcg

SEQ ID NO: 22696 - RNA, 22 nt, Mycobacterium avium subsp. paratuberculosis
gcccggcuggguguugcggugc

SEQ ID NO: 22697 - RNA, 22 nt, Mycobacterium avium subsp. paratuberculosis
gcccggcugucggcggcggccc

SEQ ID NO: 22698 - RNA, 22 nt, Mycobacterium avium subsp. paratuberculosis
cuggucauggccugguuggucu

SEQ ID NO: 22699 - RNA, 22 nt, Mycobacterium avium subsp. paratuberculosis
cuggugcacggcgucgaucugg

SEQ ID NO: 22700 - RNA, 22 nt, Mycobacterium avium subsp. paratuberculosis
cugucgccggcgguguccaucg

SEQ ID NO: 22701 - RNA, 22 nt, Mycobacterium avium subsp. paratuberculosis
cugucgggcauguagagccggu

SEQ ID NO: 22702 - RNA, 22 nt, Mycobacterium avium subsp. paratuberculosis
cuguggcuggacgaacgccgcg

SEQ ID NO: 22703 - RNA, 22 nt, Mycobacterium avium subsp. paratuberculosis
cugugguugcuggcgcucaugc

SEQ ID NO: 22704 - RNA, 22 nt, Mycobacterium avium subsp. paratuberculosis
cuguucgaggaagccguccggg

SEQ ID NO: 22705 - RNA, 22 nt, Mycobacterium avium subsp. paratuberculosis
cuguucguggccgguuucuacg

SEQ ID NO: 22706 - RNA, 22 nt, Mycobacterium avium subsp. paratuberculosis
cuucgaugguggucagcgaccu

SEQ ID NO: 22707 - RNA, 22 nt, Mycobacterium avium subsp. paratuberculosis
cuucggugaguagaucgcggua

SEQ ID NO: 22708 - RNA, 19 nt, Mycobacterium avium subsp. paratuberculosis
cuucuuggacacccggcgc

SEQ ID NO: 22709 - RNA, 22 nt, Mycobacterium avium subsp. paratuberculosis
cuugggugccucggccuugggu

SEQ ID NO: 22710 - RNA, 22 nt, Mycobacterium avium subsp. paratuberculosis
cuugucggugacggucagcugg

SEQ ID NO: 22711 - RNA, 22 nt, Mycobacterium avium subsp. paratuberculosis
cuuucgguguugcaccagggcg

SEQ ID NO: 22712 - RNA, 22 nt, Mycobacterium avium subsp. paratuberculosis
gaaacgacccgacacccuggcc

SEQ ID NO: 22713 - RNA, 22 nt, Mycobacterium avium subsp. paratuberculosis
gaaagugcaaccagcgacgugu

SEQ ID NO: 22714 - RNA, 22 nt, Mycobacterium avium subsp. paratuberculosis
gaacaccgccgugccggccagc

SEQ ID NO: 22715 - RNA, 22 nt, Mycobacterium avium subsp. paratuberculosis
gaaccccgccgauuuccuggug

SEQ ID NO: 22716 - RNA, 22 nt, Mycobacterium avium subsp. paratuberculosis
gaaccggcggcccgacccgcag

SEQ ID NO: 22717 - RNA, 22 nt, Mycobacterium avium subsp. paratuberculosis
gaacgucacgccagcgugacac

SEQ ID NO: 22718 - RNA, 22 nt, Mycobacterium avium subsp. paratuberculosis
gaacgugcacccaccgcgagaa

SEQ ID NO: 22719 - RNA, 22 nt, Mycobacterium avium subsp. paratuberculosis
gacaaggucuacuccggggcgu

SEQ ID NO: 22720 - RNA, 22 nt, Mycobacterium avium subsp. paratuberculosis
gacacccacgacggcacggccc

SEQ ID NO: 22721 - RNA, 22 nt, Mycobacterium avium subsp. paratuberculosis
gacaccgcggugaccgcggcga

SEQ ID NO: 22722 - RNA, 22 nt, Mycobacterium avium subsp. paratuberculosis
gacacgguguugauagcguggu

SEQ ID NO: 22723 - RNA, 22 nt, Mycobacterium avium subsp. paratuberculosis
gacaucgcggccguucgccgug

SEQ ID NO: 22724 - RNA, 22 nt, Mycobacterium avium subsp. paratuberculosis
gaccagguuggucaccggcacc

SEQ ID NO: 22725 - RNA, 22 nt, Mycobacterium avium subsp. paratuberculosis
gaccaguuguuggacgagcuac

SEQ ID NO: 22726 - RNA, 22 nt, Mycobacterium avium subsp. paratuberculosis
gacccacugaccaggaggacag

SEQ ID NO: 22727 - RNA, 22 nt, Mycobacterium avium subsp. paratuberculosis
gacccgcagcaucggcugcugc

SEQ ID NO: 22728 - RNA, 22 nt, Mycobacterium avium subsp. paratuberculosis
gacccggucguggucgcauggc

SEQ ID NO: 22729 - RNA, 22 nt, Mycobacterium avium subsp. paratuberculosis
gaccgcgggcguaacgccgugg

SEQ ID NO: 22730 - RNA, 22 nt, Mycobacterium avium subsp. paratuberculosis
gaccgcguugugccgaccgacg

SEQ ID NO: 22731 - RNA, 22 nt, Mycobacterium avium subsp. paratuberculosis
gaccggcagccgggcgagccga

SEQ ID NO: 22732 - RNA, 22 nt, Mycobacterium avium subsp. paratuberculosis
gaccguaccguuuccauugccg

SEQ ID NO: 22733 - RNA, 22 nt, Mycobacterium avium subsp. paratuberculosis
gaccucuucggcggccgagcgg

SEQ ID NO: 22734 - RNA, 22 nt, Mycobacterium avium subsp. paratuberculosis
gaccugcagccggaugugcuga

SEQ ID NO: 22735 - RNA, 22 nt, Mycobacterium avium subsp. paratuberculosis
gaccugcucgacgggugggugg

SEQ ID NO: 22736 - RNA, 22 nt, Mycobacterium avium subsp. paratuberculosis
gaccuggugguggccgaggcgg

SEQ ID NO: 22737 - RNA, 22 nt, Mycobacterium avium subsp. paratuberculosis
gacgaggugauggagcggcugg

SEQ ID NO: 22738 - RNA, 22 nt, Mycobacterium avium subsp. paratuberculosis
gacgcccuugccagcuuuccgg

SEQ ID NO: 22739 - RNA, 22 nt, Mycobacterium avium subsp. paratuberculosis
gacgcgaugaaggacauggacg

SEQ ID NO: 22740 - RNA, 22 nt, Mycobacterium avium subsp. paratuberculosis
gacggccgcgagccgcacggug

SEQ ID NO: 22741 - RNA, 22 nt, Mycobacterium avium subsp. paratuberculosis
gacggcgacaccggguugccgc

SEQ ID NO: 22742 - RNA, 22 nt, Mycobacterium avium subsp. paratuberculosis
gacggcgacgccgaucgcugcu

SEQ ID NO: 22743 - RNA, 22 nt, Mycobacterium avium subsp. paratuberculosis
gacggcgccgcgucgguggugg

SEQ ID NO: 22744 - RNA, 22 nt, Mycobacterium avium subsp. paratuberculosis
gacggcggcagggucgaucagg

SEQ ID NO: 22745 - RNA, 22 nt, Mycobacterium avium subsp. paratuberculosis
gacggcuacccgagccgcggcu

SEQ ID NO: 22746 - RNA, 22 nt, Mycobacterium avium subsp. paratuberculosis
gacggcuggugcccguuucccg

SEQ ID NO: 22747 - RNA, 22 nt, Mycobacterium avium subsp. paratuberculosis
gacgggcggaccgucggcaaug

SEQ ID NO: 22748 - RNA, 22 nt, Mycobacterium avium subsp. paratuberculosis
gcgacgacggccgguaucgcgg

SEQ ID NO: 22749 - RNA, 22 nt, Mycobacterium avium subsp. paratuberculosis
gcgacgagauccccgaggacgg

SEQ ID NO: 22750 - RNA, 22 nt, Mycobacterium avium subsp. paratuberculosis
gcgacgucacccugcuguggcc

SEQ ID NO: 22751 - RNA, 22 nt, Mycobacterium avium subsp. paratuberculosis
gcgagaccuucgauggccggca

SEQ ID NO: 22752 - RNA, 22 nt, Mycobacterium avium subsp. paratuberculosis
gcgagcagacgcaaaagccccc

SEQ ID NO: 22753 - RNA, 22 nt, Mycobacterium avium subsp. paratuberculosis
gcgagcagacgcaaaagcuccc

SEQ ID NO: 22754 - RNA, 22 nt, Mycobacterium avium subsp. paratuberculosis
gcgagcagacgcgaaagcaccc

SEQ ID NO: 22755 - RNA, 22 nt, Mycobacterium avium subsp. paratuberculosis
gcgaucgcgcauuucaggucgc

SEQ ID NO: 22756 - RNA, 22 nt, Mycobacterium avium subsp. paratuberculosis
gcgaugaugucggcagguucgc

SEQ ID NO: 22757 - RNA, 22 nt, Mycobacterium avium subsp. paratuberculosis
gcgaugccggacagccgcgaca

SEQ ID NO: 22758 - RNA, 22 nt, Mycobacterium avium subsp. paratuberculosis
gcgauggucggcgagaucguau

SEQ ID NO: 22759 - RNA, 22 nt, Mycobacterium avium subsp. paratuberculosis
gcgauucugccagccggccgcg

SEQ ID NO: 22760 - RNA, 22 nt, Mycobacterium avium subsp. paratuberculosis
gcgauuucgacugaccgcgaac

SEQ ID NO: 22761 - RNA, 22 nt, Mycobacterium avium subsp. paratuberculosis
gcgcagcagaucaaaccgcaag

SEQ ID NO: 22762 - RNA, 22 nt, Mycobacterium avium subsp. paratuberculosis
gcgcaggccgguuuccuggucc

SEQ ID NO: 22763 - RNA, 22 nt, Mycobacterium avium subsp. paratuberculosis
gcgcaucaucuuccuggguucg

SEQ ID NO: 22764 - RNA, 22 nt, Mycobacterium avium subsp. paratuberculosis
gcgcaucuggaccgccucguag

SEQ ID NO: 22765 - RNA, 22 nt, Mycobacterium avium subsp. paratuberculosis
gcgccacggccagcaugcugga

SEQ ID NO: 22766 - RNA, 22 nt, Mycobacterium avium subsp. paratuberculosis
gcgccaggaacugccgguccgc

SEQ ID NO: 22767 - RNA, 21 nt, Mycobacterium avium subsp. paratuberculosis
gcgccccgaacgcuggauccg

SEQ ID NO: 22768 - RNA, 22 nt, Mycobacterium avium subsp. paratuberculosis
gcgcccuggacgccgcggacga

SEQ ID NO: 22769 - RNA, 22 nt, Mycobacterium avium subsp. paratuberculosis
gcgccgaauccagguccucgag

SEQ ID NO: 22770 - RNA, 22 nt, Mycobacterium avium subsp. paratuberculosis
gcgccgaccuggccggcgacgg

SEQ ID NO: 22771 - RNA, 22 nt, Mycobacterium avium subsp. paratuberculosis
gcgccgcugcaggcugcacucg

SEQ ID NO: 22772 - RNA, 22 nt, Mycobacterium avium subsp. paratuberculosis
gcgccggggcgaucgugguguc

SEQ ID NO: 22773 - RNA, 22 nt, Mycobacterium avium subsp. paratuberculosis
gcgccgucacgucgguuaccgu

SEQ ID NO: 22774 - RNA, 22 nt, Mycobacterium avium subsp. paratuberculosis
gcgccgucgggcaacgggugca

SEQ ID NO: 22775 - RNA, 22 nt, Mycobacterium avium subsp. paratuberculosis
gcgccuccggguugccgcugcu

SEQ ID NO: 22776 - RNA, 22 nt, Mycobacterium avium subsp. paratuberculosis
gcgcgagcagacgcaaaagccc

SEQ ID NO: 22777 - RNA, 22 nt, Mycobacterium avium subsp. paratuberculosis
gcgcgcccuggucaagcaccuc

SEQ ID NO: 22778 - RNA, 22 nt, Mycobacterium avium subsp. paratuberculosis
gcgcgcucagcagcaccugccc

SEQ ID NO: 22779 - RNA, 22 nt, Mycobacterium avium subsp. paratuberculosis
gcgcgcuugcccagcuugucgc

SEQ ID NO: 22780 - RNA, 22 nt, Mycobacterium avium subsp. paratuberculosis
gcgcggcaacccggugucgccg

SEQ ID NO: 22781 - RNA, 22 nt, Mycobacterium avium subsp. paratuberculosis
gcgcggccggucugcucgagca

SEQ ID NO: 22782 - RNA, 22 nt, Mycobacterium avium subsp. paratuberculosis
gcgcggccuaugucaccgucuu

SEQ ID NO: 22783 - RNA, 22 nt, Mycobacterium avium subsp. paratuberculosis
gcgcggcgucuacggcaucucg

SEQ ID NO: 22784 - RNA, 22 nt, Mycobacterium avium subsp. paratuberculosis
gcgcguaggcgauggcggccug

SEQ ID NO: 22785 - RNA, 22 nt, Mycobacterium avium subsp. paratuberculosis
gcgcgucguccucguuguggua

SEQ ID NO: 22786 - RNA, 22 nt, Mycobacterium avium subsp. paratuberculosis
gcgcguuggugcuggauugcuu

SEQ ID NO: 22787 - RNA, 22 nt, Mycobacterium avium subsp. paratuberculosis
gcgcuacccgcugccgucggcc

SEQ ID NO: 22788 - RNA, 22 nt, Mycobacterium avium subsp. paratuberculosis
gcgcucagcggcgccuggucgg

SEQ ID NO: 22789 - RNA, 22 nt, Mycobacterium avium subsp. paratuberculosis
gcgcucgggcugcuuggcggag

SEQ ID NO: 22790 - RNA, 22 nt, Mycobacterium avium subsp. paratuberculosis
gcgcugaaguuacucaccgaca

SEQ ID NO: 22791 - RNA, 22 nt, Mycobacterium avium subsp. paratuberculosis
gcgcugaaugcgcauggcccgc

SEQ ID NO: 22792 - RNA, 22 nt, Mycobacterium avium subsp. paratuberculosis
gcgcugaugcaggcgaccggca

SEQ ID NO: 22793 - RNA, 22 nt, Mycobacterium avium subsp. paratuberculosis
gcgcugcacgagcacauccugg

SEQ ID NO: 22794 - RNA, 22 nt, Mycobacterium avium subsp. paratuberculosis
gcgcugcuggugcuguucagcg

SEQ ID NO: 22795 - RNA, 22 nt, Mycobacterium avium subsp. paratuberculosis
gcgcuuccuuuccuguccugua

SEQ ID NO: 22796 - RNA, 22 nt, Mycobacterium avium subsp. paratuberculosis
gcgcuuguccuccuggcgcugg

SEQ ID NO: 22797 - RNA, 22 nt, Mycobacterium avium subsp. paratuberculosis
gcggaauccaacuacugccccu

SEQ ID NO: 22798 - RNA, 22 nt, Mycobacterium avium subsp. paratuberculosis
gcggcaguguggucgcauccgg

SEQ ID NO: 22799 - RNA, 22 nt, Mycobacterium avium subsp. paratuberculosis
gcggccacgagaccgaccggcu

SEQ ID NO: 22800 - RNA, 22 nt, Mycobacterium avium subsp. paratuberculosis
gcggccagcacccgaucgcgcu

SEQ ID NO: 22801 - RNA, 22 nt, Mycobacterium avium subsp. paratuberculosis
gcggcccgccucguaucagggc

SEQ ID NO: 22802 - RNA, 22 nt, Mycobacterium avium subsp. paratuberculosis
gcggccgggucgaagacgguca

SEQ ID NO: 22803 - RNA, 19 nt, Mycobacterium avium subsp. paratuberculosis
gcggccgggugcucggcgu

SEQ ID NO: 22804 - RNA, 22 nt, Mycobacterium avium subsp. paratuberculosis
gcggccggguucucggugaagg

SEQ ID NO: 22805 - RNA, 22 nt, Mycobacterium avium subsp. paratuberculosis
gcggcggguguucgucaucgcc

SEQ ID NO: 22806 - RNA, 22 nt, Mycobacterium avium subsp. paratuberculosis
gcggcggguucggcauccacgu

SEQ ID NO: 22807 - RNA, 22 nt, Mycobacterium avium subsp. paratuberculosis
gcggcguugacccgcuccacgu

SEQ ID NO: 22808 - RNA, 22 nt, Mycobacterium avium subsp. paratuberculosis
gcggcguugccgcgguucaccg

SEQ ID NO: 22809 - RNA, 22 nt, Mycobacterium avium subsp. paratuberculosis
gcgggacagccgcgaccagucg

SEQ ID NO: 22810 - RNA, 23 nt, Mycobacterium avium subsp. paratuberculosis
gcgggccggagcucagcgccccg

SEQ ID NO: 22811 - RNA, 22 nt, Mycobacterium avium subsp. paratuberculosis
gcgggucguaaucggcgagcag

SEQ ID NO: 22812 - RNA, 22 nt, Mycobacterium avium subsp. paratuberculosis
gcgggugccaguaguugggcug

SEQ ID NO: 22813 - RNA, 22 nt, Mycobacterium avium subsp. paratuberculosis
gcgggugcguuguugacguucc

SEQ ID NO: 22814 - RNA, 22 nt, Mycobacterium avium subsp. paratuberculosis
gcggucacaaugacuuccggag

SEQ ID NO: 22815 - RNA, 22 nt, Mycobacterium avium subsp. paratuberculosis
gcggucggguagugacgaaucu

SEQ ID NO: 22816 - RNA, 22 nt, Mycobacterium avium subsp. paratuberculosis
gcggucgucaccgccgccgccu

SEQ ID NO: 22817 - RNA, 22 nt, Mycobacterium avium subsp. paratuberculosis
gcggugagcgauccggcgucuc

SEQ ID NO: 22818 - RNA, 22 nt, Mycobacterium avium subsp. paratuberculosis
gcgguugggagcgcgcgguucu

SEQ ID NO: 22819 - RNA, 22 nt, Mycobacterium avium subsp. paratuberculosis
uaucgcggugagugcacgcucg

SEQ ID NO: 22820 - RNA, 22 nt, Mycobacterium avium subsp. paratuberculosis
ucaacggcccggccaccaccuc

SEQ ID NO: 22821 - RNA, 22 nt, Mycobacterium avium subsp. paratuberculosis
ucaaguucggcggcggaggccg

SEQ ID NO: 22822 - RNA, 22 nt, Mycobacterium avium subsp. paratuberculosis
ucaauuccgguggugugcugaa

SEQ ID NO: 22823 - RNA, 22 nt, Mycobacterium avium subsp. paratuberculosis
ucaccggagccgcugacccggc

SEQ ID NO: 22824 - RNA, 22 nt, Mycobacterium avium subsp. paratuberculosis
ucaccggaguuccccaucggag

SEQ ID NO: 22825 - RNA, 22 nt, Mycobacterium avium subsp. paratuberculosis
ucaccgugcuucucgagcugug

SEQ ID NO: 22826 - RNA, 22 nt, Mycobacterium avium subsp. paratuberculosis
ucaccugcugcaugggcgccga

SEQ ID NO: 22827 - RNA, 22 nt, Mycobacterium avium subsp. paratuberculosis
ucacgccgcggguggcgccgua

SEQ ID NO: 22828 - RNA, 22 nt, Mycobacterium avium subsp. paratuberculosis
ucacggugaugacggcgacgac

SEQ ID NO: 22829 - RNA, 21 nt, Mycobacterium avium subsp. paratuberculosis
ucgaugccgucgaacagcugc

SEQ ID NO: 22830 - RNA, 22 nt, Mycobacterium avium subsp. paratuberculosis
ucgauguugcggcgggucucgg

SEQ ID NO: 22831 - RNA, 22 nt, Mycobacterium avium subsp. paratuberculosis
ucgauguuguggucaacuucca

SEQ ID NO: 22832 - RNA, 23 nt, Mycobacterium avium subsp. paratuberculosis
ucgcaaccagcgcacguucggcg

SEQ ID NO: 22833 - RNA, 22 nt, Mycobacterium avium subsp. paratuberculosis
ucgcagucguauccggcggcgg

SEQ ID NO: 22834 - RNA, 18 nt, Mycobacterium avium subsp. paratuberculosis
ucgccaucaccagcgggc

SEQ ID NO: 22835 - RNA, 22 nt, Mycobacterium avium subsp. paratuberculosis
ucgcccaacgacgcggccagcg

SEQ ID NO: 22836 - RNA, 22 nt, Mycobacterium avium subsp. paratuberculosis
ucgcccacgcgccggccggacu

SEQ ID NO: 22837 - RNA, 22 nt, Mycobacterium avium subsp. paratuberculosis
ucgcccugacguuacggacgcg

SEQ ID NO: 22838 - RNA, 22 nt, Mycobacterium avium subsp. paratuberculosis
ucgccgaugucgucgguguggu

SEQ ID NO: 22839 - RNA, 22 nt, Mycobacterium avium subsp. paratuberculosis
ucgccgggaacguuggcgcucg

SEQ ID NO: 22840 - RNA, 22 nt, Mycobacterium avium subsp. paratuberculosis
ucgccguccacgccgugcagcg

SEQ ID NO: 22841 - RNA, 22 nt, Mycobacterium avium subsp. paratuberculosis
ucgccguccgggcugacguuga

SEQ ID NO: 22842 - RNA, 22 nt, Mycobacterium avium subsp. paratuberculosis
ucgccgucgucggugccggucu

SEQ ID NO: 22843 - RNA, 22 nt, Mycobacterium avium subsp. paratuberculosis
ucgccguggcgaucaucgugac

SEQ ID NO: 22844 - RNA, 22 nt, Mycobacterium avium subsp. paratuberculosis
ucgcgcaacuaguccacgcucg

SEQ ID NO: 22845 - RNA, 22 nt, Mycobacterium avium subsp. paratuberculosis
ucgcgcagguagcccucggccg

SEQ ID NO: 22846 - RNA, 22 nt, Mycobacterium avium subsp. paratuberculosis
ucgcgcaucagcaccuugcacg

SEQ ID NO: 22847 - RNA, 22 nt, Mycobacterium avium subsp. paratuberculosis
ucgcgccgugaggucgggugcg

SEQ ID NO: 22848 - RNA, 22 nt, Mycobacterium avium subsp. paratuberculosis
ucgcgcucagugcacgcucggc

SEQ ID NO: 22849 - RNA, 19 nt, Mycobacterium avium subsp. paratuberculosis
ucgcgcuggggugcucgau

SEQ ID NO: 22850 - RNA, 22 nt, Mycobacterium avium subsp. paratuberculosis
ucgcggccagugcacgcucggc

SEQ ID NO: 22851 - RNA, 22 nt, Mycobacterium avium subsp. paratuberculosis
ucgcggcccaccggcgcggugu

SEQ ID NO: 22852 - RNA, 22 nt, Mycobacterium avium subsp. paratuberculosis
ucgcgggcgccgaucugcucga

SEQ ID NO: 22853 - RNA, 22 nt, Mycobacterium avium subsp. paratuberculosis
ucgcggucgcccugaaggucgc

SEQ ID NO: 22854 - RNA, 22 nt, Mycobacterium avium subsp. paratuberculosis
ucgcgguucucgauguccuugc

SEQ ID NO: 22855 - RNA, 22 nt, Mycobacterium avium subsp. paratuberculosis
ucgcguggugccagcuguucag

SEQ ID NO: 22856 - RNA, 22 nt, Mycobacterium avium subsp. paratuberculosis
ucgcuaguugcacuuucgcggu

SEQ ID NO: 22857 - RNA, 22 nt, Mycobacterium avium subsp. paratuberculosis
ucgcucauggcuguucggcggu

SEQ ID NO: 22858 - RNA, 22 nt, Mycobacterium avium subsp. paratuberculosis
ucgcugcuggaccgcggcaugg

SEQ ID NO: 22859 - RNA, 22 nt, Mycobacterium avium subsp. paratuberculosis
ucgcugucgccaagucgucgau

SEQ ID NO: 22860 - RNA, 22 nt, Mycobacterium avium subsp. paratuberculosis
ucggcaccacguccaccauggc

SEQ ID NO: 22861 - RNA, 22 nt, Mycobacterium avium subsp. paratuberculosis
ucggcaggcuggcguaguugcc

SEQ ID NO: 22862 - RNA, 22 nt, Mycobacterium avium subsp. paratuberculosis
ucggcaugguggugguggucgc

SEQ ID NO: 22863 - RNA, 22 nt, Mycobacterium avium subsp. paratuberculosis
ucggccagauccuggagaccca

SEQ ID NO: 22864 - RNA, 22 nt, Mycobacterium avium subsp. paratuberculosis
ucggccggccaggauccggcgc

SEQ ID NO: 22865 - RNA, 22 nt, Mycobacterium avium subsp. paratuberculosis
ucggccggcccggucggccgca

SEQ ID NO: 22866 - RNA, 22 nt, Mycobacterium avium subsp. paratuberculosis
ucggccuuguccgucgugcuga

SEQ ID NO: 22867 - RNA, 20 nt, Mycobacterium avium subsp. paratuberculosis
ucggcgauggucuccggucc

SEQ ID NO: 22868 - RNA, 22 nt, Mycobacterium avium subsp. paratuberculosis
ucggcgcccgcaccaugugggc

SEQ ID NO: 22869 - RNA, 22 nt, Mycobacterium avium subsp. paratuberculosis
ucggcgccggaccgcuugugcg

SEQ ID NO: 22870 - RNA, 22 nt, Mycobacterium avium subsp. paratuberculosis
ucggcggacauggcggucgccc

SEQ ID NO: 22871 - RNA, 22 nt, Mycobacterium avium subsp. paratuberculosis
ucggcggcaucguggcccuggc

SEQ ID NO: 22872 - RNA, 22 nt, Mycobacterium avium subsp. paratuberculosis
ucggcggguucgucgucguugc

SEQ ID NO: 22873 - RNA, 22 nt, Mycobacterium avium subsp. paratuberculosis
ucggcggucgccaaugccgcug

SEQ ID NO: 22874 - RNA, 22 nt, Mycobacterium avium subsp. paratuberculosis
ucggcgugccgcuucuugaacu

SEQ ID NO: 22875 - RNA, 22 nt, Mycobacterium avium subsp. paratuberculosis
ucgggaaggcuggucggcucgu

SEQ ID NO: 22876 - RNA, 22 nt, Mycobacterium avium subsp. paratuberculosis
ucgggaucaugaacuucgcgaa

SEQ ID NO: 22877 - RNA, 22 nt, Mycobacterium avium subsp. paratuberculosis
ucgggcgccuucaccgucgucc

SEQ ID NO: 22878 - RNA, 22 nt, Mycobacterium avium subsp. paratuberculosis
ucgggcguagcacgacgggccc

SEQ ID NO: 22879 - RNA, 22 nt, Mycobacterium avium subsp. paratuberculosis
ucgggcuguccagccacgaccg

SEQ ID NO: 22880 - RNA, 22 nt, Mycobacterium avium subsp. paratuberculosis
ucggggaucgacgaauaccgcc

SEQ ID NO: 22881 - RNA, 22 nt, Mycobacterium avium subsp. paratuberculosis
ucggggugugcaggacgggauc

SEQ ID NO: 22882 - RNA, 22 nt, Mycobacterium avium subsp. paratuberculosis
ucggguuggcgaucaccucggc

SEQ ID NO: 22883 - RNA, 22 nt, Mycobacterium avium subsp. paratuberculosis
ucggucaacgugcccgucuugu

SEQ ID NO: 22884 - RNA, 22 nt, Mycobacterium avium subsp. paratuberculosis
ucggucaguuccggccuggugc

SEQ ID NO: 22885 - RNA, 22 nt, Mycobacterium avium subsp. paratuberculosis
ucggucgggccuccggcaggag

SEQ ID NO: 22886 - RNA, 21 nt, Mycobacterium avium subsp. paratuberculosis
ucggucucggcguacuggccc

SEQ ID NO: 22887 - RNA, 22 nt, Mycobacterium avium subsp. paratuberculosis
ucggugaccacccgcucgcgcg

SEQ ID NO: 22888 - RNA, 22 nt, Mycobacterium avium subsp. paratuberculosis
ucggugaucgcgcccugccggu

SEQ ID NO: 22889 - RNA, 22 nt, Mycobacterium avium subsp. paratuberculosis
ucggugucgccgucgcccagcu

SEQ ID NO: 22890 - RNA, 22 nt, Mycobacterium avium subsp. paratuberculosis
ucggugucgcggaguugucgga

SEQ ID NO: 22891 - RNA, 22 nt, Mycobacterium avium subsp. paratuberculosis
ucgucgaacgcgauuucggugg

SEQ ID NO: 22892 - RNA, 22 nt, Mycobacterium avium subsp. paratuberculosis
ucgucgacgguccgcugcgcuu

SEQ ID NO: 22893 - RNA, 22 nt, Mycobacterium avium subsp. paratuberculosis
ucgucgaggaugccgccgaaga

SEQ ID NO: 22894 - RNA, 22 nt, Mycobacterium avium subsp. paratuberculosis
ucgucgaucaccgugcgcaggu

SEQ ID NO: 22895 - RNA, 20 nt, Mycobacterium avium subsp. paratuberculosis
ucgucggucucggcgaugac

SEQ ID NO: 22896 - RNA, 22 nt, Mycobacterium avium subsp. paratuberculosis
ucgugcaccucaacgacccggg

SEQ ID NO: 22897 - RNA, 22 nt, Mycobacterium avium subsp. paratuberculosis
ucgugcaccucgacggcgcgca

SEQ ID NO: 22898 - RNA, 22 nt, Mycobacterium avium subsp. paratuberculosis
ucgugcgguggucugcggucgu

SEQ ID NO: 22899 - RNA, 22 nt, Mycobacterium avium subsp. paratuberculosis
ucgugguagcuugcgcggcagc

SEQ ID NO: 22900 - RNA, 22 nt, Mycobacterium avium subsp. paratuberculosis
ucguggucggcuucaccgaauc

SEQ ID NO: 22901 - RNA, 22 nt, Mycobacterium avium subsp. paratuberculosis
ucguggugcugucgcagcugcc

SEQ ID NO: 22902 - RNA, 22 nt, Mycobacterium avium subsp. paratuberculosis
ucgugguguggaacaucgucgg

SEQ ID NO: 22903 - RNA, 22 nt, Mycobacterium avium subsp. paratuberculosis
ucgugguucgcggccgaguccg

SEQ ID NO: 22904 - RNA, 22 nt, Mycobacterium avium subsp. paratuberculosis
ucgugguuggcgacgugcuuga

SEQ ID NO: 22905 - RNA, 22 nt, Mycobacterium avium subsp. paratuberculosis
ucguucaccugacgguugaggc

SEQ ID NO: 22906 - RNA, 22 nt, Mycobacterium avium subsp. paratuberculosis
ucguugcgggagcgggucagau

SEQ ID NO: 22907 - RNA, 22 nt, Mycobacterium avium subsp. paratuberculosis
ucguugucgcucagaggcgggc

SEQ ID NO: 22908 - RNA, 22 nt, Mycobacterium avium subsp. paratuberculosis
ucuaccuuccgccggaggcguu

SEQ ID NO: 22909 - RNA, 22 nt, Mycobacterium avium subsp. paratuberculosis
ucuacgacgcgcacauggaccu

SEQ ID NO: 22910 - RNA, 22 nt, Mycobacterium avium subsp. paratuberculosis
ucucaccaccagcgauggcacg

SEQ ID NO: 22911 - RNA, 22 nt, Mycobacterium avium subsp. paratuberculosis
ucuccccagcgggcccggcggu

SEQ ID NO: 22912 - RNA, 22 nt, Mycobacterium avium subsp. paratuberculosis
ucucgcggugggugcacguucg

SEQ ID NO: 22913 - RNA, 22 nt, Mycobacterium avium subsp. paratuberculosis
ucuucggcagcacccgcggcca

SEQ ID NO: 22914 - RNA, 22 nt, Mycobacterium avium subsp. paratuberculosis
ucuucgucacagcacgaucgcc

SEQ ID NO: 22915 - RNA, 22 nt, Mycobacterium avium subsp. paratuberculosis
ugaacacguuccaggacaccac

SEQ ID NO: 22916 - RNA, 22 nt, Mycobacterium avium subsp. paratuberculosis
ugaccaccaaggguggucccaa

SEQ ID NO: 22917 - RNA, 22 nt, Mycobacterium avium subsp. paratuberculosis
ugacccgauccagggcccgcuc

SEQ ID NO: 22918 - RNA, 22 nt, Mycobacterium avium subsp. paratuberculosis
ugaccgcgucgaccggcucgaa

SEQ ID NO: 22919 - RNA, 22 nt, Mycobacterium avium subsp. paratuberculosis
ugaccgucuucgacccggccgc

SEQ ID NO: 22920 - RNA, 22 nt, Mycobacterium avium subsp. paratuberculosis
ugacgccaguucuccgcgccga

SEQ ID NO: 22921 - RNA, 22 nt, Mycobacterium avium subsp. paratuberculosis
ugagcaccaccgccgcggccac

SEQ ID NO: 22922 - RNA, 22 nt, Mycobacterium avium subsp. paratuberculosis
ugaucgccaaaaacgguacggc

SEQ ID NO: 22923 - RNA, 22 nt, Mycobacterium avium subsp. paratuberculosis
ugaucggccggcacgccgacgu

SEQ ID NO: 22924 - RNA, 22 nt, Mycobacterium avium subsp. paratuberculosis
ugaugccggcgauagguggcga

SEQ ID NO: 22925 - RNA, 22 nt, Mycobacterium avium subsp. paratuberculosis
ugauucccgcguugauggcggg

SEQ ID NO: 22926 - RNA, 22 nt, Mycobacterium avium subsp. paratuberculosis
ugcacgagaucucggugcgggu

SEQ ID NO: 22927 - RNA, 22 nt, Mycobacterium avium subsp. paratuberculosis
ugcacgcggccgacgacaugau

SEQ ID NO: 22928 - RNA, 22 nt, Mycobacterium avium subsp. paratuberculosis
ugcacguggaauucacccgcua

SEQ ID NO: 22929 - RNA, 22 nt, Mycobacterium avium subsp. paratuberculosis
ugcagcgaaccgucggcgucgc

SEQ ID NO: 22930 - RNA, 22 nt, Mycobacterium avium subsp. paratuberculosis
ugcaggacuggacacuugacac

SEQ ID NO: 22931 - RNA, 22 nt, Mycobacterium avium subsp. paratuberculosis
ugccagcccaaucauguucgua

SEQ ID NO: 22932 - RNA, 22 nt, Mycobacterium avium subsp. paratuberculosis
ugccauggcggacgggcguuuu

SEQ ID NO: 22933 - RNA, 22 nt, Mycobacterium avium subsp. paratuberculosis
ugcccgcgucgucgacgggacg

SEQ ID NO: 22934 - RNA, 22 nt, Mycobacterium avium subsp. paratuberculosis
ugcccguaaccgucgugcuggu

SEQ ID NO: 22935 - RNA, 22 nt, Mycobacterium avium subsp. paratuberculosis
ugcccugcagauccaugccggc

SEQ ID NO: 22936 - RNA, 23 nt, Mycobacterium avium subsp. paratuberculosis
ugccgaugacguggucgggcggg

SEQ ID NO: 22937 - RNA, 22 nt, Mycobacterium avium subsp. paratuberculosis
ugccgcagcgacagccggccgg

SEQ ID NO: 22938 - RNA, 22 nt, Mycobacterium avium subsp. paratuberculosis
ugccgccuccgaccgguguguu

SEQ ID NO: 22939 - RNA, 22 nt, Mycobacterium avium subsp. paratuberculosis
ugccgcgugcuuucagcacggc

SEQ ID NO: 22940 - RNA, 22 nt, Mycobacterium avium subsp. paratuberculosis
ugccgguggaucugcgccacga

SEQ ID NO: 22941 - RNA, 22 nt, Mycobacterium avium subsp. paratuberculosis
ugcgaacggugucgccgcggcc

SEQ ID NO: 22942 - RNA, 22 nt, Mycobacterium avium subsp. paratuberculosis
ugcgccgucaacuggaguccuu

SEQ ID NO: 22943 - RNA, 21 nt, Mycobacterium avium subsp. paratuberculosis
ugcgccgucgucgacugguac

SEQ ID NO: 22944 - RNA, 22 nt, Mycobacterium avium subsp. paratuberculosis
ugcgccguggugccgcagcccg

SEQ ID NO: 22945 - RNA, 22 nt, Mycobacterium avium subsp. paratuberculosis
ugcgccugcucggcggcgaugg

SEQ ID NO: 22946 - RNA, 22 nt, Mycobacterium avium subsp. paratuberculosis
ugcgcgaagccgaacugcgcug

SEQ ID NO: 22947 - RNA, 22 nt, Mycobacterium avium subsp. paratuberculosis
ugcgcgaucucgccgcauacac

SEQ ID NO: 22948 - RNA, 22 nt, Mycobacterium avium subsp. paratuberculosis
ugcggcccccguucgucgcggu

SEQ ID NO: 22949 - RNA, 22 nt, Mycobacterium avium subsp. paratuberculosis
ugcggccgaccgaccggcccaa

SEQ ID NO: 22950 - RNA, 22 nt, Mycobacterium avium subsp. paratuberculosis
ugcggcgucauugggcugcaug

SEQ ID NO: 22951 - RNA, 22 nt, Mycobacterium avium subsp. paratuberculosis
ugcggggcucgucgccgaacac

SEQ ID NO: 22952 - RNA, 22 nt, Mycobacterium avium subsp. paratuberculosis
ugcggugcugcucggcgcugau

SEQ ID NO: 22953 - RNA, 22 nt, Mycobacterium avium subsp. paratuberculosis
ugcguucgaucucggcggcguc

SEQ ID NO: 22954 - RNA, 22 nt, Mycobacterium avium subsp. paratuberculosis
ugcucgaacuggggcuuguuca

SEQ ID NO: 22955 - RNA, 21 nt, Mycobacterium avium subsp. paratuberculosis
ugcucgccugacccgccgacc

SEQ ID NO: 22956 - RNA, 22 nt, Mycobacterium avium subsp. paratuberculosis
ugcucucaccgguguugagcag

SEQ ID NO: 22957 - RNA, 22 nt, Mycobacterium avium subsp. paratuberculosis
ugcugaccagcaccucggccgc

SEQ ID NO: 22958 - RNA, 22 nt, Mycobacterium avium subsp. paratuberculosis
ugcugcuguccguggggcuggc

SEQ ID NO: 22959 - RNA, 19 nt, Mycobacterium avium subsp. paratuberculosis
ugcuggaggacucguucuc

SEQ ID NO: 22960 - RNA, 22 nt, Mycobacterium avium subsp. paratuberculosis
ugcuggucccggucgacgacgu

SEQ ID NO: 22961 - RNA, 22 nt, Mycobacterium avium subsp. paratuberculosis
ugcuggucggguauugcgcggg

SEQ ID NO: 22962 - RNA, 20 nt, Mycobacterium avium subsp. paratuberculosis
ugcugucgaccaccguggcg

SEQ ID NO: 22963 - RNA, 22 nt, Mycobacterium avium subsp. paratuberculosis
ugcuugcgggucuugagguagu

SEQ ID NO: 22964 - RNA, 22 nt, Mycobacterium avium subsp. paratuberculosis
uggacagcagcaccgccagggc

SEQ ID NO: 22965 - RNA, 22 nt, Mycobacterium avium subsp. paratuberculosis
uggacgaggccgucggccgacu

SEQ ID NO: 22966 - RNA, 22 nt, Mycobacterium avium subsp. paratuberculosis
uggacggcauccaccaggcgau

SEQ ID NO: 22967 - RNA, 22 nt, Mycobacterium avium subsp. paratuberculosis
uggacggcggugaagccggcgu

SEQ ID NO: 22968 - RNA, 22 nt, Mycobacterium avium subsp. paratuberculosis
uggagcgguccuuggccuccag

SEQ ID NO: 22969 - RNA, 22 nt, Mycobacterium avium subsp. paratuberculosis
uggaggccaucgagggacugca

SEQ ID NO: 22970 - RNA, 22 nt, Mycobacterium avium subsp. paratuberculosis
uggagggcgccggcaucgacuc

SEQ ID NO: 22971 - RNA, 22 nt, Mycobacterium avium subsp. paratuberculosis
ggucggcgaugccgucggcgag

SEQ ID NO: 22972 - RNA, 22 nt, Mycobacterium avium subsp. paratuberculosis
ggucgucgcgaucggcaucacc

SEQ ID NO: 22973 - RNA, 23 nt, Mycobacterium avium subsp. paratuberculosis
ggucuugccggugccggccgggc

SEQ ID NO: 22974 - RNA, 22 nt, Mycobacterium avium subsp. paratuberculosis
ggugagccuggccaacaccggc

SEQ ID NO: 22975 - RNA, 22 nt, Mycobacterium avium subsp. paratuberculosis
ggugauccgcagcggccgcaug

SEQ ID NO: 22976 - RNA, 22 nt, Mycobacterium avium subsp. paratuberculosis
ggugaucucccggugcaguuug

SEQ ID NO: 22977 - RNA, 22 nt, Mycobacterium avium subsp. paratuberculosis
ggugauugguggcgguggcguc

SEQ ID NO: 22978 - RNA, 22 nt, Mycobacterium avium subsp. paratuberculosis
ggugcaguuccccgacacccuc

SEQ ID NO: 22979 - RNA, 22 nt, Mycobacterium avium subsp. paratuberculosis
ggugccggugucggcggcgucg

SEQ ID NO: 22980 - RNA, 22 nt, Mycobacterium avium subsp. paratuberculosis
uggaucaucggcucgcggccgg

SEQ ID NO: 22981 - RNA, 21 nt, Mycobacterium avium subsp. paratuberculosis
uggaucccaaguccucgagcg

SEQ ID NO: 22982 - RNA, 22 nt, Mycobacterium avium subsp. paratuberculosis
uggaugaauccgucggacauca

SEQ ID NO: 22983 - RNA, 22 nt, Mycobacterium avium subsp. paratuberculosis
uggauucgcauauuagugcgug

SEQ ID NO: 22984 - RNA, 22 nt, Mycobacterium avium subsp. paratuberculosis
uggcaacugacgguuuugcgcc

SEQ ID NO: 22985 - RNA, 22 nt, Mycobacterium avium subsp. paratuberculosis
uggcacacguucuggcacagga

SEQ ID NO: 22986 - RNA, 22 nt, Mycobacterium avium subsp. paratuberculosis
uggcccgcagcagggcgaccgc

SEQ ID NO: 22987 - RNA, 22 nt, Mycobacterium avium subsp. paratuberculosis
uggccgccguccuugcccugug

SEQ ID NO: 22988 - RNA, 22 nt, Mycobacterium avium subsp. paratuberculosis
uggccggccugcaucaugauca

SEQ ID NO: 22989 - RNA, 22 nt, Mycobacterium avium subsp. paratuberculosis
uggccggucaccgccaccaugg

SEQ ID NO: 22990 - RNA, 22 nt, Mycobacterium avium subsp. paratuberculosis
uggccucggagaauccgcucga

SEQ ID NO: 22991 - RNA, 22 nt, Mycobacterium avium subsp. paratuberculosis
uggcgcagucggcgugcuugcc

SEQ ID NO: 22992 - RNA, 22 nt, Mycobacterium avium subsp. paratuberculosis
uggcgcggcgagauccggaucu

SEQ ID NO: 22993 - RNA, 22 nt, Mycobacterium avium subsp. paratuberculosis
uggcgcugaucgacgugcgcga

SEQ ID NO: 22994 - RNA, 22 nt, Mycobacterium avium subsp. paratuberculosis
uggcggcgaagguggugagccc

SEQ ID NO: 22995 - RNA, 22 nt, Mycobacterium avium subsp. paratuberculosis
uggcggcguccacgucgacguu

SEQ ID NO: 22996 - RNA, 19 nt, Mycobacterium avium subsp. paratuberculosis
uggcggucagcgggcugcc

SEQ ID NO: 22997 - RNA, 22 nt, Mycobacterium avium subsp. paratuberculosis
uggcguagagcuugcgcagcga

SEQ ID NO: 22998 - RNA, 22 nt, Mycobacterium avium subsp. paratuberculosis
uggcugcgaacagcaccuuggu

SEQ ID NO: 22999 - RNA, 22 nt, Mycobacterium avium subsp. paratuberculosis
ugggacgagcuggugcgccagc

SEQ ID NO: 23000 - RNA, 22 nt, Mycobacterium avium subsp. paratuberculosis
ugggcaccgcgcccggcggcac

SEQ ID NO: 23001 - RNA, 22 nt, Mycobacterium avium subsp. paratuberculosis
ugggcagaucccgccaggcggu

SEQ ID NO: 23002 - RNA, 22 nt, Mycobacterium avium subsp. paratuberculosis
ugggccgggcccaucgcuuuuc

SEQ ID NO: 23003 - RNA, 22 nt, Mycobacterium avium subsp. paratuberculosis
ugggcgaccugggcaccgacac

SEQ ID NO: 23004 - RNA, 22 nt, Mycobacterium avium subsp. paratuberculosis
ugggcgaucggaaucgcgaucg

SEQ ID NO: 23005 - RNA, 22 nt, Mycobacterium avium subsp. paratuberculosis
ugggcgccgggcuggccuccca

SEQ ID NO: 23006 - RNA, 20 nt, Mycobacterium avium subsp. paratuberculosis
ugggcgccuccgaacgcggc

SEQ ID NO: 23007 - RNA, 22 nt, Mycobacterium avium subsp. paratuberculosis
ugggcucagccugcuggucgaa

SEQ ID NO: 23008 - RNA, 22 nt, Mycobacterium avium subsp. paratuberculosis
ugggggcuuuugcgucugcucg

SEQ ID NO: 23009 - RNA, 22 nt, Mycobacterium avium subsp. paratuberculosis
uggggugcggcgcugacccuga

SEQ ID NO: 23010 - RNA, 22 nt, Mycobacterium avium subsp. paratuberculosis
ugggucagcugagucacgaucg

SEQ ID NO: 23011 - RNA, 18 nt, Mycobacterium avium subsp. paratuberculosis
uggguccaaguauccuga

SEQ ID NO: 23012 - RNA, 22 nt, Mycobacterium avium subsp. paratuberculosis
ugggugcucaccgacggcgacc

SEQ ID NO: 23013 - RNA, 22 nt, Mycobacterium avium subsp. paratuberculosis
uggguggccaaguccggcugga

SEQ ID NO: 23014 - RNA, 22 nt, Mycobacterium avium subsp. paratuberculosis
ugggugggcuugaccuguuuga

SEQ ID NO: 23015 - RNA, 22 nt, Mycobacterium avium subsp. paratuberculosis
ugguaacacacgguggugagca

SEQ ID NO: 23016 - RNA, 22 nt, Mycobacterium avium subsp. paratuberculosis
uggucagcguggucggccuggu

SEQ ID NO: 23017 - RNA, 22 nt, Mycobacterium avium subsp. paratuberculosis
ugguccacgaucaggcagcccg

SEQ ID NO: 23018 - RNA, 23 nt, Mycobacterium avium subsp. paratuberculosis
ugguccaggcggucggauucucg

SEQ ID NO: 23019 - RNA, 22 nt, Mycobacterium avium subsp. paratuberculosis
ugguccggcuggccgaaaacgc

SEQ ID NO: 23020 - RNA, 22 nt, Mycobacterium avium subsp. paratuberculosis
uggucgaaaugccgguccgcgg

SEQ ID NO: 23021 - RNA, 22 nt, Mycobacterium avium subsp. paratuberculosis
uggucgaaguuguugcucgcac

SEQ ID NO: 23022 - RNA, 22 nt, Mycobacterium avium subsp. paratuberculosis
uggucgagcuccgcgcggcagg

SEQ ID NO: 23023 - RNA, 22 nt, Mycobacterium avium subsp. paratuberculosis
uggucgaucucgaacaccgucg

SEQ ID NO: 23024 - RNA, 18 nt, Mycobacterium avium subsp. paratuberculosis
uggucgcggcugucccgc

SEQ ID NO: 23025 - RNA, 22 nt, Mycobacterium avium subsp. paratuberculosis
uggucggcgccgugggcgagcu

SEQ ID NO: 23026 - RNA, 23 nt, Mycobacterium avium subsp. paratuberculosis
uggucggcuucuuguucgccguc

SEQ ID NO: 23027 - RNA, 22 nt, Mycobacterium avium subsp. paratuberculosis
uggucgguucuauguaaguugg

SEQ ID NO: 23028 - RNA, 18 nt, Mycobacterium avium subsp. paratuberculosis
uggugccggccgaccucg

SEQ ID NO: 23029 - RNA, 22 nt, Mycobacterium avium subsp. paratuberculosis
uggugcuggccgccugcggcca

SEQ ID NO: 23030 - RNA, 22 nt, Mycobacterium avium subsp. paratuberculosis
ugguggagcagguccgcgcgca

SEQ ID NO: 23031 - RNA, 17 nt, Mycobacterium avium subsp. paratuberculosis
ugguggcguuguguuca

SEQ ID NO: 23032 - RNA, 22 nt, Mycobacterium avium subsp. paratuberculosis
ugguggugcccggcgucggcgc

SEQ ID NO: 23033 - RNA, 22 nt, Mycobacterium avium subsp. paratuberculosis
ugguggugcgccggaugcccaa

SEQ ID NO: 23034 - RNA, 20 nt, Mycobacterium avium subsp. paratuberculosis
uggugguggcgcccaguucg

SEQ ID NO: 23035 - RNA, 22 nt, Mycobacterium avium subsp. paratuberculosis
uggugugcgcccggcuguugcu

SEQ ID NO: 23036 - RNA, 22 nt, Mycobacterium avium subsp. paratuberculosis
ugguuuucggcgaccgagaccg

SEQ ID NO: 23037 - RNA, 22 nt, Mycobacterium avium subsp. paratuberculosis
uguccgacgaggcgucguggau

SEQ ID NO: 23038 - RNA, 22 nt, Mycobacterium avium subsp. paratuberculosis
uguccgauccggagcaguugga

SEQ ID NO: 23039 - RNA, 22 nt, Mycobacterium avium subsp. paratuberculosis
ugucgaucgacuaccggcuggc

SEQ ID NO: 23040 - RNA, 23 nt, Mycobacterium avium subsp. paratuberculosis
ugucggauacaugcugcggccgg

SEQ ID NO: 23041 - RNA, 22 nt, Mycobacterium avium subsp. paratuberculosis
ugucggcacgcuagucugcugc

SEQ ID NO: 23042 - RNA, 22 nt, Mycobacterium avium subsp. paratuberculosis
ugucggugaggaucugcauccg

SEQ ID NO: 23043 - RNA, 22 nt, Mycobacterium avium subsp. paratuberculosis
ugucguccgguuucaccugggg

SEQ ID NO: 23044 - RNA, 22 nt, Mycobacterium avium subsp. paratuberculosis
ugugaccgcaugacgcugcgcu

SEQ ID NO: 23045 - RNA, 22 nt, Mycobacterium avium subsp. paratuberculosis
ugugccccaccuuucgucuuuc

SEQ ID NO: 23046 - RNA, 22 nt, Mycobacterium avium subsp. paratuberculosis
ugugcccgccucgcagcgacaa

SEQ ID NO: 23047 - RNA, 22 nt, Mycobacterium avium subsp. paratuberculosis
ugugcuggcgguaugcgugguc

SEQ ID NO: 23048 - RNA, 23 nt, Mycobacterium avium subsp. paratuberculosis
ugugcuuccgggugucgucggac

SEQ ID NO: 23049 - RNA, 22 nt, Mycobacterium avium subsp. paratuberculosis
uguggaccgggccgucggacau

SEQ ID NO: 23050 - RNA, 22 nt, Mycobacterium avium subsp. paratuberculosis
ugugggaugaggugcaggugca

SEQ ID NO: 23051 - RNA, 22 nt, Mycobacterium avium subsp. paratuberculosis
ugacgccgaguucgacggcgcg

SEQ ID NO: 23052 - RNA, 22 nt, Mycobacterium avium subsp. paratuberculosis
ugacgcgcgaggucgacuguca

SEQ ID NO: 23053 - RNA, 22 nt, Mycobacterium avium subsp. paratuberculosis
ugacgcucgaggucgaccguca

SEQ ID NO: 23054 - RNA, 22 nt, Mycobacterium avium subsp. paratuberculosis
ugacgcugucgcaguuguugug

SEQ ID NO: 23055 - RNA, 22 nt, Mycobacterium avium subsp. paratuberculosis
ugacgucgccgaccgccucacc

SEQ ID NO: 23056 - RNA, 22 nt, Mycobacterium avium subsp. paratuberculosis
ugauccccggugaugacuucgc

SEQ ID NO: 23057 - RNA, 18 nt, Mycobacterium avium subsp. paratuberculosis
ugaucgacgagccgcucg

SEQ ID NO: 23058 - RNA, 22 nt, Mycobacterium avium subsp. paratuberculosis
ugaucgagcgggucgacgacuu

SEQ ID NO: 23059 - RNA, 22 nt, Mycobacterium avium subsp. paratuberculosis
ugaucggcuucuccggcgugcg

SEQ ID NO: 23060 - RNA, 22 nt, Mycobacterium avium subsp. paratuberculosis
ugaugaucgggcaccgggccgc

SEQ ID NO: 23061 - RNA, 22 nt, Mycobacterium avium subsp. paratuberculosis
ugaugccguagucggucgcggu

SEQ ID NO: 23062 - RNA, 22 nt, Mycobacterium avium subsp. paratuberculosis
ugauggccgagcaggucgacug

SEQ ID NO: 23063 - RNA, 22 nt, Mycobacterium avium subsp. paratuberculosis
ugauucccgacgacgggcacgc

SEQ ID NO: 23064 - RNA, 22 nt, Mycobacterium avium subsp. paratuberculosis
ugcacgacccgaugaccuucau

SEQ ID NO: 23065 - RNA, 23 nt, Mycobacterium avium subsp. paratuberculosis
ugcacgucugccucgccgacccc

SEQ ID NO: 23066 - RNA, 22 nt, Mycobacterium avium subsp. paratuberculosis
ugcagcacuucgucuuuggacc

SEQ ID NO: 23067 - RNA, 22 nt, Mycobacterium avium subsp. paratuberculosis
ugcccgacgacgacgaacgugc

SEQ ID NO: 23068 - RNA, 22 nt, Mycobacterium avium subsp. paratuberculosis
ugcccggacugcguggccucgc

SEQ ID NO: 23069 - RNA, 22 nt, Mycobacterium avium subsp. paratuberculosis
ugcccggcggugcgccuaccgg

SEQ ID NO: 23070 - RNA, 22 nt, Mycobacterium avium subsp. paratuberculosis
ugcccugauugaccgugaacug

SEQ ID NO: 23071 - RNA, 20 nt, Mycobacterium avium subsp. paratuberculosis
ugcccugcugcgcgccgggg

SEQ ID NO: 23072 - RNA, 22 nt, Mycobacterium avium subsp. paratuberculosis
ugccgcaacuucccgacgguua

SEQ ID NO: 23073 - RNA, 22 nt, Mycobacterium avium subsp. paratuberculosis
ugccggugguguucgucgugca

SEQ ID NO: 23074 - RNA, 22 nt, Mycobacterium avium subsp. paratuberculosis
ugcgcaccgaguugcugcgcga

SEQ ID NO: 23075 - RNA, 22 nt, Mycobacterium avium subsp. paratuberculosis
ugcgcccgcaguuggucggcga

SEQ ID NO: 23076 - RNA, 22 nt, Mycobacterium avium subsp. paratuberculosis
ugcgcccgugugguguucggac

SEQ ID NO: 23077 - RNA, 22 nt, Mycobacterium avium subsp. paratuberculosis
ugcgcgccuacaucgcggccaa

SEQ ID NO: 23078 - RNA, 22 nt, Mycobacterium avium subsp. paratuberculosis
ugcggcgcagcgcguggaucag

SEQ ID NO: 23079 - RNA, 22 nt, Mycobacterium avium subsp. paratuberculosis
ugcgggccgaucugaccgaccg

SEQ ID NO: 23080 - RNA, 22 nt, Mycobacterium avium subsp. paratuberculosis
ugcgggccuccucguuggcgac

SEQ ID NO: 23081 - RNA, 21 nt, Mycobacterium avium subsp. paratuberculosis
ugcgggucguacuccagggcg

SEQ ID NO: 23082 - RNA, 22 nt, Mycobacterium avium subsp. paratuberculosis
ugcgggugacaggcugaugcgg

SEQ ID NO: 23083 - RNA, 22 nt, Mycobacterium avium subsp. paratuberculosis
ugcgguccugcccgcgagagca

SEQ ID NO: 23084 - RNA, 22 nt, Mycobacterium avium subsp. paratuberculosis
ugcguaguugcagucucgugcu

SEQ ID NO: 23085 - RNA, 22 nt, Mycobacterium avium subsp. paratuberculosis
ugcgugacauacagcgugucga

SEQ ID NO: 23086 - RNA, 22 nt, Mycobacterium avium subsp. paratuberculosis
ugcgugcacaucccgaccgcgc

SEQ ID NO: 23087 - RNA, 22 nt, Mycobacterium avium subsp. paratuberculosis
ugcguugcgccacuugggguuc

SEQ ID NO: 23088 - RNA, 22 nt, Mycobacterium avium subsp. paratuberculosis
ugcucgacgacggcaccgugcu

SEQ ID NO: 23089 - RNA, 22 nt, Mycobacterium avium subsp. paratuberculosis
ugcucggccaccucggcgaugu

SEQ ID NO: 23090 - RNA, 22 nt, Mycobacterium avium subsp. paratuberculosis
ugcucugcgggcagacucgaua

SEQ ID NO: 23091 - RNA, 22 nt, Mycobacterium avium subsp. paratuberculosis
ugcugcaggagaccacccggga

SEQ ID NO: 23092 - RNA, 22 nt, Mycobacterium avium subsp. paratuberculosis
ugcugcgcgacacgucggugcu

SEQ ID NO: 23093 - RNA, 22 nt, Mycobacterium avium subsp. paratuberculosis
ugcugcgucauguggcgggcga

SEQ ID NO: 23094 - RNA, 22 nt, Mycobacterium avium subsp. paratuberculosis
ugcuggaugcgcuggccgccca

SEQ ID NO: 23095 - RNA, 22 nt, Mycobacterium avium subsp. paratuberculosis
ugcuggccgacauggcgagaau

SEQ ID NO: 23096 - RNA, 22 nt, Mycobacterium avium subsp. paratuberculosis
ugcuggccuuucucgacgucga

SEQ ID NO: 23097 - RNA, 19 nt, Mycobacterium avium subsp. paratuberculosis
ugcuggcggccucgcccgc

SEQ ID NO: 23098 - RNA, 19 nt, Mycobacterium avium subsp. paratuberculosis
ugcuggggucgguguucga

SEQ ID NO: 23099 - RNA, 22 nt, Mycobacterium avium subsp. paratuberculosis
ugcugggugcccgcggcggugc

SEQ ID NO: 23100 - RNA, 22 nt, Mycobacterium avium subsp. paratuberculosis
ucgagcugggcccgcgcauccc

SEQ ID NO: 23101 - RNA, 22 nt, Mycobacterium avium subsp. paratuberculosis
ucgagcuggucgagcuccgggg

SEQ ID NO: 23102 - RNA, 22 nt, Mycobacterium avium subsp. paratuberculosis
ucgagcuugucaacgguguaua

SEQ ID NO: 23103 - RNA, 22 nt, Mycobacterium avium subsp. paratuberculosis
ucgaggaauugccgcagcgacu

SEQ ID NO: 23104 - RNA, 19 nt, Mycobacterium avium subsp. paratuberculosis
ucgagguugacggcgccga

SEQ ID NO: 23105 - RNA, 22 nt, Mycobacterium avium subsp. paratuberculosis
ucgaucgaacgccggguggcgc

SEQ ID NO: 23106 - RNA, 22 nt, Mycobacterium avium subsp. paratuberculosis
ucgaucgcgaccuccuugauga

SEQ ID NO: 23107 - RNA, 21 nt, Mycobacterium avium subsp. paratuberculosis
ucgaugacggcggugccggcc

SEQ ID NO: 23108 - RNA, 22 nt, Mycobacterium avium subsp. paratuberculosis
ucgaugacggugucggcgccgg

SEQ ID NO: 23109 - RNA, 22 nt, Mycobacterium avium subsp. paratuberculosis
ucgaugaucaccgcggccaggc

SEQ ID NO: 23110 - RNA, 22 nt, Mycobacterium avium subsp. paratuberculosis
ucgaugcccauggcgccgccca

SEQ ID NO: 23111 - RNA, 21 nt, Mycobacterium avium subsp. paratuberculosis
ucgauggaggcggugggcggc

SEQ ID NO: 23112 - RNA, 22 nt, Mycobacterium avium subsp. paratuberculosis
ucgauguccgcgacguauuccu

SEQ ID NO: 23113 - RNA, 22 nt, Mycobacterium avium subsp. paratuberculosis
ucgauuucaaggccggggugcu

SEQ ID NO: 23114 - RNA, 22 nt, Mycobacterium avium subsp. paratuberculosis
ucgcccgucagcaucaucaccg

SEQ ID NO: 23115 - RNA, 22 nt, Mycobacterium avium subsp. paratuberculosis
ucgccgccagugcacguucggc

SEQ ID NO: 23116 - RNA, 22 nt, Mycobacterium avium subsp. paratuberculosis
ucgccgcccgcacgucgucggg

SEQ ID NO: 23117 - RNA, 22 nt, Mycobacterium avium subsp. paratuberculosis
ucgccguggcguuacgcuggcg

SEQ ID NO: 23118 - RNA, 22 nt, Mycobacterium avium subsp. paratuberculosis
ucgccuuggugaacagcgaguc

SEQ ID NO: 23119 - RNA, 22 nt, Mycobacterium avium subsp. paratuberculosis
ucgcgccagucgaccguggugc

SEQ ID NO: 23120 - RNA, 22 nt, Mycobacterium avium subsp. paratuberculosis
ucgcgcugcccuuggcggcuuc

SEQ ID NO: 23121 - RNA, 22 nt, Mycobacterium avium subsp. paratuberculosis
ucgcgcugcggccgcuggagaa

SEQ ID NO: 23122 - RNA, 18 nt, Mycobacterium avium subsp. paratuberculosis
ucgcgcugcugucccggu

SEQ ID NO: 23123 - RNA, 22 nt, Mycobacterium avium subsp. paratuberculosis
ucgcgcugggcgacuucgucga

SEQ ID NO: 23124 - RNA, 22 nt, Mycobacterium avium subsp. paratuberculosis
ucgcggaucgaggaggagaucg

SEQ ID NO: 23125 - RNA, 22 nt, Mycobacterium avium subsp. paratuberculosis
ucgcggggcuuuugcgucugcu

SEQ ID NO: 23126 - RNA, 21 nt, Mycobacterium avium subsp. paratuberculosis
ucgcggugaguacacgcucgg

SEQ ID NO: 23127 - RNA, 22 nt, Mycobacterium avium subsp. paratuberculosis
ucgcggugguugcacgcucggc

SEQ ID NO: 23128 - RNA, 22 nt, Mycobacterium avium subsp. paratuberculosis
ucgcuaguugcacucucgcggc

SEQ ID NO: 23129 - RNA, 22 nt, Mycobacterium avium subsp. paratuberculosis
ucgcucgacgaccucgacgcgg

SEQ ID NO: 23130 - RNA, 22 nt, Mycobacterium avium subsp. paratuberculosis
ucgcugcccgacaucgaggggc

SEQ ID NO: 23131 - RNA, 22 nt, Mycobacterium avium subsp. paratuberculosis
ucgcugcugaucccggcgcugc

SEQ ID NO: 23132 - RNA, 22 nt, Mycobacterium avium subsp. paratuberculosis
ucgcuggcggucuccgggucga

SEQ ID NO: 23133 - RNA, 22 nt, Mycobacterium avium subsp. paratuberculosis
ucgcugggcggcagcucggcau

SEQ ID NO: 23134 - RNA, 22 nt, Mycobacterium avium subsp. paratuberculosis
ucggaggagccaugagaagaac

SEQ ID NO: 23135 - RNA, 22 nt, Mycobacterium avium subsp. paratuberculosis
ucggcaccaaucggcugcuggc

SEQ ID NO: 23136 - RNA, 20 nt, Mycobacterium avium subsp. paratuberculosis
ucggcacccggcugugcugg

SEQ ID NO: 23137 - RNA, 22 nt, Mycobacterium avium subsp. paratuberculosis
ucggccagcgucgccgucagca

SEQ ID NO: 23138 - RNA, 22 nt, Mycobacterium avium subsp. paratuberculosis
ucggccaucgguucgguggugc

SEQ ID NO: 23139 - RNA, 22 nt, Mycobacterium avium subsp. paratuberculosis
ucggcccaauccaggguccgcu

SEQ ID NO: 23140 - RNA, 22 nt, Mycobacterium avium subsp. paratuberculosis
ucggccugcgagaugugcacgu

SEQ ID NO: 23141 - RNA, 21 nt, Mycobacterium avium subsp. paratuberculosis
ucggcgacauccucggcaucc

SEQ ID NO: 23142 - RNA, 22 nt, Mycobacterium avium subsp. paratuberculosis
ucggcgacggugaaggcgaucu

SEQ ID NO: 23143 - RNA, 22 nt, Mycobacterium avium subsp. paratuberculosis
ucggcgacguagugguggccgu

SEQ ID NO: 23144 - RNA, 23 nt, Mycobacterium avium subsp. paratuberculosis
ucggcgagcacgccaucgccucg

SEQ ID NO: 23145 - RNA, 22 nt, Mycobacterium avium subsp. paratuberculosis
ucggcgcugacguugggccggg

SEQ ID NO: 23146 - RNA, 22 nt, Mycobacterium avium subsp. paratuberculosis
ucggcggaauggaaagcgggac

SEQ ID NO: 23147 - RNA, 21 nt, Mycobacterium avium subsp. paratuberculosis
ucggcggcaccaucgggacgc

SEQ ID NO: 23148 - RNA, 22 nt, Mycobacterium avium subsp. paratuberculosis
ucggcguucgaucucgaagcag

SEQ ID NO: 23149 - RNA, 21 nt, Mycobacterium avium subsp. paratuberculosis
ucggcguuuccggccuggugg

SEQ ID NO: 23150 - RNA, 22 nt, Mycobacterium avium subsp. paratuberculosis
ucggcucgauucgguugccggg

SEQ ID NO: 23151 - RNA, 22 nt, Mycobacterium avium subsp. paratuberculosis
ucggcugcaagcgaauccugaa

SEQ ID NO: 23152 - RNA, 18 nt, Mycobacterium avium subsp. paratuberculosis
ucggcuucaccagguccg

SEQ ID NO: 23153 - RNA, 22 nt, Mycobacterium avium subsp. paratuberculosis
ucggcuuugaucaugaaguagg

SEQ ID NO: 23154 - RNA, 22 nt, Mycobacterium avium subsp. paratuberculosis
ucgggccguagcgggucagcgc

SEQ ID NO: 23155 - RNA, 22 nt, Mycobacterium avium subsp. paratuberculosis
ucgggggcuuuugcgucugcuc

SEQ ID NO: 23156 - RNA, 22 nt, Mycobacterium avium subsp. paratuberculosis
ucggguuccgaguaggcguugc

SEQ ID NO: 23157 - RNA, 22 nt, Mycobacterium avium subsp. paratuberculosis
ucggucuugcgucccucggcgg

SEQ ID NO: 23158 - RNA, 22 nt, Mycobacterium avium subsp. paratuberculosis
ucggugacgugccgcugaaccu

SEQ ID NO: 23159 - RNA, 22 nt, Mycobacterium avium subsp. paratuberculosis
ucggugcgaugguggucgccgu

SEQ ID NO: 23160 - RNA, 22 nt, Mycobacterium avium subsp. paratuberculosis
ucggugcgcgggaagcugucgu

SEQ ID NO: 23161 - RNA, 16 nt, Mycobacterium avium subsp. paratuberculosis
ucggugggcaugcuca

SEQ ID NO: 23162 - RNA, 22 nt, Mycobacterium avium subsp. paratuberculosis
ucggugguggaaggcgagcucg

SEQ ID NO: 23163 - RNA, 22 nt, Mycobacterium avium subsp. paratuberculosis
ucgguguaaucgacgaacaccu

SEQ ID NO: 23164 - RNA, 22 nt, Mycobacterium avium subsp. paratuberculosis
ucgguucccgcggcgaucgcca

SEQ ID NO: 23165 - RNA, 22 nt, Mycobacterium avium subsp. paratuberculosis
ucgguuucgacggcgacagcgc

SEQ ID NO: 23166 - RNA, 22 nt, Mycobacterium avium subsp. paratuberculosis
ucgucacgcccgcgcugcaacg

SEQ ID NO: 23167 - RNA, 22 nt, Mycobacterium avium subsp. paratuberculosis
ucgucgagcaccacggucuugc

SEQ ID NO: 23168 - RNA, 22 nt, Mycobacterium avium subsp. paratuberculosis
ucgugcuggacgucuacggcgc

SEQ ID NO: 23169 - RNA, 22 nt, Mycobacterium avium subsp. paratuberculosis
ucgugcugucggucgccacccc

SEQ ID NO: 23170 - RNA, 22 nt, Mycobacterium avium subsp. paratuberculosis
ucgugggugugcugccagucgg

SEQ ID NO: 23171 - RNA, 22 nt, Mycobacterium avium subsp. paratuberculosis
ggcgcgacugaccgaccggccc

SEQ ID NO: 23172 - RNA, 22 nt, Mycobacterium avium subsp. paratuberculosis
ggcgcggacuggacggccgcca

SEQ ID NO: 23173 - RNA, 22 nt, Mycobacterium avium subsp. paratuberculosis
ggcgcggugaccaggcugauca

SEQ ID NO: 23174 - RNA, 22 nt, Mycobacterium avium subsp. paratuberculosis
ggcgcggugccguauacccgcc

SEQ ID NO: 23175 - RNA, 22 nt, Mycobacterium avium subsp. paratuberculosis
ggcgcgguucuagacugucugc

SEQ ID NO: 23176 - RNA, 22 nt, Mycobacterium avium subsp. paratuberculosis
ggcgcucaucgguggcgaugaa

SEQ ID NO: 23177 - RNA, 22 nt, Mycobacterium avium subsp. paratuberculosis
ggcgcugguggucggcgcguuc

SEQ ID NO: 23178 - RNA, 20 nt, Mycobacterium avium subsp. paratuberculosis
ggcggcacauucgaagucac

SEQ ID NO: 23179 - RNA, 22 nt, Mycobacterium avium subsp. paratuberculosis
ggcggccucgaucucggugcgc

SEQ ID NO: 23180 - RNA, 22 nt, Mycobacterium avium subsp. paratuberculosis
ggcggcggagucgaugcgggug

SEQ ID NO: 23181 - RNA, 22 nt, Mycobacterium avium subsp. paratuberculosis
ggcggcgucgauguuggacugg

SEQ ID NO: 23182 - RNA, 22 nt, Mycobacterium avium subsp. paratuberculosis
ggcgggaugcgcugggaauuga

SEQ ID NO: 23183 - RNA, 22 nt, Mycobacterium avium subsp. paratuberculosis
ggcggucaauguccgcgacgau

SEQ ID NO: 23184 - RNA, 22 nt, Mycobacterium avium subsp. paratuberculosis
ggcggugugcagcaccucggcg

SEQ ID NO: 23185 - RNA, 22 nt, Mycobacterium avium subsp. paratuberculosis
ggcgguguuccagacccgcucg

SEQ ID NO: 23186 - RNA, 22 nt, Mycobacterium avium subsp. paratuberculosis
ggcgucgaucaacaugugcugg

SEQ ID NO: 23187 - RNA, 21 nt, Mycobacterium avium subsp. paratuberculosis
ggcgucggugucgagcaccuc

SEQ ID NO: 23188 - RNA, 22 nt, Mycobacterium avium subsp. paratuberculosis
ggcgugggcgcugaucgccgcc

SEQ ID NO: 23189 - RNA, 22 nt, Mycobacterium avium subsp. paratuberculosis
ggcguugguagaucggcacgcc

SEQ ID NO: 23190 - RNA, 22 nt, Mycobacterium avium subsp. paratuberculosis
ggcguuggugugcugggcgcgc

SEQ ID NO: 23191 - RNA, 22 nt, Mycobacterium avium subsp. paratuberculosis
ggcuaucucacuuugaucaucu

SEQ ID NO: 23192 - RNA, 22 nt, Mycobacterium avium subsp. paratuberculosis
ggcucaccaagaacuucggugc

SEQ ID NO: 23193 - RNA, 22 nt, Mycobacterium avium subsp. paratuberculosis
ggcucgucgaccagccgcugcc

SEQ ID NO: 23194 - RNA, 22 nt, Mycobacterium avium subsp. paratuberculosis
ggcugauuuugcgggccgcccg

SEQ ID NO: 23195 - RNA, 22 nt, Mycobacterium avium subsp. paratuberculosis
gggaaucggcccgcugccgucg

SEQ ID NO: 23196 - RNA, 22 nt, Mycobacterium avium subsp. paratuberculosis
gggaccaucgccggccuggucg

SEQ ID NO: 23197 - RNA, 22 nt, Mycobacterium avium subsp. paratuberculosis
gggacccgucgucaccgaccgg

SEQ ID NO: 23198 - RNA, 22 nt, Mycobacterium avium subsp. paratuberculosis
gggagcuuuugcgucugcucgc

SEQ ID NO: 23199 - RNA, 22 nt, Mycobacterium avium subsp. paratuberculosis
gggaugugcugcagguugaucc

SEQ ID NO: 23200 - RNA, 22 nt, Mycobacterium avium subsp. paratuberculosis
gggcagaugcagauacggcucg

SEQ ID NO: 23201 - RNA, 22 nt, Mycobacterium avium subsp. paratuberculosis
gggccccgcggucaucucggug

SEQ ID NO: 23202 - RNA, 22 nt, Mycobacterium avium subsp. paratuberculosis
gggccgagucguuguccuugag

SEQ ID NO: 23203 - RNA, 22 nt, Mycobacterium avium subsp. paratuberculosis
gggccggagacgucgccgacca

SEQ ID NO: 23204 - RNA, 22 nt, Mycobacterium avium subsp. paratuberculosis
gggcgagaugagucccggcgau

SEQ ID NO: 23205 - RNA, 22 nt, Mycobacterium avium subsp. paratuberculosis
gggcgccggggucgaugccgcc

SEQ ID NO: 23206 - RNA, 22 nt, Mycobacterium avium subsp. paratuberculosis
gggcggcucaacacgaugguuu

SEQ ID NO: 23207 - RNA, 22 nt, Mycobacterium avium subsp. paratuberculosis
gggcggugcucggcuucggccg

SEQ ID NO: 23208 - RNA, 22 nt, Mycobacterium avium subsp. paratuberculosis
gggcgucugcuugccgccggug

SEQ ID NO: 23209 - RNA, 22 nt, Mycobacterium avium subsp. paratuberculosis
gggcgugacguuguuggacguc

SEQ ID NO: 23210 - RNA, 22 nt, Mycobacterium avium subsp. paratuberculosis
gggcucgugcaggcugcgcagc

SEQ ID NO: 23211 - RNA, 22 nt, Mycobacterium avium subsp. paratuberculosis
gggcuggccgaccgacuucuug

SEQ ID NO: 23212 - RNA, 22 nt, Mycobacterium avium subsp. paratuberculosis
gggcuuuugcgucugcucgcga

SEQ ID NO: 23213 - RNA, 22 nt, Mycobacterium avium subsp. paratuberculosis
gggcuuuugcgucugcucgcgg

SEQ ID NO: 23214 - RNA, 23 nt, Mycobacterium avium subsp. paratuberculosis
ggggauuucacgucugcucggcg

SEQ ID NO: 23215 - RNA, 22 nt, Mycobacterium avium subsp. paratuberculosis
ggggcugaugcccucggccgcg

SEQ ID NO: 23216 - RNA, 22 nt, Mycobacterium avium subsp. paratuberculosis
gggguuggagucggugucgcug

SEQ ID NO: 23217 - RNA, 22 nt, Mycobacterium avium subsp. paratuberculosis
ggguacgcgcgcugcuguucau

SEQ ID NO: 23218 - RNA, 22 nt, Mycobacterium avium subsp. paratuberculosis
ggguccuuguagaccucggugg

SEQ ID NO: 23219 - RNA, 22 nt, Mycobacterium avium subsp. paratuberculosis
gggucgauggacgccaccacgu

SEQ ID NO: 23220 - RNA, 22 nt, Mycobacterium avium subsp. paratuberculosis
gggucgucgaugacggcgcgca

SEQ ID NO: 23221 - RNA, 22 nt, Mycobacterium avium subsp. paratuberculosis
gggugcuggacuucgcggcguu

SEQ ID NO: 23222 - RNA, 22 nt, Mycobacterium avium subsp. paratuberculosis
gugaaguuaauuucacgcucgg

SEQ ID NO: 23223 - RNA, 22 nt, Mycobacterium avium subsp. paratuberculosis
gugaccaggccgccgcugccgc

SEQ ID NO: 23224 - RNA, 22 nt, Mycobacterium avium subsp. paratuberculosis
gugaccgugucggugccgagca

SEQ ID NO: 23225 - RNA, 22 nt, Mycobacterium avium subsp. paratuberculosis
gugacggacuguucgguggacu

SEQ ID NO: 23226 - RNA, 22 nt, Mycobacterium avium subsp. paratuberculosis
gugcagcgcuggggcgaguugu

SEQ ID NO: 23227 - RNA, 22 nt, Mycobacterium avium subsp. paratuberculosis
gugcaucacgauccggcgggcc

SEQ ID NO: 23228 - RNA, 22 nt, Mycobacterium avium subsp. paratuberculosis
gugccgaacucgacgcggccgu

SEQ ID NO: 23229 - RNA, 19 nt, Mycobacterium avium subsp. paratuberculosis
gugccggcgggacguggcg

SEQ ID NO: 23230 - RNA, 22 nt, Mycobacterium avium subsp. paratuberculosis
gugcggcggucgucgcugacca

SEQ ID NO: 23231 - RNA, 22 nt, Mycobacterium avium subsp. paratuberculosis
gugcgggaaguuccacggcgug

SEQ ID NO: 23232 - RNA, 22 nt, Mycobacterium avium subsp. paratuberculosis
gugcucacgcugcugcuggccg

SEQ ID NO: 23233 - RNA, 22 nt, Mycobacterium avium subsp. paratuberculosis
gugcugauggcgauggcggucg

SEQ ID NO: 23234 - RNA, 22 nt, Mycobacterium avium subsp. paratuberculosis
gugcugggauugauggcggcga

SEQ ID NO: 23235 - RNA, 22 nt, Mycobacterium avium subsp. paratuberculosis
gugcuuuugcgucugcucgcca

SEQ ID NO: 23236 - RNA, 22 nt, Mycobacterium avium subsp. paratuberculosis
guggacgagccgaccgccgggc

SEQ ID NO: 23237 - RNA, 22 nt, Mycobacterium avium subsp. paratuberculosis
guggccacgaucgccgcggugg

SEQ ID NO: 23238 - RNA, 22 nt, Mycobacterium avium subsp. paratuberculosis
guggcccguuguugaugacggc

SEQ ID NO: 23239 - RNA, 22 nt, Mycobacterium avium subsp. paratuberculosis
guggccgaggucgucacgaucu

SEQ ID NO: 23240 - RNA, 22 nt, Mycobacterium avium subsp. paratuberculosis
guggccgaggugcuuggggucg

SEQ ID NO: 23241 - RNA, 22 nt, Mycobacterium avium subsp. paratuberculosis
guggccgucgugguggcguugc

SEQ ID NO: 23242 - RNA, 22 nt, Mycobacterium avium subsp. paratuberculosis
guggcgcggguguugcgcccug

SEQ ID NO: 23243 - RNA, 22 nt, Mycobacterium avium subsp. paratuberculosis
guggcgcugcgcacggugucgg

SEQ ID NO: 23244 - RNA, 22 nt, Mycobacterium avium subsp. paratuberculosis
guggcgucgaaguggucgaugu

SEQ ID NO: 23245 - RNA, 22 nt, Mycobacterium avium subsp. paratuberculosis
guggcuucgcccgccgagcguc

SEQ ID NO: 23246 - RNA, 22 nt, Mycobacterium avium subsp. paratuberculosis
gugggcagcgugcgcaucgggg

SEQ ID NO: 23247 - RNA, 19 nt, Mycobacterium avium subsp. paratuberculosis
gugggcgucgaauucgacg

SEQ ID NO: 23248 - RNA, 22 nt, Mycobacterium avium subsp. paratuberculosis
gugggcguucgcgcaguacgcg

SEQ ID NO: 23249 - RNA, 22 nt, Mycobacterium avium subsp. paratuberculosis
guggguuucgcgggucaccggg

SEQ ID NO: 23250 - RNA, 22 nt, Mycobacterium avium subsp. paratuberculosis
guggugcucugggaugcccugc

SEQ ID NO: 23251 - RNA, 22 nt, Mycobacterium avium subsp. paratuberculosis
guggugcugcggccggacggua

SEQ ID NO: 23252 - RNA, 22 nt, Mycobacterium avium subsp. paratuberculosis
guggugggcagcucgucgcgaa

SEQ ID NO: 23253 - RNA, 22 nt, Mycobacterium avium subsp. paratuberculosis
guggugggccagccgcggcgcu

SEQ ID NO: 23254 - RNA, 22 nt, Mycobacterium avium subsp. paratuberculosis
gugguguccgggcgcaguacag

SEQ ID NO: 23255 - RNA, 22 nt, Mycobacterium avium subsp. paratuberculosis
guggugugcccggugcaucugg

SEQ ID NO: 23256 - RNA, 23 nt, Mycobacterium avium subsp. paratuberculosis
gugucacgccagcgugacggucg

SEQ ID NO: 23257 - RNA, 22 nt, Mycobacterium avium subsp. paratuberculosis
gugucgaccuggauccugccgg

SEQ ID NO: 23258 - RNA, 22 nt, Mycobacterium avium subsp. paratuberculosis
gugucgagcaccaggucgcggc

SEQ ID NO: 23259 - RNA, 22 nt, Mycobacterium avium subsp. paratuberculosis
gugucgggggcuuuugcgucug

SEQ ID NO: 23260 - RNA, 22 nt, Mycobacterium avium subsp. paratuberculosis
gugucguucaucgucgcgauca

SEQ ID NO: 23261 - RNA, 22 nt, Mycobacterium avium subsp. paratuberculosis
gugugaucgagguugccggcca

SEQ ID NO: 23262 - RNA, 22 nt, Mycobacterium avium subsp. paratuberculosis
guucccgcucgcuccgcugcgc

SEQ ID NO: 23263 - RNA, 22 nt, Mycobacterium avium subsp. paratuberculosis
guucgcggacgggcuggccggc

SEQ ID NO: 23264 - RNA, 22 nt, Mycobacterium avium subsp. paratuberculosis
guucuccaccauggacgcgcgg

SEQ ID NO: 23265 - RNA, 22 nt, Mycobacterium avium subsp. paratuberculosis
guugccgaagugaaaggaugcc

SEQ ID NO: 23266 - RNA, 22 nt, Mycobacterium avium subsp. paratuberculosis
guugccgagucguggucgguga

SEQ ID NO: 23267 - RNA, 22 nt, Mycobacterium avium subsp. paratuberculosis
guuggccguacuggcccggcug

SEQ ID NO: 23268 - RNA, 22 nt, Mycobacterium avium subsp. paratuberculosis
guugggcgagaucgcuucacga

SEQ ID NO: 23269 - RNA, 22 nt, Mycobacterium avium subsp. paratuberculosis
guugguggaucgucgcgaaguc

SEQ ID NO: 23270 - RNA, 22 nt, Mycobacterium avium subsp. paratuberculosis
guuguccggccgcaccccgaag

SEQ ID NO: 23271 - RNA, 22 nt, Mycobacterium avium subsp. paratuberculosis
guuguguugcagugcggcgcug

SEQ ID NO: 23272 - RNA, 22 nt, Mycobacterium avium subsp. paratuberculosis
guuugcccgccgcgccgguuag

SEQ ID NO: 23273 - RNA, 22 nt, Mycobacterium avium subsp. paratuberculosis
uaaguggagcgcguuccgauua

SEQ ID NO: 23274 - RNA, 23 nt, Mycobacterium avium subsp. paratuberculosis
uaccgcgcaccguggcgcucacc

SEQ ID NO: 23275 - RNA, 22 nt, Mycobacterium avium subsp. paratuberculosis
uaccggccggaggccacggcga

SEQ ID NO: 23276 - RNA, 22 nt, Mycobacterium avium subsp. paratuberculosis
uaccggugguguagcuucgaug

SEQ ID NO: 23277 - RNA, 22 nt, Mycobacterium avium subsp. paratuberculosis
uaccugcgcuucgugcgaaugu

SEQ ID NO: 23278 - RNA, 22 nt, Mycobacterium avium subsp. paratuberculosis
uacgacgccgaguggaucgucg

SEQ ID NO: 23279 - RNA, 22 nt, Mycobacterium avium subsp. paratuberculosis
uacgaggacauccgggcgcuga

SEQ ID NO: 23280 - RNA, 22 nt, Mycobacterium avium subsp. paratuberculosis
uacgccggccggucgaugaccu

SEQ ID NO: 23281 - RNA, 22 nt, Mycobacterium avium subsp. paratuberculosis
uacggcggcaacgcgaugaccg

SEQ ID NO: 23282 - RNA, 22 nt, Mycobacterium avium subsp. paratuberculosis
uacgggccguaggagucggcgg

SEQ ID NO: 23283 - RNA, 22 nt, Mycobacterium avium subsp. paratuberculosis
uacguggggcccacgcucgggc

SEQ ID NO: 23284 - RNA, 22 nt, Mycobacterium avium subsp. paratuberculosis
uacuuccuguuccuggcggugc

SEQ ID NO: 23285 - RNA, 22 nt, Mycobacterium avium subsp. paratuberculosis
uagacccggucgggcgcgaggc

SEQ ID NO: 23286 - RNA, 22 nt, Mycobacterium avium subsp. paratuberculosis
uagcggcucagcgcguagaagu

SEQ ID NO: 23287 - RNA, 22 nt, Mycobacterium avium subsp. paratuberculosis
uagugcugggucugcagccggc

SEQ ID NO: 23288 - RNA, 22 nt, Mycobacterium avium subsp. paratuberculosis
uaucgccgugggguuacgcucg

SEQ ID NO: 23289 - RNA, 22 nt, Mycobacterium avium subsp. paratuberculosis
uauugcucagggacuuguguga

SEQ ID NO: 23290 - RNA, 22 nt, Mycobacterium avium subsp. paratuberculosis
ucaacgacgagcagggccacga

SEQ ID NO: 23291 - RNA, 22 nt, Mycobacterium avium subsp. paratuberculosis
ucaacgccaugagcgacgccga

SEQ ID NO: 23292 - RNA, 22 nt, Mycobacterium avium subsp. paratuberculosis
ucaacggcaagccgcugcgcga

SEQ ID NO: 23293 - RNA, 22 nt, Mycobacterium avium subsp. paratuberculosis
ucaacgucaucgccgcggccac

SEQ ID NO: 23294 - RNA, 22 nt, Mycobacterium avium subsp. paratuberculosis
ucaccgacugcggcccggccug

SEQ ID NO: 23295 - RNA, 22 nt, Mycobacterium avium subsp. paratuberculosis
ucaccgagaugucggcgaacgg

SEQ ID NO: 23296 - RNA, 22 nt, Mycobacterium avium subsp. paratuberculosis
ucaccgcggcgaccugguggcc

SEQ ID NO: 23297 - RNA, 22 nt, Mycobacterium avium subsp. paratuberculosis
ucaccgugagugcacguucggu

SEQ ID NO: 23298 - RNA, 22 nt, Mycobacterium avium subsp. paratuberculosis
ucaccugcccuggcaguggggc

SEQ ID NO: 23299 - RNA, 22 nt, Mycobacterium avium subsp. paratuberculosis
ucacgcaacaagucgacguugg

SEQ ID NO: 23300 - RNA, 22 nt, Mycobacterium avium subsp. paratuberculosis
ucacgccagcgugacgcucggg

SEQ ID NO: 23301 - RNA, 22 nt, Mycobacterium avium subsp. paratuberculosis
ucacgccagcgugacggccggc

SEQ ID NO: 23302 - RNA, 23 nt, Mycobacterium avium subsp. paratuberculosis
ucacgcuggcgugacgcucgccg

SEQ ID NO: 23303 - RNA, 22 nt, Mycobacterium avium subsp. paratuberculosis
ucacgcuggcgugacgcucggc

SEQ ID NO: 23304 - RNA, 23 nt, Mycobacterium avium subsp. paratuberculosis
ucacgcuggcgugacgcucggcg

SEQ ID NO: 23305 - RNA, 22 nt, Mycobacterium avium subsp. paratuberculosis
ucacgucgcuggucgugcagcg

SEQ ID NO: 23306 - RNA, 22 nt, Mycobacterium avium subsp. paratuberculosis
ucacgucguaggccgcgaucac

SEQ ID NO: 23307 - RNA, 22 nt, Mycobacterium avium subsp. paratuberculosis
ucagcacgucggugaggugggc

SEQ ID NO: 23308 - RNA, 22 nt, Mycobacterium avium subsp. paratuberculosis
ucagcagcgacggcccggugag

SEQ ID NO: 23309 - RNA, 22 nt, Mycobacterium avium subsp. paratuberculosis
ucagcaggucgaugcgguugcg

SEQ ID NO: 23310 - RNA, 22 nt, Mycobacterium avium subsp. paratuberculosis
ucagccucggccuggacagucg

SEQ ID NO: 23311 - RNA, 22 nt, Mycobacterium avium subsp. paratuberculosis
ucagcgagugcaauucgguccg

SEQ ID NO: 23312 - RNA, 22 nt, Mycobacterium avium subsp. paratuberculosis
ucagcucuucgaccgcgguggc

SEQ ID NO: 23313 - RNA, 22 nt, Mycobacterium avium subsp. paratuberculosis
gcugaaccugauccucaagggc

SEQ ID NO: 23314 - RNA, 22 nt, Mycobacterium avium subsp. paratuberculosis
gcugaccgacgcgggccgguug

SEQ ID NO: 23315 - RNA, 22 nt, Mycobacterium avium subsp. paratuberculosis
gcugacgcuguucgggggucag

SEQ ID NO: 23316 - RNA, 22 nt, Mycobacterium avium subsp. paratuberculosis
gcugacgucggcggcgcuguag

SEQ ID NO: 23317 - RNA, 22 nt, Mycobacterium avium subsp. paratuberculosis
gcugaucagcagccgugacccg

SEQ ID NO: 23318 - RNA, 20 nt, Mycobacterium avium subsp. paratuberculosis
gcugauggcguugcugaugc

SEQ ID NO: 23319 - RNA, 22 nt, Mycobacterium avium subsp. paratuberculosis
gcugauuccgguggccgccaag

SEQ ID NO: 23320 - RNA, 22 nt, Mycobacterium avium subsp. paratuberculosis
gcugcaccgcggugaucggcag

SEQ ID NO: 23321 - RNA, 22 nt, Mycobacterium avium subsp. paratuberculosis
gcugccgacggggccgucauga

SEQ ID NO: 23322 - RNA, 22 nt, Mycobacterium avium subsp. paratuberculosis
gcugccgacgucgaugccgauu

SEQ ID NO: 23323 - RNA, 22 nt, Mycobacterium avium subsp. paratuberculosis
gcugccggugcugggcaccgcg

SEQ ID NO: 23324 - RNA, 22 nt, Mycobacterium avium subsp. paratuberculosis
gcugcgcggcacgguccgguug

SEQ ID NO: 23325 - RNA, 22 nt, Mycobacterium avium subsp. paratuberculosis
gcugcgucaugccguaaguggc

SEQ ID NO: 23326 - RNA, 22 nt, Mycobacterium avium subsp. paratuberculosis
gcugcucgauuucccugcgguu

SEQ ID NO: 23327 - RNA, 22 nt, Mycobacterium avium subsp. paratuberculosis
gcugcugagcgccgccgagacg

SEQ ID NO: 23328 - RNA, 22 nt, Mycobacterium avium subsp. paratuberculosis
gcuggaugacguggucgugcag

SEQ ID NO: 23329 - RNA, 22 nt, Mycobacterium avium subsp. paratuberculosis
gcuggcaugcagcugccgcacg

SEQ ID NO: 23330 - RNA, 19 nt, Mycobacterium avium subsp. paratuberculosis
gcuggccgagcugucccgc

SEQ ID NO: 23331 - RNA, 19 nt, Mycobacterium avium subsp. paratuberculosis
gcugggccuggucgcgucc

SEQ ID NO: 23332 - RNA, 22 nt, Mycobacterium avium subsp. paratuberculosis
gcugggcgaccagcgccuccau

SEQ ID NO: 23333 - RNA, 22 nt, Mycobacterium avium subsp. paratuberculosis
gcugggucagcggcugccggcc

SEQ ID NO: 23334 - RNA, 22 nt, Mycobacterium avium subsp. paratuberculosis
gcuggugaccgaggcgauggug

SEQ ID NO: 23335 - RNA, 22 nt, Mycobacterium avium subsp. paratuberculosis
gcuggugcagccguccagcguc

SEQ ID NO: 23336 - RNA, 22 nt, Mycobacterium avium subsp. paratuberculosis
gcuucggcggaugcggcccggc

SEQ ID NO: 23337 - RNA, 22 nt, Mycobacterium avium subsp. paratuberculosis
gcuucuucgcgcaugcgcugcc

SEQ ID NO: 23338 - RNA, 22 nt, Mycobacterium avium subsp. paratuberculosis
gcuuggugaacucggccagcug

SEQ ID NO: 23339 - RNA, 22 nt, Mycobacterium avium subsp. paratuberculosis
ggacaaggucgaagcgcuggac

SEQ ID NO: 23340 - RNA, 22 nt, Mycobacterium avium subsp. paratuberculosis
ggacaguugcguggcgccggcg

SEQ ID NO: 23341 - RNA, 22 nt, Mycobacterium avium subsp. paratuberculosis
ggaccggcagcccguccacgcu

SEQ ID NO: 23342 - RNA, 22 nt, Mycobacterium avium subsp. paratuberculosis
ggacgccagcaggucggcgacg

SEQ ID NO: 23343 - RNA, 22 nt, Mycobacterium avium subsp. paratuberculosis
ggacgcugauccugggcucguu

SEQ ID NO: 23344 - RNA, 21 nt, Mycobacterium avium subsp. paratuberculosis
ggagaucaccgcagauggcgc

SEQ ID NO: 23345 - RNA, 22 nt, Mycobacterium avium subsp. paratuberculosis
ggaggucggucacggcgccagu

SEQ ID NO: 23346 - RNA, 22 nt, Mycobacterium avium subsp. paratuberculosis
ggaguugacuucucgggcgucg

SEQ ID NO: 23347 - RNA, 22 nt, Mycobacterium avium subsp. paratuberculosis
ggaucgaggacgucgccgacgc

SEQ ID NO: 23348 - RNA, 22 nt, Mycobacterium avium subsp. paratuberculosis
ggaugggugccgcgcugguggc

SEQ ID NO: 23349 - RNA, 22 nt, Mycobacterium avium subsp. paratuberculosis
ggauugagcaugaugccgggcg

SEQ ID NO: 23350 - RNA, 22 nt, Mycobacterium avium subsp. paratuberculosis
ggcacgucgaucuccacgucgg

SEQ ID NO: 23351 - RNA, 22 nt, Mycobacterium avium subsp. paratuberculosis
ggcagcagcgagaagugcaggu

SEQ ID NO: 23352 - RNA, 21 nt, Mycobacterium avium subsp. paratuberculosis
ggcagcgagcuagccgccggc

SEQ ID NO: 23353 - RNA, 22 nt, Mycobacterium avium subsp. paratuberculosis
ggcaggccgcgcuccacgaucu

SEQ ID NO: 23354 - RNA, 22 nt, Mycobacterium avium subsp. paratuberculosis
ggcaguaguuggauuccgcggc

SEQ ID NO: 23355 - RNA, 22 nt, Mycobacterium avium subsp. paratuberculosis
ggcagucgacgaugccccaggc

SEQ ID NO: 23356 - RNA, 22 nt, Mycobacterium avium subsp. paratuberculosis
ggcaucgacaaccggcucgccg

SEQ ID NO: 23357 - RNA, 22 nt, Mycobacterium avium subsp. paratuberculosis
ggcaugcaguuuggacacgucc

SEQ ID NO: 23358 - RNA, 22 nt, Mycobacterium avium subsp. paratuberculosis
ggccaccaccaggucggcgucg

SEQ ID NO: 23359 - RNA, 20 nt, Mycobacterium avium subsp. paratuberculosis
ggccaccacuacgucgccga

SEQ ID NO: 23360 - RNA, 22 nt, Mycobacterium avium subsp. paratuberculosis
ggccaccagcgccgagagccgg

SEQ ID NO: 23361 - RNA, 22 nt, Mycobacterium avium subsp. paratuberculosis
ggccaccgcgaucaucggcuac

SEQ ID NO: 23362 - RNA, 22 nt, Mycobacterium avium subsp. paratuberculosis
ggccacgucgaagcccggguau

SEQ ID NO: 23363 - RNA, 22 nt, Mycobacterium avium subsp. paratuberculosis
ggccagcugcauggcgaccucg

SEQ ID NO: 23364 - RNA, 22 nt, Mycobacterium avium subsp. paratuberculosis
ggccccgcgaguacggcggcca

SEQ ID NO: 23365 - RNA, 22 nt, Mycobacterium avium subsp. paratuberculosis
ggcccugugcacagccucgggu

SEQ ID NO: 23366 - RNA, 22 nt, Mycobacterium avium subsp. paratuberculosis
ggccgaguuccgcgugaucgac

SEQ ID NO: 23367 - RNA, 21 nt, Mycobacterium avium subsp. paratuberculosis
ggccgcaccgucaacaucgcc

SEQ ID NO: 23368 - RNA, 22 nt, Mycobacterium avium subsp. paratuberculosis
ggccgcgagccgaugauccaca

SEQ ID NO: 23369 - RNA, 22 nt, Mycobacterium avium subsp. paratuberculosis
ggccgcggcccgggucgagccu

SEQ ID NO: 23370 - RNA, 22 nt, Mycobacterium avium subsp. paratuberculosis
ggccgcugcuggccggggagag

SEQ ID NO: 23371 - RNA, 22 nt, Mycobacterium avium subsp. paratuberculosis
ggccggauccggcugcacgugc

SEQ ID NO: 23372 - RNA, 22 nt, Mycobacterium avium subsp. paratuberculosis
ggccggccgccgggccggucau

SEQ ID NO: 23373 - RNA, 22 nt, Mycobacterium avium subsp. paratuberculosis
ggccgucguugaggauguacgg

SEQ ID NO: 23374 - RNA, 22 nt, Mycobacterium avium subsp. paratuberculosis
ggccuggggauggucggcgucg

SEQ ID NO: 23375 - RNA, 22 nt, Mycobacterium avium subsp. paratuberculosis
ggcgaccagcucgaucgugaug

SEQ ID NO: 23376 - RNA, 22 nt, Mycobacterium avium subsp. paratuberculosis
ggcgagcagacgcaaaagcccc

SEQ ID NO: 23377 - RNA, 22 nt, Mycobacterium avium subsp. paratuberculosis
ggcgaggauuccggugugucgu

SEQ ID NO: 23378 - RNA, 22 nt, Mycobacterium avium subsp. paratuberculosis
ggcgaucagcaucgcgggccgg

SEQ ID NO: 23379 - RNA, 22 nt, Mycobacterium avium subsp. paratuberculosis
ggcgaucgggccgaucgccgug

SEQ ID NO: 23380 - RNA, 22 nt, Mycobacterium avium subsp. paratuberculosis
ggcgcauguugguuugcgcguu

SEQ ID NO: 23381 - RNA, 22 nt, Mycobacterium avium subsp. paratuberculosis
ggcgccacgcggaaucgccagc

SEQ ID NO: 23382 - RNA, 22 nt, Mycobacterium avium subsp. paratuberculosis
ggcgcccgcggcuucguggugu

SEQ ID NO: 23383 - RNA, 22 nt, Mycobacterium avium subsp. paratuberculosis
ggcgccgccuaucugccgaucg

SEQ ID NO: 23384 - RNA, 22 nt, Mycobacterium avium subsp. paratuberculosis
gcauggcccugcccgucgucag

SEQ ID NO: 23385 - RNA, 22 nt, Mycobacterium avium subsp. paratuberculosis
gcauggccgcggcgauccgcag

SEQ ID NO: 23386 - RNA, 22 nt, Mycobacterium avium subsp. paratuberculosis
gccacaccaggucgugcucggc

SEQ ID NO: 23387 - RNA, 22 nt, Mycobacterium avium subsp. paratuberculosis
gccaccagggugggcaggcuca

SEQ ID NO: 23388 - RNA, 22 nt, Mycobacterium avium subsp. paratuberculosis
gccacccgguggauccguuccc

SEQ ID NO: 23389 - RNA, 22 nt, Mycobacterium avium subsp. paratuberculosis
gccacccugcugggcaugcugg

SEQ ID NO: 23390 - RNA, 21 nt, Mycobacterium avium subsp. paratuberculosis
gccacgaagggcaggaucgcg

SEQ ID NO: 23391 - RNA, 22 nt, Mycobacterium avium subsp. paratuberculosis
gccacgcuggcgugacgcucgc

SEQ ID NO: 23392 - RNA, 22 nt, Mycobacterium avium subsp. paratuberculosis
gccagcaccgcgcugugcgugg

SEQ ID NO: 23393 - RNA, 22 nt, Mycobacterium avium subsp. paratuberculosis
gccagggucgguucgggcagag

SEQ ID NO: 23394 - RNA, 22 nt, Mycobacterium avium subsp. paratuberculosis
gccagguuguuguuggugcggc

SEQ ID NO: 23395 - RNA, 22 nt, Mycobacterium avium subsp. paratuberculosis
gccaugucggugacguugucga

SEQ ID NO: 23396 - RNA, 22 nt, Mycobacterium avium subsp. paratuberculosis
gcccccucgaaacgguuguccc

SEQ ID NO: 23397 - RNA, 22 nt, Mycobacterium avium subsp. paratuberculosis
gcccgaccaggacaugcugagc

SEQ ID NO: 23398 - RNA, 22 nt, Mycobacterium avium subsp. paratuberculosis
gcccgagcugggcaccacgauc

SEQ ID NO: 23399 - RNA, 22 nt, Mycobacterium avium subsp. paratuberculosis
gcccgccucugagcgacaauca

SEQ ID NO: 23400 - RNA, 20 nt, Mycobacterium avium subsp. paratuberculosis
gcccgcucggcuggcugccg

SEQ ID NO: 23401 - RNA, 22 nt, Mycobacterium avium subsp. paratuberculosis
gcccgcuguccgugugcucgag

SEQ ID NO: 23402 - RNA, 22 nt, Mycobacterium avium subsp. paratuberculosis
gcccggaaucaaccggcgcgcc

SEQ ID NO: 23403 - RNA, 22 nt, Mycobacterium avium subsp. paratuberculosis
gcccggaaucgagcggccacga

SEQ ID NO: 23404 - RNA, 20 nt, Mycobacterium avium subsp. paratuberculosis
gcccggaucgccgaacgcgg

SEQ ID NO: 23405 - RNA, 22 nt, Mycobacterium avium subsp. paratuberculosis
gcccggccaccuggucggguuc

SEQ ID NO: 23406 - RNA, 22 nt, Mycobacterium avium subsp. paratuberculosis
gcccgggggaagcuccugcugc

SEQ ID NO: 23407 - RNA, 22 nt, Mycobacterium avium subsp. paratuberculosis
gccgaacgugcaccuacugcga

SEQ ID NO: 23408 - RNA, 22 nt, Mycobacterium avium subsp. paratuberculosis
gccgaacgugcacuggcggcga

SEQ ID NO: 23409 - RNA, 22 nt, Mycobacterium avium subsp. paratuberculosis
gccgaacguguacucgcggcga

SEQ ID NO: 23410 - RNA, 22 nt, Mycobacterium avium subsp. paratuberculosis
gccgaacguguagcuguugcga

SEQ ID NO: 23411 - RNA, 22 nt, Mycobacterium avium subsp. paratuberculosis
gccgagcgucacgccagcguga

SEQ ID NO: 23412 - RNA, 22 nt, Mycobacterium avium subsp. paratuberculosis
gccgagcgucacgccagugugg

SEQ ID NO: 23413 - RNA, 19 nt, Mycobacterium avium subsp. paratuberculosis
gccgaucagcaaccgggca

SEQ ID NO: 23414 - RNA, 22 nt, Mycobacterium avium subsp. paratuberculosis
gccgaugcguuccacgaugccc

SEQ ID NO: 23415 - RNA, 22 nt, Mycobacterium avium subsp. paratuberculosis
gccgauguaguucuugcggucg

SEQ ID NO: 23416 - RNA, 22 nt, Mycobacterium avium subsp. paratuberculosis
gccgcccgcaccggugagggug

SEQ ID NO: 23417 - RNA, 22 nt, Mycobacterium avium subsp. paratuberculosis
gccgccggccuggugcugggug

SEQ ID NO: 23418 - RNA, 22 nt, Mycobacterium avium subsp. paratuberculosis
gccgccggugacggacuguucg

SEQ ID NO: 23419 - RNA, 22 nt, Mycobacterium avium subsp. paratuberculosis
gccgccgguuacucggccacgc

SEQ ID NO: 23420 - RNA, 22 nt, Mycobacterium avium subsp. paratuberculosis
gccgcgagagugcaacuaccga

SEQ ID NO: 23421 - RNA, 22 nt, Mycobacterium avium subsp. paratuberculosis
gccgcggauccgcgucacggca

SEQ ID NO: 23422 - RNA, 22 nt, Mycobacterium avium subsp. paratuberculosis
gccggcaugcuggucaccgggc

SEQ ID NO: 23423 - RNA, 22 nt, Mycobacterium avium subsp. paratuberculosis
gccggccgggugagcugaucga

SEQ ID NO: 23424 - RNA, 18 nt, Mycobacterium avium subsp. paratuberculosis
gccggcucgacaugguug

SEQ ID NO: 23425 - RNA, 22 nt, Mycobacterium avium subsp. paratuberculosis
gccggcugcucggaggcugcga

SEQ ID NO: 23426 - RNA, 22 nt, Mycobacterium avium subsp. paratuberculosis
gccgggaugcgugcgguggcgg

SEQ ID NO: 23427 - RNA, 22 nt, Mycobacterium avium subsp. paratuberculosis
gccgggcugccggucugcgccg

SEQ ID NO: 23428 - RNA, 22 nt, Mycobacterium avium subsp. paratuberculosis
gccggggcaucgccggaauggc

SEQ ID NO: 23429 - RNA, 22 nt, Mycobacterium avium subsp. paratuberculosis
gccgggugcugaacgccugaug

SEQ ID NO: 23430 - RNA, 22 nt, Mycobacterium avium subsp. paratuberculosis
gccgguagcguucguaggcgag

SEQ ID NO: 23431 - RNA, 22 nt, Mycobacterium avium subsp. paratuberculosis
gccggucauggcgcuggccuga

SEQ ID NO: 23432 - RNA, 22 nt, Mycobacterium avium subsp. paratuberculosis
gccggucggcgacgacccggcg

SEQ ID NO: 23433 - RNA, 22 nt, Mycobacterium avium subsp. paratuberculosis
gccggugacgugcgucgucucg

SEQ ID NO: 23434 - RNA, 22 nt, Mycobacterium avium subsp. paratuberculosis
gccggugccguggucugcgccg

SEQ ID NO: 23435 - RNA, 22 nt, Mycobacterium avium subsp. paratuberculosis
gccgguguugccgguggcgcga

SEQ ID NO: 23436 - RNA, 22 nt, Mycobacterium avium subsp. paratuberculosis
gccguagaacgacgccgugucg

SEQ ID NO: 23437 - RNA, 22 nt, Mycobacterium avium subsp. paratuberculosis
gccgucgaacugcagccggcca

SEQ ID NO: 23438 - RNA, 22 nt, Mycobacterium avium subsp. paratuberculosis
gccgucuugcuccucgagccgc

SEQ ID NO: 23439 - RNA, 22 nt, Mycobacterium avium subsp. paratuberculosis
gccucgcugauggacaucgaca

SEQ ID NO: 23440 - RNA, 22 nt, Mycobacterium avium subsp. paratuberculosis
gccucggcgccgaauccguuga

SEQ ID NO: 23441 - RNA, 22 nt, Mycobacterium avium subsp. paratuberculosis
gccucgggcagcaggucgucga

SEQ ID NO: 23442 - RNA, 22 nt, Mycobacterium avium subsp. paratuberculosis
gccugcaccagcaacaccgagc

SEQ ID NO: 23443 - RNA, 22 nt, Mycobacterium avium subsp. paratuberculosis
gccugcagauaguccagcgugu

SEQ ID NO: 23444 - RNA, 22 nt, Mycobacterium avium subsp. paratuberculosis
gccugcagcccuggacgucucg

SEQ ID NO: 23445 - RNA, 20 nt, Mycobacterium avium subsp. paratuberculosis
gccugcauggccgccugggc

SEQ ID NO: 23446 - RNA, 22 nt, Mycobacterium avium subsp. paratuberculosis
gccuggcauagaucuccggauu

SEQ ID NO: 23447 - RNA, 22 nt, Mycobacterium avium subsp. paratuberculosis
gccuucggauccugcuggccga

SEQ ID NO: 23448 - RNA, 22 nt, Mycobacterium avium subsp. paratuberculosis
gccuucucacgcgccagcuuga

SEQ ID NO: 23449 - RNA, 22 nt, Mycobacterium avium subsp. paratuberculosis
gcgaaaggucguggcgggcgaa

SEQ ID NO: 23450 - RNA, 22 nt, Mycobacterium avium subsp. paratuberculosis
gcgaccgaugccagcguguggc

SEQ ID NO: 23451 - RNA, 21 nt, Mycobacterium avium subsp. paratuberculosis
gcgaccucggucgcgugcggc

SEQ ID NO: 23452 - RNA, 22 nt, Mycobacterium avium subsp. paratuberculosis
gcgacgacggcucgaucgaggg

SEQ ID NO: 23453 - RNA, 22 nt, Mycobacterium avium subsp. paratuberculosis
gcgagcccguccaggucgugcu

SEQ ID NO: 23454 - RNA, 22 nt, Mycobacterium avium subsp. paratuberculosis
gcgaggcgggcgucagccggga

SEQ ID NO: 23455 - RNA, 20 nt, Mycobacterium avium subsp. paratuberculosis
gcgagggcuucuucuacggc

SEQ ID NO: 23456 - RNA, 22 nt, Mycobacterium avium subsp. paratuberculosis
gcgaggucagacaccggggguc

SEQ ID NO: 23457 - RNA, 22 nt, Mycobacterium avium subsp. paratuberculosis
gcgaggucaugcggacccgcac

SEQ ID NO: 23458 - RNA, 23 nt, Mycobacterium avium subsp. paratuberculosis
gcgaugcugaucaaccugcugcg

SEQ ID NO: 23459 - RNA, 22 nt, Mycobacterium avium subsp. paratuberculosis
gcgaugguuucggcgacgucca

SEQ ID NO: 23460 - RNA, 22 nt, Mycobacterium avium subsp. paratuberculosis
gcgcacuggcuggcgucggccg

SEQ ID NO: 23461 - RNA, 22 nt, Mycobacterium avium subsp. paratuberculosis
gcgcagugggugcagcucgacg

SEQ ID NO: 23462 - RNA, 22 nt, Mycobacterium avium subsp. paratuberculosis
gcgccaaggugccggcauagcg

SEQ ID NO: 23463 - RNA, 22 nt, Mycobacterium avium subsp. paratuberculosis
gcgccauguguucggcgacggc

SEQ ID NO: 23464 - RNA, 22 nt, Mycobacterium avium subsp. paratuberculosis
gcgcccgguagucgcagucgua

SEQ ID NO: 23465 - RNA, 22 nt, Mycobacterium avium subsp. paratuberculosis
gcgccgagcgugggggcuacgu

SEQ ID NO: 23466 - RNA, 22 nt, Mycobacterium avium subsp. paratuberculosis
gcgccgagcgugggggcugugc

SEQ ID NO: 23467 - RNA, 22 nt, Mycobacterium avium subsp. paratuberculosis
gcgccgcaucgagauugcgcug

SEQ ID NO: 23468 - RNA, 22 nt, Mycobacterium avium subsp. paratuberculosis
gcgccguacuugugcaccucga

SEQ ID NO: 23469 - RNA, 22 nt, Mycobacterium avium subsp. paratuberculosis
gcgccguucauggucaucgaca

SEQ ID NO: 23470 - RNA, 22 nt, Mycobacterium avium subsp. paratuberculosis
gcgcgagcagacacaauagcgc

SEQ ID NO: 23471 - RNA, 22 nt, Mycobacterium avium subsp. paratuberculosis
gcgcgcacacacugcugaccac

SEQ ID NO: 23472 - RNA, 22 nt, Mycobacterium avium subsp. paratuberculosis
gcgcgcaggaugcggucgucgu

SEQ ID NO: 23473 - RNA, 22 nt, Mycobacterium avium subsp. paratuberculosis
gcgcgcucggucgugguggacg

SEQ ID NO: 23474 - RNA, 22 nt, Mycobacterium avium subsp. paratuberculosis
gcgcggauuuauucggguccgg

SEQ ID NO: 23475 - RNA, 22 nt, Mycobacterium avium subsp. paratuberculosis
gcgcggcaucgagcugguggug

SEQ ID NO: 23476 - RNA, 22 nt, Mycobacterium avium subsp. paratuberculosis
gcgcggccucgauccacucguc

SEQ ID NO: 23477 - RNA, 22 nt, Mycobacterium avium subsp. paratuberculosis
gcgcgguaggacggguggcgac

SEQ ID NO: 23478 - RNA, 22 nt, Mycobacterium avium subsp. paratuberculosis
gcgcggugaucaugcuggucau

SEQ ID NO: 23479 - RNA, 22 nt, Mycobacterium avium subsp. paratuberculosis
gcgcgguguccgggaucgggac

SEQ ID NO: 23480 - RNA, 22 nt, Mycobacterium avium subsp. paratuberculosis
gcgcguuggugccugaguugcc

SEQ ID NO: 23481 - RNA, 22 nt, Mycobacterium avium subsp. paratuberculosis
gcgcucaucaucugcuuggccu

SEQ ID NO: 23482 - RNA, 22 nt, Mycobacterium avium subsp. paratuberculosis
gcgcucguaacgccacggcgga

SEQ ID NO: 23483 - RNA, 22 nt, Mycobacterium avium subsp. paratuberculosis
gcggagcacuccugguaugaac

SEQ ID NO: 23484 - RNA, 22 nt, Mycobacterium avium subsp. paratuberculosis
gcggcacuggaggcguugccgc

SEQ ID NO: 23485 - RNA, 22 nt, Mycobacterium avium subsp. paratuberculosis
gcggccagcccauugacgucgc

SEQ ID NO: 23486 - RNA, 22 nt, Mycobacterium avium subsp. paratuberculosis
gcggccugguugagcgcguugu

SEQ ID NO: 23487 - RNA, 22 nt, Mycobacterium avium subsp. paratuberculosis
gcggcgagaagggcaccgccaa

SEQ ID NO: 23488 - RNA, 22 nt, Mycobacterium avium subsp. paratuberculosis
gcggcgaugcggcgcugggaca

SEQ ID NO: 23489 - RNA, 22 nt, Mycobacterium avium subsp. paratuberculosis
gcggcgcagaagggaucgguga

SEQ ID NO: 23490 - RNA, 22 nt, Mycobacterium avium subsp. paratuberculosis
gcggcgcagcggcgaggucaac

SEQ ID NO: 23491 - RNA, 22 nt, Mycobacterium avium subsp. paratuberculosis
gcggcgcagcgucugauacacg

SEQ ID NO: 23492 - RNA, 22 nt, Mycobacterium avium subsp. paratuberculosis
gcggcggagaaguuguggauga

SEQ ID NO: 23493 - RNA, 22 nt, Mycobacterium avium subsp. paratuberculosis
gcggcgggcugaccaccaacgc

SEQ ID NO: 23494 - RNA, 22 nt, Mycobacterium avium subsp. paratuberculosis
gcggcggucgaggagcuggugg

SEQ ID NO: 23495 - RNA, 22 nt, Mycobacterium avium subsp. paratuberculosis
gcggcgucggcuucgccccgug

SEQ ID NO: 23496 - RNA, 22 nt, Mycobacterium avium subsp. paratuberculosis
gcgggacagcucggccagcgcg

SEQ ID NO: 23497 - RNA, 22 nt, Mycobacterium avium subsp. paratuberculosis
gcgggcaacgucgggcacgccg

SEQ ID NO: 23498 - RNA, 22 nt, Mycobacterium avium subsp. paratuberculosis
gcgggccgucgaacucggggug

SEQ ID NO: 23499 - RNA, 22 nt, Mycobacterium avium subsp. paratuberculosis
gcgggcgcuacuucgagaaccc

SEQ ID NO: 23500 - RNA, 22 nt, Mycobacterium avium subsp. paratuberculosis
gcggguggaccccgacgcgcug

SEQ ID NO: 23501 - RNA, 22 nt, Mycobacterium avium subsp. paratuberculosis
gcggguugccgaucacggcggg

SEQ ID NO: 23502 - RNA, 22 nt, Mycobacterium avium subsp. paratuberculosis
gcggucgaggccgccuugccga

SEQ ID NO: 23503 - RNA, 22 nt, Mycobacterium avium subsp. paratuberculosis
gcggugaauccgaauucacgga

SEQ ID NO: 23504 - RNA, 22 nt, Mycobacterium avium subsp. paratuberculosis
gcggugcugguggccgacgagu

SEQ ID NO: 23505 - RNA, 22 nt, Mycobacterium avium subsp. paratuberculosis
gcgguggagcugccgggaaucg

SEQ ID NO: 23506 - RNA, 23 nt, Mycobacterium avium subsp. paratuberculosis
gcgguggaggucucgccgccgcc

SEQ ID NO: 23507 - RNA, 22 nt, Mycobacterium avium subsp. paratuberculosis
gcgguggauggccaccaccaau

SEQ ID NO: 23508 - RNA, 22 nt, Mycobacterium avium subsp. paratuberculosis
gcgguggccaucggcacgcuga

SEQ ID NO: 23509 - RNA, 22 nt, Mycobacterium avium subsp. paratuberculosis
gcgguggcguugcuguccuacc

SEQ ID NO: 23510 - RNA, 22 nt, Mycobacterium avium subsp. paratuberculosis
gcguaguaccaccaccggcccu

SEQ ID NO: 23511 - RNA, 22 nt, Mycobacterium avium subsp. paratuberculosis
gcgucacgccagcgugacgcuc

SEQ ID NO: 23512 - RNA, 22 nt, Mycobacterium avium subsp. paratuberculosis
gcgucacgcuggcgugacgcuc

SEQ ID NO: 23513 - RNA, 20 nt, Mycobacterium avium subsp. paratuberculosis
gcgucccggacgagcgugcg

SEQ ID NO: 23514 - RNA, 22 nt, Mycobacterium avium subsp. paratuberculosis
gcgucgaucucuucacggaugg

SEQ ID NO: 23515 - RNA, 22 nt, Mycobacterium avium subsp. paratuberculosis
gcgucgaugucgaccacguugg

SEQ ID NO: 23516 - RNA, 22 nt, Mycobacterium avium subsp. paratuberculosis
gcgucgcugaucgccgucgaug

SEQ ID NO: 23517 - RNA, 22 nt, Mycobacterium avium subsp. paratuberculosis
gcgugcaggcccgccacgucuc

SEQ ID NO: 23518 - RNA, 22 nt, Mycobacterium avium subsp. paratuberculosis
gcgugccgggucugccgguagu

SEQ ID NO: 23519 - RNA, 22 nt, Mycobacterium avium subsp. paratuberculosis
gcgugcuugaugacguaguuga

SEQ ID NO: 23520 - RNA, 22 nt, Mycobacterium avium subsp. paratuberculosis
gcguggucgcggugaacagcug

SEQ ID NO: 23521 - RNA, 22 nt, Mycobacterium avium subsp. paratuberculosis
gcguugcugauccugucagcgg

SEQ ID NO: 23522 - RNA, 23 nt, Mycobacterium avium subsp. paratuberculosis
gcuaccaccgguguacggcggga

SEQ ID NO: 23523 - RNA, 22 nt, Mycobacterium avium subsp. paratuberculosis
gcucaggcuaugcaagcaggcc

SEQ ID NO: 23524 - RNA, 22 nt, Mycobacterium avium subsp. paratuberculosis
gcucgagcauguucgccauggu

SEQ ID NO: 23525 - RNA, 22 nt, Mycobacterium avium subsp. paratuberculosis
gcucuucuaccaccgguaucgg

SEQ ID NO: 23526 - RNA, 22 nt, Mycobacterium avium subsp. paratuberculosis
cugauucggcaaguucucgagg

SEQ ID NO: 23527 - RNA, 22 nt, Mycobacterium avium subsp. paratuberculosis
cugcaccgacaggccgcuggaa

SEQ ID NO: 23528 - RNA, 22 nt, Mycobacterium avium subsp. paratuberculosis
cugcacgugcugcucaucccgg

SEQ ID NO: 23529 - RNA, 22 nt, Mycobacterium avium subsp. paratuberculosis
cugcagauccgagaggguguuc

SEQ ID NO: 23530 - RNA, 20 nt, Mycobacterium avium subsp. paratuberculosis
cugccccggcgggauggcga

SEQ ID NO: 23531 - RNA, 23 nt, Mycobacterium avium subsp. paratuberculosis
cugcccggcauggucgccucggc

SEQ ID NO: 23532 - RNA, 22 nt, Mycobacterium avium subsp. paratuberculosis
cugcccgggcccgauggcggcc

SEQ ID NO: 23533 - RNA, 22 nt, Mycobacterium avium subsp. paratuberculosis
cugcccgucgcucgucggguug

SEQ ID NO: 23534 - RNA, 22 nt, Mycobacterium avium subsp. paratuberculosis
cugccgaaagugcaacuggcga

SEQ ID NO: 23535 - RNA, 22 nt, Mycobacterium avium subsp. paratuberculosis
cugccgcgcacggucgacgaga

SEQ ID NO: 23536 - RNA, 22 nt, Mycobacterium avium subsp. paratuberculosis
cugccgguaucccucgccgguc

SEQ ID NO: 23537 - RNA, 22 nt, Mycobacterium avium subsp. paratuberculosis
cugccgguuguuggugcgggcg

SEQ ID NO: 23538 - RNA, 22 nt, Mycobacterium avium subsp. paratuberculosis
cugccguugucgguggcgacga

SEQ ID NO: 23539 - RNA, 22 nt, Mycobacterium avium subsp. paratuberculosis
cugcgcgaccuggcggugacgu

SEQ ID NO: 23540 - RNA, 22 nt, Mycobacterium avium subsp. paratuberculosis
cugcgcuucgcggugaccggcg

SEQ ID NO: 23541 - RNA, 22 nt, Mycobacterium avium subsp. paratuberculosis
cugcggcugcugucgaacauca

SEQ ID NO: 23542 - RNA, 22 nt, Mycobacterium avium subsp. paratuberculosis
cugcgggcgcgguccacgguga

SEQ ID NO: 23543 - RNA, 22 nt, Mycobacterium avium subsp. paratuberculosis
cugcgugcucuacgccugcgag

SEQ ID NO: 23544 - RNA, 22 nt, Mycobacterium avium subsp. paratuberculosis
cugcuggacagccugcuguccg

SEQ ID NO: 23545 - RNA, 21 nt, Mycobacterium avium subsp. paratuberculosis
cugcuggcccaccaggccguc

SEQ ID NO: 23546 - RNA, 22 nt, Mycobacterium avium subsp. paratuberculosis
cugcuggugacccgggacuggu

SEQ ID NO: 23547 - RNA, 22 nt, Mycobacterium avium subsp. paratuberculosis
cugcuggugcggcuggccggcg

SEQ ID NO: 23548 - RNA, 22 nt, Mycobacterium avium subsp. paratuberculosis
cuggccagcuugcgggccgacu

SEQ ID NO: 23549 - RNA, 22 nt, Mycobacterium avium subsp. paratuberculosis
cuggccgaccugaucgugcugg

SEQ ID NO: 23550 - RNA, 22 nt, Mycobacterium avium subsp. paratuberculosis
cuggccggccucgacccggucg

SEQ ID NO: 23551 - RNA, 22 nt, Mycobacterium avium subsp. paratuberculosis
cuggccggcgccucgaucgccg

SEQ ID NO: 23552 - RNA, 22 nt, Mycobacterium avium subsp. paratuberculosis
cuggccgucggugaccacgucg

SEQ ID NO: 23553 - RNA, 22 nt, Mycobacterium avium subsp. paratuberculosis
cuggcgccgaaguccgcggcga

SEQ ID NO: 23554 - RNA, 22 nt, Mycobacterium avium subsp. paratuberculosis
cuggcugacgucagcgacuucg

SEQ ID NO: 23555 - RNA, 22 nt, Mycobacterium avium subsp. paratuberculosis
cuggcuggagccgcaggcccgg

SEQ ID NO: 23556 - RNA, 22 nt, Mycobacterium avium subsp. paratuberculosis
cugggcuucugggacaucacgg

SEQ ID NO: 23557 - RNA, 22 nt, Mycobacterium avium subsp. paratuberculosis
cugggugcgugccgcacucgaa

SEQ ID NO: 23558 - RNA, 22 nt, Mycobacterium avium subsp. paratuberculosis
cuggguggugcuggccgacccc

SEQ ID NO: 23559 - RNA, 22 nt, Mycobacterium avium subsp. paratuberculosis
cuggucggggaaugcgcgcagg

SEQ ID NO: 23560 - RNA, 22 nt, Mycobacterium avium subsp. paratuberculosis
cuguccggacaggcggccgacc

SEQ ID NO: 23561 - RNA, 22 nt, Mycobacterium avium subsp. paratuberculosis
cugugcgagcccggcgguagcg

SEQ ID NO: 23562 - RNA, 22 nt, Mycobacterium avium subsp. paratuberculosis
cuucuugcgauugcggcuggcg

SEQ ID NO: 23563 - RNA, 22 nt, Mycobacterium avium subsp. paratuberculosis
cuugccgaccgcgucgggaucg

SEQ ID NO: 23564 - RNA, 22 nt, Mycobacterium avium subsp. paratuberculosis
cuugccgacgugcguugccggu

SEQ ID NO: 23565 - RNA, 22 nt, Mycobacterium avium subsp. paratuberculosis
cuugccggccauccggaugacg

SEQ ID NO: 23566 - RNA, 22 nt, Mycobacterium avium subsp. paratuberculosis
cuuggucugcaacgcguugacc

SEQ ID NO: 23567 - RNA, 22 nt, Mycobacterium avium subsp. paratuberculosis
cuuugaaauaggcgugcaggcg

SEQ ID NO: 23568 - RNA, 22 nt, Mycobacterium avium subsp. paratuberculosis
gaacgggugcacauggucggca

SEQ ID NO: 23569 - RNA, 22 nt, Mycobacterium avium subsp. paratuberculosis
gaacuugcgacaacggguuggu

SEQ ID NO: 23570 - RNA, 22 nt, Mycobacterium avium subsp. paratuberculosis
gaagacgcaaaagcccccgcac

SEQ ID NO: 23571 - RNA, 22 nt, Mycobacterium avium subsp. paratuberculosis
gaaggucggcaccgugucggac

SEQ ID NO: 23572 - RNA, 22 nt, Mycobacterium avium subsp. paratuberculosis
gaaggugaaguuggcguuguug

SEQ ID NO: 23573 - RNA, 22 nt, Mycobacterium avium subsp. paratuberculosis
gaaugaucaaggugggcaccgu

SEQ ID NO: 23574 - RNA, 22 nt, Mycobacterium avium subsp. paratuberculosis
gacaccuucaucggcucgccgc

SEQ ID NO: 23575 - RNA, 22 nt, Mycobacterium avium subsp. paratuberculosis
gacacgucgacguugaggucgu

SEQ ID NO: 23576 - RNA, 22 nt, Mycobacterium avium subsp. paratuberculosis
gaccacccacgacgggcugcuc

SEQ ID NO: 23577 - RNA, 22 nt, Mycobacterium avium subsp. paratuberculosis
gaccaugucgcggcgcagccgc

SEQ ID NO: 23578 - RNA, 22 nt, Mycobacterium avium subsp. paratuberculosis
gacccccggugucugaccucgc

SEQ ID NO: 23579 - RNA, 22 nt, Mycobacterium avium subsp. paratuberculosis
gaccgaggcgggguugacgccc

SEQ ID NO: 23580 - RNA, 22 nt, Mycobacterium avium subsp. paratuberculosis
gaccgcgucgcugcugggcagc

SEQ ID NO: 23581 - RNA, 22 nt, Mycobacterium avium subsp. paratuberculosis
gaccggauccagcguucggggc

SEQ ID NO: 23582 - RNA, 22 nt, Mycobacterium avium subsp. paratuberculosis
gaccgucacgcuggcgugacac

SEQ ID NO: 23583 - RNA, 22 nt, Mycobacterium avium subsp. paratuberculosis
gacgaacagucgcuggacgcgg

SEQ ID NO: 23584 - RNA, 22 nt, Mycobacterium avium subsp. paratuberculosis
gacgacagaccuuccucggccg

SEQ ID NO: 23585 - RNA, 22 nt, Mycobacterium avium subsp. paratuberculosis
gacgacaucgagcggcuagugg

SEQ ID NO: 23586 - RNA, 22 nt, Mycobacterium avium subsp. paratuberculosis
gacgacgccgggugacagcgcc

SEQ ID NO: 23587 - RNA, 22 nt, Mycobacterium avium subsp. paratuberculosis
gacgaggguggucaugacuguu

SEQ ID NO: 23588 - RNA, 22 nt, Mycobacterium avium subsp. paratuberculosis
gacgccgcaccgaucgggcggg

SEQ ID NO: 23589 - RNA, 22 nt, Mycobacterium avium subsp. paratuberculosis
gacgcgugccguacgccguagc

SEQ ID NO: 23590 - RNA, 22 nt, Mycobacterium avium subsp. paratuberculosis
gacggcaccaccagcgaggugc

SEQ ID NO: 23591 - RNA, 22 nt, Mycobacterium avium subsp. paratuberculosis
gacggccucgucggucauguag

SEQ ID NO: 23592 - RNA, 22 nt, Mycobacterium avium subsp. paratuberculosis
gacgggccaguauuacgccaac

SEQ ID NO: 23593 - RNA, 22 nt, Mycobacterium avium subsp. paratuberculosis
gacggugcagcgcucaucuacu

SEQ ID NO: 23594 - RNA, 22 nt, Mycobacterium avium subsp. paratuberculosis
gacggugcugaucgucgcgcac

SEQ ID NO: 23595 - RNA, 22 nt, Mycobacterium avium subsp. paratuberculosis
gacguucggcgcgcaguggcug

SEQ ID NO: 23596 - RNA, 20 nt, Mycobacterium avium subsp. paratuberculosis
gacguucuccacgcugcggc

SEQ ID NO: 23597 - RNA, 22 nt, Mycobacterium avium subsp. paratuberculosis
gacuccagcguggcggccacca

SEQ ID NO: 23598 - RNA, 22 nt, Mycobacterium avium subsp. paratuberculosis
gagaaccaguccucgggcguca

SEQ ID NO: 23599 - RNA, 22 nt, Mycobacterium avium subsp. paratuberculosis
gagaaccuccgagugaagugcg

SEQ ID NO: 23600 - RNA, 22 nt, Mycobacterium avium subsp. paratuberculosis
gagacgagcgccuguaugaccg

SEQ ID NO: 23601 - RNA, 22 nt, Mycobacterium avium subsp. paratuberculosis
gagauugcaaccacgcacaucc

SEQ ID NO: 23602 - RNA, 22 nt, Mycobacterium avium subsp. paratuberculosis
gagcagacacaaaagcacccga

SEQ ID NO: 23603 - RNA, 22 nt, Mycobacterium avium subsp. paratuberculosis
gagcagacgcaaaagcccccga

SEQ ID NO: 23604 - RNA, 22 nt, Mycobacterium avium subsp. paratuberculosis
gagcagacgcaaaagccccuga

SEQ ID NO: 23605 - RNA, 22 nt, Mycobacterium avium subsp. paratuberculosis
gagcagcugcuugaucaugguc

SEQ ID NO: 23606 - RNA, 22 nt, Mycobacterium avium subsp. paratuberculosis
gagcgcgauccacugcgcaccg

SEQ ID NO: 23607 - RNA, 22 nt, Mycobacterium avium subsp. paratuberculosis
gagcgggcccuggaucggguca

SEQ ID NO: 23608 - RNA, 22 nt, Mycobacterium avium subsp. paratuberculosis
gagcguaaccccacggcgauaa

SEQ ID NO: 23609 - RNA, 22 nt, Mycobacterium avium subsp. paratuberculosis
gagcgucacgccagcgugacgc

SEQ ID NO: 23610 - RNA, 22 nt, Mycobacterium avium subsp. paratuberculosis
gagcgucacgcuagcgugaccg

SEQ ID NO: 23611 - RNA, 22 nt, Mycobacterium avium subsp. paratuberculosis
gagcgucacgcuggcguggcgc

SEQ ID NO: 23612 - RNA, 22 nt, Mycobacterium avium subsp. paratuberculosis
gagcucuuguccgacgcgucgc

SEQ ID NO: 23613 - RNA, 22 nt, Mycobacterium avium subsp. paratuberculosis
gagcugcucgaggcgcggucgc

SEQ ID NO: 23614 - RNA, 22 nt, Mycobacterium avium subsp. paratuberculosis
gagcugggaacugugggccuac

SEQ ID NO: 23615 - RNA, 22 nt, Mycobacterium avium subsp. paratuberculosis
gaggcgcccaugcggguggugg

SEQ ID NO: 23616 - RNA, 22 nt, Mycobacterium avium subsp. paratuberculosis
gaggcguucuacaugcgggucg

SEQ ID NO: 23617 - RNA, 22 nt, Mycobacterium avium subsp. paratuberculosis
gagggccaucgcgugagucucu

SEQ ID NO: 23618 - RNA, 22 nt, Mycobacterium avium subsp. paratuberculosis
gagggcgugccgccgaccgaca

SEQ ID NO: 23619 - RNA, 22 nt, Mycobacterium avium subsp. paratuberculosis
gagggcguguggcaccacacgg

SEQ ID NO: 23620 - RNA, 22 nt, Mycobacterium avium subsp. paratuberculosis
gaggugaucaucgccggcgccg

SEQ ID NO: 23621 - RNA, 22 nt, Mycobacterium avium subsp. paratuberculosis
gaggugcucgccgcggcggacc

SEQ ID NO: 23622 - RNA, 22 nt, Mycobacterium avium subsp. paratuberculosis
gaggugcucggcgaguucguca

SEQ ID NO: 23623 - RNA, 22 nt, Mycobacterium avium subsp. paratuberculosis
gaguggggacccgccgucgccg

SEQ ID NO: 23624 - RNA, 22 nt, Mycobacterium avium subsp. paratuberculosis
gaguuguccaccacgguguuga

SEQ ID NO: 23625 - RNA, 22 nt, Mycobacterium avium subsp. paratuberculosis
gaucaccaugaacccguuggag

SEQ ID NO: 23626 - RNA, 22 nt, Mycobacterium avium subsp. paratuberculosis
gaucaccguggaccgcgcccgc

SEQ ID NO: 23627 - RNA, 22 nt, Mycobacterium avium subsp. paratuberculosis
gaucaucggcagcggcgggcuc

SEQ ID NO: 23628 - RNA, 22 nt, Mycobacterium avium subsp. paratuberculosis
gauccacgacgccucgucggac

SEQ ID NO: 23629 - RNA, 22 nt, Mycobacterium avium subsp. paratuberculosis
gaucccgaugcgcaagaugcac

SEQ ID NO: 23630 - RNA, 22 nt, Mycobacterium avium subsp. paratuberculosis
gaucgacgacuuucagcuggag

SEQ ID NO: 23631 - RNA, 22 nt, Mycobacterium avium subsp. paratuberculosis
gaucgacgcugugcagaucgac

SEQ ID NO: 23632 - RNA, 22 nt, Mycobacterium avium subsp. paratuberculosis
gaucgcgaguuuggucauggag

SEQ ID NO: 23633 - RNA, 22 nt, Mycobacterium avium subsp. paratuberculosis
gaucgcggcguucgugcugauc

SEQ ID NO: 23634 - RNA, 22 nt, Mycobacterium avium subsp. paratuberculosis
gaucggccgggucgacgucgcc

SEQ ID NO: 23635 - RNA, 22 nt, Mycobacterium avium subsp. paratuberculosis
gaucucgaucucgccgaugccg

SEQ ID NO: 23636 - RNA, 23 nt, Mycobacterium avium subsp. paratuberculosis
gaugcggcccagcgcggcgaucc

SEQ ID NO: 23637 - RNA, 22 nt, Mycobacterium avium subsp. paratuberculosis
gaugcggugacuuucgaucugc

SEQ ID NO: 23638 - RNA, 22 nt, Mycobacterium avium subsp. paratuberculosis
gaugcuggcggccucgccgcgg

SEQ ID NO: 23639 - RNA, 22 nt, Mycobacterium avium subsp. paratuberculosis
gauggugagcuggccguagcgu

SEQ ID NO: 23640 - RNA, 22 nt, Mycobacterium avium subsp. paratuberculosis
gaugucggcgcccaccugcugg

SEQ ID NO: 23641 - RNA, 22 nt, Mycobacterium avium subsp. paratuberculosis
gauguugaccacccgcagcgag

SEQ ID NO: 23642 - RNA, 22 nt, Mycobacterium avium subsp. paratuberculosis
gauuccggcggcgacgcauucg

SEQ ID NO: 23643 - RNA, 22 nt, Mycobacterium avium subsp. paratuberculosis
gauugggcgacgacgagugaau

SEQ ID NO: 23644 - RNA, 22 nt, Mycobacterium avium subsp. paratuberculosis
gcaacgagaccacccgcaauuc

SEQ ID NO: 23645 - RNA, 22 nt, Mycobacterium avium subsp. paratuberculosis
gcaaggugcucaagcaucggau

SEQ ID NO: 23646 - RNA, 22 nt, Mycobacterium avium subsp. paratuberculosis
gcaccacguauaccgacgcgcc

SEQ ID NO: 23647 - RNA, 22 nt, Mycobacterium avium subsp. paratuberculosis
gcaccacgucgcugcaccggau

SEQ ID NO: 23648 - RNA, 22 nt, Mycobacterium avium subsp. paratuberculosis
gcacccagauacccggcacggu

SEQ ID NO: 23649 - RNA, 22 nt, Mycobacterium avium subsp. paratuberculosis
gcaccgcccuguggcuggaaag

SEQ ID NO: 23650 - RNA, 22 nt, Mycobacterium avium subsp. paratuberculosis
gcacgcaagagugcggccccga

SEQ ID NO: 23651 - RNA, 22 nt, Mycobacterium avium subsp. paratuberculosis
gcacgccgaucagcgggcggcu

SEQ ID NO: 23652 - RNA, 22 nt, Mycobacterium avium subsp. paratuberculosis
gcacgcgguggucggggagugg

SEQ ID NO: 23653 - RNA, 22 nt, Mycobacterium avium subsp. paratuberculosis
gcacgugugacgcuucgccacg

SEQ ID NO: 23654 - RNA, 22 nt, Mycobacterium avium subsp. paratuberculosis
gcagcagcuccucgacggcguc

SEQ ID NO: 23655 - RNA, 22 nt, Mycobacterium avium subsp. paratuberculosis
gcagcaggacgagcucaccucg

SEQ ID NO: 23656 - RNA, 22 nt, Mycobacterium avium subsp. paratuberculosis
gcagcccggccgaacugguggc

SEQ ID NO: 23657 - RNA, 22 nt, Mycobacterium avium subsp. paratuberculosis
gcagcgcgacgcccaggccaaa

SEQ ID NO: 23658 - RNA, 22 nt, Mycobacterium avium subsp. paratuberculosis
gcagcgcggccagguuguccga

SEQ ID NO: 23659 - RNA, 22 nt, Mycobacterium avium subsp. paratuberculosis
gcagcgcgucgaaccgccaguc

SEQ ID NO: 23660 - RNA, 22 nt, Mycobacterium avium subsp. paratuberculosis
gcagcggucgacgacgcgcugg

SEQ ID NO: 23661 - RNA, 22 nt, Mycobacterium avium subsp. paratuberculosis
gcagcgucuccagcagcucgcg

SEQ ID NO: 23662 - RNA, 23 nt, Mycobacterium avium subsp. paratuberculosis
gcagcgugccgaucacguugguc

SEQ ID NO: 23663 - RNA, 22 nt, Mycobacterium avium subsp. paratuberculosis
gcaguacaccaacuucacgccc

SEQ ID NO: 23664 - RNA, 22 nt, Mycobacterium avium subsp. paratuberculosis
gcagucgggaauuagcacggcg

SEQ ID NO: 23665 - RNA, 22 nt, Mycobacterium avium subsp. paratuberculosis
gcaucaccaccgucgaacucgu

SEQ ID NO: 23666 - RNA, 22 nt, Mycobacterium avium subsp. paratuberculosis
gcaucauguacaccgucaccug

SEQ ID NO: 23667 - RNA, 22 nt, Mycobacterium avium subsp. paratuberculosis
gcaugcggaaguugcgggcgug

SEQ ID NO: 23668 - RNA, 22 nt, Mycobacterium avium subsp. paratuberculosis
agcgccccggcguagcgcaaca

SEQ ID NO: 23669 - RNA, 22 nt, Mycobacterium avium subsp. paratuberculosis
agcgcgaucgggugcuggccgc

SEQ ID NO: 23670 - RNA, 22 nt, Mycobacterium avium subsp. paratuberculosis
agcggacccuggauugggccga

SEQ ID NO: 23671 - RNA, 22 nt, Mycobacterium avium subsp. paratuberculosis
agcggcagcaccagauggcggc

SEQ ID NO: 23672 - RNA, 22 nt, Mycobacterium avium subsp. paratuberculosis
agcggcaggucccaggccagga

SEQ ID NO: 23673 - RNA, 22 nt, Mycobacterium avium subsp. paratuberculosis
agcgggcggcgaaacccgcugg

SEQ ID NO: 23674 - RNA, 22 nt, Mycobacterium avium subsp. paratuberculosis
agcgggguuuuugauugcgcuu

SEQ ID NO: 23675 - RNA, 22 nt, Mycobacterium avium subsp. paratuberculosis
agcggguccagggugaucgagc

SEQ ID NO: 23676 - RNA, 22 nt, Mycobacterium avium subsp. paratuberculosis
agcgucgaguuguuggcgccga

SEQ ID NO: 23677 - RNA, 22 nt, Mycobacterium avium subsp. paratuberculosis
agcgugaaacuagcuucacgcu

SEQ ID NO: 23678 - RNA, 22 nt, Mycobacterium avium subsp. paratuberculosis
agcgugaagcuaacuucacgcu

SEQ ID NO: 23679 - RNA, 22 nt, Mycobacterium avium subsp. paratuberculosis
agcgugaagcuaguuucacgcu

SEQ ID NO: 23680 - RNA, 22 nt, Mycobacterium avium subsp. paratuberculosis
agcgugaaguuaacuucacgcu

SEQ ID NO: 23681 - RNA, 22 nt, Mycobacterium avium subsp. paratuberculosis
agcgugaaguuagcuucacgcu

SEQ ID NO: 23682 - RNA, 22 nt, Mycobacterium avium subsp. paratuberculosis
agcgugaccucgucaccaagau

SEQ ID NO: 23683 - RNA, 22 nt, Mycobacterium avium subsp. paratuberculosis
agcguggacuaguugcgcgauc

SEQ ID NO: 23684 - RNA, 22 nt, Mycobacterium avium subsp. paratuberculosis
agcguggcguagcaacggaauu

SEQ ID NO: 23685 - RNA, 22 nt, Mycobacterium avium subsp. paratuberculosis
agcucgccguagaucaacaggu

SEQ ID NO: 23686 - RNA, 20 nt, Mycobacterium avium subsp. paratuberculosis
agcucgucgaucugcugcug

SEQ ID NO: 23687 - RNA, 22 nt, Mycobacterium avium subsp. paratuberculosis
agcugcgccggacgggcuaccu

SEQ ID NO: 23688 - RNA, 22 nt, Mycobacterium avium subsp. paratuberculosis
agcugggcgacuuucgcggagu

SEQ ID NO: 23689 - RNA, 22 nt, Mycobacterium avium subsp. paratuberculosis
agcuggucggccgcggcggugu

SEQ ID NO: 23690 - RNA, 22 nt, Mycobacterium avium subsp. paratuberculosis
agcugguguacuccccggcggu

SEQ ID NO: 23691 - RNA, 22 nt, Mycobacterium avium subsp. paratuberculosis
aggacggugacguguucgcgaa

SEQ ID NO: 23692 - RNA, 22 nt, Mycobacterium avium subsp. paratuberculosis
aggagggcaaccugggccugau

SEQ ID NO: 23693 - RNA, 22 nt, Mycobacterium avium subsp. paratuberculosis
aggauggugcgggccugcaguu

SEQ ID NO: 23694 - RNA, 22 nt, Mycobacterium avium subsp. paratuberculosis
aggccgcguccaugucggccgg

SEQ ID NO: 23695 - RNA, 22 nt, Mycobacterium avium subsp. paratuberculosis
aggccggugaccagugggugcu

SEQ ID NO: 23696 - RNA, 22 nt, Mycobacterium avium subsp. paratuberculosis
agggccaucgcgugagucucug

SEQ ID NO: 23697 - RNA, 22 nt, Mycobacterium avium subsp. paratuberculosis
agggccgcaucucggcgggcgu

SEQ ID NO: 23698 - RNA, 22 nt, Mycobacterium avium subsp. paratuberculosis
aggggccgaagcgcaucgcccg

SEQ ID NO: 23699 - RNA, 22 nt, Mycobacterium avium subsp. paratuberculosis
aggggugccaccgugcgcagcg

SEQ ID NO: 23700 - RNA, 22 nt, Mycobacterium avium subsp. paratuberculosis
aggucgguaccaccaucggucu

SEQ ID NO: 23701 - RNA, 22 nt, Mycobacterium avium subsp. paratuberculosis
aggucggucucuuuggugcgcg

SEQ ID NO: 23702 - RNA, 22 nt, Mycobacterium avium subsp. paratuberculosis
aggucguagccgccaacucgaa

SEQ ID NO: 23703 - RNA, 22 nt, Mycobacterium avium subsp. paratuberculosis
aggucgugaucggucucgauca

SEQ ID NO: 23704 - RNA, 22 nt, Mycobacterium avium subsp. paratuberculosis
agguucggggguggaccacagg

SEQ ID NO: 23705 - RNA, 22 nt, Mycobacterium avium subsp. paratuberculosis
agguugccgugcaggucgaccg

SEQ ID NO: 23706 - RNA, 20 nt, Mycobacterium avium subsp. paratuberculosis
aguagucgaugcucgacguc

SEQ ID NO: 23707 - RNA, 22 nt, Mycobacterium avium subsp. paratuberculosis
aguccuugaccaggaacuucag

SEQ ID NO: 23708 - RNA, 22 nt, Mycobacterium avium subsp. paratuberculosis
agucgacuacuccggucaggac

SEQ ID NO: 23709 - RNA, 22 nt, Mycobacterium avium subsp. paratuberculosis
agucgccguaccggucaccgug

SEQ ID NO: 23710 - RNA, 22 nt, Mycobacterium avium subsp. paratuberculosis
agucguccugucacugguggcc

SEQ ID NO: 23711 - RNA, 22 nt, Mycobacterium avium subsp. paratuberculosis
agugcccgccuuugagcgacaa

SEQ ID NO: 23712 - RNA, 22 nt, Mycobacterium avium subsp. paratuberculosis
aguuccucgaagcgcgggauga

SEQ ID NO: 23713 - RNA, 22 nt, Mycobacterium avium subsp. paratuberculosis
aucaccugcaugagcugguggc

SEQ ID NO: 23714 - RNA, 22 nt, Mycobacterium avium subsp. paratuberculosis
auccaugucccccacguucggc

SEQ ID NO: 23715 - RNA, 22 nt, Mycobacterium avium subsp. paratuberculosis
aucccccgccgaucgugguguc

SEQ ID NO: 23716 - RNA, 22 nt, Mycobacterium avium subsp. paratuberculosis
aucgaucagcagggcggugggc

SEQ ID NO: 23717 - RNA, 22 nt, Mycobacterium avium subsp. paratuberculosis
aucgcauucuggugcacgcgga

SEQ ID NO: 23718 - RNA, 23 nt, Mycobacterium avium subsp. paratuberculosis
aucgccagcaucaggcccgccac

SEQ ID NO: 23719 - RNA, 22 nt, Mycobacterium avium subsp. paratuberculosis
aucgccgacgaggucggcgcca

SEQ ID NO: 23720 - RNA, 22 nt, Mycobacterium avium subsp. paratuberculosis
aucgccucggcggcgacgguca

SEQ ID NO: 23721 - RNA, 22 nt, Mycobacterium avium subsp. paratuberculosis
aucgcgauguuccucucgguag

SEQ ID NO: 23722 - RNA, 22 nt, Mycobacterium avium subsp. paratuberculosis
aucgcuguucaggacgucgcug

SEQ ID NO: 23723 - RNA, 22 nt, Mycobacterium avium subsp. paratuberculosis
aucggcagcaccgcgucgaugg

SEQ ID NO: 23724 - RNA, 22 nt, Mycobacterium avium subsp. paratuberculosis
aucggcccgcucgaugcgucgg

SEQ ID NO: 23725 - RNA, 22 nt, Mycobacterium avium subsp. paratuberculosis
aucggcgaccagaucacgucga

SEQ ID NO: 23726 - RNA, 22 nt, Mycobacterium avium subsp. paratuberculosis
aucggcgccgacgcggugaucg

SEQ ID NO: 23727 - RNA, 22 nt, Mycobacterium avium subsp. paratuberculosis
aucggcgccggugaugaugacg

SEQ ID NO: 23728 - RNA, 22 nt, Mycobacterium avium subsp. paratuberculosis
aucgggucgcccggcacgcaca

SEQ ID NO: 23729 - RNA, 22 nt, Mycobacterium avium subsp. paratuberculosis
aucggucagcccuucguggacg

SEQ ID NO: 23730 - RNA, 22 nt, Mycobacterium avium subsp. paratuberculosis
aucgucgaggacgccgagcacu

SEQ ID NO: 23731 - RNA, 22 nt, Mycobacterium avium subsp. paratuberculosis
aucgucgaugugcgcgacgagg

SEQ ID NO: 23732 - RNA, 22 nt, Mycobacterium avium subsp. paratuberculosis
aucgugcugcugcacggcgagc

SEQ ID NO: 23733 - RNA, 20 nt, Mycobacterium avium subsp. paratuberculosis
aucguucucgucgcgcacga

SEQ ID NO: 23734 - RNA, 22 nt, Mycobacterium avium subsp. paratuberculosis
aucucgaucggguccaucuuuu

SEQ ID NO: 23735 - RNA, 22 nt, Mycobacterium avium subsp. paratuberculosis
aucucgcugugcacgguguugc

SEQ ID NO: 23736 - RNA, 22 nt, Mycobacterium avium subsp. paratuberculosis
aucuggugaagaaccucgauca

SEQ ID NO: 23737 - RNA, 22 nt, Mycobacterium avium subsp. paratuberculosis
augccgagcgaucuggugcccg

SEQ ID NO: 23738 - RNA, 20 nt, Mycobacterium avium subsp. paratuberculosis
augccgaggcgggcaaaccc

SEQ ID NO: 23739 - RNA, 22 nt, Mycobacterium avium subsp. paratuberculosis
augccggcuucccagccgggca

SEQ ID NO: 23740 - RNA, 22 nt, Mycobacterium avium subsp. paratuberculosis
augccgugcuuggccagcucgc

SEQ ID NO: 23741 - RNA, 22 nt, Mycobacterium avium subsp. paratuberculosis
augcggauguaucguucugcuc

SEQ ID NO: 23742 - RNA, 22 nt, Mycobacterium avium subsp. paratuberculosis
augcucaccggccguaccgugu

SEQ ID NO: 23743 - RNA, 22 nt, Mycobacterium avium subsp. paratuberculosis
auggcagcagcaucgugguggc

SEQ ID NO: 23744 - RNA, 22 nt, Mycobacterium avium subsp. paratuberculosis
auggcagcggauccucgacauc

SEQ ID NO: 23745 - RNA, 22 nt, Mycobacterium avium subsp. paratuberculosis
auggccgacgucugguggcggu

SEQ ID NO: 23746 - RNA, 22 nt, Mycobacterium avium subsp. paratuberculosis
auggcggugcucgcgggcgugc

SEQ ID NO: 23747 - RNA, 22 nt, Mycobacterium avium subsp. paratuberculosis
auggcggugucguaggcgucga

SEQ ID NO: 23748 - RNA, 22 nt, Mycobacterium avium subsp. paratuberculosis
auggcgugcgcgaugggguguu

SEQ ID NO: 23749 - RNA, 22 nt, Mycobacterium avium subsp. paratuberculosis
augggugcggcggucaccggcu

SEQ ID NO: 23750 - RNA, 22 nt, Mycobacterium avium subsp. paratuberculosis
auggucagcuggcugcccugcu

SEQ ID NO: 23751 - RNA, 22 nt, Mycobacterium avium subsp. paratuberculosis
augguguugucgacgaucagcg

SEQ ID NO: 23752 - RNA, 22 nt, Mycobacterium avium subsp. paratuberculosis
augucggcaacccgaaauggau

SEQ ID NO: 23753 - RNA, 22 nt, Mycobacterium avium subsp. paratuberculosis
augucggccagcaggauccgaa

SEQ ID NO: 23754 - RNA, 22 nt, Mycobacterium avium subsp. paratuberculosis
augucgguggucacgccgucca

SEQ ID NO: 23755 - RNA, 22 nt, Mycobacterium avium subsp. paratuberculosis
auguucaucaccgggcccgacg

SEQ ID NO: 23756 - RNA, 22 nt, Mycobacterium avium subsp. paratuberculosis
auuccguugcuggcguuggccg

SEQ ID NO: 23757 - RNA, 22 nt, Mycobacterium avium subsp. paratuberculosis
auugggugccguugccggugca

SEQ ID NO: 23758 - RNA, 22 nt, Mycobacterium avium subsp. paratuberculosis
auuucggccuugaucgaggugc

SEQ ID NO: 23759 - RNA, 22 nt, Mycobacterium avium subsp. paratuberculosis
caaccucaccgagauccgcgag

SEQ ID NO: 23760 - RNA, 22 nt, Mycobacterium avium subsp. paratuberculosis
caacgucgacuugugggcgcca

SEQ ID NO: 23761 - RNA, 22 nt, Mycobacterium avium subsp. paratuberculosis
caaggcgucggcggcgaugacc

SEQ ID NO: 23762 - RNA, 22 nt, Mycobacterium avium subsp. paratuberculosis
caaguuccuggagggguugacg

SEQ ID NO: 23763 - RNA, 22 nt, Mycobacterium avium subsp. paratuberculosis
cacaccgagcgagcgcaccaga

SEQ ID NO: 23764 - RNA, 22 nt, Mycobacterium avium subsp. paratuberculosis
cacaccgcgucaccggcggggu

SEQ ID NO: 23765 - RNA, 22 nt, Mycobacterium avium subsp. paratuberculosis
cacaccgucgcagccgacguga

SEQ ID NO: 23766 - RNA, 22 nt, Mycobacterium avium subsp. paratuberculosis
cacaggugaucaucgaugcggc

SEQ ID NO: 23767 - RNA, 22 nt, Mycobacterium avium subsp. paratuberculosis
caccagcaggauugggacgucg

SEQ ID NO: 23768 - RNA, 22 nt, Mycobacterium avium subsp. paratuberculosis
caccagcgcgcgcuggcacguc

SEQ ID NO: 23769 - RNA, 22 nt, Mycobacterium avium subsp. paratuberculosis
caccaucgugccgauguaucug

SEQ ID NO: 23770 - RNA, 22 nt, Mycobacterium avium subsp. paratuberculosis
caccccgcugcugucggucgag

SEQ ID NO: 23771 - RNA, 22 nt, Mycobacterium avium subsp. paratuberculosis
cacccgcaguggggacgcgccg

SEQ ID NO: 23772 - RNA, 22 nt, Mycobacterium avium subsp. paratuberculosis
caccgccgcgacggcuagcggg

SEQ ID NO: 23773 - RNA, 22 nt, Mycobacterium avium subsp. paratuberculosis
caccgccgcggagaugucgucg

SEQ ID NO: 23774 - RNA, 22 nt, Mycobacterium avium subsp. paratuberculosis
caccggcacccugguggccggg

SEQ ID NO: 23775 - RNA, 22 nt, Mycobacterium avium subsp. paratuberculosis
caccggcgaugaacucagcgca

SEQ ID NO: 23776 - RNA, 22 nt, Mycobacterium avium subsp. paratuberculosis
caccggcgccgauucgaacagc

SEQ ID NO: 23777 - RNA, 22 nt, Mycobacterium avium subsp. paratuberculosis
caccggggccacaacgcggaca

SEQ ID NO: 23778 - RNA, 22 nt, Mycobacterium avium subsp. paratuberculosis
caccuaccugcgguucgucugg

SEQ ID NO: 23779 - RNA, 22 nt, Mycobacterium avium subsp. paratuberculosis
caccugcuggccacucucgccg

SEQ ID NO: 23780 - RNA, 22 nt, Mycobacterium avium subsp. paratuberculosis
cacgaugcuggagaucaccagg

SEQ ID NO: 23781 - RNA, 23 nt, Mycobacterium avium subsp. paratuberculosis
cacgccagcgugacgcucggugc

SEQ ID NO: 23782 - RNA, 22 nt, Mycobacterium avium subsp. paratuberculosis
cacgccgccgaagcugaugccg

SEQ ID NO: 23783 - RNA, 19 nt, Mycobacterium avium subsp. paratuberculosis
cacgccggcgugacgcucg

SEQ ID NO: 23784 - RNA, 22 nt, Mycobacterium avium subsp. paratuberculosis
cacgcuguucagcgcggccggc

SEQ ID NO: 23785 - RNA, 22 nt, Mycobacterium avium subsp. paratuberculosis
cacggugccgucgucgagcagu

SEQ ID NO: 23786 - RNA, 22 nt, Mycobacterium avium subsp. paratuberculosis
cacgucgcggcuggcgcgguuc

SEQ ID NO: 23787 - RNA, 20 nt, Mycobacterium avium subsp. paratuberculosis
cacguggugcaccugcccga

SEQ ID NO: 23788 - RNA, 22 nt, Mycobacterium avium subsp. paratuberculosis
cacucgggaucggucacggaga

SEQ ID NO: 23789 - RNA, 22 nt, Mycobacterium avium subsp. paratuberculosis
cacuggcuuucgcgaucgcggc

SEQ ID NO: 23790 - RNA, 22 nt, Mycobacterium avium subsp. paratuberculosis
cagaccuaccuugcccgcgcgg

SEQ ID NO: 23791 - RNA, 22 nt, Mycobacterium avium subsp. paratuberculosis
cagacgcaaaagcccccgacac

SEQ ID NO: 23792 - RNA, 22 nt, Mycobacterium avium subsp. paratuberculosis
cagcacccgcacuccggcggcc

SEQ ID NO: 23793 - RNA, 22 nt, Mycobacterium avium subsp. paratuberculosis
cagcagcugggaaucggcauga

SEQ ID NO: 23794 - RNA, 21 nt, Mycobacterium avium subsp. paratuberculosis
cagcccagcgagauggccggc

SEQ ID NO: 23795 - RNA, 22 nt, Mycobacterium avium subsp. paratuberculosis
cagcccaguguagacggccagc

SEQ ID NO: 23796 - RNA, 22 nt, Mycobacterium avium subsp. paratuberculosis
cagccgcuuauuguccagcgag

SEQ ID NO: 23797 - RNA, 22 nt, Mycobacterium avium subsp. paratuberculosis
cagccugguagcgaucgccgag

SEQ ID NO: 23798 - RNA, 22 nt, Mycobacterium avium subsp. paratuberculosis
cagcgcgacuucgcguauccgg

SEQ ID NO: 23799 - RNA, 22 nt, Mycobacterium avium subsp. paratuberculosis
cagcgcgcgggcggccagguag

SEQ ID NO: 23800 - RNA, 22 nt, Mycobacterium avium subsp. paratuberculosis
cagcgcggucaccuggcggugu

SEQ ID NO: 23801 - RNA, 22 nt, Mycobacterium avium subsp. paratuberculosis
cagcgcgugccguuccagcugg

SEQ ID NO: 23802 - RNA, 22 nt, Mycobacterium avium subsp. paratuberculosis
cagcggcaggaugucggcgaug

SEQ ID NO: 23803 - RNA, 22 nt, Mycobacterium avium subsp. paratuberculosis
cagcggccgaucauggucggcg

SEQ ID NO: 23804 - RNA, 22 nt, Mycobacterium avium subsp. paratuberculosis
cagcggccggucggcgaggacg

SEQ ID NO: 23805 - RNA, 22 nt, Mycobacterium avium subsp. paratuberculosis
cagcggcuucugggcgaucccc

SEQ ID NO: 23806 - RNA, 22 nt, Mycobacterium avium subsp. paratuberculosis
cagcgucgacuuguugcgccga

SEQ ID NO: 23807 - RNA, 22 nt, Mycobacterium avium subsp. paratuberculosis
cagcugguguugcuggacgccc

SEQ ID NO: 23808 - RNA, 22 nt, Mycobacterium avium subsp. paratuberculosis
caggagaagcugauaccgccga

SEQ ID NO: 23809 - RNA, 22 nt, Mycobacterium avium subsp. paratuberculosis
caggaucagcaggucggcguag

SEQ ID NO: 23810 - RNA, 22 nt, Mycobacterium avium subsp. paratuberculosis
caggaucgggugggucaccgug

SEQ ID NO: 23811 - RNA, 22 nt, Mycobacterium avium subsp. paratuberculosis
caggcccuguaccgcgagggcu

SEQ ID NO: 23812 - RNA, 22 nt, Mycobacterium avium subsp. paratuberculosis
caggccgcgggauggcguuccu

SEQ ID NO: 23813 - RNA, 22 nt, Mycobacterium avium subsp. paratuberculosis
caggcgcugaaccugcgcagcg

SEQ ID NO: 23814 - RNA, 22 nt, Mycobacterium avium subsp. paratuberculosis
caggcgguggcccaggcggucg

SEQ ID NO: 23815 - RNA, 22 nt, Mycobacterium avium subsp. paratuberculosis
caggcuggcaucgucggcgccg

SEQ ID NO: 23816 - RNA, 22 nt, Mycobacterium avium subsp. paratuberculosis
cagggcgaggcguucaccgcgg

SEQ ID NO: 23817 - RNA, 22 nt, Mycobacterium avium subsp. paratuberculosis
caggucguagaaggucaggucg

SEQ ID NO: 23818 - RNA, 22 nt, Mycobacterium avium subsp. paratuberculosis
caggucgucgcggcagcaggcc

SEQ ID NO: 23819 - RNA, 22 nt, Mycobacterium avium subsp. paratuberculosis
caggugcacauccuggccggca

SEQ ID NO: 23820 - RNA, 22 nt, Mycobacterium avium subsp. paratuberculosis
cagucgaucuccucguagcugc

SEQ ID NO: 23821 - RNA, 21 nt, Mycobacterium avium subsp. paratuberculosis
cagugccgacgaucugcccca

SEQ ID NO: 23822 - RNA, 22 nt, Mycobacterium avium subsp. paratuberculosis
caucccggccuggcgggcggcc

SEQ ID NO: 23823 - RNA, 22 nt, Mycobacterium avium subsp. paratuberculosis
aacgacgaaaacacgaugccgg

SEQ ID NO: 23824 - RNA, 22 nt, Mycobacterium avium subsp. paratuberculosis
aacgagcaugucgucggcaaag

SEQ ID NO: 23825 - RNA, 22 nt, Mycobacterium avium subsp. paratuberculosis
aacgccgcccgauguugccggu

SEQ ID NO: 23826 - RNA, 22 nt, Mycobacterium avium subsp. paratuberculosis
aacgccggcacgcugggcgccu

SEQ ID NO: 23827 - RNA, 22 nt, Mycobacterium avium subsp. paratuberculosis
aacgcuucugauuccuugccgu

SEQ ID NO: 23828 - RNA, 22 nt, Mycobacterium avium subsp. paratuberculosis
aacggcucugggaccgggccca

SEQ ID NO: 23829 - RNA, 22 nt, Mycobacterium avium subsp. paratuberculosis
aacggugcgucgccccggcggg

SEQ ID NO: 23830 - RNA, 22 nt, Mycobacterium avium subsp. paratuberculosis
aacgugaagcuaguuucacguu

SEQ ID NO: 23831 - RNA, 22 nt, Mycobacterium avium subsp. paratuberculosis
aacuggcgaugagccucggagc

SEQ ID NO: 23832 - RNA, 22 nt, Mycobacterium avium subsp. paratuberculosis
aagaaguggaugccgacgaagu

SEQ ID NO: 23833 - RNA, 22 nt, Mycobacterium avium subsp. paratuberculosis
aagcaguacgcgaugucggauc

SEQ ID NO: 23834 - RNA, 22 nt, Mycobacterium avium subsp. paratuberculosis
aagcgcaaucaaaaaccccgcu

SEQ ID NO: 23835 - RNA, 22 nt, Mycobacterium avium subsp. paratuberculosis
aagcugaucggcaugggcgacg

SEQ ID NO: 23836 - RNA, 22 nt, Mycobacterium avium subsp. paratuberculosis
aaggacuaugccaccuacggau

SEQ ID NO: 23837 - RNA, 22 nt, Mycobacterium avium subsp. paratuberculosis
aaggagcucguccgggauccgg

SEQ ID NO: 23838 - RNA, 22 nt, Mycobacterium avium subsp. paratuberculosis
aaggccuacaacgacuggcaca

SEQ ID NO: 23839 - RNA, 22 nt, Mycobacterium avium subsp. paratuberculosis
aaggcguacucggccggcgcca

SEQ ID NO: 23840 - RNA, 22 nt, Mycobacterium avium subsp. paratuberculosis
aaguaucuagaugaauucagug

SEQ ID NO: 23841 - RNA, 22 nt, Mycobacterium avium subsp. paratuberculosis
aagugguccgacgaccuggugu

SEQ ID NO: 23842 - RNA, 22 nt, Mycobacterium avium subsp. paratuberculosis
aauccacaucgccgacggcgug

SEQ ID NO: 23843 - RNA, 22 nt, Mycobacterium avium subsp. paratuberculosis
aaucuguugcggcgcgggcaug

SEQ ID NO: 23844 - RNA, 22 nt, Mycobacterium avium subsp. paratuberculosis
aaugggagccagcugucgaccg

SEQ ID NO: 23845 - RNA, 22 nt, Mycobacterium avium subsp. paratuberculosis
acaacguggugguggugcugca

SEQ ID NO: 23846 - RNA, 22 nt, Mycobacterium avium subsp. paratuberculosis
acaccagggcgaucagccagga

SEQ ID NO: 23847 - RNA, 22 nt, Mycobacterium avium subsp. paratuberculosis
acaccgccacgucgaugccggc

SEQ ID NO: 23848 - RNA, 20 nt, Mycobacterium avium subsp. paratuberculosis
acaccguccgccuggccgag

SEQ ID NO: 23849 - RNA, 22 nt, Mycobacterium avium subsp. paratuberculosis
acagaugucaauagugugaguu

SEQ ID NO: 23850 - RNA, 22 nt, Mycobacterium avium subsp. paratuberculosis
acauaccgcacgaucggcguca

SEQ ID NO: 23851 - RNA, 22 nt, Mycobacterium avium subsp. paratuberculosis
acauagauggugucgcgggcug

SEQ ID NO: 23852 - RNA, 22 nt, Mycobacterium avium subsp. paratuberculosis
acaucgaccccacgucggccga

SEQ ID NO: 23853 - RNA, 22 nt, Mycobacterium avium subsp. paratuberculosis
acaucgucaagaacaccgcgug

SEQ ID NO: 23854 - RNA, 22 nt, Mycobacterium avium subsp. paratuberculosis
accacgcuguagaugcccgcgc

SEQ ID NO: 23855 - RNA, 22 nt, Mycobacterium avium subsp. paratuberculosis
accacggcgguggucgcgcggu

SEQ ID NO: 23856 - RNA, 20 nt, Mycobacterium avium subsp. paratuberculosis
accagccggcggucgccggc

SEQ ID NO: 23857 - RNA, 22 nt, Mycobacterium avium subsp. paratuberculosis
accaggcguuguagaucugcag

SEQ ID NO: 23858 - RNA, 22 nt, Mycobacterium avium subsp. paratuberculosis
accaggguguugccgacggcca

SEQ ID NO: 23859 - RNA, 22 nt, Mycobacterium avium subsp. paratuberculosis
accccccacgucauaggcggcg

SEQ ID NO: 23860 - RNA, 20 nt, Mycobacterium avium subsp. paratuberculosis
accccgcgcgaacgcaucgc

SEQ ID NO: 23861 - RNA, 22 nt, Mycobacterium avium subsp. paratuberculosis
accccggugaccguggcguagc

SEQ ID NO: 23862 - RNA, 22 nt, Mycobacterium avium subsp. paratuberculosis
acccgaacagauucuggcccgg

SEQ ID NO: 23863 - RNA, 22 nt, Mycobacterium avium subsp. paratuberculosis
acccgcgggcaggccgacgccg

SEQ ID NO: 23864 - RNA, 22 nt, Mycobacterium avium subsp. paratuberculosis
acccgcuggcgaugcggccgca

SEQ ID NO: 23865 - RNA, 22 nt, Mycobacterium avium subsp. paratuberculosis
acccgcuugccggucaggucga

SEQ ID NO: 23866 - RNA, 22 nt, Mycobacterium avium subsp. paratuberculosis
acccggaugcccaucuuccaga

SEQ ID NO: 23867 - RNA, 22 nt, Mycobacterium avium subsp. paratuberculosis
acccggucggccgguucggguc

SEQ ID NO: 23868 - RNA, 22 nt, Mycobacterium avium subsp. paratuberculosis
accgaacgugcauucagugcga

SEQ ID NO: 23869 - RNA, 22 nt, Mycobacterium avium subsp. paratuberculosis
accgacggcgacgacggugccu

SEQ ID NO: 23870 - RNA, 22 nt, Mycobacterium avium subsp. paratuberculosis
accgagcgucacgcuggcgugg

SEQ ID NO: 23871 - RNA, 22 nt, Mycobacterium avium subsp. paratuberculosis
accgcccgguucggggucgguc

SEQ ID NO: 23872 - RNA, 22 nt, Mycobacterium avium subsp. paratuberculosis
accgccgaagcugguggaggcg

SEQ ID NO: 23873 - RNA, 22 nt, Mycobacterium avium subsp. paratuberculosis
accgccgacuccuacggcccgu

SEQ ID NO: 23874 - RNA, 22 nt, Mycobacterium avium subsp. paratuberculosis
accgccgagcguggaguuguug

SEQ ID NO: 23875 - RNA, 22 nt, Mycobacterium avium subsp. paratuberculosis
accgccuggcgggaucugccca

SEQ ID NO: 23876 - RNA, 22 nt, Mycobacterium avium subsp. paratuberculosis
accgcgcauguagccgcugccg

SEQ ID NO: 23877 - RNA, 22 nt, Mycobacterium avium subsp. paratuberculosis
accgcgcugcgcgccauggaca

SEQ ID NO: 23878 - RNA, 22 nt, Mycobacterium avium subsp. paratuberculosis
accgcguccguaacgucagggc

SEQ ID NO: 23879 - RNA, 22 nt, Mycobacterium avium subsp. paratuberculosis
accgcuccgcucggccugcgcc

SEQ ID NO: 23880 - RNA, 17 nt, Mycobacterium avium subsp. paratuberculosis
accgcuucgccgacgac

SEQ ID NO: 23881 - RNA, 22 nt, Mycobacterium avium subsp. paratuberculosis
accggaacgaggguggggcaga

SEQ ID NO: 23882 - RNA, 22 nt, Mycobacterium avium subsp. paratuberculosis
accggccaccggguccggcggu

SEQ ID NO: 23883 - RNA, 22 nt, Mycobacterium avium subsp. paratuberculosis
accggccgggccaucggguugg

SEQ ID NO: 23884 - RNA, 22 nt, Mycobacterium avium subsp. paratuberculosis
accgggaugacguuguggcccg

SEQ ID NO: 23885 - RNA, 22 nt, Mycobacterium avium subsp. paratuberculosis
accgggcgguugaccggcagcu

SEQ ID NO: 23886 - RNA, 22 nt, Mycobacterium avium subsp. paratuberculosis
accgggcguucaagcacgucgc

SEQ ID NO: 23887 - RNA, 22 nt, Mycobacterium avium subsp. paratuberculosis
accggggugaucgccgagaugg

SEQ ID NO: 23888 - RNA, 22 nt, Mycobacterium avium subsp. paratuberculosis
accgggguguucugcggcggcg

SEQ ID NO: 23889 - RNA, 22 nt, Mycobacterium avium subsp. paratuberculosis
accgggucguccgucggcgccg

SEQ ID NO: 23890 - RNA, 18 nt, Mycobacterium avium subsp. paratuberculosis
accggucugcuggucggc

SEQ ID NO: 23891 - RNA, 22 nt, Mycobacterium avium subsp. paratuberculosis
accggugcugcccgacgacuag

SEQ ID NO: 23892 - RNA, 22 nt, Mycobacterium avium subsp. paratuberculosis
accgugcagugccgggccgaga

SEQ ID NO: 23893 - RNA, 22 nt, Mycobacterium avium subsp. paratuberculosis
accguguccuuggccgagcgca

SEQ ID NO: 23894 - RNA, 22 nt, Mycobacterium avium subsp. paratuberculosis
accguugccucuuuccugguga

SEQ ID NO: 23895 - RNA, 22 nt, Mycobacterium avium subsp. paratuberculosis
accguugggcgucggggugccg

SEQ ID NO: 23896 - RNA, 20 nt, Mycobacterium avium subsp. paratuberculosis
accugaccuucuacgaccug

SEQ ID NO: 23897 - RNA, 22 nt, Mycobacterium avium subsp. paratuberculosis
accugcccggaucugggguuca

SEQ ID NO: 23898 - RNA, 22 nt, Mycobacterium avium subsp. paratuberculosis
accuggaacggcuugcgggcgc

SEQ ID NO: 23899 - RNA, 22 nt, Mycobacterium avium subsp. paratuberculosis
accuggcggccgcgcgggccaa

SEQ ID NO: 23900 - RNA, 22 nt, Mycobacterium avium subsp. paratuberculosis
accuugacguccucaucguggg

SEQ ID NO: 23901 - RNA, 22 nt, Mycobacterium avium subsp. paratuberculosis
acgaaccgcgucugcgguaugg

SEQ ID NO: 23902 - RNA, 22 nt, Mycobacterium avium subsp. paratuberculosis
acgaacuccgggccggccugca

SEQ ID NO: 23903 - RNA, 22 nt, Mycobacterium avium subsp. paratuberculosis
acgaccggcggcgguuauggcu

SEQ ID NO: 23904 - RNA, 23 nt, Mycobacterium avium subsp. paratuberculosis
acgacgcgauggucggugcggcg

SEQ ID NO: 23905 - RNA, 18 nt, Mycobacterium avium subsp. paratuberculosis
acgacggcggcgccgugc

SEQ ID NO: 23906 - RNA, 22 nt, Mycobacterium bovis subsp bovis AF2122/97
aaggcugcggguaugaaacgca

SEQ ID NO: 23907 - RNA, 22 nt, Mycobacterium bovis subsp bovis AF2122/97
aaggcuggagcgcacagcgcgg

SEQ ID NO: 23908 - RNA, 22 nt, Mycobacterium bovis subsp bovis AF2122/97
aagggucgcagugggcagcgau

SEQ ID NO: 23909 - RNA, 22 nt, Mycobacterium bovis subsp bovis AF2122/97
aaggugaacucacggcgagguu

SEQ ID NO: 23910 - RNA, 22 nt, Mycobacterium bovis subsp bovis AF2122/97
aaggugcggucaaugcgcucga

SEQ ID NO: 23911 - RNA, 22 nt, Mycobacterium bovis subsp bovis AF2122/97
aaucagcgacaacgcaucggua

SEQ ID NO: 23912 - RNA, 22 nt, Mycobacterium bovis subsp bovis AF2122/97
aaucggccggcgacacuguugu

SEQ ID NO: 23913 - RNA, 22 nt, Mycobacterium bovis subsp bovis AF2122/97
aaucucgcccccagugcacgcu

SEQ ID NO: 23914 - RNA, 22 nt, Mycobacterium bovis subsp bovis AF2122/97
aauggcguguaccgaggccagc

SEQ ID NO: 23915 - RNA, 22 nt, Mycobacterium bovis subsp bovis AF2122/97
aauguggucgaugcccuggcgu

SEQ ID NO: 23916 - RNA, 22 nt, Mycobacterium bovis subsp bovis AF2122/97
aauuccucuauuacgacgacgg

SEQ ID NO: 23917 - RNA, 22 nt, Mycobacterium bovis subsp bovis AF2122/97
acaaccuguggcgacugcugga

SEQ ID NO: 23918 - RNA, 22 nt, Mycobacterium bovis subsp bovis AF2122/97
acaccaagcgcccgcagcuugc

SEQ ID NO: 23919 - RNA, 22 nt, Mycobacterium bovis subsp bovis AF2122/97
acaccaaggccgucagcuuggc

SEQ ID NO: 23920 - RNA, 22 nt, Mycobacterium bovis subsp bovis AF2122/97
acaccgaacugaugcuggacgc

SEQ ID NO: 23921 - RNA, 23 nt, Mycobacterium bovis subsp bovis AF2122/97
acacuggugcuguugccggagac

SEQ ID NO: 23922 - RNA, 22 nt, Mycobacterium bovis subsp bovis AF2122/97
acagccaacgaguucgucgaca

SEQ ID NO: 23923 - RNA, 22 nt, Mycobacterium bovis subsp bovis AF2122/97
acagcccugaacgcaaucuggg

SEQ ID NO: 23924 - RNA, 22 nt, Mycobacterium bovis subsp bovis AF2122/97
acagcugcugguuugagucugc

SEQ ID NO: 23925 - RNA, 22 nt, Mycobacterium bovis subsp bovis AF2122/97
acaggucgccccagacgcgcuc

SEQ ID NO: 23926 - RNA, 22 nt, Mycobacterium bovis subsp bovis AF2122/97
accaacacucgcuggccggccc

SEQ ID NO: 23927 - RNA, 22 nt, Mycobacterium bovis subsp bovis AF2122/97
accacaccuacggucagggggu

SEQ ID NO: 23928 - RNA, 22 nt, Mycobacterium bovis subsp bovis AF2122/97
accagcucgcggggcagcuuga

SEQ ID NO: 23929 - RNA, 22 nt, Mycobacterium bovis subsp bovis AF2122/97
accaggucgccgccauaggggu

SEQ ID NO: 23930 - RNA, 22 nt, Mycobacterium bovis subsp bovis AF2122/97
accaucgucaugcgcgccggag

SEQ ID NO: 23931 - RNA, 19 nt, Mycobacterium bovis subsp bovis AF2122/97
acccaggccgucacuucga

SEQ ID NO: 23932 - RNA, 22 nt, Mycobacterium bovis subsp bovis AF2122/97
acccagguguagucaggaucgg

SEQ ID NO: 23933 - RNA, 22 nt, Mycobacterium bovis subsp bovis AF2122/97
acccaggugucgaugcagaccg

SEQ ID NO: 23934 - RNA, 22 nt, Mycobacterium bovis subsp bovis AF2122/97
acccggccagcacguagucggc

SEQ ID NO: 23935 - RNA, 22 nt, Mycobacterium bovis subsp bovis AF2122/97
acccggucgagcaccccgauga

SEQ ID NO: 23936 - RNA, 22 nt, Mycobacterium bovis subsp bovis AF2122/97
acccgguuggacaugucgaucc

SEQ ID NO: 23937 - RNA, 23 nt, Mycobacterium bovis subsp bovis AF2122/97
accgacaccgucggcuuugugcg

SEQ ID NO: 23938 - RNA, 22 nt, Mycobacterium bovis subsp bovis AF2122/97
accgagaagucguaugcggugc

SEQ ID NO: 23939 - RNA, 21 nt, Mycobacterium bovis subsp bovis AF2122/97
accgaucggucccgagcuggu

SEQ ID NO: 23940 - RNA, 22 nt, Mycobacterium bovis subsp bovis AF2122/97
accgcagcggguugcgggcaug

SEQ ID NO: 23941 - RNA, 21 nt, Mycobacterium bovis subsp bovis AF2122/97
accgccaucagccgaccgaau

SEQ ID NO: 23942 - RNA, 22 nt, Mycobacterium bovis subsp bovis AF2122/97
accgccugcuuggcguugucca

SEQ ID NO: 23943 - RNA, 22 nt, Mycobacterium bovis subsp bovis AF2122/97
accgcgaucagcgcagcgaucg

SEQ ID NO: 23944 - RNA, 22 nt, Mycobacterium bovis subsp bovis AF2122/97
accgcgcuguuucggcugcucg

SEQ ID NO: 23945 - RNA, 22 nt, Mycobacterium bovis subsp bovis AF2122/97
accgcggacgucuacgccgucc

SEQ ID NO: 23946 - RNA, 22 nt, Mycobacterium bovis subsp bovis AF2122/97
accggaucuggcuggagcagaa

SEQ ID NO: 23947 - RNA, 22 nt, Mycobacterium bovis subsp bovis AF2122/97
accggcaggcagcucacgagau

SEQ ID NO: 23948 - RNA, 22 nt, Mycobacterium bovis subsp bovis AF2122/97
accgggagaaugccgccgcacu

SEQ ID NO: 23949 - RNA, 22 nt, Mycobacterium bovis subsp bovis AF2122/97
accgggcgcaccgguaccggua

SEQ ID NO: 23950 - RNA, 22 nt, Mycobacterium bovis subsp bovis AF2122/97
accgggcuggucgacggccagc

SEQ ID NO: 23951 - RNA, 22 nt, Mycobacterium bovis subsp bovis AF2122/97
accggggcucagcucgccgaug

SEQ ID NO: 23952 - RNA, 22 nt, Mycobacterium bovis subsp bovis AF2122/97
accgguccccgaucaccguguc

SEQ ID NO: 23953 - RNA, 22 nt, Mycobacterium bovis subsp bovis AF2122/97
accgguugcccgccguggaucg

SEQ ID NO: 23954 - RNA, 22 nt, Mycobacterium bovis subsp bovis AF2122/97
accucaacauucccgacgagaa

SEQ ID NO: 23955 - RNA, 22 nt, Mycobacterium bovis subsp bovis AF2122/97
agcgagccagucagcaggccuu

SEQ ID NO: 23956 - RNA, 22 nt, Mycobacterium bovis subsp bovis AF2122/97
agcgccgagauugacguuuugc

SEQ ID NO: 23957 - RNA, 21 nt, Mycobacterium bovis subsp bovis AF2122/97
agcgcgacuucacuuugugga

SEQ ID NO: 23958 - RNA, 22 nt, Mycobacterium bovis subsp bovis AF2122/97
agcgcgccggacaucgccgguc

SEQ ID NO: 23959 - RNA, 22 nt, Mycobacterium bovis subsp bovis AF2122/97
agcgcggugauggccacccgcu

SEQ ID NO: 23960 - RNA, 21 nt, Mycobacterium bovis subsp bovis AF2122/97
agcgguccuugaucagggacc

SEQ ID NO: 23961 - RNA, 22 nt, Mycobacterium bovis subsp bovis AF2122/97
agcgugcguuguugcaccgguu

SEQ ID NO: 23962 - RNA, 22 nt, Mycobacterium bovis subsp bovis AF2122/97
agcguggacguacugucgucgc

SEQ ID NO: 23963 - RNA, 21 nt, Mycobacterium bovis subsp bovis AF2122/97
agcguugccagguagcgggca

SEQ ID NO: 23964 - RNA, 19 nt, Mycobacterium bovis subsp bovis AF2122/97
agcucgcgcagccgggcgg

SEQ ID NO: 23965 - RNA, 21 nt, Mycobacterium bovis subsp bovis AF2122/97
agcucggccaaaagcgccggc

SEQ ID NO: 23966 - RNA, 22 nt, Mycobacterium bovis subsp bovis AF2122/97
agcugcagugcccgccggauga

SEQ ID NO: 23967 - RNA, 22 nt, Mycobacterium bovis subsp bovis AF2122/97
agcugcaugacgaacucggccu

SEQ ID NO: 23968 - RNA, 22 nt, Mycobacterium bovis subsp bovis AF2122/97
agcugguucuugaagcgugguc

SEQ ID NO: 23969 - RNA, 22 nt, Mycobacterium bovis subsp bovis AF2122/97
agcuguuggugccaccgccgca

SEQ ID NO: 23970 - RNA, 22 nt, Mycobacterium bovis subsp bovis AF2122/97
aggacgucgucgauuucgucga

SEQ ID NO: 23971 - RNA, 22 nt, Mycobacterium bovis subsp bovis AF2122/97
aggaugucggggcgaagcuuga

SEQ ID NO: 23972 - RNA, 22 nt, Mycobacterium bovis subsp bovis AF2122/97
aggcacacgccagacggcgccc

SEQ ID NO: 23973 - RNA, 22 nt, Mycobacterium bovis subsp bovis AF2122/97
aggccgaguucgucaugcagcu

SEQ ID NO: 23974 - RNA, 22 nt, Mycobacterium bovis subsp bovis AF2122/97
aggcgagauguggcccgcaggu

SEQ ID NO: 23975 - RNA, 22 nt, Mycobacterium bovis subsp bovis AF2122/97
aggcgguaccgguagcgccggu

SEQ ID NO: 23976 - RNA, 22 nt, Mycobacterium bovis subsp bovis AF2122/97
aggcugucggcucucaccgaca

SEQ ID NO: 23977 - RNA, 23 nt, Mycobacterium bovis subsp bovis AF2122/97
agggaugugguagccccggcgag

SEQ ID NO: 23978 - RNA, 22 nt, Mycobacterium bovis subsp bovis AF2122/97
agggcaccggcgaucgugucca

SEQ ID NO: 23979 - RNA, 22 nt, Mycobacterium bovis subsp bovis AF2122/97
agggcgaguacaccgagggugc

SEQ ID NO: 23980 - RNA, 21 nt, Mycobacterium bovis subsp bovis AF2122/97
agggcgauuuugcgucugcuc

SEQ ID NO: 23981 - RNA, 23 nt, Mycobacterium bovis subsp bovis AF2122/97
agggcgauuuugcgucugcucgc

SEQ ID NO: 23982 - RNA, 22 nt, Mycobacterium bovis subsp bovis AF2122/97
agggcgccgcugucgccggccc

SEQ ID NO: 23983 - RNA, 18 nt, Mycobacterium bovis subsp bovis AF2122/97
agggugugauguggcguc

SEQ ID NO: 23984 - RNA, 22 nt, Mycobacterium bovis subsp bovis AF2122/97
agguaaccacacaugccgcagg

SEQ ID NO: 23985 - RNA, 22 nt, Mycobacterium bovis subsp bovis AF2122/97
agguagacgugucccgcauggg

SEQ ID NO: 23986 - RNA, 22 nt, Mycobacterium bovis subsp bovis AF2122/97
aggucgugcagauagcgcgggu

SEQ ID NO: 23987 - RNA, 22 nt, Mycobacterium bovis subsp bovis AF2122/97
aggugcacgcugucgagccagc

SEQ ID NO: 23988 - RNA, 22 nt, Mycobacterium bovis subsp bovis AF2122/97
aguacgacaucgccgucagcgg

SEQ ID NO: 23989 - RNA, 22 nt, Mycobacterium bovis subsp bovis AF2122/97
agucagagucucgggcauguac

SEQ ID NO: 23990 - RNA, 22 nt, Mycobacterium bovis subsp bovis AF2122/97
agucgauguugucgccacggcu

SEQ ID NO: 23991 - RNA, 22 nt, Mycobacterium bovis subsp bovis AF2122/97
agucgcaaaagcccccgacacg

SEQ ID NO: 23992 - RNA, 22 nt, Mycobacterium bovis subsp bovis AF2122/97
agucgcugcaggggcugccgag

SEQ ID NO: 23993 - RNA, 22 nt, Mycobacterium bovis subsp bovis AF2122/97
agucggugguagucggugcggc

SEQ ID NO: 23994 - RNA, 22 nt, Mycobacterium bovis subsp bovis AF2122/97
agucucguucuugccgaaccca

SEQ ID NO: 23995 - RNA, 22 nt, Mycobacterium bovis subsp bovis AF2122/97
agugaucggcaccgcuuuggcg

SEQ ID NO: 23996 - RNA, 22 nt, Mycobacterium bovis subsp bovis AF2122/97
agugcgcaggucggcgacgucg

SEQ ID NO: 23997 - RNA, 22 nt, Mycobacterium bovis subsp bovis AF2122/97
agugcucgucguccugcucgac

SEQ ID NO: 23998 - RNA, 22 nt, Mycobacterium bovis subsp bovis AF2122/97
aguucaaccucuugucggccga

SEQ ID NO: 23999 - RNA, 22 nt, Mycobacterium bovis subsp bovis AF2122/97
aguucgcccacggcuguguguc

SEQ ID NO: 24000 - RNA, 22 nt, Mycobacterium bovis subsp bovis AF2122/97
aguucgugauggaggaugccgu

SEQ ID NO: 24001 - RNA, 22 nt, Mycobacterium bovis subsp bovis AF2122/97
aguugcacgaauuacuggaugu

SEQ ID NO: 24002 - RNA, 22 nt, Mycobacterium bovis subsp bovis AF2122/97
aguugccgaggauguugggcuu

SEQ ID NO: 24003 - RNA, 22 nt, Mycobacterium bovis subsp bovis AF2122/97
aguugguucggcgcggcguccg

SEQ ID NO: 24004 - RNA, 22 nt, Mycobacterium bovis subsp bovis AF2122/97
auagcggcgcugaucuccgaca

SEQ ID NO: 24005 - RNA, 22 nt, Mycobacterium bovis subsp bovis AF2122/97
auaucaccguuaucggagcgau

SEQ ID NO: 24006 - RNA, 22 nt, Mycobacterium bovis subsp bovis AF2122/97
aucaccaugcaacgcgaaaggg

SEQ ID NO: 24007 - RNA, 22 nt, Mycobacterium bovis subsp bovis AF2122/97
aucaccggcaccauagccuggc

SEQ ID NO: 24008 - RNA, 22 nt, Mycobacterium bovis subsp bovis AF2122/97
aucaccuuccucggcaugagau

SEQ ID NO: 24009 - RNA, 22 nt, Mycobacterium bovis subsp bovis AF2122/97
aucacgucaaggaggugcggcu

SEQ ID NO: 24010 - RNA, 21 nt, Mycobacterium bovis subsp bovis AF2122/97
aucagcgccgucuuuucccac

SEQ ID NO: 24011 - RNA, 22 nt, Mycobacterium bovis subsp bovis AF2122/97
aucagcggggacuugguuucgg

SEQ ID NO: 24012 - RNA, 23 nt, Mycobacterium bovis subsp bovis AF2122/97
aucagcuggauaggcaaggagac

SEQ ID NO: 24013 - RNA, 22 nt, Mycobacterium bovis subsp bovis AF2122/97
aucaucgaggccgucgggccgg

SEQ ID NO: 24014 - RNA, 22 nt, Mycobacterium bovis subsp bovis AF2122/97
auccaggaauugucagacguua

SEQ ID NO: 24015 - RNA, 22 nt, Mycobacterium bovis subsp bovis AF2122/97
aucccgagggacacaucugugc

SEQ ID NO: 24016 - RNA, 22 nt, Mycobacterium bovis subsp bovis AF2122/97
auccgcgcgacgaacuugucga

SEQ ID NO: 24017 - RNA, 22 nt, Mycobacterium bovis subsp bovis AF2122/97
auccgcuagccaacguuaauaa

SEQ ID NO: 24018 - RNA, 20 nt, Mycobacterium bovis subsp bovis AF2122/97
aucgacacaaucgguggauc

SEQ ID NO: 24019 - RNA, 22 nt, Mycobacterium bovis subsp bovis AF2122/97
aucgacaugacccucacgucgg

SEQ ID NO: 24020 - RNA, 22 nt, Mycobacterium bovis subsp bovis AF2122/97
aucgagauagccgcccugguca

SEQ ID NO: 24021 - RNA, 22 nt, Mycobacterium bovis subsp bovis AF2122/97
aucgagauugagccggccccga

SEQ ID NO: 24022 - RNA, 22 nt, Mycobacterium bovis subsp bovis AF2122/97
aucgaguugaugcgccaucgcg

SEQ ID NO: 24023 - RNA, 22 nt, Mycobacterium bovis subsp bovis AF2122/97
aucgcacguucugcugcagcgc

SEQ ID NO: 24024 - RNA, 22 nt, Mycobacterium bovis subsp bovis AF2122/97
aucgccuagccgcggcgggugg

SEQ ID NO: 24025 - RNA, 22 nt, Mycobacterium bovis subsp bovis AF2122/97
aucgccugcuggggcgccaucu

SEQ ID NO: 24026 - RNA, 22 nt, Mycobacterium bovis subsp bovis AF2122/97
caccgcgaaucuguccaaccag

SEQ ID NO: 24027 - RNA, 22 nt, Mycobacterium bovis subsp bovis AF2122/97
caccgguggucgccgagccacc

SEQ ID NO: 24028 - RNA, 22 nt, Mycobacterium bovis subsp bovis AF2122/97
caccugccgaucgcacagguug

SEQ ID NO: 24029 - RNA, 22 nt, Mycobacterium bovis subsp bovis AF2122/97
cacgccgacgagcuuccgcgac

SEQ ID NO: 24030 - RNA, 22 nt, Mycobacterium bovis subsp bovis AF2122/97
cacgccgcggcuguccucggug

SEQ ID NO: 24031 - RNA, 22 nt, Mycobacterium bovis subsp bovis AF2122/97
cacgcgugugacgcugcggcga

SEQ ID NO: 24032 - RNA, 22 nt, Mycobacterium bovis subsp bovis AF2122/97
cacggugagcccggugcgaaag

SEQ ID NO: 24033 - RNA, 22 nt, Mycobacterium bovis subsp bovis AF2122/97
cacggugaucggggaccggucg

SEQ ID NO: 24034 - RNA, 22 nt, Mycobacterium bovis subsp bovis AF2122/97
cacugguugucccaugggcggu

SEQ ID NO: 24035 - RNA, 22 nt, Mycobacterium bovis subsp bovis AF2122/97
cagacgcaaaagcaccccauuu

SEQ ID NO: 24036 - RNA, 22 nt, Mycobacterium bovis subsp bovis AF2122/97
cagacgcaaaaucgcccaauuc

SEQ ID NO: 24037 - RNA, 22 nt, Mycobacterium bovis subsp bovis AF2122/97
cagccgaucccgcaaauaguuc

SEQ ID NO: 24038 - RNA, 22 nt, Mycobacterium bovis subsp bovis AF2122/97
cagccgggugcgccgggcuugc

SEQ ID NO: 24039 - RNA, 22 nt, Mycobacterium bovis subsp bovis AF2122/97
cagccggugcuaucgguuucga

SEQ ID NO: 24040 - RNA, 22 nt, Mycobacterium bovis subsp bovis AF2122/97
cagccugaccgguucggcuaug

SEQ ID NO: 24041 - RNA, 22 nt, Mycobacterium bovis subsp bovis AF2122/97
cagcgugaacugagggcggaga

SEQ ID NO: 24042 - RNA, 22 nt, Mycobacterium bovis subsp bovis AF2122/97
cagcguugucucggcgaacacc

SEQ ID NO: 24043 - RNA, 22 nt, Mycobacterium bovis subsp bovis AF2122/97
cagcugcuccgugacuacggcu

SEQ ID NO: 24044 - RNA, 22 nt, Mycobacterium bovis subsp bovis AF2122/97
caggaggugcugcgggaggcga

SEQ ID NO: 24045 - RNA, 22 nt, Mycobacterium bovis subsp bovis AF2122/97
caggccgaccagagccucgacc

SEQ ID NO: 24046 - RNA, 22 nt, Mycobacterium bovis subsp bovis AF2122/97
caggccgccauggugggugccg

SEQ ID NO: 24047 - RNA, 22 nt, Mycobacterium bovis subsp bovis AF2122/97
caggcugcuggucggcccucuc

SEQ ID NO: 24048 - RNA, 22 nt, Mycobacterium bovis subsp bovis AF2122/97
uucaccggugcucuccgcgauc

SEQ ID NO: 24049 - RNA, 20 nt, Mycobacterium bovis subsp bovis AF2122/97
uucaccguggcaaccccggc

SEQ ID NO: 24050 - RNA, 22 nt, Mycobacterium bovis subsp bovis AF2122/97
uucaggccgaucggaggacgcc

SEQ ID NO: 24051 - RNA, 22 nt, Mycobacterium bovis subsp bovis AF2122/97
uucagggugcaugugaccgaug

SEQ ID NO: 24052 - RNA, 22 nt, Mycobacterium bovis subsp bovis AF2122/97
uucaugccucgcucgcgcacgc

SEQ ID NO: 24053 - RNA, 22 nt, Mycobacterium bovis subsp bovis AF2122/97
uuccacggacucgauucgcugc

SEQ ID NO: 24054 - RNA, 21 nt, Mycobacterium bovis subsp bovis AF2122/97
uuccacugccggcgccgguga

SEQ ID NO: 24055 - RNA, 22 nt, Mycobacterium bovis subsp bovis AF2122/97
uuccaucaccaaugcgcugggc

SEQ ID NO: 24056 - RNA, 22 nt, Mycobacterium bovis subsp bovis AF2122/97
uuccgcaauccuucgucggcgu

SEQ ID NO: 24057 - RNA, 22 nt, Mycobacterium bovis subsp bovis AF2122/97
uuccugcagcuuggucaggcga

SEQ ID NO: 24058 - RNA, 22 nt, Mycobacterium bovis subsp bovis AF2122/97
uuccuugugucaucgggcaggu

SEQ ID NO: 24059 - RNA, 22 nt, Mycobacterium bovis subsp bovis AF2122/97
uucgaccaguucauguugcggc

SEQ ID NO: 24060 - RNA, 22 nt, Mycobacterium bovis subsp bovis AF2122/97
uucgccgagcagacgcaaaagc

SEQ ID NO: 24061 - RNA, 22 nt, Mycobacterium bovis subsp bovis AF2122/97
uucgcgcaucaacggauugacc

SEQ ID NO: 24062 - RNA, 22 nt, Mycobacterium bovis subsp bovis AF2122/97
uucgcgucgguggugcugaagu

SEQ ID NO: 24063 - RNA, 22 nt, Mycobacterium bovis subsp bovis AF2122/97
uucggggcgacaccggcgacga

SEQ ID NO: 24064 - RNA, 22 nt, Mycobacterium bovis subsp bovis AF2122/97
uucgguaucgccuccgccuuug

SEQ ID NO: 24065 - RNA, 22 nt, Mycobacterium bovis subsp bovis AF2122/97
uucggucacuuccucgucgcgc

SEQ ID NO: 24066 - RNA, 22 nt, Mycobacterium bovis subsp bovis AF2122/97
uucggucgcggacucgucgcaa

SEQ ID NO: 24067 - RNA, 22 nt, Mycobacterium bovis subsp bovis AF2122/97
uucgucaccgacggccggcggg

SEQ ID NO: 24068 - RNA, 22 nt, Mycobacterium bovis subsp bovis AF2122/97
uucucccuagccggacuugccg

SEQ ID NO: 24069 - RNA, 22 nt, Mycobacterium bovis subsp bovis AF2122/97
uucucgcgcucgagugagcaga

SEQ ID NO: 24070 - RNA, 22 nt, Mycobacterium bovis subsp bovis AF2122/97
uucuuccaggcagagggcggug

SEQ ID NO: 24071 - RNA, 22 nt, Mycobacterium bovis subsp bovis AF2122/97
uugaccggcgcgaccagcggcu

SEQ ID NO: 24072 - RNA, 22 nt, Mycobacterium bovis subsp bovis AF2122/97
uugacucugcauccaccacgca

SEQ ID NO: 24073 - RNA, 22 nt, Mycobacterium bovis subsp bovis AF2122/97
uugagcucggugagguugcgca

SEQ ID NO: 24074 - RNA, 22 nt, Mycobacterium bovis subsp bovis AF2122/97
uugccaaugccgguguugacca

SEQ ID NO: 24075 - RNA, 22 nt, Mycobacterium bovis subsp bovis AF2122/97
uugcccgucgugcccuggacgu

SEQ ID NO: 24076 - RNA, 22 nt, Mycobacterium bovis subsp bovis AF2122/97
uugccgcgccauuacgcucgcc

SEQ ID NO: 24077 - RNA, 22 nt, Mycobacterium bovis subsp bovis AF2122/97
uugccggccagggugccguugg

SEQ ID NO: 24078 - RNA, 22 nt, Mycobacterium bovis subsp bovis AF2122/97
uugccggccaucugauagccgg

SEQ ID NO: 24079 - RNA, 22 nt, Mycobacterium bovis subsp bovis AF2122/97
uugcgaggugcgggccucggcc

SEQ ID NO: 24080 - RNA, 22 nt, Mycobacterium bovis subsp bovis AF2122/97
uugcggauccagaucgacgagc

SEQ ID NO: 24081 - RNA, 22 nt, Mycobacterium bovis subsp bovis AF2122/97
uugcguggauccgucaggugga

SEQ ID NO: 24082 - RNA, 22 nt, Mycobacterium bovis subsp bovis AF2122/97
uugcuccgagacggaggucugc

SEQ ID NO: 24083 - RNA, 22 nt, Mycobacterium bovis subsp bovis AF2122/97
uuggccaacccgguguuggcau

SEQ ID NO: 24084 - RNA, 22 nt, Mycobacterium bovis subsp bovis AF2122/97
uuggccggguggucgagcccgc

SEQ ID NO: 24085 - RNA, 22 nt, Mycobacterium bovis subsp bovis AF2122/97
uugggaugcuaacagcgccagc

SEQ ID NO: 24086 - RNA, 20 nt, Mycobacterium bovis subsp bovis AF2122/97
uugguagccgaugcgugcag

SEQ ID NO: 24087 - RNA, 22 nt, Mycobacterium bovis subsp bovis AF2122/97
uuggugaacggcacucggcaua

SEQ ID NO: 24088 - RNA, 22 nt, Mycobacterium bovis subsp bovis AF2122/97
uuggugaacguggugaucgagu

SEQ ID NO: 24089 - RNA, 22 nt, Mycobacterium bovis subsp bovis AF2122/97
uuggugggauccagccccagcc

SEQ ID NO: 24090 - RNA, 22 nt, Mycobacterium bovis subsp bovis AF2122/97
uugguuacgcugcgcuggucga

SEQ ID NO: 24091 - RNA, 22 nt, Mycobacterium bovis subsp bovis AF2122/97
uugucaaaguuggaggcgggau

SEQ ID NO: 24092 - RNA, 22 nt, Mycobacterium bovis subsp bovis AF2122/97
uugucaacgucggcgacaucaa

SEQ ID NO: 24093 - RNA, 22 nt, Mycobacterium bovis subsp bovis AF2122/97
uugucgccgucucgguccagcu

SEQ ID NO: 24094 - RNA, 22 nt, Mycobacterium bovis subsp bovis AF2122/97
uugucgccgugcaccaccugga

SEQ ID NO: 24095 - RNA, 22 nt, Mycobacterium bovis subsp bovis AF2122/97
uugucgccgugcagucgcgcga

SEQ ID NO: 24096 - RNA, 22 nt, Mycobacterium bovis subsp bovis AF2122/97
uugucgucgucggugccaaaau

SEQ ID NO: 24097 - RNA, 22 nt, Mycobacterium bovis subsp bovis AF2122/97
uugugcgauucugcgucugcuu

SEQ ID NO: 24098 - RNA, 22 nt, Mycobacterium bovis subsp bovis AF2122/97
uuguggcacaagucgcaucaaa

SEQ ID NO: 24099 - RNA, 22 nt, Mycobacterium bovis subsp bovis AF2122/97
uuguuccugagcgagugguucc

SEQ ID NO: 24100 - RNA, 22 nt, Mycobacterium bovis subsp bovis AF2122/97
uuguugcuuucgguagugcugg

SEQ ID NO: 24101 - RNA, 22 nt, Mycobacterium bovis subsp bovis AF2122/97
uuucauucguugcgcgcagacc

SEQ ID NO: 24102 - RNA, 22 nt, Mycobacterium bovis subsp bovis AF2122/97
uuuccgcccucaguucacgcug

SEQ ID NO: 24103 - RNA, 22 nt, Mycobacterium bovis subsp bovis AF2122/97
uuucgggcgauuuugcgucucg

SEQ ID NO: 24104 - RNA, 19 nt, Mycobacterium bovis subsp bovis AF2122/97
uuugauguuccgccggaug

SEQ ID NO: 24105 - RNA, 22 nt, Mycobacterium bovis subsp bovis AF2122/97
uuugccgaccugcugaccuggu

SEQ ID NO: 24106 - RNA, 22 nt, Mycobacterium bovis subsp bovis AF2122/97
uuugcggcggcuguccgcagac

SEQ ID NO: 24107 - RNA, 22 nt, Mycobacterium bovis subsp bovis AF2122/97
uuugcgucgagaucgacggcag

SEQ ID NO: 24108 - RNA, 22 nt, Mycobacterium bovis subsp bovis AF2122/97
uuuggccuggcaugcguggaac

SEQ ID NO: 24109 - RNA, 22 nt, Mycobacterium bovis subsp bovis AF2122/97
uuugguacggaacguaggcaga

SEQ ID NO: 24110 - RNA, 20 nt, Mycobacterium bovis subsp bovis AF2122/97
uuuugcccagcacgaucgcc

SEQ ID NO: 24111 - RNA, 22 nt, Mycobacterium bovis subsp bovis AF2122/97
uuuugggcgauuuugcgucucg

SEQ ID NO: 24112 - RNA, 22 nt, Mycobacterium bovis subsp bovis AF2122/97
gucgauauggcggugucgcaca

SEQ ID NO: 24113 - RNA, 22 nt, Mycobacterium bovis subsp bovis AF2122/97
gucgcaggauucccagucgcgg

SEQ ID NO: 24114 - RNA, 22 nt, Mycobacterium bovis subsp bovis AF2122/97
gucgccgcggucgugcugggug

SEQ ID NO: 24115 - RNA, 22 nt, Mycobacterium bovis subsp bovis AF2122/97
gucgccugcgucggcaacucgc

SEQ ID NO: 24116 - RNA, 22 nt, Mycobacterium bovis subsp bovis AF2122/97
gucgcggacagucccauguuag

SEQ ID NO: 24117 - RNA, 19 nt, Mycobacterium bovis subsp bovis AF2122/97
gucgcgucccucuggcaag

SEQ ID NO: 24118 - RNA, 22 nt, Mycobacterium bovis subsp bovis AF2122/97
gucggcaggaaggaugcgauga

SEQ ID NO: 24119 - RNA, 22 nt, Mycobacterium bovis subsp bovis AF2122/97
gucggcgccgacuuguuggcgc

SEQ ID NO: 24120 - RNA, 22 nt, Mycobacterium bovis subsp bovis AF2122/97
gucggcggacacaucucagucg

SEQ ID NO: 24121 - RNA, 22 nt, Mycobacterium bovis subsp bovis AF2122/97
gucggcgugggcuuuggaaacg

SEQ ID NO: 24122 - RNA, 22 nt, Mycobacterium bovis subsp bovis AF2122/97
gucggcuugcucgguguuggug

SEQ ID NO: 24123 - RNA, 20 nt, Mycobacterium bovis subsp bovis AF2122/97
gucgggauccccggcggcgc

SEQ ID NO: 24124 - RNA, 22 nt, Mycobacterium bovis subsp bovis AF2122/97
gucgggguggccuguuacgccg

SEQ ID NO: 24125 - RNA, 22 nt, Mycobacterium bovis subsp bovis AF2122/97
gucggguuucuucaacuccggu

SEQ ID NO: 24126 - RNA, 22 nt, Mycobacterium bovis subsp bovis AF2122/97
gucggucugaaaaugugcggcg

SEQ ID NO: 24127 - RNA, 22 nt, Mycobacterium bovis subsp bovis AF2122/97
gucggugaccgugcccggaggg

SEQ ID NO: 24128 - RNA, 22 nt, Mycobacterium bovis subsp bovis AF2122/97
gucggugucgucuccgugcuga

SEQ ID NO: 24129 - RNA, 22 nt, Mycobacterium bovis subsp bovis AF2122/97
gucgguucggucggccugcgaa

SEQ ID NO: 24130 - RNA, 22 nt, Mycobacterium bovis subsp bovis AF2122/97
gucgucgacgauccgacugagc

SEQ ID NO: 24131 - RNA, 22 nt, Mycobacterium bovis subsp bovis AF2122/97
gucgugacauucacucucgugg

SEQ ID NO: 24132 - RNA, 22 nt, Mycobacterium bovis subsp bovis AF2122/97
gucguggucuugaagucgauca

SEQ ID NO: 24133 - RNA, 21 nt, Mycobacterium bovis subsp bovis AF2122/97
gucguucuccaggaucagguc

SEQ ID NO: 24134 - RNA, 22 nt, Mycobacterium bovis subsp bovis AF2122/97
gucguuguggcuuaagguuucu

SEQ ID NO: 24135 - RNA, 22 nt, Mycobacterium bovis subsp bovis AF2122/97
gucuaccauuugggcgaucguc

SEQ ID NO: 24136 - RNA, 22 nt, Mycobacterium bovis subsp bovis AF2122/97
gucugcguugagaccagcaucc

SEQ ID NO: 24137 - RNA, 22 nt, Mycobacterium bovis subsp bovis AF2122/97
gugaacaccgacagcaccaacc

SEQ ID NO: 24138 - RNA, 22 nt, Mycobacterium bovis subsp bovis AF2122/97
gugacggcgagccgccaguuga

SEQ ID NO: 24139 - RNA, 22 nt, Mycobacterium bovis subsp bovis AF2122/97
gugacguugcgaucguguccga

SEQ ID NO: 24140 - RNA, 22 nt, Mycobacterium bovis subsp bovis AF2122/97
gugagcagacgcaaaagccccc

SEQ ID NO: 24141 - RNA, 22 nt, Mycobacterium bovis subsp bovis AF2122/97
gugagccauagguugucggugg

SEQ ID NO: 24142 - RNA, 22 nt, Mycobacterium bovis subsp bovis AF2122/97
gugagcugcagcgccccgaucc

SEQ ID NO: 24143 - RNA, 22 nt, Mycobacterium bovis subsp bovis AF2122/97
gugagguucuugaucacgacca

SEQ ID NO: 24144 - RNA, 22 nt, Mycobacterium bovis subsp bovis AF2122/97
gugauccaucucuaugagcgug

SEQ ID NO: 24145 - RNA, 22 nt, Mycobacterium bovis subsp bovis AF2122/97
gugcaagucgaucugccggcgc

SEQ ID NO: 24146 - RNA, 22 nt, Mycobacterium bovis subsp bovis AF2122/97
gugccgacgacgugguguucag

SEQ ID NO: 24147 - RNA, 22 nt, Mycobacterium bovis subsp bovis AF2122/97
gugccgaucuugcucggucaug

SEQ ID NO: 24148 - RNA, 22 nt, Mycobacterium bovis subsp bovis AF2122/97
gugccggggggcgcgccaucga

SEQ ID NO: 24149 - RNA, 22 nt, Mycobacterium bovis subsp bovis AF2122/97
gugccguucgacugcccguaga

SEQ ID NO: 24150 - RNA, 22 nt, Mycobacterium bovis subsp bovis AF2122/97
gugcggaucaucgagaucggcg

SEQ ID NO: 24151 - RNA, 22 nt, Mycobacterium bovis subsp bovis AF2122/97
gugcggccuaguuuggccaguu

SEQ ID NO: 24152 - RNA, 22 nt, Mycobacterium bovis subsp bovis AF2122/97
gugcggcuaccccggcguccug

SEQ ID NO: 24153 - RNA, 22 nt, Mycobacterium bovis subsp bovis AF2122/97
gugcgggccugccgccgugacu

SEQ ID NO: 24154 - RNA, 22 nt, Mycobacterium bovis subsp bovis AF2122/97
gugcgguuguggggcgaucaga

SEQ ID NO: 24155 - RNA, 22 nt, Mycobacterium bovis subsp bovis AF2122/97
gugcuaguccucugcgugccgu

SEQ ID NO: 24156 - RNA, 22 nt, Mycobacterium bovis subsp bovis AF2122/97
gugcucaugaccggccaaugcg

SEQ ID NO: 24157 - RNA, 22 nt, Mycobacterium bovis subsp bovis AF2122/97
gugcugcagcgcggugagggcc

SEQ ID NO: 24158 - RNA, 22 nt, Mycobacterium bovis subsp bovis AF2122/97
gugcugguggucgucggcggag

SEQ ID NO: 24159 - RNA, 22 nt, Mycobacterium bovis subsp bovis AF2122/97
gugcuugccgcgcuggggcgca

SEQ ID NO: 24160 - RNA, 22 nt, Mycobacterium bovis subsp bovis AF2122/97
guggacgaccgcggugaccccc

SEQ ID NO: 24161 - RNA, 22 nt, Mycobacterium bovis subsp bovis AF2122/97
guggccgaacguggucauggcc

SEQ ID NO: 24162 - RNA, 22 nt, Mycobacterium bovis subsp bovis AF2122/97
guggcgacaagagccguaaacu

SEQ ID NO: 24163 - RNA, 22 nt, Mycobacterium bovis subsp bovis AF2122/97
guggcgaccgacguugucgcgg

SEQ ID NO: 24164 - RNA, 22 nt, Mycobacterium bovis subsp bovis AF2122/97
guggcggucgcuagguccggaa

SEQ ID NO: 24165 - RNA, 22 nt, Mycobacterium bovis subsp bovis AF2122/97
guggguggaacacggcuaggug

SEQ ID NO: 24166 - RNA, 22 nt, Mycobacterium bovis subsp bovis AF2122/97
gugguagagcaccugggcgagc

SEQ ID NO: 24167 - RNA, 22 nt, Mycobacterium bovis subsp bovis AF2122/97
guggucgucgacgcgagugcca

SEQ ID NO: 24168 - RNA, 22 nt, Mycobacterium bovis subsp bovis AF2122/97
gugguggacagcucccggcggg

SEQ ID NO: 24169 - RNA, 22 nt, Mycobacterium bovis subsp bovis AF2122/97
gugguggccguggccgcgucgu

SEQ ID NO: 24170 - RNA, 22 nt, Mycobacterium bovis subsp bovis AF2122/97
gugguggcgcaauucgaccagg

SEQ ID NO: 24171 - RNA, 22 nt, Mycobacterium bovis subsp bovis AF2122/97
guguccgucgugggccaguugg

SEQ ID NO: 24172 - RNA, 22 nt, Mycobacterium bovis subsp bovis AF2122/97
gugucggcggcaacgccgugcu

SEQ ID NO: 24173 - RNA, 22 nt, Mycobacterium bovis subsp bovis AF2122/97
gugucguccaugauucggccga

SEQ ID NO: 24174 - RNA, 22 nt, Mycobacterium bovis subsp bovis AF2122/97
gugucuggcggcggugacacug

SEQ ID NO: 24175 - RNA, 22 nt, Mycobacterium bovis subsp bovis AF2122/97
gugugagccugacagcccgaca

SEQ ID NO: 24176 - RNA, 22 nt, Mycobacterium bovis subsp bovis AF2122/97
gugugcuggcggauuuucugga

SEQ ID NO: 24177 - RNA, 22 nt, Mycobacterium bovis subsp bovis AF2122/97
guguugcgcucgaugagccugg

SEQ ID NO: 24178 - RNA, 22 nt, Mycobacterium bovis subsp bovis AF2122/97
guucagggcaucgguccgugcc

SEQ ID NO: 24179 - RNA, 22 nt, Mycobacterium bovis subsp bovis AF2122/97
guuccgccgacuggucgaggag

SEQ ID NO: 24180 - RNA, 22 nt, Mycobacterium bovis subsp bovis AF2122/97
guuccgguguccgguuggucga

SEQ ID NO: 24181 - RNA, 23 nt, Mycobacterium bovis subsp bovis AF2122/97
guuccgucaccgaagacgucgcc

SEQ ID NO: 24182 - RNA, 22 nt, Mycobacterium bovis subsp bovis AF2122/97
guucgacgaucuggccggucug

SEQ ID NO: 24183 - RNA, 22 nt, Mycobacterium bovis subsp bovis AF2122/97
guucgcaucgaggagcggcaua

SEQ ID NO: 24184 - RNA, 22 nt, Mycobacterium bovis subsp bovis AF2122/97
guucgccgagauccuccggcug

SEQ ID NO: 24185 - RNA, 22 nt, Mycobacterium bovis subsp bovis AF2122/97
guucggcaccggcggcgccggu

SEQ ID NO: 24186 - RNA, 22 nt, Mycobacterium bovis subsp bovis AF2122/97
guucggcgcuuuccgccauuug

SEQ ID NO: 24187 - RNA, 22 nt, Mycobacterium bovis subsp bovis AF2122/97
guucgggugcuagaugccgcau

SEQ ID NO: 24188 - RNA, 22 nt, Mycobacterium bovis subsp bovis AF2122/97
guucguagagcgccucggcgcg

SEQ ID NO: 24189 - RNA, 22 nt, Mycobacterium bovis subsp bovis AF2122/97
guugaucccgcugcuuacccgg

SEQ ID NO: 24190 - RNA, 22 nt, Mycobacterium bovis subsp bovis AF2122/97
guugauuuccggucacuagucg

SEQ ID NO: 24191 - RNA, 22 nt, Mycobacterium bovis subsp bovis AF2122/97
guugcccgagggugcgaccuug

SEQ ID NO: 24192 - RNA, 22 nt, Mycobacterium bovis subsp bovis AF2122/97
guugccgcuccgggacgggcca

SEQ ID NO: 24193 - RNA, 17 nt, Mycobacterium bovis subsp bovis AF2122/97
guugccggugggacgga

SEQ ID NO: 24194 - RNA, 22 nt, Mycobacterium bovis subsp bovis AF2122/97
guugcgcauacccgacgugcug

SEQ ID NO: 24195 - RNA, 22 nt, Mycobacterium bovis subsp bovis AF2122/97
guuggcgauguucucguugucg

SEQ ID NO: 24196 - RNA, 22 nt, Mycobacterium bovis subsp bovis AF2122/97
guuggcgcagcucgucgguucc

SEQ ID NO: 24197 - RNA, 22 nt, Mycobacterium bovis subsp bovis AF2122/97
guugggcagcgucacggucguc

SEQ ID NO: 24198 - RNA, 22 nt, Mycobacterium bovis subsp bovis AF2122/97
guugucaugugcauggugaccg

SEQ ID NO: 24199 - RNA, 22 nt, Mycobacterium bovis subsp bovis AF2122/97
guugugaagacgccauucgcag

SEQ ID NO: 24200 - RNA, 22 nt, Mycobacterium bovis subsp bovis AF2122/97
guuucgcugucgcuggccgugu

SEQ ID NO: 24201 - RNA, 22 nt, Mycobacterium bovis subsp bovis AF2122/97
guuuuccucggugcgggcgcgc

SEQ ID NO: 24202 - RNA, 22 nt, Mycobacterium bovis subsp bovis AF2122/97
uaaccgcauacgaugucgcugc

SEQ ID NO: 24203 - RNA, 22 nt, Mycobacterium bovis subsp bovis AF2122/97
uaagcugcgccagccacgccgu

SEQ ID NO: 24204 - RNA, 22 nt, Mycobacterium bovis subsp bovis AF2122/97
uaccagcuggccuuccggacac

SEQ ID NO: 24205 - RNA, 22 nt, Mycobacterium bovis subsp bovis AF2122/97
uacccggucgguguucgaccau

SEQ ID NO: 24206 - RNA, 22 nt, Mycobacterium bovis subsp bovis AF2122/97
uaccgauaccgggcgcaccggu

SEQ ID NO: 24207 - RNA, 22 nt, Mycobacterium bovis subsp bovis AF2122/97
uaccggugcgcccgguaucggu

SEQ ID NO: 24208 - RNA, 21 nt, Mycobacterium bovis subsp bovis AF2122/97
uaccgguucgggcaagucgac

SEQ ID NO: 24209 - RNA, 22 nt, Mycobacterium bovis subsp bovis AF2122/97
uaccgucgcugaccuuuuggcg

SEQ ID NO: 24210 - RNA, 22 nt, Mycobacterium bovis subsp bovis AF2122/97
uaccugggguucuugcugaucg

SEQ ID NO: 24211 - RNA, 22 nt, Mycobacterium bovis subsp bovis AF2122/97
uacgcggugaccguagccggau

SEQ ID NO: 24212 - RNA, 22 nt, Mycobacterium bovis subsp bovis AF2122/97
uacggcauucggcacacguugu

SEQ ID NO: 24213 - RNA, 23 nt, Mycobacterium bovis subsp bovis AF2122/97
uacggcgucacgauguugaaggc

SEQ ID NO: 24214 - RNA, 22 nt, Mycobacterium bovis subsp bovis AF2122/97
uacucggcggacaucggaugcg

SEQ ID NO: 24215 - RNA, 22 nt, Mycobacterium bovis subsp bovis AF2122/97
uacuggauccgccggcggcugc

SEQ ID NO: 24216 - RNA, 20 nt, Mycobacterium bovis subsp bovis AF2122/97
uagacgcaggaucaacggcu

SEQ ID NO: 24217 - RNA, 22 nt, Mycobacterium bovis subsp bovis AF2122/97
uagacguccauaucgccaugcc

SEQ ID NO: 24218 - RNA, 23 nt, Mycobacterium bovis subsp bovis AF2122/97
uagcccaguucacgugccaaaug

SEQ ID NO: 24219 - RNA, 22 nt, Mycobacterium bovis subsp bovis AF2122/97
uagcgcccggccacuggccaau

SEQ ID NO: 24220 - RNA, 22 nt, Mycobacterium bovis subsp bovis AF2122/97
uagcggcgaagcgggccacgcu

SEQ ID NO: 24221 - RNA, 22 nt, Mycobacterium bovis subsp bovis AF2122/97
uagcugcguagcucgugccggu

SEQ ID NO: 24222 - RNA, 21 nt, Mycobacterium bovis subsp bovis AF2122/97
uaggcgaucgccucguccaag

SEQ ID NO: 24223 - RNA, 22 nt, Mycobacterium bovis subsp bovis AF2122/97
uaggggugcaccgauccgcccu

SEQ ID NO: 24224 - RNA, 22 nt, Mycobacterium bovis subsp bovis AF2122/97
uauccccugcacggcggcggau

SEQ ID NO: 24225 - RNA, 22 nt, Mycobacterium bovis subsp bovis AF2122/97
uaucgagggcaccggccuguuc

SEQ ID NO: 24226 - RNA, 22 nt, Mycobacterium bovis subsp bovis AF2122/97
uaucgguggccuccucggccug

SEQ ID NO: 24227 - RNA, 22 nt, Mycobacterium bovis subsp bovis AF2122/97
uaucgguggugguugcggcugg

SEQ ID NO: 24228 - RNA, 22 nt, Mycobacterium bovis subsp bovis AF2122/97
uaucgugggaugcgcuacuccu

SEQ ID NO: 24229 - RNA, 22 nt, Mycobacterium bovis subsp bovis AF2122/97
uaucugcuggccagucccgacg

SEQ ID NO: 24230 - RNA, 22 nt, Mycobacterium bovis subsp bovis AF2122/97
uaugcgcgaaaccucggcaccc

SEQ ID NO: 24231 - RNA, 22 nt, Mycobacterium bovis subsp bovis AF2122/97
ucaacaucggcagcaaccucgc

SEQ ID NO: 24232 - RNA, 22 nt, Mycobacterium bovis subsp bovis AF2122/97
ucaccacugccaagaucaccga

SEQ ID NO: 24233 - RNA, 22 nt, Mycobacterium bovis subsp bovis AF2122/97
ucaccgcgaugaacgacgccga

SEQ ID NO: 24234 - RNA, 22 nt, Mycobacterium bovis subsp bovis AF2122/97
ucaccgguccugcugcaucguc

SEQ ID NO: 24235 - RNA, 19 nt, Mycobacterium bovis subsp bovis AF2122/97
ucacgcaccccgugcagca

SEQ ID NO: 24236 - RNA, 22 nt, Mycobacterium bovis subsp bovis AF2122/97
ucacgcuaacccuuugcguggc

SEQ ID NO: 24237 - RNA, 22 nt, Mycobacterium bovis subsp bovis AF2122/97
ucagacgaucccguuccugccc

SEQ ID NO: 24238 - RNA, 23 nt, Mycobacterium bovis subsp bovis AF2122/97
ucagcgugacgccgagaucagcg

SEQ ID NO: 24239 - RNA, 19 nt, Mycobacterium bovis subsp bovis AF2122/97
ucagcuguacucgaugaau

SEQ ID NO: 24240 - RNA, 22 nt, Mycobacterium bovis subsp bovis AF2122/97
ucagguacgcgucagcagauug

SEQ ID NO: 24241 - RNA, 22 nt, Mycobacterium bovis subsp bovis AF2122/97
ucagucuuucgucgcgguggcu

SEQ ID NO: 24242 - RNA, 22 nt, Mycobacterium bovis subsp bovis AF2122/97
ucaucgaggcuguaguuggcgc

SEQ ID NO: 24243 - RNA, 20 nt, Mycobacterium bovis subsp bovis AF2122/97
ucaucgugucuucgggcgcc

SEQ ID NO: 24244 - RNA, 22 nt, Mycobacterium bovis subsp bovis AF2122/97
ucaugcgauucugcguccugcu

SEQ ID NO: 24245 - RNA, 22 nt, Mycobacterium bovis subsp bovis AF2122/97
ucauguucuuucgcgucuacuc

SEQ ID NO: 24246 - RNA, 20 nt, Mycobacterium bovis subsp bovis AF2122/97
uccacgguuuaucgugccca

SEQ ID NO: 24247 - RNA, 23 nt, Mycobacterium bovis subsp bovis AF2122/97
uccagcccgacucauacccgcug

SEQ ID NO: 24248 - RNA, 22 nt, Mycobacterium bovis subsp bovis AF2122/97
uccagcucguacuucucgucgg

SEQ ID NO: 24249 - RNA, 23 nt, Mycobacterium bovis subsp bovis AF2122/97
uccagggcaugcugaccgucgcc

SEQ ID NO: 24250 - RNA, 22 nt, Mycobacterium bovis subsp bovis AF2122/97
uccauaccgcgguauccgguga

SEQ ID NO: 24251 - RNA, 22 nt, Mycobacterium bovis subsp bovis AF2122/97
uccauggggucagucuugcgca

SEQ ID NO: 24252 - RNA, 22 nt, Mycobacterium bovis subsp bovis AF2122/97
ucccccuucaaggggaccggag

SEQ ID NO: 24253 - RNA, 22 nt, Mycobacterium bovis subsp bovis AF2122/97
uccccgcggugcuggcgaugcu

SEQ ID NO: 24254 - RNA, 22 nt, Mycobacterium bovis subsp bovis AF2122/97
ucccgggucgugccgacccggg

SEQ ID NO: 24255 - RNA, 22 nt, Mycobacterium bovis subsp bovis AF2122/97
ucccgguucuucaagaaacacu

SEQ ID NO: 24256 - RNA, 22 nt, Mycobacterium bovis subsp bovis AF2122/97
uccgccgcggucaucgcggcca

SEQ ID NO: 24257 - RNA, 22 nt, Mycobacterium bovis subsp bovis AF2122/97
uccgccgugaguucacguucgg

SEQ ID NO: 24258 - RNA, 23 nt, Mycobacterium bovis subsp bovis AF2122/97
uccgcgucacaagauccgcucga

SEQ ID NO: 24259 - RNA, 22 nt, Mycobacterium bovis subsp bovis AF2122/97
uccggcccaacaucguugaggu

SEQ ID NO: 24260 - RNA, 22 nt, Mycobacterium bovis subsp bovis AF2122/97
uccggcggugguguagcuucga

SEQ ID NO: 24261 - RNA, 22 nt, Mycobacterium bovis subsp bovis AF2122/97
uccggcuacggucaccgcguau

SEQ ID NO: 24262 - RNA, 22 nt, Mycobacterium bovis subsp bovis AF2122/97
uccgucggugauccuggccacc

SEQ ID NO: 24263 - RNA, 22 nt, Mycobacterium bovis subsp bovis AF2122/97
uccguugcaacaccuucggaug

SEQ ID NO: 24264 - RNA, 22 nt, Mycobacterium bovis subsp bovis AF2122/97
uccguuggccgcguucguccau

SEQ ID NO: 24265 - RNA, 22 nt, Mycobacterium bovis subsp bovis AF2122/97
uccucagucguugacagcgcuc

SEQ ID NO: 24266 - RNA, 20 nt, Mycobacterium bovis subsp bovis AF2122/97
uccuggcggcguuguucggc

SEQ ID NO: 24267 - RNA, 22 nt, Mycobacterium bovis subsp bovis AF2122/97
uccuuuccgucgaugcggaagc

SEQ ID NO: 24268 - RNA, 22 nt, Mycobacterium bovis subsp bovis AF2122/97
ucgaacauccacagcgccgcgg

SEQ ID NO: 24269 - RNA, 23 nt, Mycobacterium bovis subsp bovis AF2122/97
ucgaaggaaaugacgcaaugacc

SEQ ID NO: 24270 - RNA, 22 nt, Mycobacterium bovis subsp bovis AF2122/97
ucgacaacgcgucgaaaggucg

SEQ ID NO: 24271 - RNA, 22 nt, Mycobacterium bovis subsp bovis AF2122/97
ucgaccguccucagugugugag

SEQ ID NO: 24272 - RNA, 22 nt, Mycobacterium bovis subsp bovis AF2122/97
ucgaccgugacggcaggggcgu

SEQ ID NO: 24273 - RNA, 22 nt, Mycobacterium bovis subsp bovis AF2122/97
ucgacgaugaccagucgccggc

SEQ ID NO: 24274 - RNA, 22 nt, Mycobacterium bovis subsp bovis AF2122/97
ucgacgccgaacgucaacccga

SEQ ID NO: 24275 - RNA, 21 nt, Mycobacterium bovis subsp bovis AF2122/97
ucgacggccguagcgccgccc

SEQ ID NO: 24276 - RNA, 22 nt, Mycobacterium bovis subsp bovis AF2122/97
ucgacgguuccucguucggcac

SEQ ID NO: 24277 - RNA, 22 nt, Mycobacterium bovis subsp bovis AF2122/97
ucgacgucuugucgcagcgagu

SEQ ID NO: 24278 - RNA, 20 nt, Mycobacterium bovis subsp bovis AF2122/97
ucgacgugccccggaucacc

SEQ ID NO: 24279 - RNA, 22 nt, Mycobacterium bovis subsp bovis AF2122/97
ucgacgugcggcagcagccuuc

SEQ ID NO: 24280 - RNA, 22 nt, Mycobacterium bovis subsp bovis AF2122/97
ucgacuugcccgaaccgcuggg

SEQ ID NO: 24281 - RNA, 22 nt, Mycobacterium bovis subsp bovis AF2122/97
ucgagcggaucuugugacgcgg

SEQ ID NO: 24282 - RNA, 22 nt, Mycobacterium bovis subsp bovis AF2122/97
ucgaggaugcuggcucgacggc

SEQ ID NO: 24283 - RNA, 22 nt, Mycobacterium bovis subsp bovis AF2122/97
ucgagugaguuccgggcaccac

SEQ ID NO: 24284 - RNA, 20 nt, Mycobacterium bovis subsp bovis AF2122/97
ucgaucucggucaugccguc

SEQ ID NO: 24285 - RNA, 22 nt, Mycobacterium bovis subsp bovis AF2122/97
ucgaugccggccucgaucuggc

SEQ ID NO: 24286 - RNA, 22 nt, Mycobacterium bovis subsp bovis AF2122/97
ucgaugccucacccagguacac

SEQ ID NO: 24287 - RNA, 22 nt, Mycobacterium bovis subsp bovis AF2122/97
ucgauggugaugacgcuggcgc

SEQ ID NO: 24288 - RNA, 22 nt, Mycobacterium bovis subsp bovis AF2122/97
ucgaugucggagcgcacugcgu

SEQ ID NO: 24289 - RNA, 22 nt, Mycobacterium bovis subsp bovis AF2122/97
ucgcagccacguuacgcucgcg

SEQ ID NO: 24290 - RNA, 22 nt, Mycobacterium bovis subsp bovis AF2122/97
ucgcagccacguuacgcucgug

SEQ ID NO: 24291 - RNA, 22 nt, Mycobacterium bovis subsp bovis AF2122/97
ucgcaguccgguuacgcucgcg

SEQ ID NO: 24292 - RNA, 23 nt, Mycobacterium bovis subsp bovis AF2122/97
ucgcagugccguuacgcucgugg

SEQ ID NO: 24293 - RNA, 22 nt, Mycobacterium bovis subsp bovis AF2122/97
ucgcagugccguuacguucgug

SEQ ID NO: 24294 - RNA, 22 nt, Mycobacterium bovis subsp bovis AF2122/97
ucgcaguggcguuacgcucgcg

SEQ ID NO: 24295 - RNA, 22 nt, Mycobacterium bovis subsp bovis AF2122/97
ucgccaguggcgaguccccguu

SEQ ID NO: 24296 - RNA, 22 nt, Mycobacterium bovis subsp bovis AF2122/97
ucgcccagcgagugcgccuggu

SEQ ID NO: 24297 - RNA, 22 nt, Mycobacterium bovis subsp bovis AF2122/97
ucgcccgguggugcugguagcc

SEQ ID NO: 24298 - RNA, 22 nt, Mycobacterium bovis subsp bovis AF2122/97
ucgcccugagaacacguucggc

SEQ ID NO: 24299 - RNA, 22 nt, Mycobacterium bovis subsp bovis AF2122/97
ucgcccugaguucacgcucggc

SEQ ID NO: 24300 - RNA, 23 nt, Mycobacterium bovis subsp bovis AF2122/97
ucgcccuggcuucacguucggcg

SEQ ID NO: 24301 - RNA, 22 nt, Mycobacterium bovis subsp bovis AF2122/97
ucgccgaccacggcgugccguu

SEQ ID NO: 24302 - RNA, 22 nt, Mycobacterium bovis subsp bovis AF2122/97
ucgccgacggaguggccggcca

SEQ ID NO: 24303 - RNA, 22 nt, Mycobacterium bovis subsp bovis AF2122/97
ucgccgagccuguaauuuugca

SEQ ID NO: 24304 - RNA, 22 nt, Mycobacterium bovis subsp bovis AF2122/97
ucgccgaucggcguggugcccu

SEQ ID NO: 24305 - RNA, 20 nt, Mycobacterium bovis subsp bovis AF2122/97
ucgccgccaacaaggugccc

SEQ ID NO: 24306 - RNA, 22 nt, Mycobacterium bovis subsp bovis AF2122/97
ucgccggucucccagucgaaga

SEQ ID NO: 24307 - RNA, 21 nt, Mycobacterium bovis subsp bovis AF2122/97
ucgccguggcguuacgcucgc

SEQ ID NO: 24308 - RNA, 22 nt, Mycobacterium bovis subsp bovis AF2122/97
ucgccuccuucgaggaagagcc

SEQ ID NO: 24309 - RNA, 22 nt, Mycobacterium bovis subsp bovis AF2122/97
ucgcgcuggcagacccgccgcc

SEQ ID NO: 24310 - RNA, 22 nt, Mycobacterium bovis subsp bovis AF2122/97
ucgcggcaugggaucacugggu

SEQ ID NO: 24311 - RNA, 22 nt, Mycobacterium bovis subsp bovis AF2122/97
ucgcgguugcuguuuaccgcca

SEQ ID NO: 24312 - RNA, 22 nt, Mycobacterium bovis subsp bovis AF2122/97
ucgcgucgccagauucacaauc

SEQ ID NO: 24313 - RNA, 22 nt, Mycobacterium bovis subsp bovis AF2122/97
ucgcgucgucagauucacaauc

SEQ ID NO: 24314 - RNA, 22 nt, Mycobacterium bovis subsp bovis AF2122/97
ucgcucgcaucgcgaucuuuua

SEQ ID NO: 24315 - RNA, 22 nt, Mycobacterium bovis subsp bovis AF2122/97
ucgcucggccgugguggucugc

SEQ ID NO: 24316 - RNA, 22 nt, Mycobacterium bovis subsp bovis AF2122/97
ucgcuggucgacgcguucgguc

SEQ ID NO: 24317 - RNA, 23 nt, Mycobacterium bovis subsp bovis AF2122/97
ucggaucgacuacaucgugagcc

SEQ ID NO: 24318 - RNA, 22 nt, Mycobacterium bovis subsp bovis AF2122/97
ucggcacggucuuggccugggu

SEQ ID NO: 24319 - RNA, 22 nt, Mycobacterium bovis subsp bovis AF2122/97
ucggccauggcgcgcuggacau

SEQ ID NO: 24320 - RNA, 22 nt, Mycobacterium bovis subsp bovis AF2122/97
ucggcgaaggugaucucgcugg

SEQ ID NO: 24321 - RNA, 22 nt, Mycobacterium bovis subsp bovis AF2122/97
ucggcggcggcccgauugucgc

SEQ ID NO: 24322 - RNA, 22 nt, Mycobacterium bovis subsp bovis AF2122/97
ucggcggcuaucacaccggcga

SEQ ID NO: 24323 - RNA, 22 nt, Mycobacterium bovis subsp bovis AF2122/97
ucggcggcuucgaugacacggu

SEQ ID NO: 24324 - RNA, 22 nt, Mycobacterium bovis subsp bovis AF2122/97
ucggcggugaucuugccuacuu

SEQ ID NO: 24325 - RNA, 22 nt, Mycobacterium bovis subsp bovis AF2122/97
ucggcgguucguuugaccguga

SEQ ID NO: 24326 - RNA, 22 nt, Mycobacterium bovis subsp bovis AF2122/97
ucggcguucuggucuacgagcu

SEQ ID NO: 24327 - RNA, 22 nt, Mycobacterium bovis subsp bovis AF2122/97
ucggcuccguacuugccgugcu

SEQ ID NO: 24328 - RNA, 22 nt, Mycobacterium bovis subsp bovis AF2122/97
gcgaucauccgucggacuugau

SEQ ID NO: 24329 - RNA, 22 nt, Mycobacterium bovis subsp bovis AF2122/97
gcgaugcgcgauuacgucgaac

SEQ ID NO: 24330 - RNA, 21 nt, Mycobacterium bovis subsp bovis AF2122/97
gcgauucugcgucugcucgcc

SEQ ID NO: 24331 - RNA, 22 nt, Mycobacterium bovis subsp bovis AF2122/97
gcgauuuugugucugcucgccg

SEQ ID NO: 24332 - RNA, 19 nt, Mycobacterium bovis subsp bovis AF2122/97
gcgcaccgacgaucagguc

SEQ ID NO: 24333 - RNA, 22 nt, Mycobacterium bovis subsp bovis AF2122/97
gcgcacgagucgcugguggugg

SEQ ID NO: 24334 - RNA, 21 nt, Mycobacterium bovis subsp bovis AF2122/97
gcgcagcaucucagccagugc

SEQ ID NO: 24335 - RNA, 22 nt, Mycobacterium bovis subsp bovis AF2122/97
gcgcaugaacccuuccugcacc

SEQ ID NO: 24336 - RNA, 22 nt, Mycobacterium bovis subsp bovis AF2122/97
gcgccagugcugcgcgugcaca

SEQ ID NO: 24337 - RNA, 22 nt, Mycobacterium bovis subsp bovis AF2122/97
gcgccaucacacagcgcgucga

SEQ ID NO: 24338 - RNA, 22 nt, Mycobacterium bovis subsp bovis AF2122/97
gcgccgaacgugcccugguggc

SEQ ID NO: 24339 - RNA, 22 nt, Mycobacterium bovis subsp bovis AF2122/97
gcgccgaguccagguccuccag

SEQ ID NO: 24340 - RNA, 22 nt, Mycobacterium bovis subsp bovis AF2122/97
gcgccgaugccgacgacaccag

SEQ ID NO: 24341 - RNA, 22 nt, Mycobacterium bovis subsp bovis AF2122/97
gcgccgccggggaucccgaccu

SEQ ID NO: 24342 - RNA, 22 nt, Mycobacterium bovis subsp bovis AF2122/97
gcgccgguguugauauugccgg

SEQ ID NO: 24343 - RNA, 22 nt, Mycobacterium bovis subsp bovis AF2122/97
gcgccgucgauccuagccgcug

SEQ ID NO: 24344 - RNA, 22 nt, Mycobacterium bovis subsp bovis AF2122/97
gcgcgacaucgaacuggcguag

SEQ ID NO: 24345 - RNA, 22 nt, Mycobacterium bovis subsp bovis AF2122/97
gcgcgcagucgaaguugaccgg

SEQ ID NO: 24346 - RNA, 22 nt, Mycobacterium bovis subsp bovis AF2122/97
gcgcgcuagcuggcaucccgaa

SEQ ID NO: 24347 - RNA, 22 nt, Mycobacterium bovis subsp bovis AF2122/97
gcgcgcugugguaggcgaggcg

SEQ ID NO: 24348 - RNA, 22 nt, Mycobacterium bovis subsp bovis AF2122/97
gcgcggaaguccuuggcgggcg

SEQ ID NO: 24349 - RNA, 22 nt, Mycobacterium bovis subsp bovis AF2122/97
gcgcggcuccggugcuugucga

SEQ ID NO: 24350 - RNA, 23 nt, Mycobacterium bovis subsp bovis AF2122/97
gcgcggucccgcucaacaucguu

SEQ ID NO: 24351 - RNA, 22 nt, Mycobacterium bovis subsp bovis AF2122/97
gcgcugacacuccccucgggau

SEQ ID NO: 24352 - RNA, 22 nt, Mycobacterium bovis subsp bovis AF2122/97
gcgcugcggcacuccgacgaca

SEQ ID NO: 24353 - RNA, 22 nt, Mycobacterium bovis subsp bovis AF2122/97
gcgcugcugcguggcgauccgu

SEQ ID NO: 24354 - RNA, 22 nt, Mycobacterium bovis subsp bovis AF2122/97
gcgcuggucggaauuccucgaa

SEQ ID NO: 24355 - RNA, 22 nt, Mycobacterium bovis subsp bovis AF2122/97
gcggaauccucggcgucgcccu

SEQ ID NO: 24356 - RNA, 22 nt, Mycobacterium bovis subsp bovis AF2122/97
gcggaggagcgugcuucgauuc

SEQ ID NO: 24357 - RNA, 22 nt, Mycobacterium bovis subsp bovis AF2122/97
gcggaguccuugcucaccauga

SEQ ID NO: 24358 - RNA, 22 nt, Mycobacterium bovis subsp bovis AF2122/97
gcggcagggaaaggccgugguc

SEQ ID NO: 24359 - RNA, 22 nt, Mycobacterium bovis subsp bovis AF2122/97
gcggcaguucgccaguggcgag

SEQ ID NO: 24360 - RNA, 22 nt, Mycobacterium bovis subsp bovis AF2122/97
gcggccgguaauugcuuugauc

SEQ ID NO: 24361 - RNA, 22 nt, Mycobacterium bovis subsp bovis AF2122/97
gcggcgaucaagcccgacuagu

SEQ ID NO: 24362 - RNA, 22 nt, Mycobacterium bovis subsp bovis AF2122/97
gcgggcaucaccgucgugcagg

SEQ ID NO: 24363 - RNA, 22 nt, Mycobacterium bovis subsp bovis AF2122/97
gcgggcggucgugcgacgaagu

SEQ ID NO: 24364 - RNA, 22 nt, Mycobacterium bovis subsp bovis AF2122/97
gcgggugcgguauuggugcccg

SEQ ID NO: 24365 - RNA, 22 nt, Mycobacterium bovis subsp bovis AF2122/97
gcggguguugacgauggaacgg

SEQ ID NO: 24366 - RNA, 22 nt, Mycobacterium bovis subsp bovis AF2122/97
gcggguuuucggcuccgugcga

SEQ ID NO: 24367 - RNA, 22 nt, Mycobacterium bovis subsp bovis AF2122/97
gcgguaguagaggucccgguag

SEQ ID NO: 24368 - RNA, 22 nt, Mycobacterium bovis subsp bovis AF2122/97
gcgguaucuacaggcucggcga

SEQ ID NO: 24369 - RNA, 22 nt, Mycobacterium bovis subsp bovis AF2122/97
gcggugaucgacgaugucugua

SEQ ID NO: 24370 - RNA, 22 nt, Mycobacterium bovis subsp bovis AF2122/97
gcgguggaucucggcgccgauu

SEQ ID NO: 24371 - RNA, 21 nt, Mycobacterium bovis subsp bovis AF2122/97
gcgguggcggucguagacggc

SEQ ID NO: 24372 - RNA, 19 nt, Mycobacterium bovis subsp bovis AF2122/97
gcgguggcucgugggcgcg

SEQ ID NO: 24373 - RNA, 22 nt, Mycobacterium bovis subsp bovis AF2122/97
gcgucauugggcccaacggggu

SEQ ID NO: 24374 - RNA, 22 nt, Mycobacterium bovis subsp bovis AF2122/97
gcauucaacgcgucggcgaguu

SEQ ID NO: 24375 - RNA, 22 nt, Mycobacterium bovis subsp bovis AF2122/97
gccaaaccggucugagaucgcg

SEQ ID NO: 24376 - RNA, 22 nt, Mycobacterium bovis subsp bovis AF2122/97
gccaacaccgacgacggucgca

SEQ ID NO: 24377 - RNA, 22 nt, Mycobacterium bovis subsp bovis AF2122/97
gccaccacucaggccgcgguca

SEQ ID NO: 24378 - RNA, 22 nt, Mycobacterium bovis subsp bovis AF2122/97
gccaccgccagggcaauauccc

SEQ ID NO: 24379 - RNA, 19 nt, Mycobacterium bovis subsp bovis AF2122/97
gccaccgcgaaccgucgcc

SEQ ID NO: 24380 - RNA, 22 nt, Mycobacterium bovis subsp bovis AF2122/97
gccaccuucugcgcgaugcgca

SEQ ID NO: 24381 - RNA, 22 nt, Mycobacterium bovis subsp bovis AF2122/97
gccacggaauuguucgcugagc

SEQ ID NO: 24382 - RNA, 22 nt, Mycobacterium bovis subsp bovis AF2122/97
gccacugugaauggcacgacgc

SEQ ID NO: 24383 - RNA, 21 nt, Mycobacterium bovis subsp bovis AF2122/97
gccagcacgguguucaaguug

SEQ ID NO: 24384 - RNA, 22 nt, Mycobacterium bovis subsp bovis AF2122/97
gccagcucaaaaaguacgguuc

SEQ ID NO: 24385 - RNA, 22 nt, Mycobacterium bovis subsp bovis AF2122/97
gccaggacgucgacagcuucga

SEQ ID NO: 24386 - RNA, 22 nt, Mycobacterium bovis subsp bovis AF2122/97
gccaggucaucgagcgaaucca

SEQ ID NO: 24387 - RNA, 22 nt, Mycobacterium bovis subsp bovis AF2122/97
gccaugccgaccgcggcgaucg

SEQ ID NO: 24388 - RNA, 22 nt, Mycobacterium bovis subsp bovis AF2122/97
gccaugguugcacguucggcgu

SEQ ID NO: 24389 - RNA, 21 nt, Mycobacterium bovis subsp bovis AF2122/97
gcccagcaggaaaggccuuug

SEQ ID NO: 24390 - RNA, 22 nt, Mycobacterium bovis subsp bovis AF2122/97
gcccaucauguucuuuugcgcc

SEQ ID NO: 24391 - RNA, 22 nt, Mycobacterium bovis subsp bovis AF2122/97
gcccaucgagauucgcggacug

SEQ ID NO: 24392 - RNA, 22 nt, Mycobacterium bovis subsp bovis AF2122/97
gcccgcacccugcacgaccggc

SEQ ID NO: 24393 - RNA, 22 nt, Mycobacterium bovis subsp bovis AF2122/97
gcccgccuacacaugcuggcgg

SEQ ID NO: 24394 - RNA, 21 nt, Mycobacterium bovis subsp bovis AF2122/97
gcccggcauggacuccucacc

SEQ ID NO: 24395 - RNA, 23 nt, Mycobacterium bovis subsp bovis AF2122/97
gcccggcgauccucggucagugc

SEQ ID NO: 24396 - RNA, 22 nt, Mycobacterium bovis subsp bovis AF2122/97
gcccggcggauucggcaucuuu

SEQ ID NO: 24397 - RNA, 22 nt, Mycobacterium bovis subsp bovis AF2122/97
gcccgugcggauccaguccggu

SEQ ID NO: 24398 - RNA, 22 nt, Mycobacterium bovis subsp bovis AF2122/97
gcccucaguucacguucggcga

SEQ ID NO: 24399 - RNA, 22 nt, Mycobacterium bovis subsp bovis AF2122/97
gcccugagcgcagacgcgaugc

SEQ ID NO: 24400 - RNA, 22 nt, Mycobacterium bovis subsp bovis AF2122/97
gcccugaguucacgcucggcgc

SEQ ID NO: 24401 - RNA, 22 nt, Mycobacterium bovis subsp bovis AF2122/97
gccgaacgugaagccagggcga

SEQ ID NO: 24402 - RNA, 22 nt, Mycobacterium bovis subsp bovis AF2122/97
gccgagcgcgccgaggucccca

SEQ ID NO: 24403 - RNA, 22 nt, Mycobacterium bovis subsp bovis AF2122/97
gccgagcgugaacucagggcga

SEQ ID NO: 24404 - RNA, 22 nt, Mycobacterium bovis subsp bovis AF2122/97
gccgagcgugaacucagggcgg

SEQ ID NO: 24405 - RNA, 22 nt, Mycobacterium bovis subsp bovis AF2122/97
gccgaguugcgucgcugggauc

SEQ ID NO: 24406 - RNA, 22 nt, Mycobacterium bovis subsp bovis AF2122/97
gccgcaccgacuaccaccgacu

SEQ ID NO: 24407 - RNA, 22 nt, Mycobacterium bovis subsp bovis AF2122/97
gccgccaccagugcacauucgg

SEQ ID NO: 24408 - RNA, 22 nt, Mycobacterium bovis subsp bovis AF2122/97
gccgccagcucucggcgcuggc

SEQ ID NO: 24409 - RNA, 22 nt, Mycobacterium bovis subsp bovis AF2122/97
gccgccggcauugugcuggcuu

SEQ ID NO: 24410 - RNA, 22 nt, Mycobacterium bovis subsp bovis AF2122/97
gccgcggugcuagaacgcagcc

SEQ ID NO: 24411 - RNA, 22 nt, Mycobacterium bovis subsp bovis AF2122/97
gccgcguguucgacuggguggu

SEQ ID NO: 24412 - RNA, 22 nt, Mycobacterium bovis subsp bovis AF2122/97
gccggaacgguguagucgauga

SEQ ID NO: 24413 - RNA, 22 nt, Mycobacterium bovis subsp bovis AF2122/97
gccggcaugccgcgacauucac

SEQ ID NO: 24414 - RNA, 22 nt, Mycobacterium bovis subsp bovis AF2122/97
gccggccauagcggccauggaa

SEQ ID NO: 24415 - RNA, 22 nt, Mycobacterium bovis subsp bovis AF2122/97
gccggcggcaguaccggcccga

SEQ ID NO: 24416 - RNA, 22 nt, Mycobacterium bovis subsp bovis AF2122/97
gccggcguuggcugccuugggu

SEQ ID NO: 24417 - RNA, 22 nt, Mycobacterium bovis subsp bovis AF2122/97
gccgggcuggccauaauggcgg

SEQ ID NO: 24418 - RNA, 22 nt, Mycobacterium bovis subsp bovis AF2122/97
gccggguccacccggcugaucu

SEQ ID NO: 24419 - RNA, 22 nt, Mycobacterium bovis subsp bovis AF2122/97
gccggucguggguacgggccuc

SEQ ID NO: 24420 - RNA, 22 nt, Mycobacterium bovis subsp bovis AF2122/97
gccggugguggacgccgccgcg

SEQ ID NO: 24421 - RNA, 22 nt, Mycobacterium bovis subsp bovis AF2122/97
ccgacgaggaaauggcuccgau

SEQ ID NO: 24422 - RNA, 22 nt, Mycobacterium bovis subsp bovis AF2122/97
ccgacgaguaccacgcgcagga

SEQ ID NO: 24423 - RNA, 22 nt, Mycobacterium bovis subsp bovis AF2122/97
ccgacugugaaucucacgacgc

SEQ ID NO: 24424 - RNA, 22 nt, Mycobacterium bovis subsp bovis AF2122/97
ccgagaaggaagaagccgaccg

SEQ ID NO: 24425 - RNA, 22 nt, Mycobacterium bovis subsp bovis AF2122/97
ccgagaucaacguucugcaggc

SEQ ID NO: 24426 - RNA, 22 nt, Mycobacterium bovis subsp bovis AF2122/97
ccgagugaaggugggguacaug

SEQ ID NO: 24427 - RNA, 22 nt, Mycobacterium bovis subsp bovis AF2122/97
ccgaucgcugcgcugaucgcgg

SEQ ID NO: 24428 - RNA, 22 nt, Mycobacterium bovis subsp bovis AF2122/97
ccgaugucaucgaggaucaguc

SEQ ID NO: 24429 - RNA, 22 nt, Mycobacterium bovis subsp bovis AF2122/97
ccgcaucgagcgggcaugauug

SEQ ID NO: 24430 - RNA, 23 nt, Mycobacterium bovis subsp bovis AF2122/97
ccgccaccagggcacguucggcg

SEQ ID NO: 24431 - RNA, 22 nt, Mycobacterium bovis subsp bovis AF2122/97
ccgcccaggcucccgcucgacg

SEQ ID NO: 24432 - RNA, 22 nt, Mycobacterium bovis subsp bovis AF2122/97
ccgccggcgaagccguugccgu

SEQ ID NO: 24433 - RNA, 23 nt, Mycobacterium bovis subsp bovis AF2122/97
ccgccgguucggaugaucucgcc

SEQ ID NO: 24434 - RNA, 22 nt, Mycobacterium bovis subsp bovis AF2122/97
ccgcgacagugaaauccacgac

SEQ ID NO: 24435 - RNA, 22 nt, Mycobacterium bovis subsp bovis AF2122/97
ccgcgacugggaauccugcgac

SEQ ID NO: 24436 - RNA, 22 nt, Mycobacterium bovis subsp bovis AF2122/97
ccgcgacugugagucuggcgac

SEQ ID NO: 24437 - RNA, 22 nt, Mycobacterium bovis subsp bovis AF2122/97
ccgcgaucuccuccucgcugag

SEQ ID NO: 24438 - RNA, 22 nt, Mycobacterium bovis subsp bovis AF2122/97
ccgcgccacgaaguuggcugac

SEQ ID NO: 24439 - RNA, 22 nt, Mycobacterium bovis subsp bovis AF2122/97
ccgcgcgguagcggucuagguc

SEQ ID NO: 24440 - RNA, 21 nt, Mycobacterium bovis subsp bovis AF2122/97
ccgcgcugacacuggaccauc

SEQ ID NO: 24441 - RNA, 19 nt, Mycobacterium bovis subsp bovis AF2122/97
ccgcgguggcuucacgguc

SEQ ID NO: 24442 - RNA, 20 nt, Mycobacterium bovis subsp bovis AF2122/97
ccgcgguucacgccgguggc

SEQ ID NO: 24443 - RNA, 22 nt, Mycobacterium bovis subsp bovis AF2122/97
ccgcugcugcucgugguugggg

SEQ ID NO: 24444 - RNA, 22 nt, Mycobacterium bovis subsp bovis AF2122/97
ccgcuuggggugacacgggguu

SEQ ID NO: 24445 - RNA, 22 nt, Mycobacterium bovis subsp bovis AF2122/97
ccggaagcagcuccggauucaa

SEQ ID NO: 24446 - RNA, 22 nt, Mycobacterium bovis subsp bovis AF2122/97
ccggacggauuagccggacuca

SEQ ID NO: 24447 - RNA, 22 nt, Mycobacterium bovis subsp bovis AF2122/97
ccggauauccgcucuuggcuuc

SEQ ID NO: 24448 - RNA, 23 nt, Mycobacterium bovis subsp bovis AF2122/97
ccggcccggcauguucguccggg

SEQ ID NO: 24449 - RNA, 22 nt, Mycobacterium bovis subsp bovis AF2122/97
ccggccgaacugacgugcuucg

SEQ ID NO: 24450 - RNA, 20 nt, Mycobacterium bovis subsp bovis AF2122/97
ccggccgucggcccgguacc

SEQ ID NO: 24451 - RNA, 22 nt, Mycobacterium bovis subsp bovis AF2122/97
ccggcgaccacuggucggcugg

SEQ ID NO: 24452 - RNA, 22 nt, Mycobacterium bovis subsp bovis AF2122/97
ccggcggacgacgucggguccc

SEQ ID NO: 24453 - RNA, 22 nt, Mycobacterium bovis subsp bovis AF2122/97
ccggcggcaccaccugggucgg

SEQ ID NO: 24454 - RNA, 22 nt, Mycobacterium bovis subsp bovis AF2122/97
ccggcucacccagggugaccac

SEQ ID NO: 24455 - RNA, 22 nt, Mycobacterium bovis subsp bovis AF2122/97
ccggcugcgcgcauccuggcga

SEQ ID NO: 24456 - RNA, 20 nt, Mycobacterium bovis subsp bovis AF2122/97
ccgggcggaacgugucagcc

SEQ ID NO: 24457 - RNA, 22 nt, Mycobacterium bovis subsp bovis AF2122/97
ccgggcggaugaugggucggcu

SEQ ID NO: 24458 - RNA, 22 nt, Mycobacterium bovis subsp bovis AF2122/97
ccggguaucggcugcaccccgu

SEQ ID NO: 24459 - RNA, 22 nt, Mycobacterium bovis subsp bovis AF2122/97
ccgggucgcucaugcucucgau

SEQ ID NO: 24460 - RNA, 22 nt, Mycobacterium bovis subsp bovis AF2122/97
ccggguugggcuucggagcggu

SEQ ID NO: 24461 - RNA, 22 nt, Mycobacterium bovis subsp bovis AF2122/97
ccggugcgaaaaauccgcucga

SEQ ID NO: 24462 - RNA, 22 nt, Mycobacterium bovis subsp bovis AF2122/97
ccgguggcggugaugcugucgu

SEQ ID NO: 24463 - RNA, 22 nt, Mycobacterium bovis subsp bovis AF2122/97
ccggugggcgauggucucguag

SEQ ID NO: 24464 - RNA, 22 nt, Mycobacterium bovis subsp bovis AF2122/97
ccguaucaccggucgcugacaa

SEQ ID NO: 24465 - RNA, 22 nt, Mycobacterium bovis subsp bovis AF2122/97
ccgucgagaucgacgucagcgc

SEQ ID NO: 24466 - RNA, 22 nt, Mycobacterium bovis subsp bovis AF2122/97
ccgucgauguacuucaggcggu

SEQ ID NO: 24467 - RNA, 22 nt, Mycobacterium bovis subsp bovis AF2122/97
ccgucggcgaguuggcccgcga

SEQ ID NO: 24468 - RNA, 22 nt, Mycobacterium bovis subsp bovis AF2122/97
ccgucucaccgaggauuucgac

SEQ ID NO: 24469 - RNA, 21 nt, Mycobacterium bovis subsp bovis AF2122/97
ccgugacguuacgcucgcgac

SEQ ID NO: 24470 - RNA, 22 nt, Mycobacterium bovis subsp bovis AF2122/97
ccgugagccggugcagagccgg

SEQ ID NO: 24471 - RNA, 21 nt, Mycobacterium bovis subsp bovis AF2122/97
ccgugcugacccuguacccgc

SEQ ID NO: 24472 - RNA, 21 nt, Mycobacterium bovis subsp bovis AF2122/97
ccguuaccgaucagcggacgg

SEQ ID NO: 24473 - RNA, 22 nt, Mycobacterium bovis subsp bovis AF2122/97
ccguucuugaucagcggaccac

SEQ ID NO: 24474 - RNA, 22 nt, Mycobacterium bovis subsp bovis AF2122/97
ccuacacagcggccgcgucagc

SEQ ID NO: 24475 - RNA, 16 nt, Mycobacterium bovis subsp bovis AF2122/97
ccucaccggccaggcg

SEQ ID NO: 24476 - RNA, 22 nt, Mycobacterium bovis subsp bovis AF2122/97
ccucgacguggugcgaguuggu

SEQ ID NO: 24477 - RNA, 22 nt, Mycobacterium bovis subsp bovis AF2122/97
ccucgcccccgggcaugccguc

SEQ ID NO: 24478 - RNA, 22 nt, Mycobacterium bovis subsp bovis AF2122/97
ccucggcgucgguacgggcgau

SEQ ID NO: 24479 - RNA, 22 nt, Mycobacterium bovis subsp bovis AF2122/97
ccucuaccuugugggcaccucc

SEQ ID NO: 24480 - RNA, 20 nt, Mycobacterium bovis subsp bovis AF2122/97
ccugaugugaguccagccgg

SEQ ID NO: 24481 - RNA, 22 nt, Mycobacterium bovis subsp bovis AF2122/97
ccuuggaugcaggcuaucgccg

SEQ ID NO: 24482 - RNA, 22 nt, Mycobacterium bovis subsp bovis AF2122/97
cgaaaucgacauuagcgcggug

SEQ ID NO: 24483 - RNA, 22 nt, Mycobacterium bovis subsp bovis AF2122/97
cgaacagacacagaaucgcacg

SEQ ID NO: 24484 - RNA, 22 nt, Mycobacterium bovis subsp bovis AF2122/97
cgaacuaucgugacggcgccuu

SEQ ID NO: 24485 - RNA, 22 nt, Mycobacterium bovis subsp bovis AF2122/97
cgaauacgccgcggucgccgac

SEQ ID NO: 24486 - RNA, 22 nt, Mycobacterium bovis subsp bovis AF2122/97
cgacccuucguugagcgccgau

SEQ ID NO: 24487 - RNA, 19 nt, Mycobacterium bovis subsp bovis AF2122/97
cgaccgcgcacguguuggc

SEQ ID NO: 24488 - RNA, 22 nt, Mycobacterium bovis subsp bovis AF2122/97
cgaccgucgucgguguuggcgg

SEQ ID NO: 24489 - RNA, 22 nt, Mycobacterium bovis subsp bovis AF2122/97
cgacgaggcgcaacggauuccg

SEQ ID NO: 24490 - RNA, 22 nt, Mycobacterium bovis subsp bovis AF2122/97
cgacgccgccccgauauugcag

SEQ ID NO: 24491 - RNA, 22 nt, Mycobacterium bovis subsp bovis AF2122/97
cgacguggugguggccggcggu

SEQ ID NO: 24492 - RNA, 22 nt, Mycobacterium bovis subsp bovis AF2122/97
cgacguucggguccggcgcugg

SEQ ID NO: 24493 - RNA, 22 nt, Mycobacterium bovis subsp bovis AF2122/97
cgacuguggauccugcgacgcg

SEQ ID NO: 24494 - RNA, 22 nt, Mycobacterium bovis subsp bovis AF2122/97
aagaguucgcgcagcgccucgg

SEQ ID NO: 24495 - RNA, 22 nt, Mycobacterium bovis subsp bovis AF2122/97
aagaucaacaguggugcccaca

SEQ ID NO: 24496 - RNA, 22 nt, Mycobacterium bovis subsp bovis AF2122/97
aagcagacgcagaaucgcacaa

SEQ ID NO: 24497 - RNA, 22 nt, Mycobacterium bovis subsp bovis AF2122/97
aagcauuggagccggacccgcg

SEQ ID NO: 24498 - RNA, 22 nt, Mycobacterium bovis subsp bovis AF2122/97
aagccgauggccgcggacgccg

SEQ ID NO: 24499 - RNA, 22 nt, Mycobacterium bovis subsp bovis AF2122/97
aagcggggcgcgcguuccguau

SEQ ID NO: 24500 - RNA, 22 nt, Mycobacterium bovis subsp bovis AF2122/97
aagcucgauggauccagcggcc

SEQ ID NO: 24501 - RNA, 22 nt, Mycobacterium bovis subsp bovis AF2122/97
aagcucgugcagcgauucgcca

SEQ ID NO: 24502 - RNA, 22 nt, Mycobacterium bovis subsp bovis AF2122/97
aaggcgagcgacgucuuucccg

SEQ ID NO: 24503 - RNA, 22 nt, Mycobacterium bovis subsp bovis AF2122/97
aaggcuguggccggcgucgucg

SEQ ID NO: 24504 - RNA, 22 nt, Mycobacterium bovis subsp bovis AF2122/97
aaggucgucaugcugaugcccg

SEQ ID NO: 24505 - RNA, 22 nt, Mycobacterium bovis subsp bovis AF2122/97
aaguagggucggcacaccucaa

SEQ ID NO: 24506 - RNA, 22 nt, Mycobacterium bovis subsp bovis AF2122/97
aaguccagcagaucgaucucgc

SEQ ID NO: 24507 - RNA, 22 nt, Mycobacterium bovis subsp bovis AF2122/97
aagugcaacacgaacguuggau

SEQ ID NO: 24508 - RNA, 22 nt, Mycobacterium bovis subsp bovis AF2122/97
aaguggcgcuuuugcgucugcu

SEQ ID NO: 24509 - RNA, 22 nt, Mycobacterium bovis subsp bovis AF2122/97
aauccggccugugucgggucgu

SEQ ID NO: 24510 - RNA, 22 nt, Mycobacterium bovis subsp bovis AF2122/97
aaucgaaugaaagccguagguu

SEQ ID NO: 24511 - RNA, 22 nt, Mycobacterium bovis subsp bovis AF2122/97
aaucggcacuguugcagcgggu

SEQ ID NO: 24512 - RNA, 22 nt, Mycobacterium bovis subsp bovis AF2122/97
aaucuggugaaugcaccccaua

SEQ ID NO: 24513 - RNA, 22 nt, Mycobacterium bovis subsp bovis AF2122/97
aaugaugccgucgguggccagg

SEQ ID NO: 24514 - RNA, 22 nt, Mycobacterium bovis subsp bovis AF2122/97
aaugggcgauuuugcgucugcu

SEQ ID NO: 24515 - RNA, 22 nt, Mycobacterium bovis subsp bovis AF2122/97
acacaccgacgaucucgccgac

SEQ ID NO: 24516 - RNA, 22 nt, Mycobacterium bovis subsp bovis AF2122/97
acacagguacgcgggucggugu

SEQ ID NO: 24517 - RNA, 22 nt, Mycobacterium bovis subsp bovis AF2122/97
acaccgaguucauggcgcccgc

SEQ ID NO: 24518 - RNA, 22 nt, Mycobacterium bovis subsp bovis AF2122/97
acaccgguguugacgaugccgg

SEQ ID NO: 24519 - RNA, 22 nt, Mycobacterium bovis subsp bovis AF2122/97
acacgccacccugcugggcaug

SEQ ID NO: 24520 - RNA, 22 nt, Mycobacterium bovis subsp bovis AF2122/97
acacggcaaagaucaggaaugc

SEQ ID NO: 24521 - RNA, 22 nt, Mycobacterium bovis subsp bovis AF2122/97
acagcgcgguucgcggaccgaa

SEQ ID NO: 24522 - RNA, 22 nt, Mycobacterium bovis subsp bovis AF2122/97
acaggucggcaccaccaucggg

SEQ ID NO: 24523 - RNA, 22 nt, Mycobacterium bovis subsp bovis AF2122/97
accaccagcugcaggucaucga

SEQ ID NO: 24524 - RNA, 22 nt, Mycobacterium bovis subsp bovis AF2122/97
accagcuccauggccagguugc

SEQ ID NO: 24525 - RNA, 22 nt, Mycobacterium bovis subsp bovis AF2122/97
accagugucgcgagguccugcu

SEQ ID NO: 24526 - RNA, 22 nt, Mycobacterium bovis subsp bovis AF2122/97
accaucgucgggcucgagacgc

SEQ ID NO: 24527 - RNA, 22 nt, Mycobacterium bovis subsp bovis AF2122/97
acccgcacggcgauguucauca

SEQ ID NO: 24528 - RNA, 22 nt, Mycobacterium bovis subsp bovis AF2122/97
acccgcggccaaggcgucgguc

SEQ ID NO: 24529 - RNA, 22 nt, Mycobacterium bovis subsp bovis AF2122/97
acccgggucggcacgacccggg

SEQ ID NO: 24530 - RNA, 22 nt, Mycobacterium bovis subsp bovis AF2122/97
acccgucgauguucgagccggu

SEQ ID NO: 24531 - RNA, 22 nt, Mycobacterium bovis subsp bovis AF2122/97
accgacugaugagcgcgucagc

SEQ ID NO: 24532 - RNA, 22 nt, Mycobacterium bovis subsp bovis AF2122/97
accgagucgcgaggcguuccgg

SEQ ID NO: 24533 - RNA, 22 nt, Mycobacterium bovis subsp bovis AF2122/97
accgcaucaaggaauugguugg

SEQ ID NO: 24534 - RNA, 22 nt, Mycobacterium bovis subsp bovis AF2122/97
accgccaccuugucccugcgcu

SEQ ID NO: 24535 - RNA, 22 nt, Mycobacterium bovis subsp bovis AF2122/97
accgcccgucgggcgcgcuguu

SEQ ID NO: 24536 - RNA, 22 nt, Mycobacterium bovis subsp bovis AF2122/97
accgccgguccguucaugccgu

SEQ ID NO: 24537 - RNA, 22 nt, Mycobacterium bovis subsp bovis AF2122/97
accgcgaccaggucaacacucg

SEQ ID NO: 24538 - RNA, 22 nt, Mycobacterium bovis subsp bovis AF2122/97
accgcgaccgcugcgacguugu

SEQ ID NO: 24539 - RNA, 22 nt, Mycobacterium bovis subsp bovis AF2122/97
accgcggugcucgaucguggcc

SEQ ID NO: 24540 - RNA, 22 nt, Mycobacterium bovis subsp bovis AF2122/97
accggcacaccguuuucagagg

SEQ ID NO: 24541 - RNA, 22 nt, Mycobacterium bovis subsp bovis AF2122/97
accggccgucagcgcgcccguc

SEQ ID NO: 24542 - RNA, 22 nt, Mycobacterium bovis subsp bovis AF2122/97
accggcuacgcugcuguucacg

SEQ ID NO: 24543 - RNA, 22 nt, Mycobacterium bovis subsp bovis AF2122/97
accggguuggcguccagcgcgg

SEQ ID NO: 24544 - RNA, 22 nt, Mycobacterium bovis subsp bovis AF2122/97
accggugugcuggcgaagguuc

SEQ ID NO: 24545 - RNA, 18 nt, Mycobacterium bovis subsp bovis AF2122/97
accgguguuuucgucgcg

SEQ ID NO: 24546 - RNA, 22 nt, Mycobacterium bovis subsp bovis AF2122/97
accgucagggcaucaccgaggc

SEQ ID NO: 24547 - RNA, 22 nt, Mycobacterium bovis subsp bovis AF2122/97
accgugauuguuccgcaccgac

SEQ ID NO: 24548 - RNA, 22 nt, Mycobacterium bovis subsp bovis AF2122/97
accguggugaugcacgggaugu

SEQ ID NO: 24549 - RNA, 20 nt, Mycobacterium bovis subsp bovis AF2122/97
accucgcgccgcacaugguc

SEQ ID NO: 24550 - RNA, 22 nt, Mycobacterium bovis subsp bovis AF2122/97
accugcacuucucgcugcugcc

SEQ ID NO: 24551 - RNA, 22 nt, Mycobacterium bovis subsp bovis AF2122/97
accugcuccuugcugaucccgg

SEQ ID NO: 24552 - RNA, 23 nt, Mycobacterium bovis subsp bovis AF2122/97
acgacgccggccacagccuugac

SEQ ID NO: 24553 - RNA, 22 nt, Mycobacterium bovis subsp bovis AF2122/97
acgagauugccgucauggcugu

SEQ ID NO: 24554 - RNA, 22 nt, Mycobacterium bovis subsp bovis AF2122/97
acgagcguaacgucacggcuga

SEQ ID NO: 24555 - RNA, 22 nt, Mycobacterium bovis subsp bovis AF2122/97
acgaucgucgcccaggccgcga

SEQ ID NO: 24556 - RNA, 22 nt, Mycobacterium bovis subsp bovis AF2122/97
acgcagaggacuagcacgucga

SEQ ID NO: 24557 - RNA, 19 nt, Mycobacterium bovis subsp bovis AF2122/97
acgcccaacgaacgugggc

SEQ ID NO: 24558 - RNA, 22 nt, Mycobacterium bovis subsp bovis AF2122/97
acgccgcgcacgacaugguuag

SEQ ID NO: 24559 - RNA, 22 nt, Mycobacterium bovis subsp bovis AF2122/97
acgccugguaguuguucacgcu

SEQ ID NO: 24560 - RNA, 22 nt, Mycobacterium bovis subsp bovis AF2122/97
acgcggucagcuucaggcauug

SEQ ID NO: 24561 - RNA, 22 nt, Mycobacterium bovis subsp bovis AF2122/97
acggcaucuccaugggucauga

SEQ ID NO: 24562 - RNA, 22 nt, Mycobacterium bovis subsp bovis AF2122/97
acggcccauuguggcggccguc

SEQ ID NO: 24563 - RNA, 22 nt, Mycobacterium bovis subsp bovis AF2122/97
acggcccgacacgggcucggcc

SEQ ID NO: 24564 - RNA, 20 nt, Mycobacterium bovis subsp bovis AF2122/97
acggccuggccugucggcgc

SEQ ID NO: 24565 - RNA, 22 nt, Mycobacterium bovis subsp bovis AF2122/97
auucggggccuuuugcgucugc

SEQ ID NO: 24566 - RNA, 22 nt, Mycobacterium bovis subsp bovis AF2122/97
auucggucgccugaucgguucc

SEQ ID NO: 24567 - RNA, 22 nt, Mycobacterium bovis subsp bovis AF2122/97
auucuugggugcugaucucugg

SEQ ID NO: 24568 - RNA, 22 nt, Mycobacterium bovis subsp bovis AF2122/97
auugcgagccacgcagguugaa

SEQ ID NO: 24569 - RNA, 22 nt, Mycobacterium bovis subsp bovis AF2122/97
auugcgcacgucguugucggcu

SEQ ID NO: 24570 - RNA, 22 nt, Mycobacterium bovis subsp bovis AF2122/97
auuggccaguggccgggcgcua

SEQ ID NO: 24571 - RNA, 22 nt, Mycobacterium bovis subsp bovis AF2122/97
auugggcgauucugcgucugcu

SEQ ID NO: 24572 - RNA, 22 nt, Mycobacterium bovis subsp bovis AF2122/97
auugggcgauuuugcgucugcu

SEQ ID NO: 24573 - RNA, 22 nt, Mycobacterium bovis subsp bovis AF2122/97
auugggcgcuuaugcgucugcu

SEQ ID NO: 24574 - RNA, 22 nt, Mycobacterium bovis subsp bovis AF2122/97
auuuaggagcuuuugcgucuuc

SEQ ID NO: 24575 - RNA, 22 nt, Mycobacterium bovis subsp bovis AF2122/97
auuuagugggcuuuugcgucug

SEQ ID NO: 24576 - RNA, 22 nt, Mycobacterium bovis subsp bovis AF2122/97
auuucggucggcucgucgacua

SEQ ID NO: 24577 - RNA, 22 nt, Mycobacterium bovis subsp bovis AF2122/97
auuugggagcuuuugcgucuuu

SEQ ID NO: 24578 - RNA, 19 nt, Mycobacterium bovis subsp bovis AF2122/97
caacggcgacgggcucguc

SEQ ID NO: 24579 - RNA, 20 nt, Mycobacterium bovis subsp bovis AF2122/97
caacggcgagcuucccgcac

SEQ ID NO: 24580 - RNA, 22 nt, Mycobacterium bovis subsp bovis AF2122/97
caagaugacccuaccggugcua

SEQ ID NO: 24581 - RNA, 22 nt, Mycobacterium bovis subsp bovis AF2122/97
caaguaguaggcgagaucaccg

SEQ ID NO: 24582 - RNA, 22 nt, Mycobacterium bovis subsp bovis AF2122/97
cacauccggguucagcuugccc

SEQ ID NO: 24583 - RNA, 18 nt, Mycobacterium bovis subsp bovis AF2122/97
caccagaacgagaucggc

SEQ ID NO: 24584 - RNA, 22 nt, Mycobacterium bovis subsp bovis AF2122/97
cacccgaucaaacuggccugga

SEQ ID NO: 24585 - RNA, 22 nt, Mycobacterium bovis subsp bovis AF2122/97
cacccggcuggccauucaugcc

SEQ ID NO: 24586 - RNA, 22 nt, Mycobacterium bovis subsp bovis AF2122/97
cacccguaugaucgcugcggcc

SEQ ID NO: 24587 - RNA, 22 nt, Mycobacterium bovis subsp bovis AF2122/97
cacccugcgacugguggcccgc

SEQ ID NO: 24588 - RNA, 22 nt, Mycobacterium bovis subsp bovis AF2122/97
caccgacaccuauugccccgcc

SEQ ID NO: 24589 - RNA, 22 nt, Mycobacterium bovis subsp bovis AF2122/97
caccgacaucgacccggucgcg

SEQ ID NO: 24590 - RNA, 23 nt, Mycobacterium bovis subsp bovis AF2122/97
caccgcguucggugugcggcgug

SEQ ID NO: 24591 - RNA, 23 nt, Mycobacterium bovis subsp bovis AF2122/97
caccggcgccggcggcaacaagu

SEQ ID NO: 24592 - RNA, 22 nt, Mycobacterium bovis subsp bovis AF2122/97
caccgggauggaaaccacccgc

SEQ ID NO: 24593 - RNA, 22 nt, Mycobacterium bovis subsp bovis AF2122/97
caccgucaauacgauguugcug

SEQ ID NO: 24594 - RNA, 22 nt, Mycobacterium bovis subsp bovis AF2122/97
caccuggcacugggugguggcc

SEQ ID NO: 24595 - RNA, 22 nt, Mycobacterium bovis subsp bovis AF2122/97
caccuucgacgacaucgacgcc

SEQ ID NO: 24596 - RNA, 22 nt, Mycobacterium bovis subsp bovis AF2122/97
cacgagcguaaccccagugcga

SEQ ID NO: 24597 - RNA, 22 nt, Mycobacterium bovis subsp bovis AF2122/97
cacgcccaucgguucguugaaa

SEQ ID NO: 24598 - RNA, 22 nt, Mycobacterium bovis subsp bovis AF2122/97
cacggcgaugggcuggagcccg

SEQ ID NO: 24599 - RNA, 22 nt, Mycobacterium bovis subsp bovis AF2122/97
cacggcguguuugagugcgagu

SEQ ID NO: 24600 - RNA, 22 nt, Mycobacterium bovis subsp bovis AF2122/97
cacggugcaauggucgcaugcu

SEQ ID NO: 24601 - RNA, 22 nt, Mycobacterium bovis subsp bovis AF2122/97
cacgucggugaccagaugaucg

SEQ ID NO: 24602 - RNA, 20 nt, Mycobacterium bovis subsp bovis AF2122/97
cacuccuggcuggauucggc

SEQ ID NO: 24603 - RNA, 20 nt, Mycobacterium bovis subsp bovis AF2122/97
cacuggguacacgcucggcg

SEQ ID NO: 24604 - RNA, 22 nt, Mycobacterium bovis subsp bovis AF2122/97
cacuggucguugcgccaggcgg

SEQ ID NO: 24605 - RNA, 22 nt, Mycobacterium bovis subsp bovis AF2122/97
cagacgcaaaagaacaugaugg

SEQ ID NO: 24606 - RNA, 22 nt, Mycobacterium bovis subsp bovis AF2122/97
cagacgcaaaagcccacuaaau

SEQ ID NO: 24607 - RNA, 22 nt, Mycobacterium bovis subsp bovis AF2122/97
cagacgcaaaagcccccgcacg

SEQ ID NO: 24608 - RNA, 22 nt, Mycobacterium bovis subsp bovis AF2122/97
cagacgcaaaagcgccacuuuu

SEQ ID NO: 24609 - RNA, 22 nt, Mycobacterium bovis subsp bovis AF2122/97
cagacgcaaaaggccccgaaau

SEQ ID NO: 24610 - RNA, 22 nt, Mycobacterium bovis subsp bovis AF2122/97
cagacgcauaagcgcccaauuu

SEQ ID NO: 24611 - RNA, 22 nt, Mycobacterium bovis subsp bovis AF2122/97
cagcaaaagccauucauuucua

SEQ ID NO: 24612 - RNA, 22 nt, Mycobacterium bovis subsp bovis AF2122/97
cagccacaccagcccuuaugcg

SEQ ID NO: 24613 - RNA, 22 nt, Mycobacterium bovis subsp bovis AF2122/97
cagccggaggaucucggcgaac

SEQ ID NO: 24614 - RNA, 22 nt, Mycobacterium bovis subsp bovis AF2122/97
cagccggcgcauggucaaagcg

SEQ ID NO: 24615 - RNA, 20 nt, Mycobacterium bovis subsp bovis AF2122/97
cagcgcagccccgaugucga

SEQ ID NO: 24616 - RNA, 22 nt, Mycobacterium bovis subsp bovis AF2122/97
cagcggguuaggcagugcugcg

SEQ ID NO: 24617 - RNA, 22 nt, Mycobacterium bovis subsp bovis AF2122/97
cagcguaugggcgggcaggcga

SEQ ID NO: 24618 - RNA, 22 nt, Mycobacterium bovis subsp bovis AF2122/97
caggacgguuagugcugauggg

SEQ ID NO: 24619 - RNA, 22 nt, Mycobacterium bovis subsp bovis AF2122/97
caggguggugagaaugacgccc

SEQ ID NO: 24620 - RNA, 22 nt, Mycobacterium bovis subsp bovis AF2122/97
cagguagugggugugcccggca

SEQ ID NO: 24621 - RNA, 22 nt, Mycobacterium bovis subsp bovis AF2122/97
cagguguuguucggcgaugccc

SEQ ID NO: 24622 - RNA, 22 nt, Mycobacterium bovis subsp bovis AF2122/97
cagucgugccucggccgcagcu

SEQ ID NO: 24623 - RNA, 22 nt, Mycobacterium bovis subsp bovis AF2122/97
cagugcggucgaggcuccgaga

SEQ ID NO: 24624 - RNA, 22 nt, Mycobacterium bovis subsp bovis AF2122/97
caguuguccgaugaggaacugg

SEQ ID NO: 24625 - RNA, 21 nt, Mycobacterium bovis subsp bovis AF2122/97
caucaggugcauaacguugcc

SEQ ID NO: 24626 - RNA, 22 nt, Mycobacterium bovis subsp bovis AF2122/97
cauccgcaccugggugccaccg

SEQ ID NO: 24627 - RNA, 22 nt, Mycobacterium bovis subsp bovis AF2122/97
cauccgccuuaacgaagucggg

SEQ ID NO: 24628 - RNA, 22 nt, Mycobacterium bovis subsp bovis AF2122/97
caucgccucgaccggcggaaac

SEQ ID NO: 24629 - RNA, 22 nt, Mycobacterium bovis subsp bovis AF2122/97
caucgcgguggugcgcgcuucg

SEQ ID NO: 24630 - RNA, 21 nt, Mycobacterium bovis subsp bovis AF2122/97
caucgucaacacccgcucggu

SEQ ID NO: 24631 - RNA, 22 nt, Mycobacterium bovis subsp bovis AF2122/97
caucgucguggcagguguuggg

SEQ ID NO: 24632 - RNA, 21 nt, Mycobacterium bovis subsp bovis AF2122/97
caucuugaucaccccggcgac

SEQ ID NO: 24633 - RNA, 22 nt, Mycobacterium bovis subsp bovis AF2122/97
caugcaucggaagaaccggcau

SEQ ID NO: 24634 - RNA, 22 nt, Mycobacterium bovis subsp bovis AF2122/97
caugcccgguagcucguugcgc

SEQ ID NO: 24635 - RNA, 22 nt, Mycobacterium bovis subsp bovis AF2122/97
cauggcagguuuucgacgaugg

SEQ ID NO: 24636 - RNA, 22 nt, Mycobacterium bovis subsp bovis AF2122/97
cauuccccggcguuggcgcagc

SEQ ID NO: 24637 - RNA, 22 nt, Mycobacterium bovis subsp bovis AF2122/97
cauugaaaccgaugaucaccgc

SEQ ID NO: 24638 - RNA, 22 nt, Mycobacterium bovis subsp bovis AF2122/97
ccaagcucuggauggccugccg

SEQ ID NO: 24639 - RNA, 22 nt, Mycobacterium bovis subsp bovis AF2122/97
ccaccgccacggccagcaccgc

SEQ ID NO: 24640 - RNA, 22 nt, Mycobacterium bovis subsp bovis AF2122/97
ccacgacgagcucgugcugccg

SEQ ID NO: 24641 - RNA, 22 nt, Mycobacterium bovis subsp bovis AF2122/97
ccacgccgagagccuugccauc

SEQ ID NO: 24642 - RNA, 22 nt, Mycobacterium bovis subsp bovis AF2122/97
ccacgcugagccguggcgaauu

SEQ ID NO: 24643 - RNA, 22 nt, Mycobacterium bovis subsp bovis AF2122/97
cgagcagacgcaaaagccccca

SEQ ID NO: 24644 - RNA, 22 nt, Mycobacterium bovis subsp bovis AF2122/97
cgagcagacgcaaaauccccuc

SEQ ID NO: 24645 - RNA, 22 nt, Mycobacterium bovis subsp bovis AF2122/97
cgagcagacgcaaaaucgccca

SEQ ID NO: 24646 - RNA, 22 nt, Mycobacterium bovis subsp bovis AF2122/97
cgagcagacgcagaaucgcacg

SEQ ID NO: 24647 - RNA, 22 nt, Mycobacterium bovis subsp bovis AF2122/97
cgagcagacgcggaaucgcacc

SEQ ID NO: 24648 - RNA, 22 nt, Mycobacterium bovis subsp bovis AF2122/97
cgagcagacgcggaaucgcacu

SEQ ID NO: 24649 - RNA, 22 nt, Mycobacterium bovis subsp bovis AF2122/97
gcugcggccaccugcucggccg

SEQ ID NO: 24650 - RNA, 22 nt, Mycobacterium bovis subsp bovis AF2122/97
gcugcguccgucuuccgggccg

SEQ ID NO: 24651 - RNA, 22 nt, Mycobacterium bovis subsp bovis AF2122/97
gcugcgugcacgaacuggucga

SEQ ID NO: 24652 - RNA, 22 nt, Mycobacterium bovis subsp bovis AF2122/97
gcugcucacugcgaucgcgagc

SEQ ID NO: 24653 - RNA, 22 nt, Mycobacterium bovis subsp bovis AF2122/97
gcuggccagggcguuuccgcuc

SEQ ID NO: 24654 - RNA, 22 nt, Mycobacterium bovis subsp bovis AF2122/97
gcuggccaguucgcccugaccu

SEQ ID NO: 24655 - RNA, 22 nt, Mycobacterium bovis subsp bovis AF2122/97
gcuggccgacguugacgaucgg

SEQ ID NO: 24656 - RNA, 22 nt, Mycobacterium bovis subsp bovis AF2122/97
gcuggcgggcgaccguccguug

SEQ ID NO: 24657 - RNA, 22 nt, Mycobacterium bovis subsp bovis AF2122/97
gcuggcuggaucgugugguguc

SEQ ID NO: 24658 - RNA, 22 nt, Mycobacterium bovis subsp bovis AF2122/97
gcuggcugucgggcaacggcgg

SEQ ID NO: 24659 - RNA, 22 nt, Mycobacterium bovis subsp bovis AF2122/97
gcuggugagugcggcgaccgcu

SEQ ID NO: 24660 - RNA, 22 nt, Mycobacterium bovis subsp bovis AF2122/97
gcugucaacggggguagcgcug

SEQ ID NO: 24661 - RNA, 22 nt, Mycobacterium bovis subsp bovis AF2122/97
gcugucgucgacgguggcggug

SEQ ID NO: 24662 - RNA, 22 nt, Mycobacterium bovis subsp bovis AF2122/97
gcugugccgagggcuucgcugg

SEQ ID NO: 24663 - RNA, 22 nt, Mycobacterium bovis subsp bovis AF2122/97
gcuucggacucgcucuugcgca

SEQ ID NO: 24664 - RNA, 22 nt, Mycobacterium bovis subsp bovis AF2122/97
gcuugcccuugucgagguugcg

SEQ ID NO: 24665 - RNA, 20 nt, Mycobacterium bovis subsp bovis AF2122/97
gcuugccgacccggcgccgu

SEQ ID NO: 24666 - RNA, 22 nt, Mycobacterium bovis subsp bovis AF2122/97
ggaaccgcugcgagugugcgcc

SEQ ID NO: 24667 - RNA, 22 nt, Mycobacterium bovis subsp bovis AF2122/97
ggaacugcucgucgagcugcuc

SEQ ID NO: 24668 - RNA, 22 nt, Mycobacterium bovis subsp bovis AF2122/97
ggaaguucuaucugccgccaaa

SEQ ID NO: 24669 - RNA, 22 nt, Mycobacterium bovis subsp bovis AF2122/97
ggacaugaccgaacacgguugg

SEQ ID NO: 24670 - RNA, 22 nt, Mycobacterium bovis subsp bovis AF2122/97
ggacugccaacuucggguuguu

SEQ ID NO: 24671 - RNA, 22 nt, Mycobacterium bovis subsp bovis AF2122/97
ggagacguuguauggcgagauc

SEQ ID NO: 24672 - RNA, 22 nt, Mycobacterium bovis subsp bovis AF2122/97
ggaugcgcgcgguccccgagca

SEQ ID NO: 24673 - RNA, 22 nt, Mycobacterium bovis subsp bovis AF2122/97
ggcaacuccgggguggccagca

SEQ ID NO: 24674 - RNA, 22 nt, Mycobacterium bovis subsp bovis AF2122/97
ggcaccuaccgacaggacguaa

SEQ ID NO: 24675 - RNA, 22 nt, Mycobacterium bovis subsp bovis AF2122/97
ggcagccagccuuaccgcaggc

SEQ ID NO: 24676 - RNA, 22 nt, Mycobacterium bovis subsp bovis AF2122/97
ggcaugcagcuuggacacgucg

SEQ ID NO: 24677 - RNA, 22 nt, Mycobacterium bovis subsp bovis AF2122/97
ggcccaggucacacacaucgca

SEQ ID NO: 24678 - RNA, 22 nt, Mycobacterium bovis subsp bovis AF2122/97
ggccccguggaccuggauugcg

SEQ ID NO: 24679 - RNA, 22 nt, Mycobacterium bovis subsp bovis AF2122/97
ggcccgugucgucgaccggccg

SEQ ID NO: 24680 - RNA, 22 nt, Mycobacterium bovis subsp bovis AF2122/97
ggccgacacuuccagcucgggg

SEQ ID NO: 24681 - RNA, 22 nt, Mycobacterium bovis subsp bovis AF2122/97
ggccgacgggucgguggacauc

SEQ ID NO: 24682 - RNA, 22 nt, Mycobacterium bovis subsp bovis AF2122/97
ggccgacuuggugauuggugug

SEQ ID NO: 24683 - RNA, 22 nt, Mycobacterium bovis subsp bovis AF2122/97
ggccgcagucacauggcaagga

SEQ ID NO: 24684 - RNA, 22 nt, Mycobacterium bovis subsp bovis AF2122/97
ggccgccgcaaagccgucaagu

SEQ ID NO: 24685 - RNA, 21 nt, Mycobacterium bovis subsp bovis AF2122/97
ggccgccucgucgaccaucgc

SEQ ID NO: 24686 - RNA, 22 nt, Mycobacterium bovis subsp bovis AF2122/97
ggccgcggcucgcguagggcuu

SEQ ID NO: 24687 - RNA, 22 nt, Mycobacterium bovis subsp bovis AF2122/97
ggccgcggugcagcgaucguug

SEQ ID NO: 24688 - RNA, 22 nt, Mycobacterium bovis subsp bovis AF2122/97
ggccgcugucggucacguagac

SEQ ID NO: 24689 - RNA, 22 nt, Mycobacterium bovis subsp bovis AF2122/97
ggccggacccgagcaccuugau

SEQ ID NO: 24690 - RNA, 23 nt, Mycobacterium bovis subsp bovis AF2122/97
ggccggcaugcugcgccagguau

SEQ ID NO: 24691 - RNA, 22 nt, Mycobacterium bovis subsp bovis AF2122/97
ggccucgccgcacaguugcggu

SEQ ID NO: 24692 - RNA, 22 nt, Mycobacterium bovis subsp bovis AF2122/97
ggccuggcuggcgguggcgugu

SEQ ID NO: 24693 - RNA, 22 nt, Mycobacterium bovis subsp bovis AF2122/97
ggcgacgguucgcgguggccgu

SEQ ID NO: 24694 - RNA, 22 nt, Mycobacterium bovis subsp bovis AF2122/97
ucggcuccuccucacgccgcug

SEQ ID NO: 24695 - RNA, 22 nt, Mycobacterium bovis subsp bovis AF2122/97
ucgggaaggcucgguucucguc

SEQ ID NO: 24696 - RNA, 22 nt, Mycobacterium bovis subsp bovis AF2122/97
ucggggacuucugcgucugcuc

SEQ ID NO: 24697 - RNA, 22 nt, Mycobacterium bovis subsp bovis AF2122/97
ucgggggcauuuugcgucugcu

SEQ ID NO: 24698 - RNA, 22 nt, Mycobacterium bovis subsp bovis AF2122/97
ucgggggcuuuugcgucugcuc

SEQ ID NO: 24699 - RNA, 22 nt, Mycobacterium bovis subsp bovis AF2122/97
ucggggucaaucaggcccagcc

SEQ ID NO: 24700 - RNA, 22 nt, Mycobacterium bovis subsp bovis AF2122/97
ucggguuguucaacuccggcag

SEQ ID NO: 24701 - RNA, 22 nt, Mycobacterium bovis subsp bovis AF2122/97
ucggucaacagguucguggcgc

SEQ ID NO: 24702 - RNA, 22 nt, Mycobacterium bovis subsp bovis AF2122/97
ucgguccaccccgcaggcgcug

SEQ ID NO: 24703 - RNA, 22 nt, Mycobacterium bovis subsp bovis AF2122/97
ucggugacagcugcguggugcu

SEQ ID NO: 24704 - RNA, 22 nt, Mycobacterium bovis subsp bovis AF2122/97
ucggugagcuuggcagccugcg

SEQ ID NO: 24705 - RNA, 22 nt, Mycobacterium bovis subsp bovis AF2122/97
ucggugaugacccaagagcugc

SEQ ID NO: 24706 - RNA, 22 nt, Mycobacterium bovis subsp bovis AF2122/97
ucgguuccaggaugugguggau

SEQ ID NO: 24707 - RNA, 22 nt, Mycobacterium bovis subsp bovis AF2122/97
ucguaaugaaugucgaaccuga

SEQ ID NO: 24708 - RNA, 22 nt, Mycobacterium bovis subsp bovis AF2122/97
ucgucaccgcgggcaccggggu

SEQ ID NO: 24709 - RNA, 22 nt, Mycobacterium bovis subsp bovis AF2122/97
ucgucgacgugcugcgggaguc

SEQ ID NO: 24710 - RNA, 22 nt, Mycobacterium bovis subsp bovis AF2122/97
ucgucgaggcugugccguccgg

SEQ ID NO: 24711 - RNA, 22 nt, Mycobacterium bovis subsp bovis AF2122/97
ucgucggcgaaaccggcucuac

SEQ ID NO: 24712 - RNA, 22 nt, Mycobacterium bovis subsp bovis AF2122/97
ucgucgggccgagguuuucggc

SEQ ID NO: 24713 - RNA, 22 nt, Mycobacterium bovis subsp bovis AF2122/97
ucgucgguguagggcgaacugc

SEQ ID NO: 24714 - RNA, 19 nt, Mycobacterium bovis subsp bovis AF2122/97
ucgucgucgacgauccgac

SEQ ID NO: 24715 - RNA, 21 nt, Mycobacterium bovis subsp bovis AF2122/97
ucgugcgauucacugucggcg

SEQ ID NO: 24716 - RNA, 22 nt, Mycobacterium bovis subsp bovis AF2122/97
ucucccggugcaccgccaccaa

SEQ ID NO: 24717 - RNA, 22 nt, Mycobacterium bovis subsp bovis AF2122/97
ucuccgcccucaguucacgcug

SEQ ID NO: 24718 - RNA, 22 nt, Mycobacterium bovis subsp bovis AF2122/97
ucuccucgacccggcugcgggu

SEQ ID NO: 24719 - RNA, 22 nt, Mycobacterium bovis subsp bovis AF2122/97
ucuccuucagcagguucgugcg

SEQ ID NO: 24720 - RNA, 22 nt, Mycobacterium bovis subsp bovis AF2122/97
ucucgcagugacguuacgcucg

SEQ ID NO: 24721 - RNA, 22 nt, Mycobacterium bovis subsp bovis AF2122/97
ucucgccgagguuagcggcauc

SEQ ID NO: 24722 - RNA, 22 nt, Mycobacterium bovis subsp bovis AF2122/97
ucugacggugccaacccuggug

SEQ ID NO: 24723 - RNA, 22 nt, Mycobacterium bovis subsp bovis AF2122/97
ucugcggggacaggaacgacau

SEQ ID NO: 24724 - RNA, 20 nt, Mycobacterium bovis subsp bovis AF2122/97
ucuggccaaggugucgagca

SEQ ID NO: 24725 - RNA, 20 nt, Mycobacterium bovis subsp bovis AF2122/97
ucuggcccgagcccaugaug

SEQ ID NO: 24726 - RNA, 22 nt, Mycobacterium bovis subsp bovis AF2122/97
ucugggcgucgucgcugccgga

SEQ ID NO: 24727 - RNA, 22 nt, Mycobacterium bovis subsp bovis AF2122/97
ucugugcgcgguuugugcacag

SEQ ID NO: 24728 - RNA, 22 nt, Mycobacterium bovis subsp bovis AF2122/97
ucuugcccucaaggcggaucca

SEQ ID NO: 24729 - RNA, 22 nt, Mycobacterium bovis subsp bovis AF2122/97
ucuuucccuccagaucggugcg

SEQ ID NO: 24730 - RNA, 22 nt, Mycobacterium bovis subsp bovis AF2122/97
ugacagcgcugauccugguguu

SEQ ID NO: 24731 - RNA, 22 nt, Mycobacterium bovis subsp bovis AF2122/97
ugaccagcagugcggccacggc

SEQ ID NO: 24732 - RNA, 22 nt, Mycobacterium bovis subsp bovis AF2122/97
ugacccaggcgccggucggugu

SEQ ID NO: 24733 - RNA, 22 nt, Mycobacterium bovis subsp bovis AF2122/97
ugaccgagcgggugcgcuucca

SEQ ID NO: 24734 - RNA, 22 nt, Mycobacterium bovis subsp bovis AF2122/97
ugaccgaugagcaggcgaucac

SEQ ID NO: 24735 - RNA, 22 nt, Mycobacterium bovis subsp bovis AF2122/97
ugaccgguaagcgcggcgaugg

SEQ ID NO: 24736 - RNA, 22 nt, Mycobacterium bovis subsp bovis AF2122/97
ugaccugagccuugucugcgga

SEQ ID NO: 24737 - RNA, 22 nt, Mycobacterium bovis subsp bovis AF2122/97
ugaccuugaucggugcgggucc

SEQ ID NO: 24738 - RNA, 22 nt, Mycobacterium bovis subsp bovis AF2122/97
ugacgaccgcggugagcgcagc

SEQ ID NO: 24739 - RNA, 22 nt, Mycobacterium bovis subsp bovis AF2122/97
ugacgaggaugauucggccgcg

SEQ ID NO: 24740 - RNA, 21 nt, Mycobacterium bovis subsp bovis AF2122/97
ugacgccaucaaguccgccgg

SEQ ID NO: 24741 - RNA, 22 nt, Mycobacterium bovis subsp bovis AF2122/97
ugacucugcguccagcaggcgg

SEQ ID NO: 24742 - RNA, 22 nt, Mycobacterium bovis subsp bovis AF2122/97
ugagacccccgucgaagucuag

SEQ ID NO: 24743 - RNA, 22 nt, Mycobacterium bovis subsp bovis AF2122/97
ugagcagacgcaaaagaacccg

SEQ ID NO: 24744 - RNA, 22 nt, Mycobacterium bovis subsp bovis AF2122/97
ugaggaggaugaguuugcccuc

SEQ ID NO: 24745 - RNA, 22 nt, Mycobacterium bovis subsp bovis AF2122/97
ugagggcaucgucggucgccgg

SEQ ID NO: 24746 - RNA, 22 nt, Mycobacterium bovis subsp bovis AF2122/97
ugaucgcaugcccgugcgcggu

SEQ ID NO: 24747 - RNA, 22 nt, Mycobacterium bovis subsp bovis AF2122/97
ugaucucacccgaaguuguguc

SEQ ID NO: 24748 - RNA, 22 nt, Mycobacterium bovis subsp bovis AF2122/97
ugaugguggaaccuuuggccgc

SEQ ID NO: 24749 - RNA, 22 nt, Mycobacterium bovis subsp bovis AF2122/97
ugcacccgcgauaucgcaguua

SEQ ID NO: 24750 - RNA, 19 nt, Mycobacterium bovis subsp bovis AF2122/97
ugcacuccaccgcuggcgc

SEQ ID NO: 24751 - RNA, 22 nt, Mycobacterium bovis subsp bovis AF2122/97
ugcagcgcaaggauuuugguga

SEQ ID NO: 24752 - RNA, 22 nt, Mycobacterium bovis subsp bovis AF2122/97
ugcagcugcgaccguucguucu

SEQ ID NO: 24753 - RNA, 22 nt, Mycobacterium bovis subsp bovis AF2122/97
ugcagucaauggugucucgucg

SEQ ID NO: 24754 - RNA, 22 nt, Mycobacterium bovis subsp bovis AF2122/97
ugcauagacccgcggcgcugua

SEQ ID NO: 24755 - RNA, 22 nt, Mycobacterium bovis subsp bovis AF2122/97
ugccagaacgugaugcuggggc

SEQ ID NO: 24756 - RNA, 22 nt, Mycobacterium bovis subsp bovis AF2122/97
ugccagccgccgacgagcagca

SEQ ID NO: 24757 - RNA, 22 nt, Mycobacterium bovis subsp bovis AF2122/97
ugcccgcucucggcgacucguu

SEQ ID NO: 24758 - RNA, 22 nt, Mycobacterium bovis subsp bovis AF2122/97
ugcccgugggcgugcguaggcu

SEQ ID NO: 24759 - RNA, 22 nt, Mycobacterium bovis subsp bovis AF2122/97
ugccgagauauccagcgguacu

SEQ ID NO: 24760 - RNA, 22 nt, Mycobacterium bovis subsp bovis AF2122/97
ugccgccgagaugcagggucgc

SEQ ID NO: 24761 - RNA, 20 nt, Mycobacterium bovis subsp bovis AF2122/97
ugccgcggcugcggugauga

SEQ ID NO: 24762 - RNA, 22 nt, Mycobacterium bovis subsp bovis AF2122/97
ugccggcggccaacaggcuuac

SEQ ID NO: 24763 - RNA, 22 nt, Mycobacterium bovis subsp bovis AF2122/97
ugccgggguucgggaauacgac

SEQ ID NO: 24764 - RNA, 22 nt, Mycobacterium bovis subsp bovis AF2122/97
ugccgguccuccgaacggaugu

SEQ ID NO: 24765 - RNA, 22 nt, Mycobacterium bovis subsp bovis AF2122/97
ugccugguauccgcagagucaa

SEQ ID NO: 24766 - RNA, 22 nt, Mycobacterium bovis subsp bovis AF2122/97
ugcgacucugugucugcucgcc

SEQ ID NO: 24767 - RNA, 22 nt, Mycobacterium bovis subsp bovis AF2122/97
ugcgagcgugcgggugcucguc

SEQ ID NO: 24768 - RNA, 22 nt, Mycobacterium bovis subsp bovis AF2122/97
ugcgauaucggcaccggcuugc

SEQ ID NO: 24769 - RNA, 20 nt, Mycobacterium bovis subsp bovis AF2122/97
ugcgauuccgcgucugcucg

SEQ ID NO: 24770 - RNA, 22 nt, Mycobacterium bovis subsp bovis AF2122/97
ugcgauuccgcgucugcucggc

SEQ ID NO: 24771 - RNA, 22 nt, Mycobacterium bovis subsp bovis AF2122/97
ugcgccgaaggcccagcgcgga

SEQ ID NO: 24772 - RNA, 22 nt, Mycobacterium bovis subsp bovis AF2122/97
ugcgccgaaugugcacuggugg

SEQ ID NO: 24773 - RNA, 22 nt, Mycobacterium bovis subsp bovis AF2122/97
ugcgccgcgguugccgucggga

SEQ ID NO: 24774 - RNA, 18 nt, Mycobacterium bovis subsp bovis AF2122/97
ugcgcgccgccagcuauc

SEQ ID NO: 24775 - RNA, 22 nt, Mycobacterium bovis subsp bovis AF2122/97
ugcgcggcgccugcuggcaguc

SEQ ID NO: 24776 - RNA, 23 nt, Mycobacterium bovis subsp bovis AF2122/97
ugcgcggcugccgucuccugguc

SEQ ID NO: 24777 - RNA, 22 nt, Mycobacterium bovis subsp bovis AF2122/97
ugcgcugacucugcguccacca

SEQ ID NO: 24778 - RNA, 22 nt, Mycobacterium bovis subsp bovis AF2122/97
ugcggcacucgucaggcccgcg

SEQ ID NO: 24779 - RNA, 22 nt, Mycobacterium bovis subsp bovis AF2122/97
ugcgggaguugcgggauugaug

SEQ ID NO: 24780 - RNA, 22 nt, Mycobacterium bovis subsp bovis AF2122/97
ugcgggaucagaucggcagucg

SEQ ID NO: 24781 - RNA, 22 nt, Mycobacterium bovis subsp bovis AF2122/97
ugcgggccuugacaucguggcg

SEQ ID NO: 24782 - RNA, 22 nt, Mycobacterium bovis subsp bovis AF2122/97
ugcgggcgcugauguggucuca

SEQ ID NO: 24783 - RNA, 21 nt, Mycobacterium bovis subsp bovis AF2122/97
ugcggguaccacggcggcggc

SEQ ID NO: 24784 - RNA, 22 nt, Mycobacterium bovis subsp bovis AF2122/97
ugcgguauuuagcuccgguggc

SEQ ID NO: 24785 - RNA, 22 nt, Mycobacterium bovis subsp bovis AF2122/97
ugcggugaguucggcguccuug

SEQ ID NO: 24786 - RNA, 22 nt, Mycobacterium bovis subsp bovis AF2122/97
ugcggugcucucgaccaucggg

SEQ ID NO: 24787 - RNA, 22 nt, Mycobacterium bovis subsp bovis AF2122/97
ugcuagcggcccucauucaaac

SEQ ID NO: 24788 - RNA, 22 nt, Mycobacterium bovis subsp bovis AF2122/97
ugcuccggcacguuggucgaga

SEQ ID NO: 24789 - RNA, 22 nt, Mycobacterium bovis subsp bovis AF2122/97
ugcuccuggaaguacacggcgg

SEQ ID NO: 24790 - RNA, 22 nt, Mycobacterium bovis subsp bovis AF2122/97
ugcuccuggugaugcgcuucac

SEQ ID NO: 24791 - RNA, 22 nt, Mycobacterium bovis subsp bovis AF2122/97
ugcugcucgucggcggcuggca

SEQ ID NO: 24792 - RNA, 19 nt, Mycobacterium bovis subsp bovis AF2122/97
ugcugcugcagcgcagaau

SEQ ID NO: 24793 - RNA, 19 nt, Mycobacterium bovis subsp bovis AF2122/97
ugcuggacgcagagucagc

SEQ ID NO: 24794 - RNA, 22 nt, Mycobacterium bovis subsp bovis AF2122/97
ugcuggcccgagaaccgaugac

SEQ ID NO: 24795 - RNA, 22 nt, Mycobacterium bovis subsp bovis AF2122/97
ugcuggccgcgaugaccgcggc

SEQ ID NO: 24796 - RNA, 22 nt, Mycobacterium bovis subsp bovis AF2122/97
ugcuggugaccggugcuugccg

SEQ ID NO: 24797 - RNA, 22 nt, Mycobacterium bovis subsp bovis AF2122/97
ugcugguggugacggcggccgg

SEQ ID NO: 24798 - RNA, 22 nt, Mycobacterium bovis subsp bovis AF2122/97
ugcugugcaccgaugucgguuc

SEQ ID NO: 24799 - RNA, 22 nt, Mycobacterium bovis subsp bovis AF2122/97
uggaaaccgaucugggccgcca

SEQ ID NO: 24800 - RNA, 22 nt, Mycobacterium bovis subsp bovis AF2122/97
uggaagacgagcucgacgagau

SEQ ID NO: 24801 - RNA, 22 nt, Mycobacterium bovis subsp bovis AF2122/97
uggacgcggugcagcggcagcg

SEQ ID NO: 24802 - RNA, 22 nt, Mycobacterium bovis subsp bovis AF2122/97
uggacggaucgggcacgguucg

SEQ ID NO: 24803 - RNA, 22 nt, Mycobacterium bovis subsp bovis AF2122/97
uggagauuggagacgucggccg

SEQ ID NO: 24804 - RNA, 22 nt, Mycobacterium bovis subsp bovis AF2122/97
uggcagcaaucggguauccgau

SEQ ID NO: 24805 - RNA, 22 nt, Mycobacterium bovis subsp bovis AF2122/97
uggccaagcggaccgucggcau

SEQ ID NO: 24806 - RNA, 22 nt, Mycobacterium bovis subsp bovis AF2122/97
uggccgauguaguccggccagu

SEQ ID NO: 24807 - RNA, 22 nt, Mycobacterium bovis subsp bovis AF2122/97
uggccgaugugaugcgcaucgc

SEQ ID NO: 24808 - RNA, 22 nt, Mycobacterium bovis subsp bovis AF2122/97
uggccgucgacaagcagcgugg

SEQ ID NO: 24809 - RNA, 22 nt, Mycobacterium bovis subsp bovis AF2122/97
uggccuggagcgagggccgcga

SEQ ID NO: 24810 - RNA, 22 nt, Mycobacterium bovis subsp bovis AF2122/97
uggcgagcagacgcaaaagccc

SEQ ID NO: 24811 - RNA, 22 nt, Mycobacterium bovis subsp bovis AF2122/97
uggcgcccaacuuggcggccug

SEQ ID NO: 24812 - RNA, 22 nt, Mycobacterium bovis subsp bovis AF2122/97
uggcgcggcggacggcaccauu

SEQ ID NO: 24813 - RNA, 22 nt, Mycobacterium bovis subsp bovis AF2122/97
uggcgcugcaguacuuucacgc

SEQ ID NO: 24814 - RNA, 22 nt, Mycobacterium bovis subsp bovis AF2122/97
uggcggagacgcuggcccgcga

SEQ ID NO: 24815 - RNA, 22 nt, Mycobacterium bovis subsp bovis AF2122/97
uggcggccaagguggugcccag

SEQ ID NO: 24816 - RNA, 22 nt, Mycobacterium bovis subsp bovis AF2122/97
uggcggcguggucaccggcgug

SEQ ID NO: 24817 - RNA, 22 nt, Mycobacterium bovis subsp bovis AF2122/97
uggcggucgauccgucgggugc

SEQ ID NO: 24818 - RNA, 22 nt, Mycobacterium bovis subsp bovis AF2122/97
uggcggucgccgaggcgguggu

SEQ ID NO: 24819 - RNA, 22 nt, Mycobacterium bovis subsp bovis AF2122/97
uggcucgcacuagcgaucggug

SEQ ID NO: 24820 - RNA, 22 nt, Mycobacterium bovis subsp bovis AF2122/97
uggcugacgacgaccgucggcg

SEQ ID NO: 24821 - RNA, 22 nt, Mycobacterium bovis subsp bovis AF2122/97
uggcuggucggaccgucagcga

SEQ ID NO: 24822 - RNA, 22 nt, Mycobacterium bovis subsp bovis AF2122/97
uggcuguaucgccccagggcgu

SEQ ID NO: 24823 - RNA, 22 nt, Mycobacterium bovis subsp bovis AF2122/97
ugggcaggugauccucgccggc

SEQ ID NO: 24824 - RNA, 22 nt, Mycobacterium bovis subsp bovis AF2122/97
ugggcaugaucuguggaucagg

SEQ ID NO: 24825 - RNA, 22 nt, Mycobacterium bovis subsp bovis AF2122/97
ugggccaacacgugcgcggucg

SEQ ID NO: 24826 - RNA, 22 nt, Mycobacterium bovis subsp bovis AF2122/97
ugggccccuugaccgcugccca

SEQ ID NO: 24827 - RNA, 22 nt, Mycobacterium bovis subsp bovis AF2122/97
ugggccuccugagcagcggcuu

SEQ ID NO: 24828 - RNA, 22 nt, Mycobacterium bovis subsp bovis AF2122/97
ugggcgacuuugcgucugcuca

SEQ ID NO: 24829 - RNA, 22 nt, Mycobacterium bovis subsp bovis AF2122/97
ugggcgauucugcgucugcucg

SEQ ID NO: 24830 - RNA, 22 nt, Mycobacterium bovis subsp bovis AF2122/97
ugggcgcuuacgcgucugcccg

SEQ ID NO: 24831 - RNA, 22 nt, Mycobacterium bovis subsp bovis AF2122/97
ugggcgcuuaugcgucugcucg

SEQ ID NO: 24832 - RNA, 23 nt, Mycobacterium bovis subsp bovis AF2122/97
ugggcucaggauguggcugcgau

SEQ ID NO: 24833 - RNA, 22 nt, Mycobacterium bovis subsp bovis AF2122/97
ugggcugaacaggacggccgcc

SEQ ID NO: 24834 - RNA, 22 nt, Mycobacterium bovis subsp bovis AF2122/97
ugggcugcugcgccgcaucggc

SEQ ID NO: 24835 - RNA, 22 nt, Mycobacterium bovis subsp bovis AF2122/97
ugggcuucugggacaucgcggu

SEQ ID NO: 24836 - RNA, 22 nt, Mycobacterium bovis subsp bovis AF2122/97
ugggggcuucugcgucugcucg

SEQ ID NO: 24837 - RNA, 22 nt, Mycobacterium bovis subsp bovis AF2122/97
ugggggcuuuugcgucugcucg

SEQ ID NO: 24838 - RNA, 22 nt, Mycobacterium bovis subsp bovis AF2122/97
ugcccgccaccuucgucaggcc

SEQ ID NO: 24839 - RNA, 22 nt, Mycobacterium bovis subsp bovis AF2122/97
ugcccgucgcgaaguacgacug

SEQ ID NO: 24840 - RNA, 22 nt, Mycobacterium bovis subsp bovis AF2122/97
ugccgauugugaaucuggcgac

SEQ ID NO: 24841 - RNA, 22 nt, Mycobacterium bovis subsp bovis AF2122/97
ugccgcuggauccggaagccgu

SEQ ID NO: 24842 - RNA, 22 nt, Mycobacterium bovis subsp bovis AF2122/97
ugccgcuucggcgugucgccga

SEQ ID NO: 24843 - RNA, 22 nt, Mycobacterium bovis subsp bovis AF2122/97
ugccggcaucacugucgaucag

SEQ ID NO: 24844 - RNA, 23 nt, Mycobacterium bovis subsp bovis AF2122/97
ugccggccgagcuguucgacguc

SEQ ID NO: 24845 - RNA, 22 nt, Mycobacterium bovis subsp bovis AF2122/97
ugccgucacuggugucggccgg

SEQ ID NO: 24846 - RNA, 22 nt, Mycobacterium bovis subsp bovis AF2122/97
ugccuuccaacggcggcgguuu

SEQ ID NO: 24847 - RNA, 19 nt, Mycobacterium bovis subsp bovis AF2122/97
ugcgaaucgaagccugggc

SEQ ID NO: 24848 - RNA, 22 nt, Mycobacterium bovis subsp bovis AF2122/97
ugcgacucugcgucugcucgcg

SEQ ID NO: 24849 - RNA, 22 nt, Mycobacterium bovis subsp bovis AF2122/97
ugcgacucugugucugcucgcg

SEQ ID NO: 24850 - RNA, 22 nt, Mycobacterium bovis subsp bovis AF2122/97
ugcgagucugugucugcucgcc

SEQ ID NO: 24851 - RNA, 23 nt, Mycobacterium bovis subsp bovis AF2122/97
ugcgauucugugucugcucgcgc

SEQ ID NO: 24852 - RNA, 20 nt, Mycobacterium bovis subsp bovis AF2122/97
ugcgauugugugucugcucg

SEQ ID NO: 24853 - RNA, 22 nt, Mycobacterium bovis subsp bovis AF2122/97
ugcgccaccgccagaggauaac

SEQ ID NO: 24854 - RNA, 22 nt, Mycobacterium bovis subsp bovis AF2122/97
ugcgccagcgccucccgcagga

SEQ ID NO: 24855 - RNA, 22 nt, Mycobacterium bovis subsp bovis AF2122/97
ugcgccccgacgguucgguugc

SEQ ID NO: 24856 - RNA, 22 nt, Mycobacterium bovis subsp bovis AF2122/97
ugcgccgagaucgacguuagcg

SEQ ID NO: 24857 - RNA, 22 nt, Mycobacterium bovis subsp bovis AF2122/97
ugcgcuugcccuugccgaguuu

SEQ ID NO: 24858 - RNA, 22 nt, Mycobacterium bovis subsp bovis AF2122/97
ugcggcagacgcugcagcagua

SEQ ID NO: 24859 - RNA, 22 nt, Mycobacterium bovis subsp bovis AF2122/97
ugcggcagcgaaaggagcucca

SEQ ID NO: 24860 - RNA, 21 nt, Mycobacterium bovis subsp bovis AF2122/97
ugcggccacggcaaccugugc

SEQ ID NO: 24861 - RNA, 18 nt, Mycobacterium bovis subsp bovis AF2122/97
ugcggccggcgcucaggu

SEQ ID NO: 24862 - RNA, 22 nt, Mycobacterium bovis subsp bovis AF2122/97
ugcggcucgucuacggcgggca

SEQ ID NO: 24863 - RNA, 22 nt, Mycobacterium bovis subsp bovis AF2122/97
ugcgggauuugcagguucucgc

SEQ ID NO: 24864 - RNA, 22 nt, Mycobacterium bovis subsp bovis AF2122/97
ugcgggggcuuuuacgucugcu

SEQ ID NO: 24865 - RNA, 22 nt, Mycobacterium bovis subsp bovis AF2122/97
ugcggguacuggucggcaaugg

SEQ ID NO: 24866 - RNA, 23 nt, Mycobacterium bovis subsp bovis AF2122/97
ugcgggugacggucgccgauauc

SEQ ID NO: 24867 - RNA, 22 nt, Mycobacterium bovis subsp bovis AF2122/97
ugcgguggucggggaguggcag

SEQ ID NO: 24868 - RNA, 23 nt, Mycobacterium bovis subsp bovis AF2122/97
ugcgucagcagcggugcugccag

SEQ ID NO: 24869 - RNA, 22 nt, Mycobacterium bovis subsp bovis AF2122/97
ugcgugaagccuucgacgguca

SEQ ID NO: 24870 - RNA, 21 nt, Mycobacterium bovis subsp bovis AF2122/97
ugcgugguggaugcagaguca

SEQ ID NO: 24871 - RNA, 22 nt, Mycobacterium bovis subsp bovis AF2122/97
ugcguuaucccacggcagauag

SEQ ID NO: 24872 - RNA, 22 nt, Mycobacterium bovis subsp bovis AF2122/97
ugcguuucauacccgcagccuu

SEQ ID NO: 24873 - RNA, 22 nt, Mycobacterium bovis subsp bovis AF2122/97
ugcucgaagggggaaagguguu

SEQ ID NO: 24874 - RNA, 22 nt, Mycobacterium bovis subsp bovis AF2122/97
ugcucgaggacgcguugauccu

SEQ ID NO: 24875 - RNA, 22 nt, Mycobacterium bovis subsp bovis AF2122/97
ugcucgccgcuuuuucggucgg

SEQ ID NO: 24876 - RNA, 22 nt, Mycobacterium bovis subsp bovis AF2122/97
ugcucgucggugacgccgugcu

SEQ ID NO: 24877 - RNA, 22 nt, Mycobacterium bovis subsp bovis AF2122/97
ugcucugcaucgucgccggcgc

SEQ ID NO: 24878 - RNA, 22 nt, Mycobacterium bovis subsp bovis AF2122/97
ugcucuuguccagugcggcgcc

SEQ ID NO: 24879 - RNA, 22 nt, Mycobacterium bovis subsp bovis AF2122/97
ugcugaucauccugauccucgu

SEQ ID NO: 24880 - RNA, 22 nt, Mycobacterium bovis subsp bovis AF2122/97
ugcugcccaaagaacagcgagc

SEQ ID NO: 24881 - RNA, 22 nt, Mycobacterium bovis subsp bovis AF2122/97
ugcugcucguaguuguuggcgu

SEQ ID NO: 24882 - RNA, 22 nt, Mycobacterium bovis subsp bovis AF2122/97
ugcuggccgaaugucgaugauc

SEQ ID NO: 24883 - RNA, 22 nt, Mycobacterium bovis subsp bovis AF2122/97
ugcuggcuaccuacucggaguu

SEQ ID NO: 24884 - RNA, 22 nt, Mycobacterium bovis subsp bovis AF2122/97
ugcugggcuugaucgccggcac

SEQ ID NO: 24885 - RNA, 22 nt, Mycobacterium bovis subsp bovis AF2122/97
uucggcgccccgcagggucgug

SEQ ID NO: 24886 - RNA, 22 nt, Mycobacterium bovis subsp bovis AF2122/97
uucgguauguccucuccgucga

SEQ ID NO: 24887 - RNA, 22 nt, Mycobacterium bovis subsp bovis AF2122/97
uucggugagaucucuggugcgc

SEQ ID NO: 24888 - RNA, 22 nt, Mycobacterium bovis subsp bovis AF2122/97
uucguacugaugcggcgucgag

SEQ ID NO: 24889 - RNA, 22 nt, Mycobacterium bovis subsp bovis AF2122/97
uucgucccaacuuggcgacgcu

SEQ ID NO: 24890 - RNA, 22 nt, Mycobacterium bovis subsp bovis AF2122/97
uucgucugauuggcgucgaucg

SEQ ID NO: 24891 - RNA, 22 nt, Mycobacterium bovis subsp bovis AF2122/97
uucgugaucgcgagcgcaaugc

SEQ ID NO: 24892 - RNA, 22 nt, Mycobacterium bovis subsp bovis AF2122/97
uugaccgcgugucugggacgcg

SEQ ID NO: 24893 - RNA, 22 nt, Mycobacterium bovis subsp bovis AF2122/97
uugacucugcgcuuaccacgcg

SEQ ID NO: 24894 - RNA, 22 nt, Mycobacterium bovis subsp bovis AF2122/97
uugaggaucagguucagcuggc

SEQ ID NO: 24895 - RNA, 22 nt, Mycobacterium bovis subsp bovis AF2122/97
uugaugccgaacugguugauca

SEQ ID NO: 24896 - RNA, 22 nt, Mycobacterium bovis subsp bovis AF2122/97
uugaugcgauucugcgucugcu

SEQ ID NO: 24897 - RNA, 22 nt, Mycobacterium bovis subsp bovis AF2122/97
uugaugucggcgacuacaucuu

SEQ ID NO: 24898 - RNA, 22 nt, Mycobacterium bovis subsp bovis AF2122/97
uugccgcacaccauccgacggc

SEQ ID NO: 24899 - RNA, 22 nt, Mycobacterium bovis subsp bovis AF2122/97
uugccggacggcagcaccagca

SEQ ID NO: 24900 - RNA, 22 nt, Mycobacterium bovis subsp bovis AF2122/97
uugccggccugauggucggugu

SEQ ID NO: 24901 - RNA, 22 nt, Mycobacterium bovis subsp bovis AF2122/97
uugccgggacuuuuuguguggc

SEQ ID NO: 24902 - RNA, 22 nt, Mycobacterium bovis subsp bovis AF2122/97
uugccugggccuggaucucguc

SEQ ID NO: 24903 - RNA, 22 nt, Mycobacterium bovis subsp bovis AF2122/97
uugcgcaggggcaugucagcgu

SEQ ID NO: 24904 - RNA, 22 nt, Mycobacterium bovis subsp bovis AF2122/97
uugcgggcauaguugcggcuga

SEQ ID NO: 24905 - RNA, 22 nt, Mycobacterium bovis subsp bovis AF2122/97
uugcggguuuucaccgauucag

SEQ ID NO: 24906 - RNA, 22 nt, Mycobacterium bovis subsp bovis AF2122/97
uugcgugugacgccgcgcugag

SEQ ID NO: 24907 - RNA, 22 nt, Mycobacterium bovis subsp bovis AF2122/97
uugcucgcgaucgcagugagca

SEQ ID NO: 24908 - RNA, 22 nt, Mycobacterium bovis subsp bovis AF2122/97
uugcugauugccggauugugcg

SEQ ID NO: 24909 - RNA, 22 nt, Mycobacterium bovis subsp bovis AF2122/97
uuggagguggccgccagcacga

SEQ ID NO: 24910 - RNA, 22 nt, Mycobacterium bovis subsp bovis AF2122/97
uuggccgaccagcgcuucgaua

SEQ ID NO: 24911 - RNA, 22 nt, Mycobacterium bovis subsp bovis AF2122/97
uuggcgaguagacgcaaaagcc

SEQ ID NO: 24912 - RNA, 22 nt, Mycobacterium bovis subsp bovis AF2122/97
uuggcggugugcgccgcccucg

SEQ ID NO: 24913 - RNA, 22 nt, Mycobacterium bovis subsp bovis AF2122/97
uugggaccaugccgcuggggug

SEQ ID NO: 24914 - RNA, 22 nt, Mycobacterium bovis subsp bovis AF2122/97
uugggauuguugauuccgccga

SEQ ID NO: 24915 - RNA, 22 nt, Mycobacterium bovis subsp bovis AF2122/97
uugggcggcggccuggagaucg

SEQ ID NO: 24916 - RNA, 22 nt, Mycobacterium bovis subsp bovis AF2122/97
uuggggugcuuucgcgucugcu

SEQ ID NO: 24917 - RNA, 22 nt, Mycobacterium bovis subsp bovis AF2122/97
uuggggugucggugcucugccc

SEQ ID NO: 24918 - RNA, 22 nt, Mycobacterium bovis subsp bovis AF2122/97
uuggugcgguauccggggaaga

SEQ ID NO: 24919 - RNA, 22 nt, Mycobacterium bovis subsp bovis AF2122/97
uugucguuugccgauuaccuga

SEQ ID NO: 24920 - RNA, 22 nt, Mycobacterium bovis subsp bovis AF2122/97
uugugcgauucugcgucugcuc

SEQ ID NO: 24921 - RNA, 22 nt, Mycobacterium bovis subsp bovis AF2122/97
uuguuugacuuauaucaaaaug

SEQ ID NO: 24922 - RNA, 19 nt, Mycobacterium bovis subsp bovis AF2122/97
uuucacccgcaacgucugc

SEQ ID NO: 24923 - RNA, 22 nt, Mycobacterium bovis subsp bovis AF2122/97
uuuccagcggcacgcauucggc

SEQ ID NO: 24924 - RNA, 22 nt, Mycobacterium bovis subsp bovis AF2122/97
uuuccccgcaagcgggucggcc

SEQ ID NO: 24925 - RNA, 22 nt, Mycobacterium bovis subsp bovis AF2122/97
uuuccgcccgcagaacacguug

SEQ ID NO: 24926 - RNA, 22 nt, Mycobacterium bovis subsp bovis AF2122/97
uuucgcagugccgucacgcucg

SEQ ID NO: 24927 - RNA, 22 nt, Mycobacterium bovis subsp bovis AF2122/97
uuucgccgugacguuacgcugg

SEQ ID NO: 24928 - RNA, 22 nt, Mycobacterium bovis subsp bovis AF2122/97
uuucgcgugacugagcggucug

SEQ ID NO: 24929 - RNA, 22 nt, Mycobacterium bovis subsp bovis AF2122/97
uuucgggcgauuuugcgucugc

SEQ ID NO: 24930 - RNA, 22 nt, Mycobacterium bovis subsp bovis AF2122/97
uuugacuccacgcgaaacacag

SEQ ID NO: 24931 - RNA, 18 nt, Mycobacterium bovis subsp bovis AF2122/97
uuugagcauggccgcgcc

SEQ ID NO: 24932 - RNA, 22 nt, Mycobacterium bovis subsp bovis AF2122/97
uuugccgaccgcggcaucagcu

SEQ ID NO: 24933 - RNA, 22 nt, Mycobacterium bovis subsp bovis AF2122/97
uuuggcgccgaauacgccaacg

SEQ ID NO: 24934 - RNA, 22 nt, Mycobacterium bovis subsp bovis AF2122/97
cgcggucaggucgccggucugg

SEQ ID NO: 24935 - RNA, 22 nt, Mycobacterium bovis subsp bovis AF2122/97
cgcggucgggaguacaugccgu

SEQ ID NO: 24936 - RNA, 22 nt, Mycobacterium bovis subsp bovis AF2122/97
cgcggucugcaugacgaugggc

SEQ ID NO: 24937 - RNA, 22 nt, Mycobacterium bovis subsp bovis AF2122/97
cgcuaugcugacugauuccgcg

SEQ ID NO: 24938 - RNA, 22 nt, Mycobacterium bovis subsp bovis AF2122/97
cgcucggugcugaccggccccu

SEQ ID NO: 24939 - RNA, 22 nt, Mycobacterium bovis subsp bovis AF2122/97
cgcucgucguaucugauggggu

SEQ ID NO: 24940 - RNA, 22 nt, Mycobacterium bovis subsp bovis AF2122/97
cgcucuggcguggaucucggcg

SEQ ID NO: 24941 - RNA, 22 nt, Mycobacterium bovis subsp bovis AF2122/97
cgcuggcugaucaacucauucg

SEQ ID NO: 24942 - RNA, 20 nt, Mycobacterium bovis subsp bovis AF2122/97
cgcuggucguugaugcgcag

SEQ ID NO: 24943 - RNA, 22 nt, Mycobacterium bovis subsp bovis AF2122/97
cgcugguuguucagcucgucgc

SEQ ID NO: 24944 - RNA, 22 nt, Mycobacterium bovis subsp bovis AF2122/97
cgcuugaugcccggucggcaag

SEQ ID NO: 24945 - RNA, 19 nt, Mycobacterium bovis subsp bovis AF2122/97
cggaaucgaagcacgcucc

SEQ ID NO: 24946 - RNA, 22 nt, Mycobacterium bovis subsp bovis AF2122/97
cggacaccagcggccaccgauu

SEQ ID NO: 24947 - RNA, 22 nt, Mycobacterium bovis subsp bovis AF2122/97
cggacgaaguccucggcguucu

SEQ ID NO: 24948 - RNA, 22 nt, Mycobacterium bovis subsp bovis AF2122/97
cggacggcucagguagucguuc

SEQ ID NO: 24949 - RNA, 23 nt, Mycobacterium bovis subsp bovis AF2122/97
cggacgucgacuuguugggcgcg

SEQ ID NO: 24950 - RNA, 22 nt, Mycobacterium bovis subsp bovis AF2122/97
cggacuccgaggcgaugcugcu

SEQ ID NO: 24951 - RNA, 22 nt, Mycobacterium bovis subsp bovis AF2122/97
cggagcgacgucgcgaugguca

SEQ ID NO: 24952 - RNA, 23 nt, Mycobacterium bovis subsp bovis AF2122/97
cggaucacgggaucguuaugccg

SEQ ID NO: 24953 - RNA, 22 nt, Mycobacterium bovis subsp bovis AF2122/97
cggaugcgaguggugaguucuu

SEQ ID NO: 24954 - RNA, 22 nt, Mycobacterium bovis subsp bovis AF2122/97
cggcagcggugguggugcggcu

SEQ ID NO: 24955 - RNA, 22 nt, Mycobacterium bovis subsp bovis AF2122/97
cggcaucgcgaaucgucgaaag

SEQ ID NO: 24956 - RNA, 22 nt, Mycobacterium bovis subsp bovis AF2122/97
cggcauuggccagaccgguguu

SEQ ID NO: 24957 - RNA, 22 nt, Mycobacterium bovis subsp bovis AF2122/97
cggccauggcuccggccucggu

SEQ ID NO: 24958 - RNA, 22 nt, Mycobacterium bovis subsp bovis AF2122/97
cggcccuggucgacgccggagc

SEQ ID NO: 24959 - RNA, 22 nt, Mycobacterium bovis subsp bovis AF2122/97
cggccgcaguguucucggcgau

SEQ ID NO: 24960 - RNA, 22 nt, Mycobacterium bovis subsp bovis AF2122/97
cggccgccuugcguucggcguu

SEQ ID NO: 24961 - RNA, 22 nt, Mycobacterium bovis subsp bovis AF2122/97
cggccggcaauucgacuccgcu

SEQ ID NO: 24962 - RNA, 22 nt, Mycobacterium bovis subsp bovis AF2122/97
cggcgagacggaugccgugacg

SEQ ID NO: 24963 - RNA, 22 nt, Mycobacterium bovis subsp bovis AF2122/97
cggcgagcaccgcauccaccgc

SEQ ID NO: 24964 - RNA, 22 nt, Mycobacterium bovis subsp bovis AF2122/97
cggcgagcagacacaaaaucgc

SEQ ID NO: 24965 - RNA, 22 nt, Mycobacterium bovis subsp bovis AF2122/97
cggcgccgucaccaccaucacc

SEQ ID NO: 24966 - RNA, 22 nt, Mycobacterium bovis subsp bovis AF2122/97
cggcgccuguuggaccggcgcc

SEQ ID NO: 24967 - RNA, 22 nt, Mycobacterium bovis subsp bovis AF2122/97
cggcgcuugauccuugcgccgg

SEQ ID NO: 24968 - RNA, 22 nt, Mycobacterium bovis subsp bovis AF2122/97
cggcggcgacgucuucucgccg

SEQ ID NO: 24969 - RNA, 22 nt, Mycobacterium bovis subsp bovis AF2122/97
cggcgggcaugaggccaucgaa

SEQ ID NO: 24970 - RNA, 22 nt, Mycobacterium bovis subsp bovis AF2122/97
cggcggugcugaucgccgugcg

SEQ ID NO: 24971 - RNA, 22 nt, Mycobacterium bovis subsp bovis AF2122/97
cggcgucaaccaggcggucgcu

SEQ ID NO: 24972 - RNA, 22 nt, Mycobacterium bovis subsp bovis AF2122/97
cggcguggccgaccccgcgguc

SEQ ID NO: 24973 - RNA, 18 nt, Mycobacterium bovis subsp bovis AF2122/97
cggcuagccgaguacggc

SEQ ID NO: 24974 - RNA, 22 nt, Mycobacterium bovis subsp bovis AF2122/97
cggcugcagugcgacgacgaga

SEQ ID NO: 24975 - RNA, 21 nt, Mycobacterium bovis subsp bovis AF2122/97
cggcuggcggccacggucgcc

SEQ ID NO: 24976 - RNA, 22 nt, Mycobacterium bovis subsp bovis AF2122/97
cggcugucggccuauaccgaca

SEQ ID NO: 24977 - RNA, 22 nt, Mycobacterium bovis subsp bovis AF2122/97
cggcuucccagacuucggauuc

SEQ ID NO: 24978 - RNA, 22 nt, Mycobacterium bovis subsp bovis AF2122/97
cgggaugccagcuagcgcgcgu

SEQ ID NO: 24979 - RNA, 22 nt, Mycobacterium bovis subsp bovis AF2122/97
cgggcagacgcguaagcgccca

SEQ ID NO: 24980 - RNA, 22 nt, Mycobacterium bovis subsp bovis AF2122/97
cgggcagcgucgggauaaucgg

SEQ ID NO: 24981 - RNA, 22 nt, Mycobacterium bovis subsp bovis AF2122/97
cgggccgcaacuggcaacugag

SEQ ID NO: 24982 - RNA, 22 nt, Mycobacterium bovis subsp bovis AF2122/97
cgggccgcagcgugcucgcugu

SEQ ID NO: 24983 - RNA, 22 nt, Mycobacterium bovis subsp bovis AF2122/97
cgggcgaucaaagccagcaccu

SEQ ID NO: 24984 - RNA, 22 nt, Mycobacterium bovis subsp bovis AF2122/97
cgggcgcucgagguguccgguc

SEQ ID NO: 24985 - RNA, 20 nt, Mycobacterium bovis subsp bovis AF2122/97
cggggacuuucaccucgucc

SEQ ID NO: 24986 - RNA, 22 nt, Mycobacterium bovis subsp bovis AF2122/97
cgggggauuucgcgucugcucg

SEQ ID NO: 24987 - RNA, 22 nt, Mycobacterium bovis subsp bovis AF2122/97
cgggggcuuaugcgacugcucg

SEQ ID NO: 24988 - RNA, 22 nt, Mycobacterium bovis subsp bovis AF2122/97
cggggugcagaagccgcauugc

SEQ ID NO: 24989 - RNA, 22 nt, Mycobacterium bovis subsp bovis AF2122/97
cggggugcagccgauacccggg

SEQ ID NO: 24990 - RNA, 22 nt, Mycobacterium bovis subsp bovis AF2122/97
cgggucuauggguggaugcucg

SEQ ID NO: 24991 - RNA, 22 nt, Mycobacterium bovis subsp bovis AF2122/97
cgggugaucaccgcggcagcgu

SEQ ID NO: 24992 - RNA, 22 nt, Mycobacterium bovis subsp bovis AF2122/97
cgguacgguccgcaguugggug

SEQ ID NO: 24993 - RNA, 22 nt, Mycobacterium bovis subsp bovis AF2122/97
cgguccagucucgaugucgccg

SEQ ID NO: 24994 - RNA, 22 nt, Mycobacterium bovis subsp bovis AF2122/97
cggucccgcggggacagccgag

SEQ ID NO: 24995 - RNA, 22 nt, Mycobacterium bovis subsp bovis AF2122/97
cggucgacguuccuagcuuucg

SEQ ID NO: 24996 - RNA, 22 nt, Mycobacterium bovis subsp bovis AF2122/97
cggucgcgauaccguguagcag

SEQ ID NO: 24997 - RNA, 22 nt, Mycobacterium bovis subsp bovis AF2122/97
cggucgcugaugcuggauguga

SEQ ID NO: 24998 - RNA, 22 nt, Mycobacterium bovis subsp bovis AF2122/97
cggucggucaaggucgcgugca

SEQ ID NO: 24999 - RNA, 22 nt, Mycobacterium bovis subsp bovis AF2122/97
cggugaccgcgacccgcgcggu

SEQ ID NO: 25000 - RNA, 22 nt, Mycobacterium bovis subsp bovis AF2122/97
cggugacuauuucggcgccgug

SEQ ID NO: 25001 - RNA, 21 nt, Mycobacterium bovis subsp bovis AF2122/97
cggugccgaugacggugucga

SEQ ID NO: 25002 - RNA, 20 nt, Mycobacterium bovis subsp bovis AF2122/97
cggugcguugaucacguugg

SEQ ID NO: 25003 - RNA, 17 nt, Mycobacterium bovis subsp bovis AF2122/97
cgguggaugcgcaguug

SEQ ID NO: 25004 - RNA, 22 nt, Mycobacterium bovis subsp bovis AF2122/97
cgguggcauagguaguugcucg

SEQ ID NO: 25005 - RNA, 22 nt, Mycobacterium bovis subsp bovis AF2122/97
cgguggcuuuugcgucugcucg

SEQ ID NO: 25006 - RNA, 22 nt, Mycobacterium bovis subsp bovis AF2122/97
gcggcgcggugauacgccggga

SEQ ID NO: 25007 - RNA, 22 nt, Mycobacterium bovis subsp bovis AF2122/97
gcggcggaccuuggugcgcagg

SEQ ID NO: 25008 - RNA, 22 nt, Mycobacterium bovis subsp bovis AF2122/97
gcggcguaccacccagcgcguc

SEQ ID NO: 25009 - RNA, 22 nt, Mycobacterium bovis subsp bovis AF2122/97
gcgggcaucacuucggacgggg

SEQ ID NO: 25010 - RNA, 22 nt, Mycobacterium bovis subsp bovis AF2122/97
gcggguaacggagguccgccgg

SEQ ID NO: 25011 - RNA, 22 nt, Mycobacterium bovis subsp bovis AF2122/97
gcgggucugaugcaggaucgcg

SEQ ID NO: 25012 - RNA, 22 nt, Mycobacterium bovis subsp bovis AF2122/97
gcggugacgauaauuucuuucu

SEQ ID NO: 25013 - RNA, 22 nt, Mycobacterium bovis subsp bovis AF2122/97
gcgguggcacgcuggucgguua

SEQ ID NO: 25014 - RNA, 22 nt, Mycobacterium bovis subsp bovis AF2122/97
gcgguggucgcgaccggccccg

SEQ ID NO: 25015 - RNA, 22 nt, Mycobacterium bovis subsp bovis AF2122/97
gcggugugggucccauccguca

SEQ ID NO: 25016 - RNA, 22 nt, Mycobacterium bovis subsp bovis AF2122/97
gcgucgauugccuccgccucgg

SEQ ID NO: 25017 - RNA, 22 nt, Mycobacterium bovis subsp bovis AF2122/97
gcgucgccagacucacagucgc

SEQ ID NO: 25018 - RNA, 19 nt, Mycobacterium bovis subsp bovis AF2122/97
gcgugacgagcgccugcgc

SEQ ID NO: 25019 - RNA, 22 nt, Mycobacterium bovis subsp bovis AF2122/97
gcguggacagccguucgcgcau

SEQ ID NO: 25020 - RNA, 22 nt, Mycobacterium bovis subsp bovis AF2122/97
gcgugguacggugguguaccgu

SEQ ID NO: 25021 - RNA, 21 nt, Mycobacterium bovis subsp bovis AF2122/97
gcguucgaaucucguugccgc

SEQ ID NO: 25022 - RNA, 22 nt, Mycobacterium bovis subsp bovis AF2122/97
gcguugaacugauaggugcggc

SEQ ID NO: 25023 - RNA, 22 nt, Mycobacterium bovis subsp bovis AF2122/97
gcguugcccggccggcgucguc

SEQ ID NO: 25024 - RNA, 22 nt, Mycobacterium bovis subsp bovis AF2122/97
gcuacggauuucgcccgucgaa

SEQ ID NO: 25025 - RNA, 22 nt, Mycobacterium bovis subsp bovis AF2122/97
gcuacgucggaucugucggccg

SEQ ID NO: 25026 - RNA, 23 nt, Mycobacterium bovis subsp bovis AF2122/97
gcuacuggcggcgagagcgucgg

SEQ ID NO: 25027 - RNA, 22 nt, Mycobacterium bovis subsp bovis AF2122/97
gcucaccacggagauccgccgg

SEQ ID NO: 25028 - RNA, 22 nt, Mycobacterium bovis subsp bovis AF2122/97
gcucagcaucgucgaauccucg

SEQ ID NO: 25029 - RNA, 22 nt, Mycobacterium bovis subsp bovis AF2122/97
gcucaugucgccguagaccggg

SEQ ID NO: 25030 - RNA, 22 nt, Mycobacterium bovis subsp bovis AF2122/97
gcucgcuggaugagcagcucgg

SEQ ID NO: 25031 - RNA, 22 nt, Mycobacterium bovis subsp bovis AF2122/97
gcucggaucaucaucuuguccg

SEQ ID NO: 25032 - RNA, 22 nt, Mycobacterium bovis subsp bovis AF2122/97
gcucgguuaucaguugauaaca

SEQ ID NO: 25033 - RNA, 22 nt, Mycobacterium bovis subsp bovis AF2122/97
gcucuaccacguccugcacgcg

SEQ ID NO: 25034 - RNA, 22 nt, Mycobacterium bovis subsp bovis AF2122/97
gcucugcuggucgauaagaucg

SEQ ID NO: 25035 - RNA, 22 nt, Mycobacterium bovis subsp bovis AF2122/97
gcugaacuccuggccgaguguc

SEQ ID NO: 25036 - RNA, 22 nt, Mycobacterium bovis subsp bovis AF2122/97
gcugacaucgucgaacaccagg

SEQ ID NO: 25037 - RNA, 22 nt, Mycobacterium bovis subsp bovis AF2122/97
gcugacucgguuuggugcgacg

SEQ ID NO: 25038 - RNA, 22 nt, Mycobacterium bovis subsp bovis AF2122/97
gcugcaacaucaaaccgacucc

SEQ ID NO: 25039 - RNA, 22 nt, Mycobacterium bovis subsp bovis AF2122/97
gcugcagcggcucguggguggu

SEQ ID NO: 25040 - RNA, 22 nt, Mycobacterium bovis subsp bovis AF2122/97
gcugccccgcgagcuggugcug

SEQ ID NO: 25041 - RNA, 22 nt, Mycobacterium bovis subsp bovis AF2122/97
gcugccucgcugggcgcccagg

SEQ ID NO: 25042 - RNA, 22 nt, Mycobacterium bovis subsp bovis AF2122/97
gcugcgggaguacgggcgccgg

SEQ ID NO: 25043 - RNA, 22 nt, Mycobacterium bovis subsp bovis AF2122/97
gcuggccgccagcgaggcguug

SEQ ID NO: 25044 - RNA, 22 nt, Mycobacterium bovis subsp bovis AF2122/97
gcuggccgcgcuggcgugggug

SEQ ID NO: 25045 - RNA, 22 nt, Mycobacterium bovis subsp bovis AF2122/97
gcuggcguugcugaugucgccg

SEQ ID NO: 25046 - RNA, 22 nt, Mycobacterium bovis subsp bovis AF2122/97
gcugggccuuacgcaccugccg

SEQ ID NO: 25047 - RNA, 22 nt, Mycobacterium bovis subsp bovis AF2122/97
gcuggugccggacgacgucgca

SEQ ID NO: 25048 - RNA, 22 nt, Mycobacterium bovis subsp bovis AF2122/97
gcuguccuguggcgcccgcagc

SEQ ID NO: 25049 - RNA, 22 nt, Mycobacterium bovis subsp bovis AF2122/97
gcugugguggcggaugauccgc

SEQ ID NO: 25050 - RNA, 22 nt, Mycobacterium bovis subsp bovis AF2122/97
gcuguuguucggcuacgucggc

SEQ ID NO: 25051 - RNA, 22 nt, Mycobacterium bovis subsp bovis AF2122/97
gcuucacaucauuuucuggaag

SEQ ID NO: 25052 - RNA, 22 nt, Mycobacterium bovis subsp bovis AF2122/97
gcuuuuaugacugcucggcggg

SEQ ID NO: 25053 - RNA, 21 nt, Mycobacterium bovis subsp bovis AF2122/97
gcuuuuugcgucuguucgccg

SEQ ID NO: 25054 - RNA, 22 nt, Mycobacterium bovis subsp bovis AF2122/97
ggaagaagaacaccgacacuga

SEQ ID NO: 25055 - RNA, 22 nt, Mycobacterium bovis subsp bovis AF2122/97
ggacgaucgccagaguggucga

SEQ ID NO: 25056 - RNA, 22 nt, Mycobacterium bovis subsp bovis AF2122/97
ggagaagguaauacucaaggcu

SEQ ID NO: 25057 - RNA, 22 nt, Mycobacterium bovis subsp bovis AF2122/97
ggagccguguucgcgauucugc

SEQ ID NO: 25058 - RNA, 19 nt, Mycobacterium bovis subsp bovis AF2122/97
ggagugcccggugccggcg

SEQ ID NO: 25059 - RNA, 22 nt, Mycobacterium bovis subsp bovis AF2122/97
ggaguucaaugccacggcgucg

SEQ ID NO: 25060 - RNA, 22 nt, Mycobacterium bovis subsp bovis AF2122/97
ggaucgacguaggcagccgguu

SEQ ID NO: 25061 - RNA, 22 nt, Mycobacterium bovis subsp bovis AF2122/97
ggaucgggugcuugcggugauc

SEQ ID NO: 25062 - RNA, 22 nt, Mycobacterium bovis subsp bovis AF2122/97
ggauucgggucuuggugagccg

SEQ ID NO: 25063 - RNA, 22 nt, Mycobacterium bovis subsp bovis AF2122/97
ggcaacggcggcaacgccggca

SEQ ID NO: 25064 - RNA, 22 nt, Mycobacterium bovis subsp bovis AF2122/97
ggcaccguucgucgagggcggc

SEQ ID NO: 25065 - RNA, 22 nt, Mycobacterium bovis subsp bovis AF2122/97
ggcacgaucuuccucggcgguc

SEQ ID NO: 25066 - RNA, 23 nt, Mycobacterium bovis subsp bovis AF2122/97
ggcacgauggaaugucgcaacca

SEQ ID NO: 25067 - RNA, 22 nt, Mycobacterium bovis subsp bovis AF2122/97
ggcacugucagccuguccucac

SEQ ID NO: 25068 - RNA, 22 nt, Mycobacterium bovis subsp bovis AF2122/97
ggcagcggcacgucgacgcugg

SEQ ID NO: 25069 - RNA, 22 nt, Mycobacterium bovis subsp bovis AF2122/97
ggcaggugcgcuaggucccggu

SEQ ID NO: 25070 - RNA, 19 nt, Mycobacterium bovis subsp bovis AF2122/97
ggccaccggucccggcugc

SEQ ID NO: 25071 - RNA, 22 nt, Mycobacterium bovis subsp bovis AF2122/97
ggccacgccgcccuugccggac

SEQ ID NO: 25072 - RNA, 22 nt, Mycobacterium bovis subsp bovis AF2122/97
ggccaucgcugcuugcugcgcc

SEQ ID NO: 25073 - RNA, 22 nt, Mycobacterium bovis subsp bovis AF2122/97
ggcccagcgacucgccgagcuc

SEQ ID NO: 25074 - RNA, 22 nt, Mycobacterium bovis subsp bovis AF2122/97
ggcccgaacccacaucuccacg

SEQ ID NO: 25075 - RNA, 22 nt, Mycobacterium bovis subsp bovis AF2122/97
ggccguugauucugcguccacc

SEQ ID NO: 25076 - RNA, 22 nt, Mycobacterium bovis subsp bovis AF2122/97
ggccucgucgaaggucaggcgu

SEQ ID NO: 25077 - RNA, 22 nt, Mycobacterium bovis subsp bovis AF2122/97
ggcgaagagcgcagccgggugu

SEQ ID NO: 25078 - RNA, 22 nt, Mycobacterium bovis subsp bovis AF2122/97
ggcgaaggucgcauggucaagc

SEQ ID NO: 25079 - RNA, 22 nt, Mycobacterium bovis subsp bovis AF2122/97
ggcgagcagacacagagucgca

SEQ ID NO: 25080 - RNA, 22 nt, Mycobacterium bovis subsp bovis AF2122/97
ggcgagcagacgcagaaucgca

SEQ ID NO: 25081 - RNA, 22 nt, Mycobacterium bovis subsp bovis AF2122/97
ggcgauuuugcgucugcucgcc

SEQ ID NO: 25082 - RNA, 22 nt, Mycobacterium bovis subsp bovis AF2122/97
ggcgcccgacuucuucgaaggg

SEQ ID NO: 25083 - RNA, 22 nt, Mycobacterium bovis subsp bovis AF2122/97
ggcgccuguuggacgggcgcuu

SEQ ID NO: 25084 - RNA, 22 nt, Mycobacterium bovis subsp bovis AF2122/97
ggcgcgcuggccggucacccug

SEQ ID NO: 25085 - RNA, 22 nt, Mycobacterium bovis subsp bovis AF2122/97
ggcgcggcugcugagugagguc

SEQ ID NO: 25086 - RNA, 22 nt, Mycobacterium bovis subsp bovis AF2122/97
ggcgcugacggccugauagauc

SEQ ID NO: 25087 - RNA, 22 nt, Mycobacterium bovis subsp bovis AF2122/97
ggcggcaccagcaauccgugga

SEQ ID NO: 25088 - RNA, 22 nt, Mycobacterium bovis subsp bovis AF2122/97
ggcggcccgcaucgucgccggg

SEQ ID NO: 25089 - RNA, 22 nt, Mycobacterium bovis subsp bovis AF2122/97
ggcggccgcaauuagcgagggc

SEQ ID NO: 25090 - RNA, 22 nt, Mycobacterium bovis subsp bovis AF2122/97
ggcggcgguggcuugaccgcug

SEQ ID NO: 25091 - RNA, 22 nt, Mycobacterium bovis subsp bovis AF2122/97
ggcggcucgggcauccugauga

SEQ ID NO: 25092 - RNA, 22 nt, Mycobacterium bovis subsp bovis AF2122/97
ggcgggaucuccuucggugcgu

SEQ ID NO: 25093 - RNA, 22 nt, Mycobacterium bovis subsp bovis AF2122/97
ggcgggcccgaaucgaggcggu

SEQ ID NO: 25094 - RNA, 22 nt, Mycobacterium bovis subsp bovis AF2122/97
ggcgggggcaccguugcugcga

SEQ ID NO: 25095 - RNA, 22 nt, Mycobacterium bovis subsp bovis AF2122/97
ggcgggucaacgacccagacga

SEQ ID NO: 25096 - RNA, 22 nt, Mycobacterium bovis subsp bovis AF2122/97
ggcgguagguccgagcuauccu

SEQ ID NO: 25097 - RNA, 22 nt, Mycobacterium bovis subsp bovis AF2122/97
ggcggucaccaacguuggcgcc

SEQ ID NO: 25098 - RNA, 22 nt, Mycobacterium bovis subsp bovis AF2122/97
ggcggucaccgauugggagagg

SEQ ID NO: 25099 - RNA, 22 nt, Mycobacterium bovis subsp bovis AF2122/97
ggcggugcacagugccacaucg

SEQ ID NO: 25100 - RNA, 22 nt, Mycobacterium bovis subsp bovis AF2122/97
ggcgguggaauugcuuggagcc

SEQ ID NO: 25101 - RNA, 22 nt, Mycobacterium bovis subsp bovis AF2122/97
ggcguggucaccggcguggucg

SEQ ID NO: 25102 - RNA, 22 nt, Mycobacterium bovis subsp bovis AF2122/97
ggcuccguagcagcguuggcua

SEQ ID NO: 25103 - RNA, 22 nt, Mycobacterium bovis subsp bovis AF2122/97
ggcucggugaacaagaucgucg

SEQ ID NO: 25104 - RNA, 22 nt, Mycobacterium bovis subsp bovis AF2122/97
ggcugacacguuccgcccggca

SEQ ID NO: 25105 - RNA, 22 nt, Mycobacterium bovis subsp bovis AF2122/97
ggcugaggccgccgaguuggcg

SEQ ID NO: 25106 - RNA, 22 nt, Mycobacterium bovis subsp bovis AF2122/97
ggcugaguuuagucaagcgcgu

SEQ ID NO: 25107 - RNA, 22 nt, Mycobacterium bovis subsp bovis AF2122/97
ggcugauggccaacgaguuuua

SEQ ID NO: 25108 - RNA, 19 nt, Mycobacterium bovis subsp bovis AF2122/97
ggcugcguacucggcgguc

SEQ ID NO: 25109 - RNA, 22 nt, Mycobacterium bovis subsp bovis AF2122/97
ggcugcugcggaguccacaccg

SEQ ID NO: 25110 - RNA, 22 nt, Mycobacterium bovis subsp bovis AF2122/97
ggcuggcagcucacgacgccuc

SEQ ID NO: 25111 - RNA, 22 nt, Mycobacterium bovis subsp bovis AF2122/97
ggcuugucggaacucggcccca

SEQ ID NO: 25112 - RNA, 22 nt, Mycobacterium bovis subsp bovis AF2122/97
ggcuugucgguacucggaccga

SEQ ID NO: 25113 - RNA, 22 nt, Mycobacterium bovis subsp bovis AF2122/97
ggcuuguucggugcggccgguc

SEQ ID NO: 25114 - RNA, 22 nt, Mycobacterium bovis subsp bovis AF2122/97
gggcaucgugcugggcggaucg

SEQ ID NO: 25115 - RNA, 22 nt, Mycobacterium bovis subsp bovis AF2122/97
gggccagucuuucggagucaga

SEQ ID NO: 25116 - RNA, 22 nt, Mycobacterium bovis subsp bovis AF2122/97
gggcccugguugaugaucacgu

SEQ ID NO: 25117 - RNA, 22 nt, Mycobacterium bovis subsp bovis AF2122/97
gggccgaugcggaacucgauca

SEQ ID NO: 25118 - RNA, 22 nt, Mycobacterium bovis subsp bovis AF2122/97
gggccgccgauguggccgcgau

SEQ ID NO: 25119 - RNA, 22 nt, Mycobacterium bovis subsp bovis AF2122/97
gggccggugcgaauggugcaac

SEQ ID NO: 25120 - RNA, 22 nt, Mycobacterium bovis subsp bovis AF2122/97
gggcgcgcugucccgugaugcc

SEQ ID NO: 25121 - RNA, 22 nt, Mycobacterium bovis subsp bovis AF2122/97
gggcggcguucgaggccauccg

SEQ ID NO: 25122 - RNA, 22 nt, Mycobacterium bovis subsp bovis AF2122/97
gggcggcuuauggcucgucggu

SEQ ID NO: 25123 - RNA, 22 nt, Mycobacterium bovis subsp bovis AF2122/97
gggcggugaacgcagccugguc

SEQ ID NO: 25124 - RNA, 22 nt, Mycobacterium bovis subsp bovis AF2122/97
gggcggugaggaguccaugccg

SEQ ID NO: 25125 - RNA, 22 nt, Mycobacterium bovis subsp bovis AF2122/97
gggcgguugcucgagcugacgu

SEQ ID NO: 25126 - RNA, 22 nt, Mycobacterium bovis subsp bovis AF2122/97
gggcuaccuggaaccgcugcag

SEQ ID NO: 25127 - RNA, 20 nt, Mycobacterium bovis subsp bovis AF2122/97
gggcuuuugcgucugcucgc

SEQ ID NO: 25128 - RNA, 22 nt, Mycobacterium bovis subsp bovis AF2122/97
gggcuuuugcgucugcucgccg

SEQ ID NO: 25129 - RNA, 22 nt, Mycobacterium bovis subsp bovis AF2122/97
ggggccggccucacugccguua

SEQ ID NO: 25130 - RNA, 22 nt, Mycobacterium bovis subsp bovis AF2122/97
ggggucaacaucgagcugaucu

SEQ ID NO: 25131 - RNA, 22 nt, Mycobacterium bovis subsp bovis AF2122/97
ggggucgguauagaugucgguc

SEQ ID NO: 25132 - RNA, 22 nt, Mycobacterium bovis subsp bovis AF2122/97
ggguacugagcaucggguuguu

SEQ ID NO: 25133 - RNA, 23 nt, Mycobacterium bovis subsp bovis AF2122/97
ggguccguuucccguggccgccc

SEQ ID NO: 25134 - RNA, 22 nt, Mycobacterium bovis subsp bovis AF2122/97
gggucgucgacgggcgcaacgu

SEQ ID NO: 25135 - RNA, 22 nt, Mycobacterium bovis subsp bovis AF2122/97
gggucuggcgguggacacccug

SEQ ID NO: 25136 - RNA, 22 nt, Mycobacterium bovis subsp bovis AF2122/97
gggugccgcauucuucagcucg

SEQ ID NO: 25137 - RNA, 22 nt, Mycobacterium bovis subsp bovis AF2122/97
ggguggcuccggucagaucgac

SEQ ID NO: 25138 - RNA, 22 nt, Mycobacterium bovis subsp bovis AF2122/97
ggguggugaaguuggcggccgg

SEQ ID NO: 25139 - RNA, 22 nt, Mycobacterium bovis subsp bovis AF2122/97
gggugguggucgccaacgccga

SEQ ID NO: 25140 - RNA, 22 nt, Mycobacterium bovis subsp bovis AF2122/97
ggguugguggcggccagcagca

SEQ ID NO: 25141 - RNA, 22 nt, Mycobacterium bovis subsp bovis AF2122/97
gguaucggugacgcgcgaccgg

SEQ ID NO: 25142 - RNA, 22 nt, Mycobacterium bovis subsp bovis AF2122/97
gguauucgagccgucaccguug

SEQ ID NO: 25143 - RNA, 20 nt, Mycobacterium bovis subsp bovis AF2122/97
ggucacccugggugagccgg

SEQ ID NO: 25144 - RNA, 22 nt, Mycobacterium bovis subsp bovis AF2122/97
ggucaccgucacgcucgagccg

SEQ ID NO: 25145 - RNA, 22 nt, Mycobacterium bovis subsp bovis AF2122/97
ggucaucgcgugauccuucgaa

SEQ ID NO: 25146 - RNA, 22 nt, Mycobacterium bovis subsp bovis AF2122/97
ggucccuuaaacccgaaugccg

SEQ ID NO: 25147 - RNA, 22 nt, Mycobacterium bovis subsp bovis AF2122/97
gguccgaaggcuucggcaagcc

SEQ ID NO: 25148 - RNA, 22 nt, Mycobacterium bovis subsp bovis AF2122/97
gguccgcgagcagcacgccauu

SEQ ID NO: 25149 - RNA, 22 nt, Mycobacterium bovis subsp bovis AF2122/97
gguccucugauccgcaccgcau

SEQ ID NO: 25150 - RNA, 22 nt, Mycobacterium bovis subsp bovis AF2122/97
ccgcgccagcgacgaugcagug

SEQ ID NO: 25151 - RNA, 22 nt, Mycobacterium bovis subsp bovis AF2122/97
ccgcgccuggucgcagguugcc

SEQ ID NO: 25152 - RNA, 22 nt, Mycobacterium bovis subsp bovis AF2122/97
ccgcgcugaccgacguuuggcg

SEQ ID NO: 25153 - RNA, 22 nt, Mycobacterium bovis subsp bovis AF2122/97
ccgcggagcaugggcacgauga

SEQ ID NO: 25154 - RNA, 23 nt, Mycobacterium bovis subsp bovis AF2122/97
ccgcguagucgugagugccggcc

SEQ ID NO: 25155 - RNA, 22 nt, Mycobacterium bovis subsp bovis AF2122/97
ccgcgucggccucagccggaaa

SEQ ID NO: 25156 - RNA, 22 nt, Mycobacterium bovis subsp bovis AF2122/97
ccgcuguugccguugguccagc

SEQ ID NO: 25157 - RNA, 22 nt, Mycobacterium bovis subsp bovis AF2122/97
ccggaacgcccugguggugcug

SEQ ID NO: 25158 - RNA, 22 nt, Mycobacterium bovis subsp bovis AF2122/97
ccggcaugagucgaagccucaa

SEQ ID NO: 25159 - RNA, 22 nt, Mycobacterium bovis subsp bovis AF2122/97
ccggccgccaaauggcgccgga

SEQ ID NO: 25160 - RNA, 22 nt, Mycobacterium bovis subsp bovis AF2122/97
ccggccugaugaugguguugcu

SEQ ID NO: 25161 - RNA, 22 nt, Mycobacterium bovis subsp bovis AF2122/97
ccggcggcaaacgauucgacgg

SEQ ID NO: 25162 - RNA, 22 nt, Mycobacterium bovis subsp bovis AF2122/97
ccggcggccugaucagccugcu

SEQ ID NO: 25163 - RNA, 22 nt, Mycobacterium bovis subsp bovis AF2122/97
ccggcgucuucgacaccccgga

SEQ ID NO: 25164 - RNA, 18 nt, Mycobacterium bovis subsp bovis AF2122/97
ccggcguucuggugcucg

SEQ ID NO: 25165 - RNA, 21 nt, Mycobacterium bovis subsp bovis AF2122/97
ccggcucaccguuggccgggu

SEQ ID NO: 25166 - RNA, 22 nt, Mycobacterium bovis subsp bovis AF2122/97
ccggcugcccaccaacgagcag

SEQ ID NO: 25167 - RNA, 18 nt, Mycobacterium bovis subsp bovis AF2122/97
ccgggaccgcgaacccgu

SEQ ID NO: 25168 - RNA, 22 nt, Mycobacterium bovis subsp bovis AF2122/97
ccgggcaaccauuacacaguug

SEQ ID NO: 25169 - RNA, 23 nt, Mycobacterium bovis subsp bovis AF2122/97
ccgggcgcacuggcgagcugcuu

SEQ ID NO: 25170 - RNA, 22 nt, Mycobacterium bovis subsp bovis AF2122/97
ccgggcgguugagcgugauggu

SEQ ID NO: 25171 - RNA, 22 nt, Mycobacterium bovis subsp bovis AF2122/97
ccgggcugggccugcgggucau

SEQ ID NO: 25172 - RNA, 22 nt, Mycobacterium bovis subsp bovis AF2122/97
ccgggcugguucuggaucggcg

SEQ ID NO: 25173 - RNA, 22 nt, Mycobacterium bovis subsp bovis AF2122/97
ccggggugcucgugcuggcgcg

SEQ ID NO: 25174 - RNA, 22 nt, Mycobacterium bovis subsp bovis AF2122/97
ccggucccguaccguacuguug

SEQ ID NO: 25175 - RNA, 22 nt, Mycobacterium bovis subsp bovis AF2122/97
ccggugauaugggucgucucgu

SEQ ID NO: 25176 - RNA, 22 nt, Mycobacterium bovis subsp bovis AF2122/97
ccggugucacggagcuggcccc

SEQ ID NO: 25177 - RNA, 22 nt, Mycobacterium bovis subsp bovis AF2122/97
ccgguguugccgaugccggugu

SEQ ID NO: 25178 - RNA, 22 nt, Mycobacterium bovis subsp bovis AF2122/97
ccgguguuguagucgccggugu

SEQ ID NO: 25179 - RNA, 22 nt, Mycobacterium bovis subsp bovis AF2122/97
ccgguucaucguaaucgggguc

SEQ ID NO: 25180 - RNA, 22 nt, Mycobacterium bovis subsp bovis AF2122/97
ccgguuguccagauacgacgug

SEQ ID NO: 25181 - RNA, 22 nt, Mycobacterium bovis subsp bovis AF2122/97
ccguaacgcgugcacuucggcg

SEQ ID NO: 25182 - RNA, 22 nt, Mycobacterium bovis subsp bovis AF2122/97
ccguccuggcaggugcuggguu

SEQ ID NO: 25183 - RNA, 22 nt, Mycobacterium bovis subsp bovis AF2122/97
ccgugcagcgagcgcacuggcc

SEQ ID NO: 25184 - RNA, 22 nt, Mycobacterium bovis subsp bovis AF2122/97
ccgugcguguggucgccguugg

SEQ ID NO: 25185 - RNA, 22 nt, Mycobacterium bovis subsp bovis AF2122/97
ccgugcugccguucaccggccu

SEQ ID NO: 25186 - RNA, 22 nt, Mycobacterium bovis subsp bovis AF2122/97
ccguggucacagacgaucacga

SEQ ID NO: 25187 - RNA, 22 nt, Mycobacterium bovis subsp bovis AF2122/97
ccguucgaccucgagucgcugc

SEQ ID NO: 25188 - RNA, 22 nt, Mycobacterium bovis subsp bovis AF2122/97
ccguucgccgacauggguuuug

SEQ ID NO: 25189 - RNA, 22 nt, Mycobacterium bovis subsp bovis AF2122/97
ccguuuggucccgaggugucgg

SEQ ID NO: 25190 - RNA, 22 nt, Mycobacterium bovis subsp bovis AF2122/97
ccuccguuggccccggugccgg

SEQ ID NO: 25191 - RNA, 22 nt, Mycobacterium bovis subsp bovis AF2122/97
ccuccugcgccuggcgcaccga

SEQ ID NO: 25192 - RNA, 22 nt, Mycobacterium bovis subsp bovis AF2122/97
ccucgagcucgcugaucacuga

SEQ ID NO: 25193 - RNA, 22 nt, Mycobacterium bovis subsp bovis AF2122/97
ccucuucggggguggccggcuu

SEQ ID NO: 25194 - RNA, 22 nt, Mycobacterium bovis subsp bovis AF2122/97
ccugacgaaucuggucgugcca

SEQ ID NO: 25195 - RNA, 22 nt, Mycobacterium bovis subsp bovis AF2122/97
ccugauggcgucgaucaccggc

SEQ ID NO: 25196 - RNA, 22 nt, Mycobacterium bovis subsp bovis AF2122/97
ccugcacgacggugaugcccgc

SEQ ID NO: 25197 - RNA, 22 nt, Mycobacterium bovis subsp bovis AF2122/97
ccuggaccaaucgcggcuugca

SEQ ID NO: 25198 - RNA, 22 nt, Mycobacterium bovis subsp bovis AF2122/97
ccugggugccgaucgagccggu

SEQ ID NO: 25199 - RNA, 22 nt, Mycobacterium bovis subsp bovis AF2122/97
ccuguuucgaguucuucacguu

SEQ ID NO: 25200 - RNA, 22 nt, Mycobacterium bovis subsp bovis AF2122/97
cgaaaucgacagcagcgcgaca

SEQ ID NO: 25201 - RNA, 22 nt, Mycobacterium bovis subsp bovis AF2122/97
cgaacgccuggccaccgacggc

SEQ ID NO: 25202 - RNA, 22 nt, Mycobacterium bovis subsp bovis AF2122/97
cgaacguaacggcacugcgaau

SEQ ID NO: 25203 - RNA, 22 nt, Mycobacterium bovis subsp bovis AF2122/97
cgaacgugcacgcacugcgaag

SEQ ID NO: 25204 - RNA, 22 nt, Mycobacterium bovis subsp bovis AF2122/97
cgaagaacugguugccgucgac

SEQ ID NO: 25205 - RNA, 22 nt, Mycobacterium bovis subsp bovis AF2122/97
cgaaggucucgacguacugcgc

SEQ ID NO: 25206 - RNA, 22 nt, Mycobacterium bovis subsp bovis AF2122/97
cgaaguaauuucgcggcuggcu

SEQ ID NO: 25207 - RNA, 22 nt, Mycobacterium bovis subsp bovis AF2122/97
cgaaugugcacugguggcggcg

SEQ ID NO: 25208 - RNA, 22 nt, Mycobacterium bovis subsp bovis AF2122/97
cgaccaggcaauccagcaggug

SEQ ID NO: 25209 - RNA, 22 nt, Mycobacterium bovis subsp bovis AF2122/97
cgaccguuccgucgugcagucg

SEQ ID NO: 25210 - RNA, 22 nt, Mycobacterium bovis subsp bovis AF2122/97
cgacgcacccgccuauggcggc

SEQ ID NO: 25211 - RNA, 22 nt, Mycobacterium bovis subsp bovis AF2122/97
cgacggcaacccgcugugugaa

SEQ ID NO: 25212 - RNA, 22 nt, Mycobacterium bovis subsp bovis AF2122/97
cgacggccaccaccagcgacuc

SEQ ID NO: 25213 - RNA, 22 nt, Mycobacterium bovis subsp bovis AF2122/97
cgagacgagccacggcuucgcc

SEQ ID NO: 25214 - RNA, 22 nt, Mycobacterium bovis subsp bovis AF2122/97
cgagcagacacagaaucgcacg

SEQ ID NO: 25215 - RNA, 22 nt, Mycobacterium bovis subsp bovis AF2122/97
cgagcagacacagaaucgccca

SEQ ID NO: 25216 - RNA, 22 nt, Mycobacterium bovis subsp bovis AF2122/97
ggucgacucgaucggcgagccc

SEQ ID NO: 25217 - RNA, 22 nt, Mycobacterium bovis subsp bovis AF2122/97
ggucgagucguggucgcaugag

SEQ ID NO: 25218 - RNA, 22 nt, Mycobacterium bovis subsp bovis AF2122/97
ggucggauucgaggcagccggc

SEQ ID NO: 25219 - RNA, 22 nt, Mycobacterium bovis subsp bovis AF2122/97
ggucggccaucaccuuacgcag

SEQ ID NO: 25220 - RNA, 22 nt, Mycobacterium bovis subsp bovis AF2122/97
ggucgguugcgcuguacuacac

SEQ ID NO: 25221 - RNA, 22 nt, Mycobacterium bovis subsp bovis AF2122/97
ggucugguuggcgucgccgacg

SEQ ID NO: 25222 - RNA, 22 nt, Mycobacterium bovis subsp bovis AF2122/97
ggugaacgggagguucagcccg

SEQ ID NO: 25223 - RNA, 22 nt, Mycobacterium bovis subsp bovis AF2122/97
ggugaccgucgccgcgucguug

SEQ ID NO: 25224 - RNA, 22 nt, Mycobacterium bovis subsp bovis AF2122/97
ggugagagcccauggcggucgu

SEQ ID NO: 25225 - RNA, 19 nt, Mycobacterium bovis subsp bovis AF2122/97
ggugagcagggucucgcgc

SEQ ID NO: 25226 - RNA, 22 nt, Mycobacterium bovis subsp bovis AF2122/97
ggugaucacgagggccuguuca

SEQ ID NO: 25227 - RNA, 22 nt, Mycobacterium bovis subsp bovis AF2122/97
ggugaucuccaugccgcccggc

SEQ ID NO: 25228 - RNA, 22 nt, Mycobacterium bovis subsp bovis AF2122/97
ggugaugguggaggcagccgac

SEQ ID NO: 25229 - RNA, 22 nt, Mycobacterium bovis subsp bovis AF2122/97
ggugcagcggucagcaguccga

SEQ ID NO: 25230 - RNA, 22 nt, Mycobacterium bovis subsp bovis AF2122/97
ggugccaaaagcggaguccagg

SEQ ID NO: 25231 - RNA, 22 nt, Mycobacterium bovis subsp bovis AF2122/97
ggugccgcaugacccgcgccgg

SEQ ID NO: 25232 - RNA, 22 nt, Mycobacterium bovis subsp bovis AF2122/97
ggugccgccguggcugacagcc

SEQ ID NO: 25233 - RNA, 22 nt, Mycobacterium bovis subsp bovis AF2122/97
ggugcgauuccgcgucugcucg

SEQ ID NO: 25234 - RNA, 22 nt, Mycobacterium bovis subsp bovis AF2122/97
ggugcgcaaccguugggcgacc

SEQ ID NO: 25235 - RNA, 22 nt, Mycobacterium bovis subsp bovis AF2122/97
ggugcguccgcgcucggcuugu

SEQ ID NO: 25236 - RNA, 22 nt, Mycobacterium bovis subsp bovis AF2122/97
gguggacgaagacggguucuug

SEQ ID NO: 25237 - RNA, 22 nt, Mycobacterium bovis subsp bovis AF2122/97
gguggagggacucgagaauguc

SEQ ID NO: 25238 - RNA, 22 nt, Mycobacterium bovis subsp bovis AF2122/97
gguggcagcggguccggcgacu

SEQ ID NO: 25239 - RNA, 22 nt, Mycobacterium bovis subsp bovis AF2122/97
gguggccaggaucaccgacgga

SEQ ID NO: 25240 - RNA, 22 nt, Mycobacterium bovis subsp bovis AF2122/97
gguggcggugucgaagacgucg

SEQ ID NO: 25241 - RNA, 22 nt, Mycobacterium bovis subsp bovis AF2122/97
gguggucccagcuucuguugug

SEQ ID NO: 25242 - RNA, 22 nt, Mycobacterium bovis subsp bovis AF2122/97
gguucaccgacgccgccgaguc

SEQ ID NO: 25243 - RNA, 22 nt, Mycobacterium bovis subsp bovis AF2122/97
gguucggcaagaacgagacuca

SEQ ID NO: 25244 - RNA, 21 nt, Mycobacterium bovis subsp bovis AF2122/97
gguucucgagguagcugggcu

SEQ ID NO: 25245 - RNA, 22 nt, Mycobacterium bovis subsp bovis AF2122/97
guacagaucugguugugcccgu

SEQ ID NO: 25246 - RNA, 22 nt, Mycobacterium bovis subsp bovis AF2122/97
guacagcgagaccagcucgccc

SEQ ID NO: 25247 - RNA, 22 nt, Mycobacterium bovis subsp bovis AF2122/97
guacgcggagaucccggcgggg

SEQ ID NO: 25248 - RNA, 22 nt, Mycobacterium bovis subsp bovis AF2122/97
guacuucgucgacgucugaucg

SEQ ID NO: 25249 - RNA, 19 nt, Mycobacterium bovis subsp bovis AF2122/97
guagcaggucugcuccggc

SEQ ID NO: 25250 - RNA, 22 nt, Mycobacterium bovis subsp bovis AF2122/97
guagugcauuucacagucggau

SEQ ID NO: 25251 - RNA, 22 nt, Mycobacterium bovis subsp bovis AF2122/97
guaucgaguagccggucgucua

SEQ ID NO: 25252 - RNA, 19 nt, Mycobacterium bovis subsp bovis AF2122/97
guauucacucccugcccgc

SEQ ID NO: 25253 - RNA, 17 nt, Mycobacterium bovis subsp bovis AF2122/97
gucaccgucgccacagc

SEQ ID NO: 25254 - RNA, 22 nt, Mycobacterium bovis subsp bovis AF2122/97
gucagggcgacuuuuugauccg

SEQ ID NO: 25255 - RNA, 22 nt, Mycobacterium bovis subsp bovis AF2122/97
gucaugcggcaucggcgcgauc

SEQ ID NO: 25256 - RNA, 22 nt, Mycobacterium bovis subsp bovis AF2122/97
gucauugcgucauuuccuucga

SEQ ID NO: 25257 - RNA, 22 nt, Mycobacterium bovis subsp bovis AF2122/97
guccggcuacgaucaugcccgc

SEQ ID NO: 25258 - RNA, 22 nt, Mycobacterium bovis subsp bovis AF2122/97
guccucaagccggcguuccagc

SEQ ID NO: 25259 - RNA, 22 nt, Mycobacterium bovis subsp bovis AF2122/97
gucgacauugauuugcuggccg

SEQ ID NO: 25260 - RNA, 22 nt, Mycobacterium bovis subsp bovis AF2122/97
gucgaccaugggugcggugccc

SEQ ID NO: 25261 - RNA, 20 nt, Mycobacterium bovis subsp bovis AF2122/97
gucgacgugcaguaccguca

SEQ ID NO: 25262 - RNA, 22 nt, Mycobacterium bovis subsp bovis AF2122/97
gucgacguguccaagcugcaug

SEQ ID NO: 25263 - RNA, 22 nt, Mycobacterium bovis subsp bovis AF2122/97
gucgauggccuggucgaugaau

SEQ ID NO: 25264 - RNA, 22 nt, Mycobacterium bovis subsp bovis AF2122/97
gucgccagauucacggucgcgc

SEQ ID NO: 25265 - RNA, 23 nt, Mycobacterium bovis subsp bovis AF2122/97
gucgccgaauucacuaucggcgg

SEQ ID NO: 25266 - RNA, 22 nt, Mycobacterium bovis subsp bovis AF2122/97
gucgccggcaucaccccaugac

SEQ ID NO: 25267 - RNA, 22 nt, Mycobacterium bovis subsp bovis AF2122/97
gucgcgacgaaccguccauccg

SEQ ID NO: 25268 - RNA, 22 nt, Mycobacterium bovis subsp bovis AF2122/97
gucgcggaagcucgucggcgug

SEQ ID NO: 25269 - RNA, 22 nt, Mycobacterium bovis subsp bovis AF2122/97
gucgcggacggggcagagcuag

SEQ ID NO: 25270 - RNA, 22 nt, Mycobacterium bovis subsp bovis AF2122/97
gucgcgggauucacacucggcg

SEQ ID NO: 25271 - RNA, 22 nt, Mycobacterium bovis subsp bovis AF2122/97
gucgcgguuccaacuugagcgc

SEQ ID NO: 25272 - RNA, 22 nt, Mycobacterium bovis subsp bovis AF2122/97
gucgcuggugggaucgcagcgc

SEQ ID NO: 25273 - RNA, 22 nt, Mycobacterium bovis subsp bovis AF2122/97
gucggaucgucgacgacgacag

SEQ ID NO: 25274 - RNA, 22 nt, Mycobacterium bovis subsp bovis AF2122/97
gucggccagcguaaccggcagc

SEQ ID NO: 25275 - RNA, 22 nt, Mycobacterium bovis subsp bovis AF2122/97
gucggcuugucgacggccucgg

SEQ ID NO: 25276 - RNA, 22 nt, Mycobacterium bovis subsp bovis AF2122/97
gucggguaucgcggcacccacg

SEQ ID NO: 25277 - RNA, 22 nt, Mycobacterium bovis subsp bovis AF2122/97
gucggucaccgacggcgccguc

SEQ ID NO: 25278 - RNA, 22 nt, Mycobacterium bovis subsp bovis AF2122/97
gucggucuucaaggcgaccacg

SEQ ID NO: 25279 - RNA, 22 nt, Mycobacterium bovis subsp bovis AF2122/97
gucgguggucaccgcggcaggg

SEQ ID NO: 25280 - RNA, 19 nt, Mycobacterium bovis subsp bovis AF2122/97
gucgucagauucacggucg

SEQ ID NO: 25281 - RNA, 22 nt, Mycobacterium bovis subsp bovis AF2122/97
gucgugagauucacagucgcag

SEQ ID NO: 25282 - RNA, 22 nt, Mycobacterium bovis subsp bovis AF2122/97
gucguggacggcacgagcgcug

SEQ ID NO: 25283 - RNA, 22 nt, Mycobacterium bovis subsp bovis AF2122/97
gucguucagauaacaacguggc

SEQ ID NO: 25284 - RNA, 22 nt, Mycobacterium bovis subsp bovis AF2122/97
gucuggacuucgacgucgcccc

SEQ ID NO: 25285 - RNA, 21 nt, Mycobacterium bovis subsp bovis AF2122/97
gugaaucgucggaaccgccgu

SEQ ID NO: 25286 - RNA, 22 nt, Mycobacterium bovis subsp bovis AF2122/97
gugacggucggggaaaucugcc

SEQ ID NO: 25287 - RNA, 21 nt, Mycobacterium bovis subsp bovis AF2122/97
gugauuuugcgucugcucgcg

SEQ ID NO: 25288 - RNA, 22 nt, Mycobacterium bovis subsp bovis AF2122/97
gugccgagcgugcaucuggggc

SEQ ID NO: 25289 - RNA, 22 nt, Mycobacterium bovis subsp bovis AF2122/97
gugcggccacccugggugagcu

SEQ ID NO: 25290 - RNA, 22 nt, Mycobacterium bovis subsp bovis AF2122/97
gugcgucaccggaucaaagaca

SEQ ID NO: 25291 - RNA, 22 nt, Mycobacterium bovis subsp bovis AF2122/97
gugcuuugaccgcaucgaccac

SEQ ID NO: 25292 - RNA, 22 nt, Mycobacterium bovis subsp bovis AF2122/97
guggaugucgccuuccuggcuc

SEQ ID NO: 25293 - RNA, 22 nt, Mycobacterium bovis subsp bovis AF2122/97
guggccaccaacgccgagggcg

SEQ ID NO: 25294 - RNA, 22 nt, Mycobacterium bovis subsp bovis AF2122/97
guggcgguggcacccggccggg

SEQ ID NO: 25295 - RNA, 22 nt, Mycobacterium bovis subsp bovis AF2122/97
guggcucggcgccguggccaua

SEQ ID NO: 25296 - RNA, 22 nt, Mycobacterium bovis subsp bovis AF2122/97
gugggcagaugggugauacgca

SEQ ID NO: 25297 - RNA, 19 nt, Mycobacterium bovis subsp bovis AF2122/97
gugggcgcagagucaacgu

SEQ ID NO: 25298 - RNA, 22 nt, Mycobacterium bovis subsp bovis AF2122/97
guggugauuggccuguauccgc

SEQ ID NO: 25299 - RNA, 22 nt, Mycobacterium bovis subsp bovis AF2122/97
guggugggaaccgcuccagggc

SEQ ID NO: 25300 - RNA, 22 nt, Mycobacterium bovis subsp bovis AF2122/97
gugguggucuccagcgcgcucg

SEQ ID NO: 25301 - RNA, 22 nt, Mycobacterium bovis subsp bovis AF2122/97
gugguguucccaaugcccgggg

SEQ ID NO: 25302 - RNA, 22 nt, Mycobacterium bovis subsp bovis AF2122/97
gugguuacggcaucguguucgg

SEQ ID NO: 25303 - RNA, 22 nt, Mycobacterium bovis subsp bovis AF2122/97
gugguugucgagcaucaucgcc

SEQ ID NO: 25304 - RNA, 22 nt, Mycobacterium bovis subsp bovis AF2122/97
guguauggcguguucacccccg

SEQ ID NO: 25305 - RNA, 22 nt, Mycobacterium bovis subsp bovis AF2122/97
guguccagccacgcgccgcgcc

SEQ ID NO: 25306 - RNA, 22 nt, Mycobacterium bovis subsp bovis AF2122/97
gugugcgcgcggacagcuggau

SEQ ID NO: 25307 - RNA, 22 nt, Mycobacterium bovis subsp bovis AF2122/97
guguggcagucgcugcggcaug

SEQ ID NO: 25308 - RNA, 22 nt, Mycobacterium bovis subsp bovis AF2122/97
gugugggcgacacccgaucaca

SEQ ID NO: 25309 - RNA, 22 nt, Mycobacterium bovis subsp bovis AF2122/97
gugugugcggaacggccaucgg

SEQ ID NO: 25310 - RNA, 22 nt, Mycobacterium bovis subsp bovis AF2122/97
guuaucggcggugaccguggga

SEQ ID NO: 25311 - RNA, 22 nt, Mycobacterium bovis subsp bovis AF2122/97
guucgaaaaccacacugccguu

SEQ ID NO: 25312 - RNA, 22 nt, Mycobacterium bovis subsp bovis AF2122/97
guucggcgacacauccgucggu

SEQ ID NO: 25313 - RNA, 22 nt, Mycobacterium bovis subsp bovis AF2122/97
guugacugcgcggcccgguacc

SEQ ID NO: 25314 - RNA, 22 nt, Mycobacterium bovis subsp bovis AF2122/97
guuggcgaggccgcgcaauaca

SEQ ID NO: 25315 - RNA, 22 nt, Mycobacterium bovis subsp bovis AF2122/97
guuggcuaucgaccgcgucaaa

SEQ ID NO: 25316 - RNA, 22 nt, Mycobacterium bovis subsp bovis AF2122/97
guugguccucgaggucggcagu

SEQ ID NO: 25317 - RNA, 22 nt, Mycobacterium bovis subsp bovis AF2122/97
guuggugugaacgccgugucca

SEQ ID NO: 25318 - RNA, 22 nt, Mycobacterium bovis subsp bovis AF2122/97
guugucgacgaagugcacggcu

SEQ ID NO: 25319 - RNA, 22 nt, Mycobacterium bovis subsp bovis AF2122/97
guugugaacggaaccgccggga

SEQ ID NO: 25320 - RNA, 22 nt, Mycobacterium bovis subsp bovis AF2122/97
guugugcagguucguacuggca

SEQ ID NO: 25321 - RNA, 22 nt, Mycobacterium bovis subsp bovis AF2122/97
guuucgggcgauuuugcguccu

SEQ ID NO: 25322 - RNA, 22 nt, Mycobacterium bovis subsp bovis AF2122/97
guuuggcaagccuggaggaucu

SEQ ID NO: 25323 - RNA, 22 nt, Mycobacterium bovis subsp bovis AF2122/97
guuugguaccaaagaguaccgu

SEQ ID NO: 25324 - RNA, 22 nt, Mycobacterium bovis subsp bovis AF2122/97
guuugguugccuaccgcguggg

SEQ ID NO: 25325 - RNA, 22 nt, Mycobacterium bovis subsp bovis AF2122/97
guuuugggccucggcgagccga

SEQ ID NO: 25326 - RNA, 22 nt, Mycobacterium bovis subsp bovis AF2122/97
uaacagucugccaggaaucgcc

SEQ ID NO: 25327 - RNA, 22 nt, Mycobacterium bovis subsp bovis AF2122/97
uaaccggacgugaccagaucac

SEQ ID NO: 25328 - RNA, 22 nt, Mycobacterium bovis subsp bovis AF2122/97
uaaugcgauucugcgucugcuu

SEQ ID NO: 25329 - RNA, 22 nt, Mycobacterium bovis subsp bovis AF2122/97
uaccggcugagcauugagcacg

SEQ ID NO: 25330 - RNA, 22 nt, Mycobacterium bovis subsp bovis AF2122/97
uacgcgccaacgaucgaacagc

SEQ ID NO: 25331 - RNA, 22 nt, Mycobacterium bovis subsp bovis AF2122/97
uacggcaucgauccgugggaga

SEQ ID NO: 25332 - RNA, 22 nt, Mycobacterium bovis subsp bovis AF2122/97
uacggcauggucuuucugcugc

SEQ ID NO: 25333 - RNA, 22 nt, Mycobacterium bovis subsp bovis AF2122/97
uacggcgacccgagguucggcu

SEQ ID NO: 25334 - RNA, 22 nt, Mycobacterium bovis subsp bovis AF2122/97
uacgggaucaccgcccaaugga

SEQ ID NO: 25335 - RNA, 22 nt, Mycobacterium bovis subsp bovis AF2122/97
uacgucaucuaucaacgccuga

SEQ ID NO: 25336 - RNA, 22 nt, Mycobacterium bovis subsp bovis AF2122/97
uacguugcaacccgagcgcuuc

SEQ ID NO: 25337 - RNA, 22 nt, Mycobacterium bovis subsp bovis AF2122/97
uacugcugcagcgucugccgca

SEQ ID NO: 25338 - RNA, 22 nt, Mycobacterium bovis subsp bovis AF2122/97
uacuucgguuugugcugacuag

SEQ ID NO: 25339 - RNA, 22 nt, Mycobacterium bovis subsp bovis AF2122/97
uacuucgugcagcagcugcgcc

SEQ ID NO: 25340 - RNA, 22 nt, Mycobacterium bovis subsp bovis AF2122/97
uagcccaccggugcuguaggcg

SEQ ID NO: 25341 - RNA, 22 nt, Mycobacterium bovis subsp bovis AF2122/97
uagccgacaucgccggcgccuu

SEQ ID NO: 25342 - RNA, 22 nt, Mycobacterium bovis subsp bovis AF2122/97
uagcgcgcauugagacuuucaa

SEQ ID NO: 25343 - RNA, 22 nt, Mycobacterium bovis subsp bovis AF2122/97
uagcguggcggcgccggacaac

SEQ ID NO: 25344 - RNA, 22 nt, Mycobacterium bovis subsp bovis AF2122/97
uagcuugucgaccgugcggucg

SEQ ID NO: 25345 - RNA, 22 nt, Mycobacterium bovis subsp bovis AF2122/97
uaggaacuggcuugugcccaau

SEQ ID NO: 25346 - RNA, 22 nt, Mycobacterium bovis subsp bovis AF2122/97
uagguaaauaaauccguguuug

SEQ ID NO: 25347 - RNA, 22 nt, Mycobacterium bovis subsp bovis AF2122/97
uaugcguuccugugcgccacgg

SEQ ID NO: 25348 - RNA, 22 nt, Mycobacterium bovis subsp bovis AF2122/97
uauggcggcgaucaguccgcgc

SEQ ID NO: 25349 - RNA, 22 nt, Mycobacterium bovis subsp bovis AF2122/97
uauguucaauaaaucauuaugu

SEQ ID NO: 25350 - RNA, 22 nt, Mycobacterium bovis subsp bovis AF2122/97
ucaaccgguauugguggcggcu

SEQ ID NO: 25351 - RNA, 22 nt, Mycobacterium bovis subsp bovis AF2122/97
ucaacgacgucgucuuggcgcu

SEQ ID NO: 25352 - RNA, 22 nt, Mycobacterium bovis subsp bovis AF2122/97
ucaaugucgaggauuucaucca

SEQ ID NO: 25353 - RNA, 20 nt, Mycobacterium bovis subsp bovis AF2122/97
ucacccaggacggccgaucc

SEQ ID NO: 25354 - RNA, 22 nt, Mycobacterium bovis subsp bovis AF2122/97
ucaccgggaugcacgucgaguu

SEQ ID NO: 25355 - RNA, 22 nt, Mycobacterium bovis subsp bovis AF2122/97
ucaccugcccggucacaaucuc

SEQ ID NO: 25356 - RNA, 22 nt, Mycobacterium bovis subsp bovis AF2122/97
ucagcaccgaccaugccgaacg

SEQ ID NO: 25357 - RNA, 22 nt, Mycobacterium bovis subsp bovis AF2122/97
ucagcgaucccaaugccugggu

SEQ ID NO: 25358 - RNA, 18 nt, Mycobacterium bovis subsp bovis AF2122/97
ucagcgaucggggugcgg

SEQ ID NO: 25359 - RNA, 22 nt, Mycobacterium bovis subsp bovis AF2122/97
ucagcgucgaugaccaugucga

SEQ ID NO: 25360 - RNA, 22 nt, Mycobacterium bovis subsp bovis AF2122/97
ucagcuaccaaggcaacgacau

SEQ ID NO: 25361 - RNA, 22 nt, Mycobacterium bovis subsp bovis AF2122/97
ucgcuggagcagaacccgcuaa

SEQ ID NO: 25362 - RNA, 22 nt, Mycobacterium bovis subsp bovis AF2122/97
ucgcuguagaagcuggacugcc

SEQ ID NO: 25363 - RNA, 22 nt, Mycobacterium bovis subsp bovis AF2122/97
ugccaguaccucucgaugccaa

SEQ ID NO: 25364 - RNA, 22 nt, Mycobacterium bovis subsp bovis AF2122/97
ugccaugaccucguuugcgcac

SEQ ID NO: 25365 - RNA, 22 nt, Mycobacterium bovis subsp bovis AF2122/97
aaacggcugugcgaucccaugg

SEQ ID NO: 25366 - RNA, 22 nt, Mycobacterium bovis subsp bovis AF2122/97
aaaggccuuacccuggcugggu

SEQ ID NO: 25367 - RNA, 22 nt, Mycobacterium bovis subsp bovis AF2122/97
aacagucgaccgacgcguucgu

SEQ ID NO: 25368 - RNA, 22 nt, Mycobacterium bovis subsp bovis AF2122/97
aaccagcgaaugucguugccuc

SEQ ID NO: 25369 - RNA, 22 nt, Mycobacterium bovis subsp bovis AF2122/97
aacccggugcuggccgugcccg

SEQ ID NO: 25370 - RNA, 22 nt, Mycobacterium bovis subsp bovis AF2122/97
aaccgagcguugggccugccgu

SEQ ID NO: 25371 - RNA, 22 nt, Mycobacterium bovis subsp bovis AF2122/97
aaccgcuacaaaugaaguuggu

SEQ ID NO: 25372 - RNA, 22 nt, Mycobacterium bovis subsp bovis AF2122/97
aaccggcuggagcauccgauac

SEQ ID NO: 25373 - RNA, 22 nt, Mycobacterium bovis subsp bovis AF2122/97
aacgauguugggccggaaaugc

SEQ ID NO: 25374 - RNA, 22 nt, Mycobacterium bovis subsp bovis AF2122/97
aacgcgcgccccgcuuugucaa

SEQ ID NO: 25375 - RNA, 22 nt, Mycobacterium bovis subsp bovis AF2122/97
aacgggcgcugcgugagcacgu

SEQ ID NO: 25376 - RNA, 22 nt, Mycobacterium bovis subsp bovis AF2122/97
aacggucugcgguugccagucg

SEQ ID NO: 25377 - RNA, 22 nt, Mycobacterium bovis subsp bovis AF2122/97
aacgucgccaggauggucgcga

SEQ ID NO: 25378 - RNA, 22 nt, Mycobacterium bovis subsp bovis AF2122/97
aacucagggagcagugccgugc

SEQ ID NO: 25379 - RNA, 22 nt, Mycobacterium bovis subsp bovis AF2122/97
aacuccagcaugcucucgguca

SEQ ID NO: 25380 - RNA, 22 nt, Mycobacterium bovis subsp bovis AF2122/97
aacucgucgaaccgcagcgcgu

SEQ ID NO: 25381 - RNA, 23 nt, Mycobacterium bovis subsp bovis AF2122/97
aacugcaccggcucaggcagauc

SEQ ID NO: 25382 - RNA, 19 nt, Mycobacterium bovis subsp bovis AF2122/97
aagaggucaccgagaucaa

SEQ ID NO: 25383 - RNA, 22 nt, Mycobacterium bovis subsp bovis AF2122/97
aagaucagcucgcuucccgauc

SEQ ID NO: 25384 - RNA, 22 nt, Mycobacterium bovis subsp bovis AF2122/97
aagaucguugauccccagugcu

SEQ ID NO: 25385 - RNA, 22 nt, Mycobacterium bovis subsp bovis AF2122/97
aagcagacgcagaaucgcauua

SEQ ID NO: 25386 - RNA, 22 nt, Mycobacterium bovis subsp bovis AF2122/97
aagcggagcgcucgccccgcuu

SEQ ID NO: 25387 - RNA, 19 nt, Mycobacterium bovis subsp bovis AF2122/97
aagcugacggccuuggugu

SEQ ID NO: 25388 - RNA, 22 nt, Mycobacterium bovis subsp bovis AF2122/97
aagcugauucugauggcgauug

SEQ ID NO: 25389 - RNA, 22 nt, Mycobacterium bovis subsp bovis AF2122/97
aaggacccggcggcguuugugu

SEQ ID NO: 25390 - RNA, 22 nt, Mycobacterium bovis subsp bovis AF2122/97
cagggccuccgacucgucuuca

SEQ ID NO: 25391 - RNA, 22 nt, Mycobacterium bovis subsp bovis AF2122/97
caggggcucgauccggccgggc

SEQ ID NO: 25392 - RNA, 22 nt, Mycobacterium bovis subsp bovis AF2122/97
cagucgccggcuucgauguacg

SEQ ID NO: 25393 - RNA, 21 nt, Mycobacterium bovis subsp bovis AF2122/97
cagucgucuggcagcggccug

SEQ ID NO: 25394 - RNA, 22 nt, Mycobacterium bovis subsp bovis AF2122/97
cagugcgauucugugucugcuc

SEQ ID NO: 25395 - RNA, 22 nt, Mycobacterium bovis subsp bovis AF2122/97
cauccgcacggugcugauccca

SEQ ID NO: 25396 - RNA, 21 nt, Mycobacterium bovis subsp bovis AF2122/97
cauccguucggaggaccggca

SEQ ID NO: 25397 - RNA, 23 nt, Mycobacterium bovis subsp bovis AF2122/97
cauccugcuggugcggaccggca

SEQ ID NO: 25398 - RNA, 22 nt, Mycobacterium bovis subsp bovis AF2122/97
cauccuggccuauuccggcggu

SEQ ID NO: 25399 - RNA, 22 nt, Mycobacterium bovis subsp bovis AF2122/97
caucgaggagaugcaggcgugg

SEQ ID NO: 25400 - RNA, 22 nt, Mycobacterium bovis subsp bovis AF2122/97
caucggccaacgcaucgcgcgg

SEQ ID NO: 25401 - RNA, 22 nt, Mycobacterium bovis subsp bovis AF2122/97
caucgggaaauuccauggcgug

SEQ ID NO: 25402 - RNA, 20 nt, Mycobacterium bovis subsp bovis AF2122/97
caucgguucucgggccagca

SEQ ID NO: 25403 - RNA, 22 nt, Mycobacterium bovis subsp bovis AF2122/97
cauggcucgcccagcugcgccg

SEQ ID NO: 25404 - RNA, 22 nt, Mycobacterium bovis subsp bovis AF2122/97
caugggugcgguaagcgcgucu

SEQ ID NO: 25405 - RNA, 22 nt, Mycobacterium bovis subsp bovis AF2122/97
cauggugggcgcgggccagcac

SEQ ID NO: 25406 - RNA, 22 nt, Mycobacterium bovis subsp bovis AF2122/97
caugucgcugcuguacaucggc

SEQ ID NO: 25407 - RNA, 22 nt, Mycobacterium bovis subsp bovis AF2122/97
ccaccaucagcagaucgacauc

SEQ ID NO: 25408 - RNA, 22 nt, Mycobacterium bovis subsp bovis AF2122/97
ccaccgauugugucgaugcgca

SEQ ID NO: 25409 - RNA, 22 nt, Mycobacterium bovis subsp bovis AF2122/97
ccaccgcgacagucggcgcgcc

SEQ ID NO: 25410 - RNA, 22 nt, Mycobacterium bovis subsp bovis AF2122/97
ccaccgggcugcaugucgcggc

SEQ ID NO: 25411 - RNA, 20 nt, Mycobacterium bovis subsp bovis AF2122/97
ccaccggugcuggagggauc

SEQ ID NO: 25412 - RNA, 22 nt, Mycobacterium bovis subsp bovis AF2122/97
ccagcagcgcguacagcaucga

SEQ ID NO: 25413 - RNA, 22 nt, Mycobacterium bovis subsp bovis AF2122/97
ccagcagcuugcugaucgccuc

SEQ ID NO: 25414 - RNA, 22 nt, Mycobacterium bovis subsp bovis AF2122/97
ccagcgauuggcggcgacuggc

SEQ ID NO: 25415 - RNA, 22 nt, Mycobacterium bovis subsp bovis AF2122/97
ccagcgugacgccacugcgaga

SEQ ID NO: 25416 - RNA, 22 nt, Mycobacterium bovis subsp bovis AF2122/97
ccaggacaggaugcugucggcc

SEQ ID NO: 25417 - RNA, 22 nt, Mycobacterium bovis subsp bovis AF2122/97
ccaggacgacaccggcaccuau

SEQ ID NO: 25418 - RNA, 22 nt, Mycobacterium bovis subsp bovis AF2122/97
ccaguucgguauguuuggcggc

SEQ ID NO: 25419 - RNA, 22 nt, Mycobacterium bovis subsp bovis AF2122/97
ccaucgccagcgucgacgugcc

SEQ ID NO: 25420 - RNA, 22 nt, Mycobacterium bovis subsp bovis AF2122/97
cccagcaccgaccagugccggc

SEQ ID NO: 25421 - RNA, 22 nt, Mycobacterium bovis subsp bovis AF2122/97
cccagccaggguaaggccuuug

SEQ ID NO: 25422 - RNA, 22 nt, Mycobacterium bovis subsp bovis AF2122/97
cccagucgugcucgcucucggc

SEQ ID NO: 25423 - RNA, 22 nt, Mycobacterium bovis subsp bovis AF2122/97
ccccaucgaggucggcgaggac

SEQ ID NO: 25424 - RNA, 22 nt, Mycobacterium bovis subsp bovis AF2122/97
ccccgagugugaacugcgcaac

SEQ ID NO: 25425 - RNA, 22 nt, Mycobacterium bovis subsp bovis AF2122/97
cccgacagcaccaccgauaccg

SEQ ID NO: 25426 - RNA, 22 nt, Mycobacterium bovis subsp bovis AF2122/97
cccgacgccgaagucagcaccg

SEQ ID NO: 25427 - RNA, 22 nt, Mycobacterium bovis subsp bovis AF2122/97
cccgagugugaaucgcacgacg

SEQ ID NO: 25428 - RNA, 22 nt, Mycobacterium bovis subsp bovis AF2122/97
cccgccugggugccgcuaccgg

SEQ ID NO: 25429 - RNA, 22 nt, Mycobacterium bovis subsp bovis AF2122/97
cccgcggcgugcugguggucaa

SEQ ID NO: 25430 - RNA, 22 nt, Mycobacterium bovis subsp bovis AF2122/97
cccggccacgaccguggcggca

SEQ ID NO: 25431 - RNA, 22 nt, Mycobacterium bovis subsp bovis AF2122/97
cccgggucgugccgacccgggu

SEQ ID NO: 25432 - RNA, 21 nt, Mycobacterium bovis subsp bovis AF2122/97
cccuggugcuggccaccggcu

SEQ ID NO: 25433 - RNA, 22 nt, Mycobacterium bovis subsp bovis AF2122/97
cccuggugguccgaucguucau

SEQ ID NO: 25434 - RNA, 22 nt, Mycobacterium bovis subsp bovis AF2122/97
cccugguugcacguucggcgug

SEQ ID NO: 25435 - RNA, 22 nt, Mycobacterium bovis subsp bovis AF2122/97
ccgaacgcaucggugugacguu

SEQ ID NO: 25436 - RNA, 22 nt, Mycobacterium bovis subsp bovis AF2122/97
ccgaacgugcaacagcugcgaa

SEQ ID NO: 25437 - RNA, 22 nt, Mycobacterium bovis subsp bovis AF2122/97
ccgaccguguuaaccgcgcggg

SEQ ID NO: 25438 - RNA, 22 nt, Mycobacterium bovis subsp bovis AF2122/97
ccgaccguucgaagauguggaa

SEQ ID NO: 25439 - RNA, 22 nt, Mycobacterium bovis subsp bovis AF2122/97
cgagcagacgcaaaacccccuu

SEQ ID NO: 25440 - RNA, 22 nt, Mycobacterium bovis subsp bovis AF2122/97
cgagcagacgcaaaagccaccg

SEQ ID NO: 25441 - RNA, 22 nt, Mycobacterium bovis subsp bovis AF2122/97
cgagcagacgcaaaaucacccg

SEQ ID NO: 25442 - RNA, 22 nt, Mycobacterium bovis subsp bovis AF2122/97
cgagcagacgcaaaaucgcccu

SEQ ID NO: 25443 - RNA, 22 nt, Mycobacterium bovis subsp bovis AF2122/97
cgagcagacgcagaaucgccca

SEQ ID NO: 25444 - RNA, 22 nt, Mycobacterium bovis subsp bovis AF2122/97
cgagcagacgcagagucgcacu

SEQ ID NO: 25445 - RNA, 22 nt, Mycobacterium bovis subsp bovis AF2122/97
cgagcagacgcauaagcccccg

SEQ ID NO: 25446 - RNA, 22 nt, Mycobacterium bovis subsp bovis AF2122/97
cgagcagacgcauaagcgccca

SEQ ID NO: 25447 - RNA, 22 nt, Mycobacterium bovis subsp bovis AF2122/97
cgagcagacgcgaaaucccccg

SEQ ID NO: 25448 - RNA, 22 nt, Mycobacterium bovis subsp bovis AF2122/97
cgagcagacguaaagcccccaa

SEQ ID NO: 25449 - RNA, 22 nt, Mycobacterium bovis subsp bovis AF2122/97
cgagcagucgcauaagcccccg

SEQ ID NO: 25450 - RNA, 22 nt, Mycobacterium bovis subsp bovis AF2122/97
cgagcagucgcuaaagcccccg

SEQ ID NO: 25451 - RNA, 22 nt, Mycobacterium bovis subsp bovis AF2122/97
cgagcaucugaacgccugggug

SEQ ID NO: 25452 - RNA, 22 nt, Mycobacterium bovis subsp bovis AF2122/97
cgagcguaacgccacugcgauu

SEQ ID NO: 25453 - RNA, 22 nt, Mycobacterium bovis subsp bovis AF2122/97
cgagcguaacgccacugcgcua

SEQ ID NO: 25454 - RNA, 22 nt, Mycobacterium bovis subsp bovis AF2122/97
cgagcguaacgucacugcgaga

SEQ ID NO: 25455 - RNA, 22 nt, Mycobacterium bovis subsp bovis AF2122/97
cgagcgugaacugagggcgaga

SEQ ID NO: 25456 - RNA, 22 nt, Mycobacterium bovis subsp bovis AF2122/97
cgagcgugcacugggggcgaga

SEQ ID NO: 25457 - RNA, 22 nt, Mycobacterium bovis subsp bovis AF2122/97
cgagcucggcgaugcugagccg

SEQ ID NO: 25458 - RNA, 22 nt, Mycobacterium bovis subsp bovis AF2122/97
cgaggaguagcgcaucccacga

SEQ ID NO: 25459 - RNA, 22 nt, Mycobacterium bovis subsp bovis AF2122/97
cgaggauuucgucgcgcggcug

SEQ ID NO: 25460 - RNA, 22 nt, Mycobacterium bovis subsp bovis AF2122/97
cgaguaacccguccgguggacg

SEQ ID NO: 25461 - RNA, 22 nt, Mycobacterium bovis subsp bovis AF2122/97
accucgacgagcaccauccggu

SEQ ID NO: 25462 - RNA, 22 nt, Mycobacterium bovis subsp bovis AF2122/97
accucggugaacccgguggcgg

SEQ ID NO: 25463 - RNA, 22 nt, Mycobacterium bovis subsp bovis AF2122/97
accugggucgccaccgacgacg

SEQ ID NO: 25464 - RNA, 22 nt, Mycobacterium bovis subsp bovis AF2122/97
acgacuggcuuucggcaaggug

SEQ ID NO: 25465 - RNA, 21 nt, Mycobacterium bovis subsp bovis AF2122/97
acgagcccaucgcgaacucgu

SEQ ID NO: 25466 - RNA, 20 nt, Mycobacterium bovis subsp bovis AF2122/97
acgagccgcguugccggcgg

SEQ ID NO: 25467 - RNA, 22 nt, Mycobacterium bovis subsp bovis AF2122/97
acgagguugacuucgacguccc

SEQ ID NO: 25468 - RNA, 22 nt, Mycobacterium bovis subsp bovis AF2122/97
acgauguuccgccacgccgagc

SEQ ID NO: 25469 - RNA, 22 nt, Mycobacterium bovis subsp bovis AF2122/97
acgcagcagcacguccauuagc

SEQ ID NO: 25470 - RNA, 22 nt, Mycobacterium bovis subsp bovis AF2122/97
acgccagaacucaauaccgucu

SEQ ID NO: 25471 - RNA, 22 nt, Mycobacterium bovis subsp bovis AF2122/97
acgcccgucguccucuugcacg

SEQ ID NO: 25472 - RNA, 22 nt, Mycobacterium bovis subsp bovis AF2122/97
acgccggcaccccguugcugau

SEQ ID NO: 25473 - RNA, 20 nt, Mycobacterium bovis subsp bovis AF2122/97
acgccggcggcaucggaucc

SEQ ID NO: 25474 - RNA, 22 nt, Mycobacterium bovis subsp bovis AF2122/97
acgcgacgaauccacugcgcuu

SEQ ID NO: 25475 - RNA, 22 nt, Mycobacterium bovis subsp bovis AF2122/97
acgcgcacggggagcuggccga

SEQ ID NO: 25476 - RNA, 22 nt, Mycobacterium bovis subsp bovis AF2122/97
acgcgggugguacccccacugc

SEQ ID NO: 25477 - RNA, 21 nt, Mycobacterium bovis subsp bovis AF2122/97
acgcggugaucaucuuggacg

SEQ ID NO: 25478 - RNA, 22 nt, Mycobacterium bovis subsp bovis AF2122/97
acggacgacgagugcaucggug

SEQ ID NO: 25479 - RNA, 22 nt, Mycobacterium bovis subsp bovis AF2122/97
acggccaugaugcaguucuacg

SEQ ID NO: 25480 - RNA, 22 nt, Mycobacterium bovis subsp bovis AF2122/97
acggccggaguccagccagucg

SEQ ID NO: 25481 - RNA, 22 nt, Mycobacterium bovis subsp bovis AF2122/97
acggccuagagaccgcaacuac

SEQ ID NO: 25482 - RNA, 22 nt, Mycobacterium bovis subsp bovis AF2122/97
acggcgcccgcgcauggccaau

SEQ ID NO: 25483 - RNA, 22 nt, Mycobacterium bovis subsp bovis AF2122/97
acggguugcgggugggaccgua

SEQ ID NO: 25484 - RNA, 22 nt, Mycobacterium bovis subsp bovis AF2122/97
acgguacucuuugguaccaaac

SEQ ID NO: 25485 - RNA, 22 nt, Mycobacterium bovis subsp bovis AF2122/97
acgguccguugucguuccuguc

SEQ ID NO: 25486 - RNA, 22 nt, Mycobacterium bovis subsp bovis AF2122/97
acggucgucgucagccaaggca

SEQ ID NO: 25487 - RNA, 22 nt, Mycobacterium bovis subsp bovis AF2122/97
acggucucggugcgugggguuu

SEQ ID NO: 25488 - RNA, 22 nt, Mycobacterium bovis subsp bovis AF2122/97
acggugagggcgucgucgaguu

SEQ ID NO: 25489 - RNA, 22 nt, Mycobacterium bovis subsp bovis AF2122/97
acggugucauagagcgagaacc

SEQ ID NO: 25490 - RNA, 22 nt, Mycobacterium bovis subsp bovis AF2122/97
acgguguucgguguggccgucg

SEQ ID NO: 25491 - RNA, 22 nt, Mycobacterium bovis subsp bovis AF2122/97
acguaggucaggugcggcaccu

SEQ ID NO: 25492 - RNA, 22 nt, Mycobacterium bovis subsp bovis AF2122/97
acgucagaaucucgcugcgcgg

SEQ ID NO: 25493 - RNA, 23 nt, Mycobacterium bovis subsp bovis AF2122/97
acgucaugaaugugguguugcgg

SEQ ID NO: 25494 - RNA, 22 nt, Mycobacterium bovis subsp bovis AF2122/97
acgucgacauccgugcaccagg

SEQ ID NO: 25495 - RNA, 22 nt, Mycobacterium bovis subsp bovis AF2122/97
acgucgaguugaccgucgccuu

SEQ ID NO: 25496 - RNA, 22 nt, Mycobacterium bovis subsp bovis AF2122/97
acgucgggcacgucgguuccga

SEQ ID NO: 25497 - RNA, 22 nt, Mycobacterium bovis subsp bovis AF2122/97
acgucggguucuucaacaccgg

SEQ ID NO: 25498 - RNA, 22 nt, Mycobacterium bovis subsp bovis AF2122/97
acgugggcgccucggcggguuc

SEQ ID NO: 25499 - RNA, 22 nt, Mycobacterium bovis subsp bovis AF2122/97
acguugaccgcgguggcgugcu

SEQ ID NO: 25500 - RNA, 22 nt, Mycobacterium bovis subsp bovis AF2122/97
acguugcuggacauggugcggg

SEQ ID NO: 25501 - RNA, 21 nt, Mycobacterium bovis subsp bovis AF2122/97
acucgcagacgacgccgaggg

SEQ ID NO: 25502 - RNA, 22 nt, Mycobacterium bovis subsp bovis AF2122/97
acugccgacgucgauggugguu

SEQ ID NO: 25503 - RNA, 22 nt, Mycobacterium bovis subsp bovis AF2122/97
acugcuuuccugucugggcggc

SEQ ID NO: 25504 - RNA, 22 nt, Mycobacterium bovis subsp bovis AF2122/97
acuggccagcccgcacaaccac

SEQ ID NO: 25505 - RNA, 22 nt, Mycobacterium bovis subsp bovis AF2122/97
acuggucuguaaucggugcccg

SEQ ID NO: 25506 - RNA, 22 nt, Mycobacterium bovis subsp bovis AF2122/97
acugucccgagcgcaccaggaa

SEQ ID NO: 25507 - RNA, 22 nt, Mycobacterium bovis subsp bovis AF2122/97
acuguuggccgcggagguauuc

SEQ ID NO: 25508 - RNA, 22 nt, Mycobacterium bovis subsp bovis AF2122/97
acuucagcaccaccgacgcgaa

SEQ ID NO: 25509 - RNA, 21 nt, Mycobacterium bovis subsp bovis AF2122/97
acuucgaucacgcggcgcggu

SEQ ID NO: 25510 - RNA, 21 nt, Mycobacterium bovis subsp bovis AF2122/97
acuugccggcgccguuagccc

SEQ ID NO: 25511 - RNA, 22 nt, Mycobacterium bovis subsp bovis AF2122/97
acuuggggugcuuuugcgucug

SEQ ID NO: 25512 - RNA, 22 nt, Mycobacterium bovis subsp bovis AF2122/97
agaaacacaaggagccgacaac

SEQ ID NO: 25513 - RNA, 22 nt, Mycobacterium bovis subsp bovis AF2122/97
agaacccgucuucguccaccgc

SEQ ID NO: 25514 - RNA, 23 nt, Mycobacterium bovis subsp bovis AF2122/97
agaccgcucgacgcgggcgaucg

SEQ ID NO: 25515 - RNA, 22 nt, Mycobacterium bovis subsp bovis AF2122/97
agaccgucgcggccaggcagca

SEQ ID NO: 25516 - RNA, 22 nt, Mycobacterium bovis subsp bovis AF2122/97
agacgagugaggccgcgcagau

SEQ ID NO: 25517 - RNA, 22 nt, Mycobacterium bovis subsp bovis AF2122/97
agacgcaaaaucgcccgaaagc

SEQ ID NO: 25518 - RNA, 22 nt, Mycobacterium bovis subsp bovis AF2122/97
agaucaggaucucgguguugug

SEQ ID NO: 25519 - RNA, 22 nt, Mycobacterium bovis subsp bovis AF2122/97
agcaccgcggccagguucagcg

SEQ ID NO: 25520 - RNA, 22 nt, Mycobacterium bovis subsp bovis AF2122/97
agcaccuacaugugguggaggu

SEQ ID NO: 25521 - RNA, 22 nt, Mycobacterium bovis subsp bovis AF2122/97
agcagacacagaaucgcacugc

SEQ ID NO: 25522 - RNA, 22 nt, Mycobacterium bovis subsp bovis AF2122/97
agcagacgcaaaagcccccauu

SEQ ID NO: 25523 - RNA, 22 nt, Mycobacterium bovis subsp bovis AF2122/97
agcagacgcaaaaucgcccaau

SEQ ID NO: 25524 - RNA, 22 nt, Mycobacterium bovis subsp bovis AF2122/97
agcagacgcaaaaucgcccauu

SEQ ID NO: 25525 - RNA, 22 nt, Mycobacterium bovis subsp bovis AF2122/97
agcagacgcagaaucgcacugc

SEQ ID NO: 25526 - RNA, 22 nt, Mycobacterium bovis subsp bovis AF2122/97
agcagacgcagaaucgcaucaa

SEQ ID NO: 25527 - RNA, 22 nt, Mycobacterium bovis subsp bovis AF2122/97
agcagacgcauaagcccccgca

SEQ ID NO: 25528 - RNA, 19 nt, Mycobacterium bovis subsp bovis AF2122/97
agcaggaggcggguuuggg

SEQ ID NO: 25529 - RNA, 20 nt, Mycobacterium bovis subsp bovis AF2122/97
agcagugagccgaucgcguc

SEQ ID NO: 25530 - RNA, 22 nt, Mycobacterium bovis subsp bovis AF2122/97
agcaugcgaccauugcaccgug

SEQ ID NO: 25531 - RNA, 20 nt, Mycobacterium bovis subsp bovis AF2122/97
agcauucgaugaugucggug

SEQ ID NO: 25532 - RNA, 22 nt, Mycobacterium bovis subsp bovis AF2122/97
agccccagucgcuuugucucga

SEQ ID NO: 25533 - RNA, 22 nt, Mycobacterium bovis subsp bovis AF2122/97
agccggucggcgauggcccaca

SEQ ID NO: 25534 - RNA, 22 nt, Mycobacterium bovis subsp bovis AF2122/97
aucgcuucauccaugagcugcu

SEQ ID NO: 25535 - RNA, 22 nt, Mycobacterium bovis subsp bovis AF2122/97
aucggaucacauugcgcccgga

SEQ ID NO: 25536 - RNA, 22 nt, Mycobacterium bovis subsp bovis AF2122/97
aucggcacggcgagacggccga

SEQ ID NO: 25537 - RNA, 22 nt, Mycobacterium bovis subsp bovis AF2122/97
aucggcaucgggaucgugcugg

SEQ ID NO: 25538 - RNA, 22 nt, Mycobacterium bovis subsp bovis AF2122/97
aucgggcagcugccuggcgugg

SEQ ID NO: 25539 - RNA, 22 nt, Mycobacterium bovis subsp bovis AF2122/97
aucgggucggcaauggccgccg

SEQ ID NO: 25540 - RNA, 22 nt, Mycobacterium bovis subsp bovis AF2122/97
aucggugcgcaagcgauacucg

SEQ ID NO: 25541 - RNA, 22 nt, Mycobacterium bovis subsp bovis AF2122/97
aucgguguucgccgcgaccguu

SEQ ID NO: 25542 - RNA, 22 nt, Mycobacterium bovis subsp bovis AF2122/97
aucugcugggcuuugucgaugg

SEQ ID NO: 25543 - RNA, 22 nt, Mycobacterium bovis subsp bovis AF2122/97
augaggcgauuuugcgucugcu

SEQ ID NO: 25544 - RNA, 22 nt, Mycobacterium bovis subsp bovis AF2122/97
augaucaagccgccgcggcccu

SEQ ID NO: 25545 - RNA, 22 nt, Mycobacterium bovis subsp bovis AF2122/97
augaucgcccagauuuucgccg

SEQ ID NO: 25546 - RNA, 22 nt, Mycobacterium bovis subsp bovis AF2122/97
augauguugaccaucacccgca

SEQ ID NO: 25547 - RNA, 22 nt, Mycobacterium bovis subsp bovis AF2122/97
augccgguucuuccgaugcaug

SEQ ID NO: 25548 - RNA, 22 nt, Mycobacterium bovis subsp bovis AF2122/97
augcgggugaugccgaacucgg

SEQ ID NO: 25549 - RNA, 22 nt, Mycobacterium bovis subsp bovis AF2122/97
augcggugaccuucggcuucga

SEQ ID NO: 25550 - RNA, 22 nt, Mycobacterium bovis subsp bovis AF2122/97
augcggugcgcgacggugaucg

SEQ ID NO: 25551 - RNA, 22 nt, Mycobacterium bovis subsp bovis AF2122/97
augcggugcggaucagaggacc

SEQ ID NO: 25552 - RNA, 22 nt, Mycobacterium bovis subsp bovis AF2122/97
augcucaagcuagcuuccagac

SEQ ID NO: 25553 - RNA, 22 nt, Mycobacterium bovis subsp bovis AF2122/97
augcugcaguuucugcgcacgg

SEQ ID NO: 25554 - RNA, 22 nt, Mycobacterium bovis subsp bovis AF2122/97
augcugcucggacccagcggcu

SEQ ID NO: 25555 - RNA, 22 nt, Mycobacterium bovis subsp bovis AF2122/97
augcugcuggccgacaugcucg

SEQ ID NO: 25556 - RNA, 22 nt, Mycobacterium bovis subsp bovis AF2122/97
auggccgccgacgccaggucgu

SEQ ID NO: 25557 - RNA, 22 nt, Mycobacterium bovis subsp bovis AF2122/97
augggcgauucugcgucugcuc

SEQ ID NO: 25558 - RNA, 22 nt, Mycobacterium bovis subsp bovis AF2122/97
augggcgauuuugcgucugcuc

SEQ ID NO: 25559 - RNA, 22 nt, Mycobacterium bovis subsp bovis AF2122/97
augggucgauucggcggugccc

SEQ ID NO: 25560 - RNA, 22 nt, Mycobacterium bovis subsp bovis AF2122/97
auggguuagguuuggcggccgc

SEQ ID NO: 25561 - RNA, 22 nt, Mycobacterium bovis subsp bovis AF2122/97
auggugcgcuggcgcaucgcgu

SEQ ID NO: 25562 - RNA, 22 nt, Mycobacterium bovis subsp bovis AF2122/97
augguguucgagcaugaacgug

SEQ ID NO: 25563 - RNA, 22 nt, Mycobacterium bovis subsp bovis AF2122/97
augguugcgccagguuugacgg

SEQ ID NO: 25564 - RNA, 22 nt, Mycobacterium bovis subsp bovis AF2122/97
augguuucgaacugacccgcga

SEQ ID NO: 25565 - RNA, 21 nt, Mycobacterium bovis subsp bovis AF2122/97
augucacgcgguccugaucgc

SEQ ID NO: 25566 - RNA, 22 nt, Mycobacterium bovis subsp bovis AF2122/97
augucgagucgaacucggcgcu

SEQ ID NO: 25567 - RNA, 22 nt, Mycobacterium bovis subsp bovis AF2122/97
augucguuaugagaacaucgcc

SEQ ID NO: 25568 - RNA, 22 nt, Mycobacterium bovis subsp bovis AF2122/97
augugccgcucaucgcccggug

SEQ ID NO: 25569 - RNA, 22 nt, Mycobacterium bovis subsp bovis AF2122/97
auguugcuguacucgccgaugu

SEQ ID NO: 25570 - RNA, 22 nt, Mycobacterium bovis subsp bovis AF2122/97
auguuggccgagccgagauuga

SEQ ID NO: 25571 - RNA, 22 nt, Mycobacterium bovis subsp bovis AF2122/97
auucggguuuccagaaccucgg

SEQ ID NO: 25572 - RNA, 22 nt, Mycobacterium bovis subsp bovis AF2122/97
auucgucgagcaauugcuggua

SEQ ID NO: 25573 - RNA, 22 nt, Mycobacterium bovis subsp bovis AF2122/97
auucucuucauggugguguuga

SEQ ID NO: 25574 - RNA, 19 nt, Mycobacterium bovis subsp bovis AF2122/97
auucugcgucugcucggcg

SEQ ID NO: 25575 - RNA, 22 nt, Mycobacterium bovis subsp bovis AF2122/97
auugcguggacugaugcgggug

SEQ ID NO: 25576 - RNA, 22 nt, Mycobacterium bovis subsp bovis AF2122/97
auugcucagcaucgggcuggcu

SEQ ID NO: 25577 - RNA, 22 nt, Mycobacterium bovis subsp bovis AF2122/97
auuggccaugcgcgggcgccgu

SEQ ID NO: 25578 - RNA, 22 nt, Mycobacterium bovis subsp bovis AF2122/97
auugggggaucuugugcgcccg

SEQ ID NO: 25579 - RNA, 22 nt, Mycobacterium bovis subsp bovis AF2122/97
auugggggcuuuugcgucugcu

SEQ ID NO: 25580 - RNA, 22 nt, Mycobacterium bovis subsp bovis AF2122/97
auugguaccggugcgcccggua

SEQ ID NO: 25581 - RNA, 20 nt, Mycobacterium bovis subsp bovis AF2122/97
auugucgagccgguuccgca

SEQ ID NO: 25582 - RNA, 18 nt, Mycobacterium bovis subsp bovis AF2122/97
auugugcguggcuguccg

SEQ ID NO: 25583 - RNA, 22 nt, Mycobacterium bovis subsp bovis AF2122/97
auuucgccgugacguuccgcuc

SEQ ID NO: 25584 - RNA, 22 nt, Mycobacterium bovis subsp bovis AF2122/97
auuucggggccuuuugcgucug

SEQ ID NO: 25585 - RNA, 21 nt, Mycobacterium bovis subsp bovis AF2122/97
auuugcaacgcaacggcgugc

SEQ ID NO: 25586 - RNA, 22 nt, Mycobacterium bovis subsp bovis AF2122/97
auuugggagcuuuugcgucugc

SEQ ID NO: 25587 - RNA, 22 nt, Mycobacterium bovis subsp bovis AF2122/97
auuugggcgauuuugcgucugc

SEQ ID NO: 25588 - RNA, 22 nt, Mycobacterium bovis subsp bovis AF2122/97
caaaggccuuuccugcugggcu

SEQ ID NO: 25589 - RNA, 22 nt, Mycobacterium bovis subsp bovis AF2122/97
caaccgcgacgcucaggccagc

SEQ ID NO: 25590 - RNA, 22 nt, Mycobacterium bovis subsp bovis AF2122/97
caacgcaucagugccggcgccg

SEQ ID NO: 25591 - RNA, 22 nt, Mycobacterium bovis subsp bovis AF2122/97
caacgccguuucggcgaucgcu

SEQ ID NO: 25592 - RNA, 22 nt, Mycobacterium bovis subsp bovis AF2122/97
caacugcccgagucgcagcgcc

SEQ ID NO: 25593 - RNA, 22 nt, Mycobacterium bovis subsp bovis AF2122/97
caacuucauuuguagcgguuac

SEQ ID NO: 25594 - RNA, 22 nt, Mycobacterium bovis subsp bovis AF2122/97
caacuucgacgcugacggcuag

SEQ ID NO: 25595 - RNA, 22 nt, Mycobacterium bovis subsp bovis AF2122/97
caagaaagaaauuaucgucacc

SEQ ID NO: 25596 - RNA, 22 nt, Mycobacterium bovis subsp bovis AF2122/97
caagggcaucgaguugggcacc

SEQ ID NO: 25597 - RNA, 22 nt, Mycobacterium bovis subsp bovis AF2122/97
caagggcauggccguuuugcuc

SEQ ID NO: 25598 - RNA, 22 nt, Mycobacterium bovis subsp bovis AF2122/97
caauguuucgacgggcaccaaa

SEQ ID NO: 25599 - RNA, 22 nt, Mycobacterium bovis subsp bovis AF2122/97
cacaccaucaccgugaugauca

SEQ ID NO: 25600 - RNA, 22 nt, Mycobacterium bovis subsp bovis AF2122/97
cacacccgccgcggucggcuac

SEQ ID NO: 25601 - RNA, 22 nt, Mycobacterium bovis subsp bovis AF2122/97
cacaccgcgaacggugucgauc

SEQ ID NO: 25602 - RNA, 22 nt, Mycobacterium bovis subsp bovis AF2122/97
cacaccgcgaugacuccggcga

SEQ ID NO: 25603 - RNA, 22 nt, Mycobacterium bovis subsp bovis AF2122/97
cacacguggccgaucgguuacu

SEQ ID NO: 25604 - RNA, 21 nt, Mycobacterium bovis subsp bovis AF2122/97
caccacgccggcgccgcggug

SEQ ID NO: 25605 - RNA, 22 nt, Mycobacterium bovis subsp bovis AF2122/97
caccagcgcgguggugaucacc

SEQ ID NO: 25606 - RNA, 22 nt, Mycobacterium bovis subsp bovis AF2122/97
caccagcggucgucaggugcuc

SEQ ID NO: 25607 - RNA, 22 nt, Mycobacterium bovis subsp bovis AF2122/97
ggcgacguuggcaccucggugc

SEQ ID NO: 25608 - RNA, 22 nt, Mycobacterium bovis subsp bovis AF2122/97
ggcgagagggagggccaugugg

SEQ ID NO: 25609 - RNA, 22 nt, Mycobacterium bovis subsp bovis AF2122/97
ggcgagcagacacagacucgca

SEQ ID NO: 25610 - RNA, 22 nt, Mycobacterium bovis subsp bovis AF2122/97
ggcgaucgguugucccgcgaca

SEQ ID NO: 25611 - RNA, 20 nt, Mycobacterium bovis subsp bovis AF2122/97
ggcgauuuugcgucugcucg

SEQ ID NO: 25612 - RNA, 22 nt, Mycobacterium bovis subsp bovis AF2122/97
ggcgccgguguucacgucgccg

SEQ ID NO: 25613 - RNA, 22 nt, Mycobacterium bovis subsp bovis AF2122/97
ggcgccuggcccaucaccgcgg

SEQ ID NO: 25614 - RNA, 22 nt, Mycobacterium bovis subsp bovis AF2122/97
ggcgcggaccuaucgguguggc

SEQ ID NO: 25615 - RNA, 22 nt, Mycobacterium bovis subsp bovis AF2122/97
ggcgcggugucgguguugaccg

SEQ ID NO: 25616 - RNA, 22 nt, Mycobacterium bovis subsp bovis AF2122/97
ggcgcgucaucaugccgggcac

SEQ ID NO: 25617 - RNA, 22 nt, Mycobacterium bovis subsp bovis AF2122/97
ggcgcuggugcagcugaucggc

SEQ ID NO: 25618 - RNA, 22 nt, Mycobacterium bovis subsp bovis AF2122/97
ggcggacuguucggagccggcg

SEQ ID NO: 25619 - RNA, 22 nt, Mycobacterium bovis subsp bovis AF2122/97
ggcggaguccggcagcgucaac

SEQ ID NO: 25620 - RNA, 22 nt, Mycobacterium bovis subsp bovis AF2122/97
ggcggccgucgacggcggugac

SEQ ID NO: 25621 - RNA, 22 nt, Mycobacterium bovis subsp bovis AF2122/97
ggcggccgugcgcgugaucgac

SEQ ID NO: 25622 - RNA, 22 nt, Mycobacterium bovis subsp bovis AF2122/97
ggcggcgaugaugcgcacugag

SEQ ID NO: 25623 - RNA, 22 nt, Mycobacterium bovis subsp bovis AF2122/97
ggcggcuaccugaaggacauca

SEQ ID NO: 25624 - RNA, 22 nt, Mycobacterium bovis subsp bovis AF2122/97
ggcggcuugaacuccggugccg

SEQ ID NO: 25625 - RNA, 22 nt, Mycobacterium bovis subsp bovis AF2122/97
ggcgggacgcgguguacggugc

SEQ ID NO: 25626 - RNA, 22 nt, Mycobacterium bovis subsp bovis AF2122/97
ggcggucgagcggcggaugaag

SEQ ID NO: 25627 - RNA, 22 nt, Mycobacterium bovis subsp bovis AF2122/97
ggcggucuggcugcugggcguc

SEQ ID NO: 25628 - RNA, 22 nt, Mycobacterium bovis subsp bovis AF2122/97
ggcgucgaucagggcugugucg

SEQ ID NO: 25629 - RNA, 22 nt, Mycobacterium bovis subsp bovis AF2122/97
ggcugacggcguggcggugcug

SEQ ID NO: 25630 - RNA, 22 nt, Mycobacterium bovis subsp bovis AF2122/97
ggcugcgcugcguaccgacgug

SEQ ID NO: 25631 - RNA, 22 nt, Mycobacterium bovis subsp bovis AF2122/97
ggcugcgguucaugagugccug

SEQ ID NO: 25632 - RNA, 23 nt, Mycobacterium bovis subsp bovis AF2122/97
ggcuggacuggucgacaccgcag

SEQ ID NO: 25633 - RNA, 22 nt, Mycobacterium bovis subsp bovis AF2122/97
ggcuuuugcgucuguucgccgc

SEQ ID NO: 25634 - RNA, 22 nt, Mycobacterium bovis subsp bovis AF2122/97
gggaaguguccacgugcccgca

SEQ ID NO: 25635 - RNA, 22 nt, Mycobacterium bovis subsp bovis AF2122/97
gggcacccugucgaucgucuuc

SEQ ID NO: 25636 - RNA, 22 nt, Mycobacterium bovis subsp bovis AF2122/97
gggcgagcagacgcagaaucgc

SEQ ID NO: 25637 - RNA, 22 nt, Mycobacterium bovis subsp bovis AF2122/97
gggcgccaccgcgauggcguca

SEQ ID NO: 25638 - RNA, 22 nt, Mycobacterium bovis subsp bovis AF2122/97
gggcggcaccgucaggucggcu

SEQ ID NO: 25639 - RNA, 22 nt, Mycobacterium bovis subsp bovis AF2122/97
gggcggcgucaagcagaaucac

SEQ ID NO: 25640 - RNA, 22 nt, Mycobacterium bovis subsp bovis AF2122/97
gggcggcugggucgacuuugac

SEQ ID NO: 25641 - RNA, 22 nt, Mycobacterium bovis subsp bovis AF2122/97
gggcucgcccguugguguagac

SEQ ID NO: 25642 - RNA, 22 nt, Mycobacterium bovis subsp bovis AF2122/97
gggcucgggcaaugucagcgcg

SEQ ID NO: 25643 - RNA, 22 nt, Mycobacterium bovis subsp bovis AF2122/97
gggcuggacggugccggcgauc

SEQ ID NO: 25644 - RNA, 22 nt, Mycobacterium bovis subsp bovis AF2122/97
gggcuuccguaccgccgacauu

SEQ ID NO: 25645 - RNA, 22 nt, Mycobacterium bovis subsp bovis AF2122/97
ggggauuuugcgucugcucggc

SEQ ID NO: 25646 - RNA, 22 nt, Mycobacterium bovis subsp bovis AF2122/97
ggggccaugccgaggacacggu

SEQ ID NO: 25647 - RNA, 22 nt, Mycobacterium bovis subsp bovis AF2122/97
ggggcgcugagcguggaguucg

SEQ ID NO: 25648 - RNA, 22 nt, Mycobacterium bovis subsp bovis AF2122/97
ggggcggaucagcgccaccucc

SEQ ID NO: 25649 - RNA, 22 nt, Mycobacterium bovis subsp bovis AF2122/97
ggggcugagcggguuugaguug

SEQ ID NO: 25650 - RNA, 22 nt, Mycobacterium bovis subsp bovis AF2122/97
gggggcuuuugcgucugcucgg

SEQ ID NO: 25651 - RNA, 22 nt, Mycobacterium bovis subsp bovis AF2122/97
ggggucagcgccaggcgguggu

SEQ ID NO: 25652 - RNA, 22 nt, Mycobacterium bovis subsp bovis AF2122/97
gggguuggugauguagccgaua

SEQ ID NO: 25653 - RNA, 22 nt, Mycobacterium bovis subsp bovis AF2122/97
ggguaucgccucgacagcgcgc

SEQ ID NO: 25654 - RNA, 22 nt, Mycobacterium bovis subsp bovis AF2122/97
gggucggcaagaccgagcuggc

SEQ ID NO: 25655 - RNA, 19 nt, Mycobacterium bovis subsp bovis AF2122/97
gggugaccggccagcgcgc

SEQ ID NO: 25656 - RNA, 22 nt, Mycobacterium bovis subsp bovis AF2122/97
gggugaccgucauggaccacgg

SEQ ID NO: 25657 - RNA, 22 nt, Mycobacterium bovis subsp bovis AF2122/97
gggugcgagccaggccggcucg

SEQ ID NO: 25658 - RNA, 22 nt, Mycobacterium bovis subsp bovis AF2122/97
ggguggacaccagcacguagug

SEQ ID NO: 25659 - RNA, 22 nt, Mycobacterium bovis subsp bovis AF2122/97
ggguggugcaggauggcgucga

SEQ ID NO: 25660 - RNA, 19 nt, Mycobacterium bovis subsp bovis AF2122/97
gguauucccgccacgcgga

SEQ ID NO: 25661 - RNA, 22 nt, Mycobacterium bovis subsp bovis AF2122/97
ggucaaccgggcauugcuggcg

SEQ ID NO: 25662 - RNA, 22 nt, Mycobacterium bovis subsp bovis AF2122/97
ggucagcacgcaugugcggugg

SEQ ID NO: 25663 - RNA, 22 nt, Mycobacterium bovis subsp bovis AF2122/97
ggucaucucggcgaucaccgag

SEQ ID NO: 25664 - RNA, 22 nt, Mycobacterium bovis subsp bovis AF2122/97
gguccagugucagcgcggccau

SEQ ID NO: 25665 - RNA, 22 nt, Mycobacterium bovis subsp bovis AF2122/97
ggucgcaaugggcaggacuuug

SEQ ID NO: 25666 - RNA, 22 nt, Mycobacterium bovis subsp bovis AF2122/97
ggucggucaaggucgcgugcac

SEQ ID NO: 25667 - RNA, 22 nt, Mycobacterium bovis subsp bovis AF2122/97
ggucguucguggucgcgaugau

SEQ ID NO: 25668 - RNA, 22 nt, Mycobacterium bovis subsp bovis AF2122/97
ggucucgagcuugccggccgca

SEQ ID NO: 25669 - RNA, 22 nt, Mycobacterium bovis subsp bovis AF2122/97
ggucuugacguugccguuggcg

SEQ ID NO: 25670 - RNA, 22 nt, Mycobacterium bovis subsp bovis AF2122/97
ggucuugcucgacguucgcgca

SEQ ID NO: 25671 - RNA, 21 nt, Mycobacterium bovis subsp bovis AF2122/97
ggugacacggcgggccgcgag

SEQ ID NO: 25672 - RNA, 22 nt, Mycobacterium bovis subsp bovis AF2122/97
ggugacggucgucgcggcggca

SEQ ID NO: 25673 - RNA, 22 nt, Mycobacterium bovis subsp bovis AF2122/97
ggugagcagacgcagagucgca

SEQ ID NO: 25674 - RNA, 22 nt, Mycobacterium bovis subsp bovis AF2122/97
ggugaggucguagccgguggac

SEQ ID NO: 25675 - RNA, 22 nt, Mycobacterium bovis subsp bovis AF2122/97
ggugcgcgcauguacucgaagc

SEQ ID NO: 25676 - RNA, 22 nt, Mycobacterium bovis subsp bovis AF2122/97
ggugcgcucuggugccggagcu

SEQ ID NO: 25677 - RNA, 22 nt, Mycobacterium bovis subsp bovis AF2122/97
ggugcggucgccgcggugcugg

SEQ ID NO: 25678 - RNA, 22 nt, Mycobacterium bovis subsp bovis AF2122/97
ggugcuggcggugcugcagcua

SEQ ID NO: 25679 - RNA, 22 nt, Mycobacterium bovis subsp bovis AF2122/97
ggugcuuuugcgucugcucggc

SEQ ID NO: 25680 - RNA, 22 nt, Mycobacterium bovis subsp bovis AF2122/97
gguggagcuggcugccgcgcua

SEQ ID NO: 25681 - RNA, 22 nt, Mycobacterium bovis subsp bovis AF2122/97
gguggccucgaggaacacgaca

SEQ ID NO: 25682 - RNA, 22 nt, Mycobacterium bovis subsp bovis AF2122/97
gguggcgcacaucgccgugcac

SEQ ID NO: 25683 - RNA, 22 nt, Mycobacterium bovis subsp bovis AF2122/97
gguggcuuccgaaaucgcgcgc

SEQ ID NO: 25684 - RNA, 22 nt, Mycobacterium bovis subsp bovis AF2122/97
ggugggcgcgucaucgacgcuu

SEQ ID NO: 25685 - RNA, 22 nt, Mycobacterium bovis subsp bovis AF2122/97
gguggucgaaguaggccagcac

SEQ ID NO: 25686 - RNA, 22 nt, Mycobacterium bovis subsp bovis AF2122/97
ggugguuuugugucuguucggc

SEQ ID NO: 25687 - RNA, 22 nt, Mycobacterium bovis subsp bovis AF2122/97
gguguccuccgaucgggggaag

SEQ ID NO: 25688 - RNA, 22 nt, Mycobacterium bovis subsp bovis AF2122/97
ggugucgagcacgcugggccga

SEQ ID NO: 25689 - RNA, 21 nt, Mycobacterium bovis subsp bovis AF2122/97
ggugucuuuggcggggccgcg

SEQ ID NO: 25690 - RNA, 22 nt, Mycobacterium bovis subsp bovis AF2122/97
ggugugauauaucaccuuugcc

SEQ ID NO: 25691 - RNA, 22 nt, Mycobacterium bovis subsp bovis AF2122/97
gguguucacggcgcacguagcc

SEQ ID NO: 25692 - RNA, 22 nt, Mycobacterium bovis subsp bovis AF2122/97
gguguucuuggcuggcgcgucc

SEQ ID NO: 25693 - RNA, 22 nt, Mycobacterium bovis subsp bovis AF2122/97
gguguuggcaagccggcgggca

SEQ ID NO: 25694 - RNA, 22 nt, Mycobacterium bovis subsp bovis AF2122/97
gguugccagcgaaccggaaugg

SEQ ID NO: 25695 - RNA, 22 nt, Mycobacterium bovis subsp bovis AF2122/97
gguugcuggucggccggaggcu

SEQ ID NO: 25696 - RNA, 22 nt, Mycobacterium bovis subsp bovis AF2122/97
gguuugcugaagaagcugggug

SEQ ID NO: 25697 - RNA, 22 nt, Mycobacterium bovis subsp bovis AF2122/97
guaccgacgaucggucggcugc

SEQ ID NO: 25698 - RNA, 22 nt, Mycobacterium bovis subsp bovis AF2122/97
guacgcaacggcugucacacga

SEQ ID NO: 25699 - RNA, 22 nt, Mycobacterium bovis subsp bovis AF2122/97
guacgugcugggcaccgagcgc

SEQ ID NO: 25700 - RNA, 22 nt, Mycobacterium bovis subsp bovis AF2122/97
guaggaggucuccagcagccgc

SEQ ID NO: 25701 - RNA, 22 nt, Mycobacterium bovis subsp bovis AF2122/97
guaggucagggcguauuugucg

SEQ ID NO: 25702 - RNA, 22 nt, Mycobacterium bovis subsp bovis AF2122/97
gucauagccgagcaggugcgcu

SEQ ID NO: 25703 - RNA, 22 nt, Mycobacterium bovis subsp bovis AF2122/97
guccgcgagcggaacgucacgg

SEQ ID NO: 25704 - RNA, 22 nt, Mycobacterium bovis subsp bovis AF2122/97
gucgacaucgacaccagcgcgg

SEQ ID NO: 25705 - RNA, 22 nt, Mycobacterium bovis subsp bovis AF2122/97
gucgagcuuggcccggccggcc

SEQ ID NO: 25706 - RNA, 22 nt, Mycobacterium bovis subsp bovis AF2122/97
gcguccuugccgcgugcaucga

SEQ ID NO: 25707 - RNA, 22 nt, Mycobacterium bovis subsp bovis AF2122/97
gcgucgacgguguggguucgga

SEQ ID NO: 25708 - RNA, 22 nt, Mycobacterium bovis subsp bovis AF2122/97
gcgucgaugucgucgaaggugg

SEQ ID NO: 25709 - RNA, 21 nt, Mycobacterium bovis subsp bovis AF2122/97
gcgucggcuugugcgcuccgu

SEQ ID NO: 25710 - RNA, 22 nt, Mycobacterium bovis subsp bovis AF2122/97
gcgucguagguguggcccuccg

SEQ ID NO: 25711 - RNA, 22 nt, Mycobacterium bovis subsp bovis AF2122/97
gcgucgucagauucacagucag

SEQ ID NO: 25712 - RNA, 22 nt, Mycobacterium bovis subsp bovis AF2122/97
gcgucgugagauucacagucgg

SEQ ID NO: 25713 - RNA, 21 nt, Mycobacterium bovis subsp bovis AF2122/97
gcgucgugccauucacagugg

SEQ ID NO: 25714 - RNA, 22 nt, Mycobacterium bovis subsp bovis AF2122/97
gcgugaacugagggcggaaaau

SEQ ID NO: 25715 - RNA, 22 nt, Mycobacterium bovis subsp bovis AF2122/97
gcgugccgcgcaaaccauggcc

SEQ ID NO: 25716 - RNA, 22 nt, Mycobacterium bovis subsp bovis AF2122/97
gcgugcgauucugugucugcuc

SEQ ID NO: 25717 - RNA, 22 nt, Mycobacterium bovis subsp bovis AF2122/97
gcgugcgauucugugucuguuc

SEQ ID NO: 25718 - RNA, 22 nt, Mycobacterium bovis subsp bovis AF2122/97
gcgugggugccgcgauacccga

SEQ ID NO: 25719 - RNA, 22 nt, Mycobacterium bovis subsp bovis AF2122/97
gcguggucggaugcaggccagc

SEQ ID NO: 25720 - RNA, 22 nt, Mycobacterium bovis subsp bovis AF2122/97
gcguucguuucaagcggaucga

SEQ ID NO: 25721 - RNA, 22 nt, Mycobacterium bovis subsp bovis AF2122/97
gcguugacucugcguccaccac

SEQ ID NO: 25722 - RNA, 22 nt, Mycobacterium bovis subsp bovis AF2122/97
gcguugggcacguuggcgaccc

SEQ ID NO: 25723 - RNA, 22 nt, Mycobacterium bovis subsp bovis AF2122/97
gcguuugacucugcggauacca

SEQ ID NO: 25724 - RNA, 21 nt, Mycobacterium bovis subsp bovis AF2122/97
gcuaccgcgcccgugagcgcc

SEQ ID NO: 25725 - RNA, 21 nt, Mycobacterium bovis subsp bovis AF2122/97
gcucccgaucucccggggaga

SEQ ID NO: 25726 - RNA, 22 nt, Mycobacterium bovis subsp bovis AF2122/97
gcucgaacccggguuucggcga

SEQ ID NO: 25727 - RNA, 22 nt, Mycobacterium bovis subsp bovis AF2122/97
gcugaaccugauccucaagggc

SEQ ID NO: 25728 - RNA, 22 nt, Mycobacterium bovis subsp bovis AF2122/97
gcugaccgggacgccggccugg

SEQ ID NO: 25729 - RNA, 22 nt, Mycobacterium bovis subsp bovis AF2122/97
gcugaugcggugacgguggccg

SEQ ID NO: 25730 - RNA, 23 nt, Mycobacterium bovis subsp bovis AF2122/97
gcugccgcagcggccggugcugg

SEQ ID NO: 25731 - RNA, 21 nt, Mycobacterium bovis subsp bovis AF2122/97
gcugcgcuaugguugucacca

SEQ ID NO: 25732 - RNA, 22 nt, Mycobacterium bovis subsp bovis AF2122/97
gccgguugcuggcccgauugcc

SEQ ID NO: 25733 - RNA, 22 nt, Mycobacterium bovis subsp bovis AF2122/97
gccguacgucuucgaugcugac

SEQ ID NO: 25734 - RNA, 20 nt, Mycobacterium bovis subsp bovis AF2122/97
gccgucaacgguuucuuguu

SEQ ID NO: 25735 - RNA, 22 nt, Mycobacterium bovis subsp bovis AF2122/97
gccgucguguacagcagcgucu

SEQ ID NO: 25736 - RNA, 22 nt, Mycobacterium bovis subsp bovis AF2122/97
gccgucuggaucugcgaacgga

SEQ ID NO: 25737 - RNA, 22 nt, Mycobacterium bovis subsp bovis AF2122/97
gccgugaguucacguucggcgg

SEQ ID NO: 25738 - RNA, 22 nt, Mycobacterium bovis subsp bovis AF2122/97
gccguggccgaucagcccggcg

SEQ ID NO: 25739 - RNA, 22 nt, Mycobacterium bovis subsp bovis AF2122/97
gccgugggacccucacugccug

SEQ ID NO: 25740 - RNA, 23 nt, Mycobacterium bovis subsp bovis AF2122/97
gccguguacuuccaggagcagcc

SEQ ID NO: 25741 - RNA, 22 nt, Mycobacterium bovis subsp bovis AF2122/97
gccguguuggcuccguuggugc

SEQ ID NO: 25742 - RNA, 22 nt, Mycobacterium bovis subsp bovis AF2122/97
gccugcaaaauguugaucucac

SEQ ID NO: 25743 - RNA, 22 nt, Mycobacterium bovis subsp bovis AF2122/97
gccugcgccuugauccaggcgu

SEQ ID NO: 25744 - RNA, 22 nt, Mycobacterium bovis subsp bovis AF2122/97
gccuggaggaccuggacucggc

SEQ ID NO: 25745 - RNA, 22 nt, Mycobacterium bovis subsp bovis AF2122/97
gccuggucaccgugccgaaggu

SEQ ID NO: 25746 - RNA, 22 nt, Mycobacterium bovis subsp bovis AF2122/97
gccuugcugggaucggucagcu

SEQ ID NO: 25747 - RNA, 22 nt, Mycobacterium bovis subsp bovis AF2122/97
gcgaaacacgggaucgggcgag

SEQ ID NO: 25748 - RNA, 22 nt, Mycobacterium bovis subsp bovis AF2122/97
gcgacagugaugcccagucugc

SEQ ID NO: 25749 - RNA, 22 nt, Mycobacterium bovis subsp bovis AF2122/97
gcgaccgguaucccggcgccgc

SEQ ID NO: 25750 - RNA, 22 nt, Mycobacterium bovis subsp bovis AF2122/97
gcgaccgguugucauuccggcc

SEQ ID NO: 25751 - RNA, 22 nt, Mycobacterium bovis subsp bovis AF2122/97
gcgagcagacgcaaaaucgccc

SEQ ID NO: 25752 - RNA, 21 nt, Mycobacterium bovis subsp bovis AF2122/97
gcgagcagggcaucaccgccg

SEQ ID NO: 25753 - RNA, 22 nt, Mycobacterium bovis subsp bovis AF2122/97
gcgagcccgggcuugccgacga

SEQ ID NO: 25754 - RNA, 22 nt, Mycobacterium bovis subsp bovis AF2122/97
gcgagcguaacgccacggcgaa

SEQ ID NO: 25755 - RNA, 22 nt, Mycobacterium bovis subsp bovis AF2122/97
gcgaggauucgacgaugcugag

SEQ ID NO: 25756 - RNA, 22 nt, Mycobacterium bovis subsp bovis AF2122/97
gcgauagccgaaccacccgccg

SEQ ID NO: 25757 - RNA, 22 nt, Mycobacterium bovis subsp bovis AF2122/97
cgaguaucgcuugcgcaccgau

SEQ ID NO: 25758 - RNA, 22 nt, Mycobacterium bovis subsp bovis AF2122/97
cgaguucggcaucacccgcaug

SEQ ID NO: 25759 - RNA, 22 nt, Mycobacterium bovis subsp bovis AF2122/97
cgaguugguguuuccgcugcag

SEQ ID NO: 25760 - RNA, 22 nt, Mycobacterium bovis subsp bovis AF2122/97
cgaucacgucgguggccgggcg

SEQ ID NO: 25761 - RNA, 22 nt, Mycobacterium bovis subsp bovis AF2122/97
cgaucccgcggucgaacggcac

SEQ ID NO: 25762 - RNA, 22 nt, Mycobacterium bovis subsp bovis AF2122/97
cgaugcaccgcaauaugaccug

SEQ ID NO: 25763 - RNA, 22 nt, Mycobacterium bovis subsp bovis AF2122/97
cgaugcagcaggaccggugaga

SEQ ID NO: 25764 - RNA, 22 nt, Mycobacterium bovis subsp bovis AF2122/97
cgaugccgcgccacugcuugag

SEQ ID NO: 25765 - RNA, 21 nt, Mycobacterium bovis subsp bovis AF2122/97
cgaugcggcccagauugacgc

SEQ ID NO: 25766 - RNA, 20 nt, Mycobacterium bovis subsp bovis AF2122/97
cgauggucagcgcuugcgga

SEQ ID NO: 25767 - RNA, 22 nt, Mycobacterium bovis subsp bovis AF2122/97
cgauguaucugacguacuggac

SEQ ID NO: 25768 - RNA, 22 nt, Mycobacterium bovis subsp bovis AF2122/97
cgcaccgaaggagaucccgccg

SEQ ID NO: 25769 - RNA, 22 nt, Mycobacterium bovis subsp bovis AF2122/97
cgcaggccacccgcggggccac

SEQ ID NO: 25770 - RNA, 22 nt, Mycobacterium bovis subsp bovis AF2122/97
cgccaacgauccggugcgaguc

SEQ ID NO: 25771 - RNA, 22 nt, Mycobacterium bovis subsp bovis AF2122/97
cgccaacugcucaaccauaccg

SEQ ID NO: 25772 - RNA, 22 nt, Mycobacterium bovis subsp bovis AF2122/97
cgccagcaccaccugguugggc

SEQ ID NO: 25773 - RNA, 22 nt, Mycobacterium bovis subsp bovis AF2122/97
cgccagcauggagggcaccaac

SEQ ID NO: 25774 - RNA, 22 nt, Mycobacterium bovis subsp bovis AF2122/97
cgccagcguaacgucacggcga

SEQ ID NO: 25775 - RNA, 22 nt, Mycobacterium bovis subsp bovis AF2122/97
cgccaguaugcggucggugcug

SEQ ID NO: 25776 - RNA, 19 nt, Mycobacterium bovis subsp bovis AF2122/97
cgccaucgcgcugugccuc

SEQ ID NO: 25777 - RNA, 22 nt, Mycobacterium bovis subsp bovis AF2122/97
cgccauggaaaugcuuugcacg

SEQ ID NO: 25778 - RNA, 21 nt, Mycobacterium bovis subsp bovis AF2122/97
cgccccagaugcacgcucggc

SEQ ID NO: 25779 - RNA, 19 nt, Mycobacterium bovis subsp bovis AF2122/97
cgcccgaccggccuugauc

SEQ ID NO: 25780 - RNA, 22 nt, Mycobacterium bovis subsp bovis AF2122/97
cgcccgccaaggacuuccgcgc

SEQ ID NO: 25781 - RNA, 22 nt, Mycobacterium bovis subsp bovis AF2122/97
cgcccggccgcuggucgcguac

SEQ ID NO: 25782 - RNA, 22 nt, Mycobacterium bovis subsp bovis AF2122/97
cgccgagcagacgcagaaucgc

SEQ ID NO: 25783 - RNA, 22 nt, Mycobacterium bovis subsp bovis AF2122/97
cgccgagggugaaucucacgac

SEQ ID NO: 25784 - RNA, 22 nt, Mycobacterium bovis subsp bovis AF2122/97
cgccgccgugguugcacguucg

SEQ ID NO: 25785 - RNA, 22 nt, Mycobacterium bovis subsp bovis AF2122/97
cgccggccugguggccgcgcuc

SEQ ID NO: 25786 - RNA, 21 nt, Mycobacterium bovis subsp bovis AF2122/97
cgccgguggcguggucaccga

SEQ ID NO: 25787 - RNA, 22 nt, Mycobacterium bovis subsp bovis AF2122/97
cgccgguguggaggccggcgcg

SEQ ID NO: 25788 - RNA, 22 nt, Mycobacterium bovis subsp bovis AF2122/97
cgccgucuggaccgacaugcuc

SEQ ID NO: 25789 - RNA, 22 nt, Mycobacterium bovis subsp bovis AF2122/97
cgcgaauguaacgccacugcga

SEQ ID NO: 25790 - RNA, 22 nt, Mycobacterium bovis subsp bovis AF2122/97
cgcgagcagacacagagucgca

SEQ ID NO: 25791 - RNA, 22 nt, Mycobacterium bovis subsp bovis AF2122/97
cgcgagcguaaccggacugcga

SEQ ID NO: 25792 - RNA, 22 nt, Mycobacterium bovis subsp bovis AF2122/97
cgcgagcgugacggcacugcga

SEQ ID NO: 25793 - RNA, 23 nt, Mycobacterium bovis subsp bovis AF2122/97
cgcgcaccucccaacggucuugg

SEQ ID NO: 25794 - RNA, 21 nt, Mycobacterium bovis subsp bovis AF2122/97
cgcgccauggcaacccggccc

SEQ ID NO: 25795 - RNA, 22 nt, Mycobacterium bovis subsp bovis AF2122/97
cgcgcggaguucggugacggua

SEQ ID NO: 25796 - RNA, 22 nt, Mycobacterium bovis subsp bovis AF2122/97
cgcgcgguauguggaaagccac

SEQ ID NO: 25797 - RNA, 22 nt, Mycobacterium bovis subsp bovis AF2122/97
cgcgcuaucagcggcugauguu

SEQ ID NO: 25798 - RNA, 22 nt, Mycobacterium bovis subsp bovis AF2122/97
cgcgcucgaucauccgcggugc

SEQ ID NO: 25799 - RNA, 22 nt, Mycobacterium bovis subsp bovis AF2122/97
cgcggugagccuggacccggcg

SEQ ID NO: 25800 - RNA, 22 nt, Mycobacterium bovis subsp bovis AF2122/97
cgcgucauuggcgcggguuaug

SEQ ID NO: 25801 - RNA, 22 nt, Mycobacterium bovis subsp bovis AF2122/97
cgcgucgucauuggagguggaa

SEQ ID NO: 25802 - RNA, 22 nt, Mycobacterium bovis subsp bovis AF2122/97
cgcgugucggagagcccacgga

SEQ ID NO: 25803 - RNA, 22 nt, Mycobacterium bovis subsp bovis AF2122/97
cgcuccuaucaagucacgccgg

SEQ ID NO: 25804 - RNA, 18 nt, Mycobacterium bovis subsp bovis AF2122/97
cgcugacaccaucagcau

SEQ ID NO: 25805 - RNA, 22 nt, Mycobacterium bovis subsp bovis AF2122/97
cgcugaggugcugguguuggac

SEQ ID NO: 25806 - RNA, 22 nt, Mycobacterium bovis subsp bovis AF2122/97
cgcugcagcggcagccuccgcc

SEQ ID NO: 25807 - RNA, 16 nt, Mycobacterium bovis subsp bovis AF2122/97
cgcugccgacgccgcc

SEQ ID NO: 25808 - RNA, 22 nt, Mycobacterium bovis subsp bovis AF2122/97
cgcugccgucgaucucgacgca

SEQ ID NO: 25809 - RNA, 23 nt, Mycobacterium bovis subsp bovis AF2122/97
cgcugcgaucgaagacguccugc

SEQ ID NO: 25810 - RNA, 22 nt, Mycobacterium bovis subsp bovis AF2122/97
cgcuggucaagggcaacgacua

SEQ ID NO: 25811 - RNA, 22 nt, Mycobacterium bovis subsp bovis AF2122/97
cgcugguggaauucgagcgcuc

SEQ ID NO: 25812 - RNA, 21 nt, Mycobacterium bovis subsp bovis AF2122/97
cgcuggugucgaugucgacgg

SEQ ID NO: 25813 - RNA, 22 nt, Mycobacterium bovis subsp bovis AF2122/97
cgcuugcgguugguggauucgg

SEQ ID NO: 25814 - RNA, 22 nt, Mycobacterium bovis subsp bovis AF2122/97
cggaccaugguguuggccgguu

SEQ ID NO: 25815 - RNA, 23 nt, Mycobacterium bovis subsp bovis AF2122/97
cggacgaaaacccuggcggucau

SEQ ID NO: 25816 - RNA, 22 nt, Mycobacterium bovis subsp bovis AF2122/97
cggagcagguggacgccgccgc

SEQ ID NO: 25817 - RNA, 20 nt, Mycobacterium bovis subsp bovis AF2122/97
cggauacacaacguggcugc

SEQ ID NO: 25818 - RNA, 22 nt, Mycobacterium bovis subsp bovis AF2122/97
cggaucgguggcgugcagaugu

SEQ ID NO: 25819 - RNA, 22 nt, Mycobacterium bovis subsp bovis AF2122/97
cggcaagcccgggcucgccgga

SEQ ID NO: 25820 - RNA, 22 nt, Mycobacterium bovis subsp bovis AF2122/97
cggcaccggcaacgucggguug

SEQ ID NO: 25821 - RNA, 22 nt, Mycobacterium bovis subsp bovis AF2122/97
cggcacuucgguuugaccgacc

SEQ ID NO: 25822 - RNA, 22 nt, Mycobacterium bovis subsp bovis AF2122/97
cggcaucgacaccggcgacccg

SEQ ID NO: 25823 - RNA, 22 nt, Mycobacterium bovis subsp bovis AF2122/97
cggccgccgaaucgaugcgggc

SEQ ID NO: 25824 - RNA, 22 nt, Mycobacterium bovis subsp bovis AF2122/97
cggccgcggcggacuugaccgg

SEQ ID NO: 25825 - RNA, 22 nt, Mycobacterium bovis subsp bovis AF2122/97
cggccggccaguaucagcauca

SEQ ID NO: 25826 - RNA, 22 nt, Mycobacterium bovis subsp bovis AF2122/97
cggccggcuguaugccggugau

SEQ ID NO: 25827 - RNA, 22 nt, Mycobacterium bovis subsp bovis AF2122/97
cggccguaucgucgugcagauc

SEQ ID NO: 25828 - RNA, 22 nt, Mycobacterium bovis subsp bovis AF2122/97
cggccgugguagccgcgcugcu

SEQ ID NO: 25829 - RNA, 22 nt, Mycobacterium bovis subsp bovis AF2122/97
cggcgacgugcuugguagcugg

SEQ ID NO: 25830 - RNA, 22 nt, Mycobacterium bovis subsp bovis AF2122/97
cggcgagcagacgcaaaaucgc

SEQ ID NO: 25831 - RNA, 22 nt, Mycobacterium bovis subsp bovis AF2122/97
cggcgagcggacacauaagccc

SEQ ID NO: 25832 - RNA, 22 nt, Mycobacterium bovis subsp bovis AF2122/97
cggcgaucgccacccggaguug

SEQ ID NO: 25833 - RNA, 22 nt, Mycobacterium bovis subsp bovis AF2122/97
cggcgcggguugucgacgagca

SEQ ID NO: 25834 - RNA, 22 nt, Mycobacterium bovis subsp bovis AF2122/97
cggcgcguugaucgcacucaau

SEQ ID NO: 25835 - RNA, 22 nt, Mycobacterium bovis subsp bovis AF2122/97
cggcgcuacuggcggugagagc

SEQ ID NO: 25836 - RNA, 20 nt, Mycobacterium bovis subsp bovis AF2122/97
cggcgcugacaucauccucg

SEQ ID NO: 25837 - RNA, 22 nt, Mycobacterium bovis subsp bovis AF2122/97
cggcgguguuugaccgcugguc

SEQ ID NO: 25838 - RNA, 22 nt, Mycobacterium bovis subsp bovis AF2122/97
cggcguacagcucggcagccgg

SEQ ID NO: 25839 - RNA, 22 nt, Mycobacterium bovis subsp bovis AF2122/97
cggcgucguuggcggcgugguc

SEQ ID NO: 25840 - RNA, 22 nt, Mycobacterium bovis subsp bovis AF2122/97
cggcugauccccaucgagggca

SEQ ID NO: 25841 - RNA, 22 nt, Mycobacterium bovis subsp bovis AF2122/97
cggcuggcggaucccgcggauu

SEQ ID NO: 25842 - RNA, 22 nt, Mycobacterium bovis subsp bovis AF2122/97
cgggcaaggagacggucaccac

SEQ ID NO: 25843 - RNA, 22 nt, Mycobacterium bovis subsp bovis AF2122/97
cgggcacgguguugaucaccgg

SEQ ID NO: 25844 - RNA, 22 nt, Mycobacterium bovis subsp bovis AF2122/97
cgggcguuggucuguacguugc

SEQ ID NO: 25845 - RNA, 22 nt, Mycobacterium bovis subsp bovis AF2122/97
cgggggcuuuagcgacugcucg

SEQ ID NO: 25846 - RNA, 22 nt, Mycobacterium bovis subsp bovis AF2122/97
cgggggcuuuugcgucugcuga

SEQ ID NO: 25847 - RNA, 22 nt, Mycobacterium bovis subsp bovis AF2122/97
cgggucguugggaacuucccgg

SEQ ID NO: 25848 - RNA, 22 nt, Mycobacterium bovis subsp bovis AF2122/97
cgguacccaggcugcaaucauu

SEQ ID NO: 25849 - RNA, 22 nt, Mycobacterium bovis subsp bovis AF2122/97
cgguaguuggccuaggcgucgg

SEQ ID NO: 25850 - RNA, 22 nt, Mycobacterium bovis subsp bovis AF2122/97
cggucaaggugacgugcgugca

SEQ ID NO: 25851 - RNA, 22 nt, Mycobacterium bovis subsp bovis AF2122/97
cggucaccaucucgcagacaua

SEQ ID NO: 25852 - RNA, 22 nt, Mycobacterium bovis subsp bovis AF2122/97
cggucccgcaccgaccuugcgg

SEQ ID NO: 25853 - RNA, 22 nt, Mycobacterium bovis subsp bovis AF2122/97
cggucccugaucaaggaccgcu

SEQ ID NO: 25854 - RNA, 22 nt, Mycobacterium bovis subsp bovis AF2122/97
cgguccuacgcgugcucgucga

SEQ ID NO: 25855 - RNA, 22 nt, Mycobacterium bovis subsp bovis AF2122/97
cggucgcuugcguucaccgcga

SEQ ID NO: 25856 - RNA, 22 nt, Mycobacterium bovis subsp bovis AF2122/97
cggucguggugcccgagcgaga

SEQ ID NO: 25857 - RNA, 22 nt, Mycobacterium bovis subsp bovis AF2122/97
cggugcgauucugcgucugcuc

SEQ ID NO: 25858 - RNA, 22 nt, Mycobacterium bovis subsp bovis AF2122/97
cgguggauucccggccugcaca

SEQ ID NO: 25859 - RNA, 22 nt, Mycobacterium bovis subsp bovis AF2122/97
cgguggccaagaucggucccgu

SEQ ID NO: 25860 - RNA, 22 nt, Mycobacterium bovis subsp bovis AF2122/97
cgguggcggcgaaccgcagcac

SEQ ID NO: 25861 - RNA, 22 nt, Mycobacterium bovis subsp bovis AF2122/97
cggugucgaagaucgugggaca

SEQ ID NO: 25862 - RNA, 22 nt, Mycobacterium bovis subsp bovis AF2122/97
cggugugcuguuuggccagccg

SEQ ID NO: 25863 - RNA, 22 nt, Mycobacterium bovis subsp bovis AF2122/97
cgguuguguaucgaucgcaguu

SEQ ID NO: 25864 - RNA, 22 nt, Mycobacterium bovis subsp bovis AF2122/97
cgguuugccgucgcucuugauc

SEQ ID NO: 25865 - RNA, 22 nt, Mycobacterium bovis subsp bovis AF2122/97
cguaccgccugcacgccgggcc

SEQ ID NO: 25866 - RNA, 22 nt, Mycobacterium bovis subsp bovis AF2122/97
cguagagcgugggguugccggc

SEQ ID NO: 25867 - RNA, 22 nt, Mycobacterium bovis subsp bovis AF2122/97
cguccaggagaacaaguggcgu

SEQ ID NO: 25868 - RNA, 22 nt, Mycobacterium bovis subsp bovis AF2122/97
cgucccgaucacccaaccaggc

SEQ ID NO: 25869 - RNA, 22 nt, Mycobacterium bovis subsp bovis AF2122/97
cgucgagcaggucggcgacggc

SEQ ID NO: 25870 - RNA, 22 nt, Mycobacterium bovis subsp bovis AF2122/97
cgucgccaucagaaggucaucg

SEQ ID NO: 25871 - RNA, 21 nt, Mycobacterium bovis subsp bovis AF2122/97
cgucgcggucaccgugcggga

SEQ ID NO: 25872 - RNA, 22 nt, Mycobacterium bovis subsp bovis AF2122/97
cgucggcacgcccaacgaggug

SEQ ID NO: 25873 - RNA, 22 nt, Mycobacterium bovis subsp bovis AF2122/97
cgucggcgaaaugggccauggu

SEQ ID NO: 25874 - RNA, 22 nt, Mycobacterium bovis subsp bovis AF2122/97
cgucggcgacgccaaccagacc

SEQ ID NO: 25875 - RNA, 22 nt, Mycobacterium bovis subsp bovis AF2122/97
cgucggcgagaucgucggugug

SEQ ID NO: 25876 - RNA, 22 nt, Mycobacterium bovis subsp bovis AF2122/97
cgucggcggaaaccaacagggu

SEQ ID NO: 25877 - RNA, 22 nt, Mycobacterium bovis subsp bovis AF2122/97
cgucggcucggucucggugacg

SEQ ID NO: 25878 - RNA, 22 nt, Mycobacterium bovis subsp bovis AF2122/97
cgucgggaucuccagcacgucc

SEQ ID NO: 25879 - RNA, 22 nt, Mycobacterium bovis subsp bovis AF2122/97
cgucguccuuuccgugggggua

SEQ ID NO: 25880 - RNA, 22 nt, Mycobacterium bovis subsp bovis AF2122/97
cgucgugaccugccggccggac

SEQ ID NO: 25881 - RNA, 22 nt, Mycobacterium bovis subsp bovis AF2122/97
cgucguggauuucacugucgcg

SEQ ID NO: 25882 - RNA, 22 nt, Mycobacterium bovis subsp bovis AF2122/97
cgugagcagacgcaaaaucccc

SEQ ID NO: 25883 - RNA, 22 nt, Mycobacterium bovis subsp bovis AF2122/97
cgugagcagacgcaaagucgcc

SEQ ID NO: 25884 - RNA, 22 nt, Mycobacterium bovis subsp bovis AF2122/97
cgugaucgugugccucggcugg

SEQ ID NO: 25885 - RNA, 23 nt, Mycobacterium bovis subsp bovis AF2122/97
cgugcgauucugcgucugcucgc

SEQ ID NO: 25886 - RNA, 22 nt, Mycobacterium bovis subsp bovis AF2122/97
cgugcucgauccgacgcggcuc

SEQ ID NO: 25887 - RNA, 22 nt, Mycobacterium bovis subsp bovis AF2122/97
cguggagaccgagaucagcggg

SEQ ID NO: 25888 - RNA, 23 nt, Mycobacterium bovis subsp bovis AF2122/97
cguggccagggccgaggucaccg

SEQ ID NO: 25889 - RNA, 22 nt, Mycobacterium bovis subsp bovis AF2122/97
cguggccgucgauugcgguggc

SEQ ID NO: 25890 - RNA, 22 nt, Mycobacterium bovis subsp bovis AF2122/97
cguguugacucugcguccacca

SEQ ID NO: 25891 - RNA, 22 nt, Mycobacterium bovis subsp bovis AF2122/97
cguguugugcucgaucagcugg

SEQ ID NO: 25892 - RNA, 22 nt, Mycobacterium bovis subsp bovis AF2122/97
cguugacucugcgcccaccacg

SEQ ID NO: 25893 - RNA, 22 nt, Mycobacterium bovis subsp bovis AF2122/97
cguugacucugcguccaccacg

SEQ ID NO: 25894 - RNA, 22 nt, Mycobacterium bovis subsp bovis AF2122/97
cguugcaauacacguugccgau

SEQ ID NO: 25895 - RNA, 22 nt, Mycobacterium bovis subsp bovis AF2122/97
cguuggcgaauccgugcgaguu

SEQ ID NO: 25896 - RNA, 17 nt, Mycobacterium bovis subsp bovis AF2122/97
cguuggucggugaaugg

SEQ ID NO: 25897 - RNA, 22 nt, Mycobacterium bovis subsp bovis AF2122/97
cguugguguucuacaucugggg

SEQ ID NO: 25898 - RNA, 22 nt, Mycobacterium bovis subsp bovis AF2122/97
cguuucguugcggcgugcgauc

SEQ ID NO: 25899 - RNA, 22 nt, Mycobacterium bovis subsp bovis AF2122/97
cuaccgccgcgaccgcgagcau

SEQ ID NO: 25900 - RNA, 22 nt, Mycobacterium bovis subsp bovis AF2122/97
cuacuucgacgucgaaccccgu

SEQ ID NO: 25901 - RNA, 21 nt, Mycobacterium bovis subsp bovis AF2122/97
cucaagggcaagguuuggacc

SEQ ID NO: 25902 - RNA, 22 nt, Mycobacterium bovis subsp bovis AF2122/97
cucagcaucgccgagcucgagc

SEQ ID NO: 25903 - RNA, 22 nt, Mycobacterium bovis subsp bovis AF2122/97
cuccgcaguccuuuaggggaca

SEQ ID NO: 25904 - RNA, 22 nt, Mycobacterium bovis subsp bovis AF2122/97
cuccggugccggcaguagucgg

SEQ ID NO: 25905 - RNA, 22 nt, Mycobacterium bovis subsp bovis AF2122/97
cucgaguaccagcggauaccca

SEQ ID NO: 25906 - RNA, 22 nt, Mycobacterium bovis subsp bovis AF2122/97
cucggcggauucgguagcacuu

SEQ ID NO: 25907 - RNA, 22 nt, Mycobacterium bovis subsp bovis AF2122/97
cucggcggugacguugggcucc

SEQ ID NO: 25908 - RNA, 21 nt, Mycobacterium bovis subsp bovis AF2122/97
cucgggcgugaagcucgccga

SEQ ID NO: 25909 - RNA, 20 nt, Mycobacterium bovis subsp bovis AF2122/97
cucguccaggacggcaaguu

SEQ ID NO: 25910 - RNA, 22 nt, Mycobacterium bovis subsp bovis AF2122/97
cucugcgaccucggcgcgaaug

SEQ ID NO: 25911 - RNA, 22 nt, Mycobacterium bovis subsp bovis AF2122/97
cucugggaccuggaccggcgga

SEQ ID NO: 25912 - RNA, 22 nt, Mycobacterium bovis subsp bovis AF2122/97
cugacgucgaucucgaugcguc

SEQ ID NO: 25913 - RNA, 22 nt, Mycobacterium bovis subsp bovis AF2122/97
cugaucgcgucaucgaucgugc

SEQ ID NO: 25914 - RNA, 22 nt, Mycobacterium bovis subsp bovis AF2122/97
cugaugauccagcgcggcugcg

SEQ ID NO: 25915 - RNA, 22 nt, Mycobacterium bovis subsp bovis AF2122/97
cugauguagugggcggcggcgg

SEQ ID NO: 25916 - RNA, 22 nt, Mycobacterium bovis subsp bovis AF2122/97
cugccggacaugcgggugagug

SEQ ID NO: 25917 - RNA, 22 nt, Mycobacterium bovis subsp bovis AF2122/97
cugcgacugugaaucucacgac

SEQ ID NO: 25918 - RNA, 22 nt, Mycobacterium bovis subsp bovis AF2122/97
cugcgaucgaagagaucgugag

SEQ ID NO: 25919 - RNA, 22 nt, Mycobacterium bovis subsp bovis AF2122/97
cugcgauugguguuuccgccac

SEQ ID NO: 25920 - RNA, 22 nt, Mycobacterium bovis subsp bovis AF2122/97
cugcggagaucuaccagcucga

SEQ ID NO: 25921 - RNA, 22 nt, Mycobacterium bovis subsp bovis AF2122/97
cugcugcuaccgcggaucgugg

SEQ ID NO: 25922 - RNA, 22 nt, Mycobacterium bovis subsp bovis AF2122/97
cugcuggccagcguugcgcugu

SEQ ID NO: 25923 - RNA, 22 nt, Mycobacterium bovis subsp bovis AF2122/97
cuggacguuugagacggugauc

SEQ ID NO: 25924 - RNA, 22 nt, Mycobacterium bovis subsp bovis AF2122/97
cuggccgagcuggucaacggcg

SEQ ID NO: 25925 - RNA, 22 nt, Mycobacterium bovis subsp bovis AF2122/97
cuggcgcuguugggacgcccgu

SEQ ID NO: 25926 - RNA, 22 nt, Mycobacterium bovis subsp bovis AF2122/97
cuggcgguuuggcugcuguuga

SEQ ID NO: 25927 - RNA, 22 nt, Mycobacterium bovis subsp bovis AF2122/97
cuggcuugccuccugccgcgac

SEQ ID NO: 25928 - RNA, 22 nt, Mycobacterium bovis subsp bovis AF2122/97
cugggcauugaacgcgcgcugc

SEQ ID NO: 25929 - RNA, 22 nt, Mycobacterium bovis subsp bovis AF2122/97
cugggcgauccaucggggaugc

SEQ ID NO: 25930 - RNA, 22 nt, Mycobacterium bovis subsp bovis AF2122/97
cuggguucgacccaguccaagc

SEQ ID NO: 25931 - RNA, 22 nt, Mycobacterium bovis subsp bovis AF2122/97
cuggucgacgaguggaugaccg

SEQ ID NO: 25932 - RNA, 22 nt, Mycobacterium bovis subsp bovis AF2122/97
cuguacgugugccuggcgaccu

SEQ ID NO: 25933 - RNA, 22 nt, Mycobacterium bovis subsp bovis AF2122/97
cuguccgcgcgcacaccaacgg

SEQ ID NO: 25934 - RNA, 22 nt, Mycobacterium bovis subsp bovis AF2122/97
cugucguuguagaccggcccgu

SEQ ID NO: 25935 - RNA, 22 nt, Mycobacterium bovis subsp bovis AF2122/97
cuguggugucgacggacaugcu

SEQ ID NO: 25936 - RNA, 22 nt, Mycobacterium bovis subsp bovis AF2122/97
cuucccgacguuucguucggug

SEQ ID NO: 25937 - RNA, 22 nt, Mycobacterium bovis subsp bovis AF2122/97
cuucccggacaaguggcgcacc

SEQ ID NO: 25938 - RNA, 22 nt, Mycobacterium bovis subsp bovis AF2122/97
cuucgauacuggugcggaucug

SEQ ID NO: 25939 - RNA, 22 nt, Mycobacterium bovis subsp bovis AF2122/97
cuugcugguaugccgggccacc

SEQ ID NO: 25940 - RNA, 22 nt, Mycobacterium bovis subsp bovis AF2122/97
cuugggcguuugcguucgccgc

SEQ ID NO: 25941 - RNA, 22 nt, Mycobacterium bovis subsp bovis AF2122/97
cuuuacgaggcgacccgguuga

SEQ ID NO: 25942 - RNA, 22 nt, Mycobacterium bovis subsp bovis AF2122/97
gaaaaccuugcugccgaggcgg

SEQ ID NO: 25943 - RNA, 22 nt, Mycobacterium bovis subsp bovis AF2122/97
gaaaccgggcaccuugauggau

SEQ ID NO: 25944 - RNA, 22 nt, Mycobacterium bovis subsp bovis AF2122/97
gaaauugggcgauuuugcgucu

SEQ ID NO: 25945 - RNA, 22 nt, Mycobacterium bovis subsp bovis AF2122/97
gaaccuggcacggcgggcugca

SEQ ID NO: 25946 - RNA, 22 nt, Mycobacterium bovis subsp bovis AF2122/97
gaacgcgucggugggaucggug

SEQ ID NO: 25947 - RNA, 22 nt, Mycobacterium bovis subsp bovis AF2122/97
gaagacgcaaaagcuccuaaau

SEQ ID NO: 25948 - RNA, 22 nt, Mycobacterium bovis subsp bovis AF2122/97
gaagcgcucggguugcaacgua

SEQ ID NO: 25949 - RNA, 22 nt, Mycobacterium bovis subsp bovis AF2122/97
gaaucgcgaacacggcucccgc

SEQ ID NO: 25950 - RNA, 22 nt, Mycobacterium bovis subsp bovis AF2122/97
gacaaccguucugaugccgcgu

SEQ ID NO: 25951 - RNA, 22 nt, Mycobacterium bovis subsp bovis AF2122/97
gacaagggaucgauggccacgg

SEQ ID NO: 25952 - RNA, 22 nt, Mycobacterium bovis subsp bovis AF2122/97
gacaccgguguugacgaugccg

SEQ ID NO: 25953 - RNA, 22 nt, Mycobacterium bovis subsp bovis AF2122/97
gacaugaucgacccugccaucc

SEQ ID NO: 25954 - RNA, 22 nt, Mycobacterium bovis subsp bovis AF2122/97
gaccagcaccgcggcgaccgca

SEQ ID NO: 25955 - RNA, 22 nt, Mycobacterium bovis subsp bovis AF2122/97
gaccaucgaaucggugaucgac

SEQ ID NO: 25956 - RNA, 22 nt, Mycobacterium bovis subsp bovis AF2122/97
gaccaugcggggccggugccgu

SEQ ID NO: 25957 - RNA, 22 nt, Mycobacterium bovis subsp bovis AF2122/97
gaccauugcacgccuuugaggu

SEQ ID NO: 25958 - RNA, 22 nt, Mycobacterium bovis subsp bovis AF2122/97
gacccgauggaaguacccggca

SEQ ID NO: 25959 - RNA, 22 nt, Mycobacterium bovis subsp bovis AF2122/97
gacccgcggggauugcggcgga

SEQ ID NO: 25960 - RNA, 22 nt, Mycobacterium bovis subsp bovis AF2122/97
gaccggaaaccuaccagcaggc

SEQ ID NO: 25961 - RNA, 22 nt, Mycobacterium bovis subsp bovis AF2122/97
gaccggcucggcaagccgcugc

SEQ ID NO: 25962 - RNA, 21 nt, Mycobacterium bovis subsp bovis AF2122/97
gaccgggaugaacggguacga

SEQ ID NO: 25963 - RNA, 22 nt, Mycobacterium bovis subsp bovis AF2122/97
gaccguuuucgaugugcggguc

SEQ ID NO: 25964 - RNA, 22 nt, Mycobacterium bovis subsp bovis AF2122/97
gaccucaucggccaucgcugcg

SEQ ID NO: 25965 - RNA, 22 nt, Mycobacterium bovis subsp bovis AF2122/97
gacgagugccguugcggcgcac

SEQ ID NO: 25966 - RNA, 22 nt, Mycobacterium bovis subsp bovis AF2122/97
gacgccaucuaucugcucuaca

SEQ ID NO: 25967 - RNA, 22 nt, Mycobacterium bovis subsp bovis AF2122/97
gacgcgaaagaacaugaugggc

SEQ ID NO: 25968 - RNA, 22 nt, Mycobacterium bovis subsp bovis AF2122/97
gacgcgaguuggccguccuccu

SEQ ID NO: 25969 - RNA, 22 nt, Mycobacterium bovis subsp bovis AF2122/97
gacggcaucggccccggcgugc

SEQ ID NO: 25970 - RNA, 22 nt, Mycobacterium bovis subsp bovis AF2122/97
gacggcaugcccgcccagcugc

SEQ ID NO: 25971 - RNA, 22 nt, Mycobacterium bovis subsp bovis AF2122/97
gacggcggccugguugaugaac

SEQ ID NO: 25972 - RNA, 22 nt, Mycobacterium bovis subsp bovis AF2122/97
gacggcguugggugcaucggcg

SEQ ID NO: 25973 - RNA, 22 nt, Mycobacterium bovis subsp bovis AF2122/97
gacggggcacagucgucgagca

SEQ ID NO: 25974 - RNA, 22 nt, Mycobacterium bovis subsp bovis AF2122/97
gacggguguucccggaucggug

SEQ ID NO: 25975 - RNA, 22 nt, Mycobacterium bovis subsp bovis AF2122/97
gacgguagagaccggcacgccg

SEQ ID NO: 25976 - RNA, 19 nt, Mycobacterium bovis subsp bovis AF2122/97
gacguauucgauucccugc

SEQ ID NO: 25977 - RNA, 22 nt, Mycobacterium bovis subsp bovis AF2122/97
gacgucaagacgccggcgggca

SEQ ID NO: 25978 - RNA, 22 nt, Mycobacterium bovis subsp bovis AF2122/97
gacgucgucgcagccggccauc

SEQ ID NO: 25979 - RNA, 22 nt, Mycobacterium bovis subsp bovis AF2122/97
gacgugcgccagcugcaguaau

SEQ ID NO: 25980 - RNA, 22 nt, Mycobacterium bovis subsp bovis AF2122/97
gacugauccucgaugacaucgg

SEQ ID NO: 25981 - RNA, 22 nt, Mycobacterium bovis subsp bovis AF2122/97
gacugugaaucugacgacgcga

SEQ ID NO: 25982 - RNA, 22 nt, Mycobacterium bovis subsp bovis AF2122/97
gagaacugaacuccgccggccc

SEQ ID NO: 25983 - RNA, 22 nt, Mycobacterium bovis subsp bovis AF2122/97
gagaagaucaugccgcgggcga

SEQ ID NO: 25984 - RNA, 22 nt, Mycobacterium bovis subsp bovis AF2122/97
gagaccacagcaccgaccgacu

SEQ ID NO: 25985 - RNA, 22 nt, Mycobacterium bovis subsp bovis AF2122/97
gagaccuucgaccgauguucga

SEQ ID NO: 25986 - RNA, 22 nt, Mycobacterium bovis subsp bovis AF2122/97
gagacgcaaaaucgcccgaaaa

SEQ ID NO: 25987 - RNA, 22 nt, Mycobacterium bovis subsp bovis AF2122/97
gagcagaccguguugucgcugg

SEQ ID NO: 25988 - RNA, 22 nt, Mycobacterium bovis subsp bovis AF2122/97
gagcagacgcaaaagcccccau

SEQ ID NO: 25989 - RNA, 22 nt, Mycobacterium bovis subsp bovis AF2122/97
gagcagacgcaaaagcccccga

SEQ ID NO: 25990 - RNA, 22 nt, Mycobacterium bovis subsp bovis AF2122/97
gagcagacgcaaaaucgcccug

SEQ ID NO: 25991 - RNA, 22 nt, Mycobacterium bovis subsp bovis AF2122/97
gagcagacgcagaaucgcacaa

SEQ ID NO: 25992 - RNA, 22 nt, Mycobacterium bovis subsp bovis AF2122/97
gagcagacgcagaaucgcaccg

SEQ ID NO: 25993 - RNA, 22 nt, Mycobacterium bovis subsp bovis AF2122/97
gagcagacgcagaaucgcaucg

SEQ ID NO: 25994 - RNA, 22 nt, Mycobacterium bovis subsp bovis AF2122/97
gagcagacgcagaaucgcccau

SEQ ID NO: 25995 - RNA, 22 nt, Mycobacterium bovis subsp bovis AF2122/97
gagcagacgcgaaagcacccca

SEQ ID NO: 25996 - RNA, 22 nt, Mycobacterium bovis subsp bovis AF2122/97
gagccacgcaaaggguuagcgu

SEQ ID NO: 25997 - RNA, 22 nt, Mycobacterium bovis subsp bovis AF2122/97
gagccgggaagucgguagcccg

SEQ ID NO: 25998 - RNA, 22 nt, Mycobacterium bovis subsp bovis AF2122/97
gagccuguuccgcagcgaagac

SEQ ID NO: 25999 - RNA, 22 nt, Mycobacterium bovis subsp bovis AF2122/97
gagcgacaaagccagcgcgcca

SEQ ID NO: 26000 - RNA, 22 nt, Mycobacterium bovis subsp bovis AF2122/97
gagcgugaacugagggcggaga

SEQ ID NO: 26001 - RNA, 22 nt, Mycobacterium bovis subsp bovis AF2122/97
gagcugcuugggugggcgguca

SEQ ID NO: 26002 - RNA, 22 nt, Mycobacterium bovis subsp bovis AF2122/97
gagcuggguccaccggcguuug

SEQ ID NO: 26003 - RNA, 22 nt, Mycobacterium bovis subsp bovis AF2122/97
gaggaauucgcacccgcugccg

SEQ ID NO: 26004 - RNA, 22 nt, Mycobacterium bovis subsp bovis AF2122/97
gaggacgggucuugaccgaggc

SEQ ID NO: 26005 - RNA, 22 nt, Mycobacterium bovis subsp bovis AF2122/97
gaggagaugcuagaggcaacga

SEQ ID NO: 26006 - RNA, 22 nt, Mycobacterium bovis subsp bovis AF2122/97
gaggagguguaccggguagagg

SEQ ID NO: 26007 - RNA, 22 nt, Mycobacterium bovis subsp bovis AF2122/97
gaggcgcuguucgaggcggucg

SEQ ID NO: 26008 - RNA, 22 nt, Mycobacterium bovis subsp bovis AF2122/97
gagggacuuaugcgucugcuag

SEQ ID NO: 26009 - RNA, 22 nt, Mycobacterium bovis subsp bovis AF2122/97
gagguugugauccagugcggcg

SEQ ID NO: 26010 - RNA, 22 nt, Mycobacterium bovis subsp bovis AF2122/97
gaguaggcgcaaaagaacauga

SEQ ID NO: 26011 - RNA, 22 nt, Mycobacterium bovis subsp bovis AF2122/97
gagucagguacuccugcgucgg

SEQ ID NO: 26012 - RNA, 20 nt, Mycobacterium bovis subsp bovis AF2122/97
gaguggagucuggucggccg

SEQ ID NO: 26013 - RNA, 22 nt, Mycobacterium bovis subsp bovis AF2122/97
gaucaucauccucgacgauugg

SEQ ID NO: 26014 - RNA, 22 nt, Mycobacterium bovis subsp bovis AF2122/97
gauccgcccagauuugccggaa

SEQ ID NO: 26015 - RNA, 22 nt, Mycobacterium bovis subsp bovis AF2122/97
gaucgacaucagcacgccuugc

SEQ ID NO: 26016 - RNA, 22 nt, Mycobacterium bovis subsp bovis AF2122/97
gaucgccgauaucgacggccug

SEQ ID NO: 26017 - RNA, 22 nt, Mycobacterium bovis subsp bovis AF2122/97
gaucguugauccagccggccag

SEQ ID NO: 26018 - RNA, 22 nt, Mycobacterium bovis subsp bovis AF2122/97
gaucuuguucgguaccgguggc

SEQ ID NO: 26019 - RNA, 22 nt, Mycobacterium bovis subsp bovis AF2122/97
gaugacagcgaggugcacucgg

SEQ ID NO: 26020 - RNA, 22 nt, Mycobacterium bovis subsp bovis AF2122/97
gaugagaucaacgacgucgucc

SEQ ID NO: 26021 - RNA, 22 nt, Mycobacterium bovis subsp bovis AF2122/97
gaugcccgcacccgcuggucgu

SEQ ID NO: 26022 - RNA, 22 nt, Mycobacterium bovis subsp bovis AF2122/97
gaugccgacguggucggacugg

SEQ ID NO: 26023 - RNA, 22 nt, Mycobacterium bovis subsp bovis AF2122/97
gaugcuggagguguugagcacc

SEQ ID NO: 26024 - RNA, 22 nt, Mycobacterium bovis subsp bovis AF2122/97
gaugcugugcuacuggccguua

SEQ ID NO: 26025 - RNA, 22 nt, Mycobacterium bovis subsp bovis AF2122/97
gauggccuuucuguugcagggc

SEQ ID NO: 26026 - RNA, 22 nt, Mycobacterium bovis subsp bovis AF2122/97
gauggcgggucaucgcacccag

SEQ ID NO: 26027 - RNA, 22 nt, Mycobacterium bovis subsp bovis AF2122/97
gaugucaccgagcaucucagcg

SEQ ID NO: 26028 - RNA, 22 nt, Mycobacterium bovis subsp bovis AF2122/97
gauucgccgucauggguuggcu

SEQ ID NO: 26029 - RNA, 22 nt, Mycobacterium bovis subsp bovis AF2122/97
gcaaccguugcucgaguccaga

SEQ ID NO: 26030 - RNA, 22 nt, Mycobacterium bovis subsp bovis AF2122/97
gcaacggcgaguugauggcgau

SEQ ID NO: 26031 - RNA, 19 nt, Mycobacterium bovis subsp bovis AF2122/97
gcacaaacggcucgguucc

SEQ ID NO: 26032 - RNA, 22 nt, Mycobacterium bovis subsp bovis AF2122/97
gcaccgcaucgccgaacuuccg

SEQ ID NO: 26033 - RNA, 23 nt, Mycobacterium bovis subsp bovis AF2122/97
gcacgcgacaagcucguuugugg

SEQ ID NO: 26034 - RNA, 22 nt, Mycobacterium bovis subsp bovis AF2122/97
gcacggguucguugcugugcau

SEQ ID NO: 26035 - RNA, 22 nt, Mycobacterium bovis subsp bovis AF2122/97
gcacgucgucgcgggacaggua

SEQ ID NO: 26036 - RNA, 22 nt, Mycobacterium bovis subsp bovis AF2122/97
gcagacgcaaaagcucccaaau

SEQ ID NO: 26037 - RNA, 22 nt, Mycobacterium bovis subsp bovis AF2122/97
gcagacgcaaaaucgcccaaau

SEQ ID NO: 26038 - RNA, 22 nt, Mycobacterium bovis subsp bovis AF2122/97
gcagacucuuggucaugggcug

SEQ ID NO: 26039 - RNA, 22 nt, Mycobacterium bovis subsp bovis AF2122/97
gcagagccgaucguccuguugc

SEQ ID NO: 26040 - RNA, 22 nt, Mycobacterium bovis subsp bovis AF2122/97
gcagaucggaaucgucgucgac

SEQ ID NO: 26041 - RNA, 22 nt, Mycobacterium bovis subsp bovis AF2122/97
gcagaugauccucggcggugau

SEQ ID NO: 26042 - RNA, 22 nt, Mycobacterium bovis subsp bovis AF2122/97
gcaucgacauuaccggcguaau

SEQ ID NO: 26043 - RNA, 22 nt, Mycobacterium bovis subsp bovis AF2122/97
gcaucgcacuugagaucgagca

SEQ ID NO: 26044 - RNA, 22 nt, Mycobacterium bovis subsp bovis AF2122/97
gcaugcgauucugcgucugcuc

SEQ ID NO: 26045 - RNA, 22 nt, Mycobacterium bovis subsp bovis AF2122/97
gcaugcgcugcggcccggugac

SEQ ID NO: 26046 - RNA, 22 nt, Mycobacterium bovis subsp bovis AF2122/97
ugggggugaucaacgccagcaa

SEQ ID NO: 26047 - RNA, 23 nt, Mycobacterium bovis subsp bovis AF2122/97
uggguguucuccgacacgcugga

SEQ ID NO: 26048 - RNA, 22 nt, Mycobacterium bovis subsp bovis AF2122/97
uggguguucuccucgaccuugu

SEQ ID NO: 26049 - RNA, 22 nt, Mycobacterium bovis subsp bovis AF2122/97
ugguaggcaacaaacggcgggu

SEQ ID NO: 26050 - RNA, 22 nt, Mycobacterium bovis subsp bovis AF2122/97
uggucgaaaaagccgccguuuu

SEQ ID NO: 26051 - RNA, 23 nt, Mycobacterium bovis subsp bovis AF2122/97
uggucgaugcggucaaagcacgc

SEQ ID NO: 26052 - RNA, 21 nt, Mycobacterium bovis subsp bovis AF2122/97
uggugccgucggcguggacga

SEQ ID NO: 26053 - RNA, 22 nt, Mycobacterium bovis subsp bovis AF2122/97
uggugcgcagaccacgaucggc

SEQ ID NO: 26054 - RNA, 22 nt, Mycobacterium bovis subsp bovis AF2122/97
uggugcugccgguguugccgau

SEQ ID NO: 26055 - RNA, 18 nt, Mycobacterium bovis subsp bovis AF2122/97
ugguggaccgcuaucggc

SEQ ID NO: 26056 - RNA, 20 nt, Mycobacterium bovis subsp bovis AF2122/97
ugguggacgcagagucaacg

SEQ ID NO: 26057 - RNA, 22 nt, Mycobacterium bovis subsp bovis AF2122/97
ugguggacgcagagucaacgga

SEQ ID NO: 26058 - RNA, 20 nt, Mycobacterium bovis subsp bovis AF2122/97
ugguggacgcagagucagcg

SEQ ID NO: 26059 - RNA, 23 nt, Mycobacterium bovis subsp bovis AF2122/97
ugguggucaccccgacgacgcuc

SEQ ID NO: 26060 - RNA, 22 nt, Mycobacterium bovis subsp bovis AF2122/97
ugguguaacggucuugcauucg

SEQ ID NO: 26061 - RNA, 22 nt, Mycobacterium bovis subsp bovis AF2122/97
ugguuguccagaaucgauugcg

SEQ ID NO: 26062 - RNA, 22 nt, Mycobacterium bovis subsp bovis AF2122/97
uguaaccgaccgacgugccccg

SEQ ID NO: 26063 - RNA, 22 nt, Mycobacterium bovis subsp bovis AF2122/97
ugucaucuaccaauucggugau

SEQ ID NO: 26064 - RNA, 22 nt, Mycobacterium bovis subsp bovis AF2122/97
ugucccgcacucgauccgcaag

SEQ ID NO: 26065 - RNA, 22 nt, Mycobacterium bovis subsp bovis AF2122/97
uguccgaagacacgaaccuggc

SEQ ID NO: 26066 - RNA, 22 nt, Mycobacterium bovis subsp bovis AF2122/97
uguccgagagguugacggcacu

SEQ ID NO: 26067 - RNA, 22 nt, Mycobacterium bovis subsp bovis AF2122/97
uguccgauguggcggcggcggg

SEQ ID NO: 26068 - RNA, 22 nt, Mycobacterium bovis subsp bovis AF2122/97
ugucgcggcugaagagcucagu

SEQ ID NO: 26069 - RNA, 23 nt, Mycobacterium bovis subsp bovis AF2122/97
ugucggacgugucaagcgcggca

SEQ ID NO: 26070 - RNA, 22 nt, Mycobacterium bovis subsp bovis AF2122/97
ugucgggggcuuaugcgucugc

SEQ ID NO: 26071 - RNA, 22 nt, Mycobacterium bovis subsp bovis AF2122/97
ugucgggggcuuuugcgacugc

SEQ ID NO: 26072 - RNA, 22 nt, Mycobacterium bovis subsp bovis AF2122/97
ugucgggggcuuuugcgucuac

SEQ ID NO: 26073 - RNA, 22 nt, Mycobacterium bovis subsp bovis AF2122/97
ugucggucaaccuggcucgugu

SEQ ID NO: 26074 - RNA, 23 nt, Mycobacterium bovis subsp bovis AF2122/97
ugucguaugauucacgcucggcg

SEQ ID NO: 26075 - RNA, 22 nt, Mycobacterium bovis subsp bovis AF2122/97
ugucgucggcaugacgguggcu

SEQ ID NO: 26076 - RNA, 20 nt, Mycobacterium bovis subsp bovis AF2122/97
ugucuccggcgguguccauc

SEQ ID NO: 26077 - RNA, 22 nt, Mycobacterium bovis subsp bovis AF2122/97
ugugaucggguugcggaucgcc

SEQ ID NO: 26078 - RNA, 22 nt, Mycobacterium bovis subsp bovis AF2122/97
ugugcagccgauauugguuacu

SEQ ID NO: 26079 - RNA, 22 nt, Mycobacterium bovis subsp bovis AF2122/97
ugugcgacgacgauccggucau

SEQ ID NO: 26080 - RNA, 22 nt, Mycobacterium bovis subsp bovis AF2122/97
uguggccguagccgauguggcu

SEQ ID NO: 26081 - RNA, 22 nt, Mycobacterium bovis subsp bovis AF2122/97
uguguucuucugcgggcaacca

SEQ ID NO: 26082 - RNA, 22 nt, Mycobacterium bovis subsp bovis AF2122/97
uguuaucgacugauaaccgauu

SEQ ID NO: 26083 - RNA, 22 nt, Mycobacterium bovis subsp bovis AF2122/97
uguucgcagcuguugcacguuc

SEQ ID NO: 26084 - RNA, 22 nt, Mycobacterium bovis subsp bovis AF2122/97
uguucggcgccuucgcugucga

SEQ ID NO: 26085 - RNA, 22 nt, Mycobacterium bovis subsp bovis AF2122/97
uguugacucugcguccaccgga

SEQ ID NO: 26086 - RNA, 22 nt, Mycobacterium bovis subsp bovis AF2122/97
uguugcaggcccucaccgguca

SEQ ID NO: 26087 - RNA, 22 nt, Mycobacterium bovis subsp bovis AF2122/97
uuaguuaccaucguugcugaug

SEQ ID NO: 26088 - RNA, 22 nt, Mycobacterium bovis subsp bovis AF2122/97
uucacccagcgcgacgccgucg

SEQ ID NO: 26089 - RNA, 22 nt, Mycobacterium bovis subsp bovis AF2122/97
aacgccgacgguuggggugucg

SEQ ID NO: 26090 - RNA, 22 nt, Mycobacterium bovis subsp bovis AF2122/97
aacgcggugucggcggccugcc

SEQ ID NO: 26091 - RNA, 22 nt, Mycobacterium bovis subsp bovis AF2122/97
aacggccuggcggccgcgucga

SEQ ID NO: 26092 - RNA, 22 nt, Mycobacterium bovis subsp bovis AF2122/97
aacggugaggagaucgcggcca

SEQ ID NO: 26093 - RNA, 22 nt, Mycobacterium bovis subsp bovis AF2122/97
aacucgacgugcaucccgguga

SEQ ID NO: 26094 - RNA, 22 nt, Mycobacterium bovis subsp bovis AF2122/97
aacucgccaucgcgugggcgaa

SEQ ID NO: 26095 - RNA, 22 nt, Mycobacterium bovis subsp bovis AF2122/97
aacuggccgugcucggcccgcu

SEQ ID NO: 26096 - RNA, 22 nt, Mycobacterium bovis subsp bovis AF2122/97
aagaccucacggcgcucggcca

SEQ ID NO: 26097 - RNA, 22 nt, Mycobacterium bovis subsp bovis AF2122/97
aagacgcggucgacgacgcccu

SEQ ID NO: 26098 - RNA, 22 nt, Mycobacterium bovis subsp bovis AF2122/97
acgggaccccgcgcaucgaagg

SEQ ID NO: 26099 - RNA, 22 nt, Mycobacterium bovis subsp bovis AF2122/97
acggggugcgcaucgccaucga

SEQ ID NO: 26100 - RNA, 22 nt, Mycobacterium bovis subsp bovis AF2122/97
acgggugaacugcacgcggugu

SEQ ID NO: 26101 - RNA, 18 nt, Mycobacterium bovis subsp bovis AF2122/97
acggguucuccggcggca

SEQ ID NO: 26102 - RNA, 22 nt, Mycobacterium bovis subsp bovis AF2122/97
acggguugccggcacaucgcgc

SEQ ID NO: 26103 - RNA, 22 nt, Mycobacterium bovis subsp bovis AF2122/97
acggucgccaaccuggcgagca

SEQ ID NO: 26104 - RNA, 22 nt, Mycobacterium bovis subsp bovis AF2122/97
acggucgggcgccaucgacgcc

SEQ ID NO: 26105 - RNA, 22 nt, Mycobacterium bovis subsp bovis AF2122/97
acggugcggccacgaucuggga

SEQ ID NO: 26106 - RNA, 22 nt, Mycobacterium bovis subsp bovis AF2122/97
acguacggauauacugaacgca

SEQ ID NO: 26107 - RNA, 22 nt, Mycobacterium bovis subsp bovis AF2122/97
acgucgaagacgaucaggcguu

SEQ ID NO: 26108 - RNA, 22 nt, Mycobacterium bovis subsp bovis AF2122/97
acgucgcggugcuguucgugga

SEQ ID NO: 26109 - RNA, 20 nt, Mycobacterium bovis subsp bovis AF2122/97
acgugaccagaucaccgacc

SEQ ID NO: 26110 - RNA, 22 nt, Mycobacterium bovis subsp bovis AF2122/97
acgugcugcgcggggcacccgg

SEQ ID NO: 26111 - RNA, 22 nt, Mycobacterium bovis subsp bovis AF2122/97
acguucuccauauaugccaaca

SEQ ID NO: 26112 - RNA, 22 nt, Mycobacterium bovis subsp bovis AF2122/97
acuacgucggugauuugguugc

SEQ ID NO: 26113 - RNA, 22 nt, Mycobacterium bovis subsp bovis AF2122/97
acuccucagccggcggcccugg

SEQ ID NO: 26114 - RNA, 22 nt, Mycobacterium bovis subsp bovis AF2122/97
acugcccagcgauuucgaccgu

SEQ ID NO: 26115 - RNA, 22 nt, Mycobacterium bovis subsp bovis AF2122/97
acugcgaccggugugcgcgccg

SEQ ID NO: 26116 - RNA, 22 nt, Mycobacterium bovis subsp bovis AF2122/97
acugcgcccggcgcuggccucc

SEQ ID NO: 26117 - RNA, 22 nt, Mycobacterium bovis subsp bovis AF2122/97
acugcguugcaugaccgacggu

SEQ ID NO: 26118 - RNA, 22 nt, Mycobacterium bovis subsp bovis AF2122/97
acuggggcacggcacgcccgaa

SEQ ID NO: 26119 - RNA, 22 nt, Mycobacterium bovis subsp bovis AF2122/97
acuggguuccggcaucgaucgc

SEQ ID NO: 26120 - RNA, 22 nt, Mycobacterium bovis subsp bovis AF2122/97
agaccuagccggcucgccggac

SEQ ID NO: 26121 - RNA, 22 nt, Mycobacterium bovis subsp bovis AF2122/97
agacgcauaagcccccgacacg

SEQ ID NO: 26122 - RNA, 22 nt, Mycobacterium bovis subsp bovis AF2122/97
agacgcuguugucgcgcccguu

SEQ ID NO: 26123 - RNA, 19 nt, Mycobacterium bovis subsp bovis AF2122/97
agaguuacagccucagcga

SEQ ID NO: 26124 - RNA, 22 nt, Mycobacterium bovis subsp bovis AF2122/97
agcaccgucgaauccgcggcuu

SEQ ID NO: 26125 - RNA, 22 nt, Mycobacterium bovis subsp bovis AF2122/97
agcagacgcaaaagcccccuaa

SEQ ID NO: 26126 - RNA, 22 nt, Mycobacterium bovis subsp bovis AF2122/97
agcagacgcaaaaugcccccga

SEQ ID NO: 26127 - RNA, 22 nt, Mycobacterium bovis subsp bovis AF2122/97
agcagacgcagaaucgcccaau

SEQ ID NO: 26128 - RNA, 22 nt, Mycobacterium bovis subsp bovis AF2122/97
agcagacguaaaagcccccauu

SEQ ID NO: 26129 - RNA, 22 nt, Mycobacterium bovis subsp bovis AF2122/97
agcagacguaaaagcccccgca

SEQ ID NO: 26130 - RNA, 22 nt, Mycobacterium bovis subsp bovis AF2122/97
agcagucgcaaaagcccccgca

SEQ ID NO: 26131 - RNA, 22 nt, Mycobacterium bovis subsp bovis AF2122/97
agcagucggcaccuggcugguc

SEQ ID NO: 26132 - RNA, 22 nt, Mycobacterium bovis subsp bovis AF2122/97
agccaagccguaguccucgacg

SEQ ID NO: 26133 - RNA, 22 nt, Mycobacterium bovis subsp bovis AF2122/97
agccacaacgacgugcgccuac

SEQ ID NO: 26134 - RNA, 22 nt, Mycobacterium bovis subsp bovis AF2122/97
agccaccgucaugccgacgaca

SEQ ID NO: 26135 - RNA, 22 nt, Mycobacterium bovis subsp bovis AF2122/97
agcccaacaccugccacgacga

SEQ ID NO: 26136 - RNA, 22 nt, Mycobacterium bovis subsp bovis AF2122/97
agccggacuugccgcugcggcg

SEQ ID NO: 26137 - RNA, 22 nt, Mycobacterium bovis subsp bovis AF2122/97
agccggagucaccgaaaucacu

SEQ ID NO: 26138 - RNA, 22 nt, Mycobacterium bovis subsp bovis AF2122/97
agccggcuggugaccacgauca

SEQ ID NO: 26139 - RNA, 22 nt, Mycobacterium bovis subsp bovis AF2122/97
agccgggcaucuggaaguggcu

SEQ ID NO: 26140 - RNA, 22 nt, Mycobacterium bovis subsp bovis AF2122/97
agccgggucgccaggugcuggu

SEQ ID NO: 26141 - RNA, 22 nt, Mycobacterium bovis subsp bovis AF2122/97
agccugcugggcgccgacgguu

SEQ ID NO: 26142 - RNA, 22 nt, Mycobacterium bovis subsp bovis AF2122/97
agccuugcggacggcacagcug

SEQ ID NO: 26143 - RNA, 20 nt, Mycobacterium bovis subsp bovis AF2122/97
agccuuuguuccggaagcag

SEQ ID NO: 26144 - RNA, 20 nt, Mycobacterium bovis subsp bovis AF2122/97
agcgacuucauggccugguu

SEQ ID NO: 26145 - RNA, 22 nt, Mycobacterium bovis subsp bovis AF2122/97
agcgcgcacuacugccucgccc

SEQ ID NO: 26146 - RNA, 22 nt, Mycobacterium bovis subsp bovis AF2122/97
agcgcggugcgcuccaagguaa

SEQ ID NO: 26147 - RNA, 22 nt, Mycobacterium bovis subsp bovis AF2122/97
agcggcacugugucgggcgcga

SEQ ID NO: 26148 - RNA, 22 nt, Mycobacterium bovis subsp bovis AF2122/97
agcggcucaaacaggaugugcc

SEQ ID NO: 26149 - RNA, 22 nt, Mycobacterium bovis subsp bovis AF2122/97
agcgggaaccuguugggggcca

SEQ ID NO: 26150 - RNA, 22 nt, Mycobacterium bovis subsp bovis AF2122/97
agcgucucggcggcguugcaga

SEQ ID NO: 26151 - RNA, 19 nt, Mycobacterium bovis subsp bovis AF2122/97
agcucgagugccgucguug

SEQ ID NO: 26152 - RNA, 22 nt, Mycobacterium bovis subsp bovis AF2122/97
agcucgccguggcguuacgcuc

SEQ ID NO: 26153 - RNA, 22 nt, Mycobacterium bovis subsp bovis AF2122/97
agcugcgacgggccgggcugga

SEQ ID NO: 26154 - RNA, 22 nt, Mycobacterium bovis subsp bovis AF2122/97
agcugcuucuccccuuggucga

SEQ ID NO: 26155 - RNA, 22 nt, Mycobacterium bovis subsp bovis AF2122/97
aggaccguuucgauuuugacag

SEQ ID NO: 26156 - RNA, 22 nt, Mycobacterium bovis subsp bovis AF2122/97
aggacguugucggggcgccgaa

SEQ ID NO: 26157 - RNA, 22 nt, Mycobacterium bovis subsp bovis AF2122/97
aggcaaucagucaggucgcuau

SEQ ID NO: 26158 - RNA, 22 nt, Mycobacterium bovis subsp bovis AF2122/97
aggcccgucgguuggcgauggu

SEQ ID NO: 26159 - RNA, 22 nt, Mycobacterium bovis subsp bovis AF2122/97
agguagagcagcaucagcgcgu

SEQ ID NO: 26160 - RNA, 22 nt, Mycobacterium bovis subsp bovis AF2122/97
agguccaggaauucggcgaccc

SEQ ID NO: 26161 - RNA, 22 nt, Mycobacterium bovis subsp bovis AF2122/97
aggucgacggguucgauggacu

SEQ ID NO: 26162 - RNA, 22 nt, Mycobacterium bovis subsp bovis AF2122/97
aggucggcguaugggaaguacc

SEQ ID NO: 26163 - RNA, 22 nt, Mycobacterium bovis subsp bovis AF2122/97
aaacugcaaccacgcaccgaug

SEQ ID NO: 26164 - RNA, 22 nt, Mycobacterium bovis subsp bovis AF2122/97
aaagacgcaaaagcucccaaau

SEQ ID NO: 26165 - RNA, 22 nt, Mycobacterium bovis subsp bovis AF2122/97
aaagccccggggaccgucgaug

SEQ ID NO: 26166 - RNA, 22 nt, Mycobacterium bovis subsp bovis AF2122/97
aaagcggucaaggacgcguucg

SEQ ID NO: 26167 - RNA, 22 nt, Mycobacterium bovis subsp bovis AF2122/97
aaaugggcgcuuaugcgucugc

SEQ ID NO: 26168 - RNA, 22 nt, Mycobacterium bovis subsp bovis AF2122/97
aaauggggugcuuuugcgucug

SEQ ID NO: 26169 - RNA, 22 nt, Mycobacterium bovis subsp bovis AF2122/97
aacaccgccgccgggcacuggc

SEQ ID NO: 26170 - RNA, 22 nt, Mycobacterium bovis subsp bovis AF2122/97
aacacgaccagccaggcauagg

SEQ ID NO: 26171 - RNA, 22 nt, Mycobacterium bovis subsp bovis AF2122/97
aacacgucggcgcgcugcaggg

SEQ ID NO: 26172 - RNA, 22 nt, Mycobacterium bovis subsp bovis AF2122/97
aacagcgcaucgaucggugaca

SEQ ID NO: 26173 - RNA, 22 nt, Mycobacterium bovis subsp bovis AF2122/97
aacaggcgggauucgccgauca

SEQ ID NO: 26174 - RNA, 22 nt, Mycobacterium bovis subsp bovis AF2122/97
aacaucacggugugcgucggcg

SEQ ID NO: 26175 - RNA, 22 nt, Mycobacterium bovis subsp bovis AF2122/97
aaccgagcggccagcaccugca

SEQ ID NO: 26176 - RNA, 22 nt, Mycobacterium bovis subsp bovis AF2122/97
aaccggcuguccagggccaucu

SEQ ID NO: 26177 - RNA, 22 nt, Mycobacterium bovis subsp bovis AF2122/97
aaccggugcaacaacgcacgcu

SEQ ID NO: 26178 - RNA, 22 nt, Mycobacterium bovis subsp bovis AF2122/97
aacgagugcuggguggcagcga

SEQ ID NO: 26179 - RNA, 22 nt, Mycobacterium bovis subsp bovis AF2122/97
ccagauacugcagggaaucggg

SEQ ID NO: 26180 - RNA, 22 nt, Mycobacterium bovis subsp bovis AF2122/97
ccagcucaucgccguagcugag

SEQ ID NO: 26181 - RNA, 22 nt, Mycobacterium bovis subsp bovis AF2122/97
ccagcugggugcugccgcuguc

SEQ ID NO: 26182 - RNA, 22 nt, Mycobacterium bovis subsp bovis AF2122/97
ccaggcucagcgggguaacauc

SEQ ID NO: 26183 - RNA, 22 nt, Mycobacterium bovis subsp bovis AF2122/97
ccagucggcgcgcucgccggug

SEQ ID NO: 26184 - RNA, 22 nt, Mycobacterium bovis subsp bovis AF2122/97
ccaucagggcgaagguguggcu

SEQ ID NO: 26185 - RNA, 22 nt, Mycobacterium bovis subsp bovis AF2122/97
ccaucgacuugcugcagcuggc

SEQ ID NO: 26186 - RNA, 22 nt, Mycobacterium bovis subsp bovis AF2122/97
ccaugagcacccggauggccug

SEQ ID NO: 26187 - RNA, 23 nt, Mycobacterium bovis subsp bovis AF2122/97
ccaugucgacgugaucgcugugg

SEQ ID NO: 26188 - RNA, 22 nt, Mycobacterium bovis subsp bovis AF2122/97
cccaaaccagccuccugcuucg

SEQ ID NO: 26189 - RNA, 22 nt, Mycobacterium bovis subsp bovis AF2122/97
cccagcaccugccaggacgggc

SEQ ID NO: 26190 - RNA, 22 nt, Mycobacterium bovis subsp bovis AF2122/97
cccagcuuggugucgcgagcau

SEQ ID NO: 26191 - RNA, 22 nt, Mycobacterium bovis subsp bovis AF2122/97
cccaggaacgggacgccgugug

SEQ ID NO: 26192 - RNA, 22 nt, Mycobacterium bovis subsp bovis AF2122/97
cccaggugcagugugcaccacg

SEQ ID NO: 26193 - RNA, 22 nt, Mycobacterium bovis subsp bovis AF2122/97
cccccacucaaagcggguucuc

SEQ ID NO: 26194 - RNA, 22 nt, Mycobacterium bovis subsp bovis AF2122/97
ccccggcgcgcacgucgggagu

SEQ ID NO: 26195 - RNA, 22 nt, Mycobacterium bovis subsp bovis AF2122/97
ccccguccgaagugaugcccgc

SEQ ID NO: 26196 - RNA, 22 nt, Mycobacterium bovis subsp bovis AF2122/97
ccccuucgaagaagucgggcgc

SEQ ID NO: 26197 - RNA, 22 nt, Mycobacterium bovis subsp bovis AF2122/97
cccgaagacgaccccggugaca

SEQ ID NO: 26198 - RNA, 22 nt, Mycobacterium bovis subsp bovis AF2122/97
cccgauccacggugaccagggg

SEQ ID NO: 26199 - RNA, 22 nt, Mycobacterium bovis subsp bovis AF2122/97
cccgcgucaucagcgcaccgcc

SEQ ID NO: 26200 - RNA, 22 nt, Mycobacterium bovis subsp bovis AF2122/97
cccggcggcuuugcucgcccag

SEQ ID NO: 26201 - RNA, 22 nt, Mycobacterium bovis subsp bovis AF2122/97
cccggcuccucagcgggccgcu

SEQ ID NO: 26202 - RNA, 22 nt, Mycobacterium bovis subsp bovis AF2122/97
cccggcucucuucgcgcgcugg

SEQ ID NO: 26203 - RNA, 22 nt, Mycobacterium bovis subsp bovis AF2122/97
cccgggucggcacgacccggga

SEQ ID NO: 26204 - RNA, 22 nt, Mycobacterium bovis subsp bovis AF2122/97
cccggguuugaccacgaugcug

SEQ ID NO: 26205 - RNA, 22 nt, Mycobacterium bovis subsp bovis AF2122/97
cccggugagcugaucuucguga

SEQ ID NO: 26206 - RNA, 22 nt, Mycobacterium bovis subsp bovis AF2122/97
cccgguguugaagaagcccgac

SEQ ID NO: 26207 - RNA, 22 nt, Mycobacterium bovis subsp bovis AF2122/97
cccgguugaccgaagccggacu

SEQ ID NO: 26208 - RNA, 22 nt, Mycobacterium bovis subsp bovis AF2122/97
cccgucguacggcuggaucugg

SEQ ID NO: 26209 - RNA, 19 nt, Mycobacterium bovis subsp bovis AF2122/97
cccguuccaaacucaagug

SEQ ID NO: 26210 - RNA, 22 nt, Mycobacterium bovis subsp bovis AF2122/97
cccuaucuggucgcacgaggcg

SEQ ID NO: 26211 - RNA, 19 nt, Mycobacterium bovis subsp bovis AF2122/97
cccugcgaccuacgacuga

SEQ ID NO: 26212 - RNA, 22 nt, Mycobacterium bovis subsp bovis AF2122/97
cccugcuggagaucugcgcggu

SEQ ID NO: 26213 - RNA, 22 nt, Mycobacterium bovis subsp bovis AF2122/97
ccgaacgugaacucacggcgga

SEQ ID NO: 26214 - RNA, 22 nt, Mycobacterium bovis subsp bovis AF2122/97
ccgaacgugaacugagggcgga

SEQ ID NO: 26215 - RNA, 22 nt, Mycobacterium bovis subsp bovis AF2122/97
ccgaacgugcaaccacggcggc

SEQ ID NO: 26216 - RNA, 20 nt, Mycobacterium bovis subsp bovis AF2122/97
ccgaagcacugaucgcagcg

SEQ ID NO: 26217 - RNA, 22 nt, Mycobacterium bovis subsp bovis AF2122/97
ccgaauuggcggccguuagcca

SEQ ID NO: 26218 - RNA, 22 nt, Mycobacterium bovis subsp bovis AF2122/97
ccgaccaccgcgaugcguuugc

SEQ ID NO: 26219 - RNA, 22 nt, Mycobacterium bovis subsp bovis AF2122/97
ccgacccgcaucacggauauuc

SEQ ID NO: 26220 - RNA, 22 nt, Mycobacterium bovis subsp bovis AF2122/97
ccgacccuggcgaagcgaccgg

SEQ ID NO: 26221 - RNA, 23 nt, Mycobacterium bovis subsp bovis AF2122/97
ccgacgacuaccagcucaccgag

SEQ ID NO: 26222 - RNA, 22 nt, Mycobacterium bovis subsp bovis AF2122/97
ccgacggugcugcggacaucga

SEQ ID NO: 26223 - RNA, 22 nt, Mycobacterium bovis subsp bovis AF2122/97
ccgacgugagggucaugucgau

SEQ ID NO: 26224 - RNA, 22 nt, Mycobacterium bovis subsp bovis AF2122/97
ccgacuaccggcacucgccgau

SEQ ID NO: 26225 - RNA, 22 nt, Mycobacterium bovis subsp bovis AF2122/97
ccgagacugacguuuugcagug

SEQ ID NO: 26226 - RNA, 22 nt, Mycobacterium bovis subsp bovis AF2122/97
ccgagcaacaggaccgcuuccu

SEQ ID NO: 26227 - RNA, 20 nt, Mycobacterium bovis subsp bovis AF2122/97
ccgagcuggaagugucggcc

SEQ ID NO: 26228 - RNA, 22 nt, Mycobacterium bovis subsp bovis AF2122/97
ccgagcuggucgccucguccag

SEQ ID NO: 26229 - RNA, 22 nt, Mycobacterium bovis subsp bovis AF2122/97
ccgagcuuggccgccgccaccu

SEQ ID NO: 26230 - RNA, 22 nt, Mycobacterium bovis subsp bovis AF2122/97
ccgaggccgcguucgaguacgc

SEQ ID NO: 26231 - RNA, 22 nt, Mycobacterium bovis subsp bovis AF2122/97
ccgaucaaugggcgcccgguca

SEQ ID NO: 26232 - RNA, 22 nt, Mycobacterium bovis subsp bovis AF2122/97
ccgaucauuucggugauuccgg

SEQ ID NO: 26233 - RNA, 22 nt, Mycobacterium bovis subsp bovis AF2122/97
ccgauggucugccguacaccca

SEQ ID NO: 26234 - RNA, 22 nt, Mycobacterium bovis subsp bovis AF2122/97
ccgauguugccgcugccgaugu

SEQ ID NO: 26235 - RNA, 22 nt, Mycobacterium bovis subsp bovis AF2122/97
ccgauugugaaucugacgacgc

SEQ ID NO: 26236 - RNA, 22 nt, Mycobacterium bovis subsp bovis AF2122/97
ccgcaacaucugcgcgaugugc

SEQ ID NO: 26237 - RNA, 22 nt, Mycobacterium bovis subsp bovis AF2122/97
ccgcaccagcacgccucguugc

SEQ ID NO: 26238 - RNA, 22 nt, Mycobacterium bovis subsp bovis AF2122/97
ccgcacggucacggugccggcc

SEQ ID NO: 26239 - RNA, 22 nt, Mycobacterium bovis subsp bovis AF2122/97
ccgcaggccgagcugcucccga

SEQ ID NO: 26240 - RNA, 22 nt, Mycobacterium bovis subsp bovis AF2122/97
ccgcagguguucggcgaccaga

SEQ ID NO: 26241 - RNA, 20 nt, Mycobacterium bovis subsp bovis AF2122/97
ccgcaucgacaacaccgccg

SEQ ID NO: 26242 - RNA, 22 nt, Mycobacterium bovis subsp bovis AF2122/97
ccgcauuugaucgccuccgggg

SEQ ID NO: 26243 - RNA, 22 nt, Mycobacterium bovis subsp bovis AF2122/97
ccgccagcagcugacgcgccac

SEQ ID NO: 26244 - RNA, 22 nt, Mycobacterium bovis subsp bovis AF2122/97
ccgcccgggugcgccguagcug

SEQ ID NO: 26245 - RNA, 22 nt, Mycobacterium bovis subsp bovis AF2122/97
aggucugucggaccuggccgcg

SEQ ID NO: 26246 - RNA, 22 nt, Mycobacterium bovis subsp bovis AF2122/97
agguggcagauguugcgcucgc

SEQ ID NO: 26247 - RNA, 22 nt, Mycobacterium bovis subsp bovis AF2122/97
agguguucuucaacgaugucuu

SEQ ID NO: 26248 - RNA, 22 nt, Mycobacterium bovis subsp bovis AF2122/97
agguucagcgucgagucgagga

SEQ ID NO: 26249 - RNA, 23 nt, Mycobacterium bovis subsp bovis AF2122/97
agguugccgaugcguaugguguc

SEQ ID NO: 26250 - RNA, 22 nt, Mycobacterium bovis subsp bovis AF2122/97
agguuggcgccggggugcagag

SEQ ID NO: 26251 - RNA, 22 nt, Mycobacterium bovis subsp bovis AF2122/97
agguuggugccgccacgcuuga

SEQ ID NO: 26252 - RNA, 22 nt, Mycobacterium bovis subsp bovis AF2122/97
aguacggccccguguccggcuc

SEQ ID NO: 26253 - RNA, 22 nt, Mycobacterium bovis subsp bovis AF2122/97
agucagcggugcgaauggcugg

SEQ ID NO: 26254 - RNA, 22 nt, Mycobacterium bovis subsp bovis AF2122/97
aguccugggccaacugccggua

SEQ ID NO: 26255 - RNA, 22 nt, Mycobacterium bovis subsp bovis AF2122/97
agucgcauaagcccccgacacg

SEQ ID NO: 26256 - RNA, 22 nt, Mycobacterium bovis subsp bovis AF2122/97
agucggccagguacggcaucag

SEQ ID NO: 26257 - RNA, 22 nt, Mycobacterium bovis subsp bovis AF2122/97
agucggcucccuucaucaauuc

SEQ ID NO: 26258 - RNA, 22 nt, Mycobacterium bovis subsp bovis AF2122/97
agucggcucgagcaacaccgug

SEQ ID NO: 26259 - RNA, 22 nt, Mycobacterium bovis subsp bovis AF2122/97
agucuuggugaccguccgguac

SEQ ID NO: 26260 - RNA, 22 nt, Mycobacterium bovis subsp bovis AF2122/97
agugccgcguucaugucggcau

SEQ ID NO: 26261 - RNA, 22 nt, Mycobacterium bovis subsp bovis AF2122/97
agugcgacucugcgucugcuca

SEQ ID NO: 26262 - RNA, 22 nt, Mycobacterium bovis subsp bovis AF2122/97
aguggcgaaggucggcuucacc

SEQ ID NO: 26263 - RNA, 22 nt, Mycobacterium bovis subsp bovis AF2122/97
aguuugucgggaucuugaccaa

SEQ ID NO: 26264 - RNA, 22 nt, Mycobacterium bovis subsp bovis AF2122/97
auaccgcgaucgcuuuggccgc

SEQ ID NO: 26265 - RNA, 19 nt, Mycobacterium bovis subsp bovis AF2122/97
auagcccuggaucgccgcc

SEQ ID NO: 26266 - RNA, 22 nt, Mycobacterium bovis subsp bovis AF2122/97
auaucgagucugcguccagggu

SEQ ID NO: 26267 - RNA, 22 nt, Mycobacterium bovis subsp bovis AF2122/97
aucaacacgcugcuguuguaca

SEQ ID NO: 26268 - RNA, 22 nt, Mycobacterium bovis subsp bovis AF2122/97
aucacgguggggcaucggcggc

SEQ ID NO: 26269 - RNA, 22 nt, Mycobacterium bovis subsp bovis AF2122/97
aucacgucgacaugggguucgg

SEQ ID NO: 26270 - RNA, 22 nt, Mycobacterium bovis subsp bovis AF2122/97
aucagcagcgugguugccgcgu

SEQ ID NO: 26271 - RNA, 22 nt, Mycobacterium bovis subsp bovis AF2122/97
aucagcuuuauuucgccucggg

SEQ ID NO: 26272 - RNA, 20 nt, Mycobacterium bovis subsp bovis AF2122/97
aucaggccggcugcccccgc

SEQ ID NO: 26273 - RNA, 22 nt, Mycobacterium bovis subsp bovis AF2122/97
auccaccggccagcauuuccuc

SEQ ID NO: 26274 - RNA, 22 nt, Mycobacterium bovis subsp bovis AF2122/97
auccgggugcugaucgccggua

SEQ ID NO: 26275 - RNA, 22 nt, Mycobacterium bovis subsp bovis AF2122/97
aucgaggaaugcgccgcguacg

SEQ ID NO: 26276 - RNA, 22 nt, Mycobacterium bovis subsp bovis AF2122/97
aucgcagccacggaguucgauu

SEQ ID NO: 26277 - RNA, 22 nt, Mycobacterium bovis subsp bovis AF2122/97
aucgccaucgugcugcaauugc

SEQ ID NO: 26278 - RNA, 22 nt, Mycobacterium bovis subsp bovis AF2122/97
aucgccggugaccgcugacccc

SEQ ID NO: 26279 - RNA, 22 nt, Mycobacterium bovis subsp bovis AF2122/97
aucgccgucgcgugcgaccugc

SEQ ID NO: 26280 - RNA, 22 nt, Mycobacterium bovis subsp bovis AF2122/97
aucgcgaugaugcugccccgca

SEQ ID NO: 26281 - RNA, 22 nt, Mycobacterium bovis subsp bovis AF2122/97
aucgcggcagcaugucgucaac

SEQ ID NO: 26282 - RNA, 22 nt, Mycobacterium bovis subsp bovis AF2122/97
aucgcggcgguguugucgaugc

SEQ ID NO: 26283 - RNA, 22 nt, Mycobacterium bovis subsp bovis AF2122/97
aucgcguccugcgcggaaucgg

SEQ ID NO: 26284 - RNA, 22 nt, Mycobacterium bovis subsp bovis AF2122/97
aucggcgaguagccgucgcaca

SEQ ID NO: 26285 - RNA, 22 nt, Mycobacterium bovis subsp bovis AF2122/97
aucggcgugcaagcgguguccg

SEQ ID NO: 26286 - RNA, 22 nt, Mycobacterium bovis subsp bovis AF2122/97
aucggcuuucccgccgcccgag

SEQ ID NO: 26287 - RNA, 22 nt, Mycobacterium bovis subsp bovis AF2122/97
aucgucaacgucggccagcgcg

SEQ ID NO: 26288 - RNA, 22 nt, Mycobacterium bovis subsp bovis AF2122/97
aucgugguggaggagaaccgcu

SEQ ID NO: 26289 - RNA, 22 nt, Mycobacterium bovis subsp bovis AF2122/97
aucugcagguuccuggguugac

SEQ ID NO: 26290 - RNA, 22 nt, Mycobacterium bovis subsp bovis AF2122/97
aucuggacgugcacgccaacgg

SEQ ID NO: 26291 - RNA, 22 nt, Mycobacterium bovis subsp bovis AF2122/97
augccagcgcgaagaccgccag

SEQ ID NO: 26292 - RNA, 19 nt, Mycobacterium bovis subsp bovis AF2122/97
augcccugucgcuguaucg

SEQ ID NO: 26293 - RNA, 22 nt, Mycobacterium bovis subsp bovis AF2122/97
augccgaggguauccugcggcc

SEQ ID NO: 26294 - RNA, 22 nt, Mycobacterium bovis subsp bovis AF2122/97
augccgaugguggugaucaucg

SEQ ID NO: 26295 - RNA, 22 nt, Mycobacterium bovis subsp bovis AF2122/97
augccgcccggguugaagccac

SEQ ID NO: 26296 - RNA, 22 nt, Mycobacterium bovis subsp bovis AF2122/97
augcgcacgaauugcugguggc

SEQ ID NO: 26297 - RNA, 22 nt, Mycobacterium bovis subsp bovis AF2122/97
augcucggggcccggugaucgc

SEQ ID NO: 26298 - RNA, 22 nt, Mycobacterium bovis subsp bovis AF2122/97
augcugccggcauugaccacau

SEQ ID NO: 26299 - RNA, 22 nt, Mycobacterium bovis subsp bovis AF2122/97
auggauggcgaggcguuguggu

SEQ ID NO: 26300 - RNA, 22 nt, Mycobacterium bovis subsp bovis AF2122/97
auggccaaccucccgacuggua

SEQ ID NO: 26301 - RNA, 22 nt, Mycobacterium bovis subsp bovis AF2122/97
auggccgcgugugcaaguagcg

SEQ ID NO: 26302 - RNA, 22 nt, Mycobacterium bovis subsp bovis AF2122/97
auggcgaacgaugccggcgguc

SEQ ID NO: 26303 - RNA, 22 nt, Mycobacterium bovis subsp bovis AF2122/97
auggcguucgucggcugcggcg

SEQ ID NO: 26304 - RNA, 22 nt, Mycobacterium bovis subsp bovis AF2122/97
auggcugaacgggcgccacgcg

SEQ ID NO: 26305 - RNA, 22 nt, Mycobacterium bovis subsp bovis AF2122/97
auggguucgaacguccaggugg

SEQ ID NO: 26306 - RNA, 22 nt, Mycobacterium bovis subsp bovis AF2122/97
auggucaaagagcgguucgccg

SEQ ID NO: 26307 - RNA, 22 nt, Mycobacterium bovis subsp bovis AF2122/97
auggucaugucgcugauggugg

SEQ ID NO: 26308 - RNA, 22 nt, Mycobacterium bovis subsp bovis AF2122/97
auggucgagaagcguugccgcc

SEQ ID NO: 26309 - RNA, 22 nt, Mycobacterium bovis subsp bovis AF2122/97
auggucugacguucuggagcac

SEQ ID NO: 26310 - RNA, 22 nt, Mycobacterium bovis subsp bovis AF2122/97
augguugguggugcauaucguc

SEQ ID NO: 26311 - RNA, 21 nt, Mycobacterium bovis subsp bovis AF2122/97
augucguccaccggcuuaugg

SEQ ID NO: 26312 - RNA, 22 nt, Mycobacterium bovis subsp bovis AF2122/97
auguugaccgagaugccgccga

SEQ ID NO: 26313 - RNA, 22 nt, Mycobacterium bovis subsp bovis AF2122/97
auguugggccgauucagcgaau

SEQ ID NO: 26314 - RNA, 22 nt, Mycobacterium bovis subsp bovis AF2122/97
auuaguggucagaccggacgga

SEQ ID NO: 26315 - RNA, 22 nt, Mycobacterium bovis subsp bovis AF2122/97
auucacuggauagccacacuau

SEQ ID NO: 26316 - RNA, 22 nt, Mycobacterium bovis subsp bovis AF2122/97
auucgggaguagcgcuccuuga

SEQ ID NO: 26317 - RNA, 21 nt, Mycobacterium bovis subsp bovis AF2122/97
ccgcccuguaucggcgugucc

SEQ ID NO: 26318 - RNA, 22 nt, Mycobacterium bovis subsp bovis AF2122/97
ccgccgaacgugaacucacggc

SEQ ID NO: 26319 - RNA, 22 nt, Mycobacterium bovis subsp bovis AF2122/97
ccgccgauagugaauucggcga

SEQ ID NO: 26320 - RNA, 22 nt, Mycobacterium bovis subsp bovis AF2122/97
ccgccgauagugaauucggcgc

SEQ ID NO: 26321 - RNA, 22 nt, Mycobacterium bovis subsp bovis AF2122/97
ccgccgaugacauauugccgcu

SEQ ID NO: 26322 - RNA, 22 nt, Mycobacterium bovis subsp bovis AF2122/97
ccgcgcacgggcaugcgaucaa

SEQ ID NO: 26323 - RNA, 22 nt, Mycobacterium bovis subsp bovis AF2122/97
cgguggugaacggaucgccgga

SEQ ID NO: 26324 - RNA, 20 nt, Mycobacterium bovis subsp bovis AF2122/97
cggugucgccgugcuugccg

SEQ ID NO: 26325 - RNA, 22 nt, Mycobacterium bovis subsp bovis AF2122/97
cgguguuguagucgccgguguu

SEQ ID NO: 26326 - RNA, 22 nt, Mycobacterium bovis subsp bovis AF2122/97
cgguugacgggcguccgcgccg

SEQ ID NO: 26327 - RNA, 22 nt, Mycobacterium bovis subsp bovis AF2122/97
cgguugcggugccagccaaccg

SEQ ID NO: 26328 - RNA, 22 nt, Mycobacterium bovis subsp bovis AF2122/97
cgucaccaucgaagcggcgcac

SEQ ID NO: 26329 - RNA, 22 nt, Mycobacterium bovis subsp bovis AF2122/97
cguccgaaggcaucggcgaguc

SEQ ID NO: 26330 - RNA, 22 nt, Mycobacterium bovis subsp bovis AF2122/97
cguccgguugggauugucgagg

SEQ ID NO: 26331 - RNA, 22 nt, Mycobacterium bovis subsp bovis AF2122/97
cgucgaaccgcgaugagcccau

SEQ ID NO: 26332 - RNA, 22 nt, Mycobacterium bovis subsp bovis AF2122/97
cgucgauucgagagguaaccga

SEQ ID NO: 26333 - RNA, 22 nt, Mycobacterium bovis subsp bovis AF2122/97
cgucgccaacgccgucaagcuc

SEQ ID NO: 26334 - RNA, 22 nt, Mycobacterium bovis subsp bovis AF2122/97
cgucgccaagauugucgaugcu

SEQ ID NO: 26335 - RNA, 22 nt, Mycobacterium bovis subsp bovis AF2122/97
cgucgccgucccaggugaacca

SEQ ID NO: 26336 - RNA, 22 nt, Mycobacterium bovis subsp bovis AF2122/97
cgucgcgcacgcgcuucuugag

SEQ ID NO: 26337 - RNA, 22 nt, Mycobacterium bovis subsp bovis AF2122/97
cgucgcguuuuauguguucguc

SEQ ID NO: 26338 - RNA, 22 nt, Mycobacterium bovis subsp bovis AF2122/97
cgucggcaauacuccgcugacg

SEQ ID NO: 26339 - RNA, 22 nt, Mycobacterium bovis subsp bovis AF2122/97
cgucgugauugucaugcaacca

SEQ ID NO: 26340 - RNA, 22 nt, Mycobacterium bovis subsp bovis AF2122/97
cgucuccgacguacuggauggu

SEQ ID NO: 26341 - RNA, 22 nt, Mycobacterium bovis subsp bovis AF2122/97
cgucucgguaugggagcugcuc

SEQ ID NO: 26342 - RNA, 22 nt, Mycobacterium bovis subsp bovis AF2122/97
cgucugccccaccuucugcuug

SEQ ID NO: 26343 - RNA, 22 nt, Mycobacterium bovis subsp bovis AF2122/97
cgucugcugccgcgagccgacu

SEQ ID NO: 26344 - RNA, 22 nt, Mycobacterium bovis subsp bovis AF2122/97
cgucuggugcagggauucuucg

SEQ ID NO: 26345 - RNA, 22 nt, Mycobacterium bovis subsp bovis AF2122/97
cgucugguugcucgguuggcgg

SEQ ID NO: 26346 - RNA, 22 nt, Mycobacterium bovis subsp bovis AF2122/97
cgugauacggaagcucgccgag

SEQ ID NO: 26347 - RNA, 22 nt, Mycobacterium bovis subsp bovis AF2122/97
cgugaugguggccgugcagucg

SEQ ID NO: 26348 - RNA, 22 nt, Mycobacterium bovis subsp bovis AF2122/97
cgugcgauucugcgucugcucg

SEQ ID NO: 26349 - RNA, 22 nt, Mycobacterium bovis subsp bovis AF2122/97
cgugcgggggcuuaugcgucug

SEQ ID NO: 26350 - RNA, 22 nt, Mycobacterium bovis subsp bovis AF2122/97
cgugcgggggcuuuugcgacug

SEQ ID NO: 26351 - RNA, 22 nt, Mycobacterium bovis subsp bovis AF2122/97
cgugcggugacggcgaugugca

SEQ ID NO: 26352 - RNA, 22 nt, Mycobacterium bovis subsp bovis AF2122/97
cguggaaugcaugaucgucgcc

SEQ ID NO: 26353 - RNA, 22 nt, Mycobacterium bovis subsp bovis AF2122/97
cguggagauguggguucgggcc

SEQ ID NO: 26354 - RNA, 19 nt, Mycobacterium bovis subsp bovis AF2122/97
cguggcacuggaucgcggu

SEQ ID NO: 26355 - RNA, 22 nt, Mycobacterium bovis subsp bovis AF2122/97
cguggccaguugaugcgugauc

SEQ ID NO: 26356 - RNA, 19 nt, Mycobacterium bovis subsp bovis AF2122/97
cguggcggugauggccggc

SEQ ID NO: 26357 - RNA, 21 nt, Mycobacterium bovis subsp bovis AF2122/97
cguggugcacgccaugcuggc

SEQ ID NO: 26358 - RNA, 22 nt, Mycobacterium bovis subsp bovis AF2122/97
cguucgaacgggucgucgaauu

SEQ ID NO: 26359 - RNA, 22 nt, Mycobacterium bovis subsp bovis AF2122/97
cguucgucaucguggguuccgg

SEQ ID NO: 26360 - RNA, 22 nt, Mycobacterium bovis subsp bovis AF2122/97
cguucgugacuaggaucaucga

SEQ ID NO: 26361 - RNA, 22 nt, Mycobacterium bovis subsp bovis AF2122/97
cguugacucugcguccaccgug

SEQ ID NO: 26362 - RNA, 22 nt, Mycobacterium bovis subsp bovis AF2122/97
cguuggugaugccggugaccaa

SEQ ID NO: 26363 - RNA, 22 nt, Mycobacterium bovis subsp bovis AF2122/97
cguuuucggagaccagcuugac

SEQ ID NO: 26364 - RNA, 20 nt, Mycobacterium bovis subsp bovis AF2122/97
cuacgcagcgaccauggcgc

SEQ ID NO: 26365 - RNA, 22 nt, Mycobacterium bovis subsp bovis AF2122/97
cuacgccgcgguguucaucgac

SEQ ID NO: 26366 - RNA, 22 nt, Mycobacterium bovis subsp bovis AF2122/97
cucagcugcagugcggugggcg

SEQ ID NO: 26367 - RNA, 22 nt, Mycobacterium bovis subsp bovis AF2122/97
cucaucguguuggucgagccgg

SEQ ID NO: 26368 - RNA, 22 nt, Mycobacterium bovis subsp bovis AF2122/97
cuccaccacccaguaguagaug

SEQ ID NO: 26369 - RNA, 22 nt, Mycobacterium bovis subsp bovis AF2122/97
cucccguucgcucggcacucgu

SEQ ID NO: 26370 - RNA, 22 nt, Mycobacterium bovis subsp bovis AF2122/97
cucgacgccgcaucaguacgaa

SEQ ID NO: 26371 - RNA, 22 nt, Mycobacterium bovis subsp bovis AF2122/97
cucggccguggcgucgaucaga

SEQ ID NO: 26372 - RNA, 18 nt, Mycobacterium bovis subsp bovis AF2122/97
cucggcgaccacguccuu

SEQ ID NO: 26373 - RNA, 22 nt, Mycobacterium bovis subsp bovis AF2122/97
cucggcgcgguaguugaugacc

SEQ ID NO: 26374 - RNA, 22 nt, Mycobacterium bovis subsp bovis AF2122/97
cucggcggcucgcggaggcauc

SEQ ID NO: 26375 - RNA, 22 nt, Mycobacterium bovis subsp bovis AF2122/97
cucgggucggguucgccgucga

SEQ ID NO: 26376 - RNA, 22 nt, Mycobacterium bovis subsp bovis AF2122/97
cucgucgcgcccuacaccgacc

SEQ ID NO: 26377 - RNA, 20 nt, Mycobacterium bovis subsp bovis AF2122/97
cucgucguucuacugcccgc

SEQ ID NO: 26378 - RNA, 22 nt, Mycobacterium bovis subsp bovis AF2122/97
cucguggcuaccgcaucgcugc

SEQ ID NO: 26379 - RNA, 22 nt, Mycobacterium bovis subsp bovis AF2122/97
cucguggucgagccggccgucu

SEQ ID NO: 26380 - RNA, 22 nt, Mycobacterium bovis subsp bovis AF2122/97
cucguguucgaugcggccaucg

SEQ ID NO: 26381 - RNA, 22 nt, Mycobacterium bovis subsp bovis AF2122/97
cugaaugccuauaucgcggcca

SEQ ID NO: 26382 - RNA, 22 nt, Mycobacterium bovis subsp bovis AF2122/97
cugagcgauccggaaaccgacu

SEQ ID NO: 26383 - RNA, 22 nt, Mycobacterium bovis subsp bovis AF2122/97
cugauagacgucggcucgcugc

SEQ ID NO: 26384 - RNA, 22 nt, Mycobacterium bovis subsp bovis AF2122/97
cugaugaaaugcaugccgccgg

SEQ ID NO: 26385 - RNA, 22 nt, Mycobacterium bovis subsp bovis AF2122/97
cugcaagcccagaucggugcgu

SEQ ID NO: 26386 - RNA, 22 nt, Mycobacterium bovis subsp bovis AF2122/97
cugcacgacagcgucgaagucg

SEQ ID NO: 26387 - RNA, 22 nt, Mycobacterium bovis subsp bovis AF2122/97
cugcagcugguuuccgucggcu

SEQ ID NO: 26388 - RNA, 22 nt, Mycobacterium bovis subsp bovis AF2122/97
cugccgauguggcggcgauggu

SEQ ID NO: 26389 - RNA, 22 nt, Mycobacterium bovis subsp bovis AF2122/97
cugcgcaucgaggccggcgacg

SEQ ID NO: 26390 - RNA, 22 nt, Mycobacterium bovis subsp bovis AF2122/97
cugcgccgcgagcugucggcac

SEQ ID NO: 26391 - RNA, 22 nt, Mycobacterium bovis subsp bovis AF2122/97
cugcggaugggucagcagauug

SEQ ID NO: 26392 - RNA, 22 nt, Mycobacterium bovis subsp bovis AF2122/97
cugcugcuggccggccagcccg

SEQ ID NO: 26393 - RNA, 22 nt, Mycobacterium bovis subsp bovis AF2122/97
cuggccaucgagggcaucgggc

SEQ ID NO: 26394 - RNA, 22 nt, Mycobacterium bovis subsp bovis AF2122/97
cuggcgauaucagacguucgac

SEQ ID NO: 26395 - RNA, 22 nt, Mycobacterium bovis subsp bovis AF2122/97
cgagcagacgcggaaucgcauc

SEQ ID NO: 26396 - RNA, 22 nt, Mycobacterium bovis subsp bovis AF2122/97
cgagcagacgcuaaagcccccg

SEQ ID NO: 26397 - RNA, 22 nt, Mycobacterium bovis subsp bovis AF2122/97
cgagccaggcaaucagccgccg

SEQ ID NO: 26398 - RNA, 22 nt, Mycobacterium bovis subsp bovis AF2122/97
cgagcgcagcucgggcuucggc

SEQ ID NO: 26399 - RNA, 22 nt, Mycobacterium bovis subsp bovis AF2122/97
cgagcgcgcgauccaucagcag

SEQ ID NO: 26400 - RNA, 23 nt, Mycobacterium bovis subsp bovis AF2122/97
cgagcgguauggccggcgcugac

SEQ ID NO: 26401 - RNA, 22 nt, Mycobacterium bovis subsp bovis AF2122/97
cgagcguaacccggcugcgaaa

SEQ ID NO: 26402 - RNA, 22 nt, Mycobacterium bovis subsp bovis AF2122/97
cgagcguaaccgcacugcgaaa

SEQ ID NO: 26403 - RNA, 22 nt, Mycobacterium bovis subsp bovis AF2122/97
cgagcguaaccuggcugcgauu

SEQ ID NO: 26404 - RNA, 22 nt, Mycobacterium bovis subsp bovis AF2122/97
cgagcguaacgccaccgcgaaa

SEQ ID NO: 26405 - RNA, 22 nt, Mycobacterium bovis subsp bovis AF2122/97
cgagcguaacgccacggcgaau

SEQ ID NO: 26406 - RNA, 22 nt, Mycobacterium bovis subsp bovis AF2122/97
cgagcgugcacugagggcgaga

SEQ ID NO: 26407 - RNA, 21 nt, Mycobacterium bovis subsp bovis AF2122/97
cgagcucgcggcccagaguuc

SEQ ID NO: 26408 - RNA, 22 nt, Mycobacterium bovis subsp bovis AF2122/97
cgaggccgacgaaagguugccg

SEQ ID NO: 26409 - RNA, 22 nt, Mycobacterium bovis subsp bovis AF2122/97
cgagggcuuuagugucugcucg

SEQ ID NO: 26410 - RNA, 19 nt, Mycobacterium bovis subsp bovis AF2122/97
cgaggucguaugccguccg

SEQ ID NO: 26411 - RNA, 22 nt, Mycobacterium bovis subsp bovis AF2122/97
cgagguguggucauggagcacc

SEQ ID NO: 26412 - RNA, 22 nt, Mycobacterium bovis subsp bovis AF2122/97
cgaguggucugggcucgaccgc

SEQ ID NO: 26413 - RNA, 22 nt, Mycobacterium bovis subsp bovis AF2122/97
cgaucagcacgccucgggcguc

SEQ ID NO: 26414 - RNA, 20 nt, Mycobacterium bovis subsp bovis AF2122/97
cgaucagcgucacgccuagu

SEQ ID NO: 26415 - RNA, 22 nt, Mycobacterium bovis subsp bovis AF2122/97
cgaucaucgacauucggccagc

SEQ ID NO: 26416 - RNA, 22 nt, Mycobacterium bovis subsp bovis AF2122/97
cgauccacugaccgaguagcgc

SEQ ID NO: 26417 - RNA, 22 nt, Mycobacterium bovis subsp bovis AF2122/97
cgaucgacgccaaucagacgaa

SEQ ID NO: 26418 - RNA, 22 nt, Mycobacterium bovis subsp bovis AF2122/97
cgaucguucguggcaccgcagc

SEQ ID NO: 26419 - RNA, 22 nt, Mycobacterium bovis subsp bovis AF2122/97
cgaugacccgcaggcccagccc

SEQ ID NO: 26420 - RNA, 22 nt, Mycobacterium bovis subsp bovis AF2122/97
cgaugcaggacggcgagggcuc

SEQ ID NO: 26421 - RNA, 22 nt, Mycobacterium bovis subsp bovis AF2122/97
cgauguggcacugugcaccgcc

SEQ ID NO: 26422 - RNA, 21 nt, Mycobacterium bovis subsp bovis AF2122/97
cgauucugugucugcucggcg

SEQ ID NO: 26423 - RNA, 22 nt, Mycobacterium bovis subsp bovis AF2122/97
cgauuguguaucgcaccgacuu

SEQ ID NO: 26424 - RNA, 22 nt, Mycobacterium bovis subsp bovis AF2122/97
cgcagcagcuugaugggguucu

SEQ ID NO: 26425 - RNA, 18 nt, Mycobacterium bovis subsp bovis AF2122/97
cgcagccuggucuauuuc

SEQ ID NO: 26426 - RNA, 22 nt, Mycobacterium bovis subsp bovis AF2122/97
cgcaucgagaucgacgucagcg

SEQ ID NO: 26427 - RNA, 22 nt, Mycobacterium bovis subsp bovis AF2122/97
cgccacgugccggugcucgacg

SEQ ID NO: 26428 - RNA, 22 nt, Mycobacterium bovis subsp bovis AF2122/97
cgcccacgagccaccgcggcug

SEQ ID NO: 26429 - RNA, 22 nt, Mycobacterium bovis subsp bovis AF2122/97
cgcccaguccauccggcggaca

SEQ ID NO: 26430 - RNA, 22 nt, Mycobacterium bovis subsp bovis AF2122/97
cgcccgaugccuccgcugugca

SEQ ID NO: 26431 - RNA, 22 nt, Mycobacterium bovis subsp bovis AF2122/97
cgcccgugccgcugaucguugc

SEQ ID NO: 26432 - RNA, 22 nt, Mycobacterium bovis subsp bovis AF2122/97
cgccgaacaaugugcggaucuc

SEQ ID NO: 26433 - RNA, 22 nt, Mycobacterium bovis subsp bovis AF2122/97
cgccgagcagacacagaaucgc

SEQ ID NO: 26434 - RNA, 22 nt, Mycobacterium bovis subsp bovis AF2122/97
cgccgagcgugaacucagugca

SEQ ID NO: 26435 - RNA, 22 nt, Mycobacterium bovis subsp bovis AF2122/97
cgccgagcgugaacugagggcg

SEQ ID NO: 26436 - RNA, 22 nt, Mycobacterium bovis subsp bovis AF2122/97
cgccgaguaccgcgcgauguuc

SEQ ID NO: 26437 - RNA, 22 nt, Mycobacterium bovis subsp bovis AF2122/97
cgccgaucccgaaccggcgcuc

SEQ ID NO: 26438 - RNA, 22 nt, Mycobacterium bovis subsp bovis AF2122/97
cgccgauucgggauugucaccg

SEQ ID NO: 26439 - RNA, 19 nt, Mycobacterium bovis subsp bovis AF2122/97
cgccgccgagauggagucg

SEQ ID NO: 26440 - RNA, 22 nt, Mycobacterium bovis subsp bovis AF2122/97
cgccgcgccgucgucugagcaa

SEQ ID NO: 26441 - RNA, 22 nt, Mycobacterium bovis subsp bovis AF2122/97
cgccgcuggccaucggauccga

SEQ ID NO: 26442 - RNA, 22 nt, Mycobacterium bovis subsp bovis AF2122/97
cgccugcucccagcgcggcuau

SEQ ID NO: 26443 - RNA, 22 nt, Mycobacterium bovis subsp bovis AF2122/97
cgccugguggggucgaacugug

SEQ ID NO: 26444 - RNA, 22 nt, Mycobacterium bovis subsp bovis AF2122/97
cgccuugguaggcguugccgac

SEQ ID NO: 26445 - RNA, 22 nt, Mycobacterium bovis subsp bovis AF2122/97
cgcgacaccaacaccggugccg

SEQ ID NO: 26446 - RNA, 22 nt, Mycobacterium bovis subsp bovis AF2122/97
cgcgacgggaucaccgaccugc

SEQ ID NO: 26447 - RNA, 22 nt, Mycobacterium bovis subsp bovis AF2122/97
cgcgagcagacacagaaucgca

SEQ ID NO: 26448 - RNA, 22 nt, Mycobacterium bovis subsp bovis AF2122/97
cgcgagcagacgcaaaaucgcc

SEQ ID NO: 26449 - RNA, 22 nt, Mycobacterium bovis subsp bovis AF2122/97
cgcgagcagacgcagagucgca

SEQ ID NO: 26450 - RNA, 22 nt, Mycobacterium bovis subsp bovis AF2122/97
cgcgagcguaacguggcugcga

SEQ ID NO: 26451 - RNA, 22 nt, Mycobacterium bovis subsp bovis AF2122/97
cgcgaucgcgucuggagugccg

SEQ ID NO: 26452 - RNA, 20 nt, Mycobacterium bovis subsp bovis AF2122/97
cgcgccaacgcccugcucgc

SEQ ID NO: 26453 - RNA, 19 nt, Mycobacterium bovis subsp bovis AF2122/97
cgcgccaaggucauuggcg

SEQ ID NO: 26454 - RNA, 22 nt, Mycobacterium bovis subsp bovis AF2122/97
cgcgcccaacaagucgacgucc

SEQ ID NO: 26455 - RNA, 22 nt, Mycobacterium bovis subsp bovis AF2122/97
cgcgccgaggcgcucuacgaac

SEQ ID NO: 26456 - RNA, 22 nt, Mycobacterium bovis subsp bovis AF2122/97
cgcgccgguuggggcauccggu

SEQ ID NO: 26457 - RNA, 19 nt, Mycobacterium bovis subsp bovis AF2122/97
cgcgcuaaugucgauuucg

SEQ ID NO: 26458 - RNA, 22 nt, Mycobacterium bovis subsp bovis AF2122/97
cgcggccgcguucugggcgacc

SEQ ID NO: 26459 - RNA, 22 nt, Mycobacterium bovis subsp bovis AF2122/97
cgcggccucggccggucacacu

SEQ ID NO: 26460 - RNA, 22 nt, Mycobacterium bovis subsp bovis AF2122/97
cgcgggugcgugcacugggugu

SEQ ID NO: 26461 - RNA, 22 nt, Mycobacterium bovis subsp bovis AF2122/97
cgcggguugagcuugcguccgu

SEQ ID NO: 26462 - RNA, 22 nt, Mycobacterium bovis subsp bovis AF2122/97
cuggcgaucaccgugcgccgca

SEQ ID NO: 26463 - RNA, 22 nt, Mycobacterium bovis subsp bovis AF2122/97
cuggcggucggugccgucgaug

SEQ ID NO: 26464 - RNA, 22 nt, Mycobacterium bovis subsp bovis AF2122/97
cugggcgaugaagcgcuggguc

SEQ ID NO: 26465 - RNA, 22 nt, Mycobacterium bovis subsp bovis AF2122/97
cugggcgcgcucaucgaccggg

SEQ ID NO: 26466 - RNA, 22 nt, Mycobacterium bovis subsp bovis AF2122/97
cugggcguccguuuccgcgccg

SEQ ID NO: 26467 - RNA, 22 nt, Mycobacterium bovis subsp bovis AF2122/97
cuggucgucggcaauccagggu

SEQ ID NO: 26468 - RNA, 23 nt, Mycobacterium bovis subsp bovis AF2122/97
cugguugcaugacaaucacgacg

SEQ ID NO: 26469 - RNA, 22 nt, Mycobacterium bovis subsp bovis AF2122/97
cugucgcgagcgcugcuaggca

SEQ ID NO: 26470 - RNA, 22 nt, Mycobacterium bovis subsp bovis AF2122/97
cuguuguggccgcugucgucgg

SEQ ID NO: 26471 - RNA, 22 nt, Mycobacterium bovis subsp bovis AF2122/97
cuucgugcaccacgucggccuu

SEQ ID NO: 26472 - RNA, 22 nt, Mycobacterium bovis subsp bovis AF2122/97
cuugccaugugacugcggccga

SEQ ID NO: 26473 - RNA, 22 nt, Mycobacterium bovis subsp bovis AF2122/97
cuugccggcgcaucgcgauugc

SEQ ID NO: 26474 - RNA, 22 nt, Mycobacterium bovis subsp bovis AF2122/97
gaacgucucgugcuuggguggg

SEQ ID NO: 26475 - RNA, 22 nt, Mycobacterium bovis subsp bovis AF2122/97
gaacugagccgccgucagcgcc

SEQ ID NO: 26476 - RNA, 22 nt, Mycobacterium bovis subsp bovis AF2122/97
gaagcugcugggccaguucgug

SEQ ID NO: 26477 - RNA, 22 nt, Mycobacterium bovis subsp bovis AF2122/97
gaaggccgagcggaucugacau

SEQ ID NO: 26478 - RNA, 22 nt, Mycobacterium bovis subsp bovis AF2122/97
gaauaccauugcccccgcggug

SEQ ID NO: 26479 - RNA, 22 nt, Mycobacterium bovis subsp bovis AF2122/97
gaauuguccgguaaugcccagc

SEQ ID NO: 26480 - RNA, 22 nt, Mycobacterium bovis subsp bovis AF2122/97
gacaacgacaccgggcgccaac

SEQ ID NO: 26481 - RNA, 22 nt, Mycobacterium bovis subsp bovis AF2122/97
gacaccagaacgagaucggcca

SEQ ID NO: 26482 - RNA, 22 nt, Mycobacterium bovis subsp bovis AF2122/97
gacaccguugccgacggccgcc

SEQ ID NO: 26483 - RNA, 22 nt, Mycobacterium bovis subsp bovis AF2122/97
gacagcgauccgccggcgcggu

SEQ ID NO: 26484 - RNA, 22 nt, Mycobacterium bovis subsp bovis AF2122/97
gaccgauggugcguggcaugga

SEQ ID NO: 26485 - RNA, 22 nt, Mycobacterium bovis subsp bovis AF2122/97
gaccugguugacaccggcgacc

SEQ ID NO: 26486 - RNA, 22 nt, Mycobacterium bovis subsp bovis AF2122/97
gacgaaugcgaaugcauccgcu

SEQ ID NO: 26487 - RNA, 22 nt, Mycobacterium bovis subsp bovis AF2122/97
gacgaccgaugucugggugauc

SEQ ID NO: 26488 - RNA, 22 nt, Mycobacterium bovis subsp bovis AF2122/97
gacgaccgcaggucggcaacgu

SEQ ID NO: 26489 - RNA, 22 nt, Mycobacterium bovis subsp bovis AF2122/97
gacgagcagacgcggaaucgca

SEQ ID NO: 26490 - RNA, 22 nt, Mycobacterium bovis subsp bovis AF2122/97
gacgaggccgucgccgcguugc

SEQ ID NO: 26491 - RNA, 22 nt, Mycobacterium bovis subsp bovis AF2122/97
gacgaugccgugacgaauggcg

SEQ ID NO: 26492 - RNA, 22 nt, Mycobacterium bovis subsp bovis AF2122/97
gacgauguggucguggucuccg

SEQ ID NO: 26493 - RNA, 23 nt, Mycobacterium bovis subsp bovis AF2122/97
gacgcacgucacagaacguggug

SEQ ID NO: 26494 - RNA, 23 nt, Mycobacterium bovis subsp bovis AF2122/97
gacggagcgcuggaccggcaggc

SEQ ID NO: 26495 - RNA, 22 nt, Mycobacterium bovis subsp bovis AF2122/97
gacguagagcguggugcggaac

SEQ ID NO: 26496 - RNA, 22 nt, Mycobacterium bovis subsp bovis AF2122/97
gacgucgagggugauggugcgg

SEQ ID NO: 26497 - RNA, 22 nt, Mycobacterium bovis subsp bovis AF2122/97
gacugguacgccgaccugccgg

SEQ ID NO: 26498 - RNA, 22 nt, Mycobacterium bovis subsp bovis AF2122/97
gacuugcaugucggcggcgagu

SEQ ID NO: 26499 - RNA, 22 nt, Mycobacterium bovis subsp bovis AF2122/97
gagaucaacauuuugcaggcaa

SEQ ID NO: 26500 - RNA, 22 nt, Mycobacterium bovis subsp bovis AF2122/97
gagaucgaccgggaaggugauc

SEQ ID NO: 26501 - RNA, 22 nt, Mycobacterium bovis subsp bovis AF2122/97
gagauguucgggaugucgcggg

SEQ ID NO: 26502 - RNA, 22 nt, Mycobacterium bovis subsp bovis AF2122/97
gagcagacacacaaucgcaucc

SEQ ID NO: 26503 - RNA, 22 nt, Mycobacterium bovis subsp bovis AF2122/97
gagcagacgcaaaagcacccca

SEQ ID NO: 26504 - RNA, 22 nt, Mycobacterium bovis subsp bovis AF2122/97
gagcagacgcaaaagcacccuu

SEQ ID NO: 26505 - RNA, 22 nt, Mycobacterium bovis subsp bovis AF2122/97
gagcagacgcaaaaucgcccau

SEQ ID NO: 26506 - RNA, 22 nt, Mycobacterium bovis subsp bovis AF2122/97
gagcagacgcagaagcccccaa

SEQ ID NO: 26507 - RNA, 22 nt, Mycobacterium bovis subsp bovis AF2122/97
gagcagacgcagaaguccccga

SEQ ID NO: 26508 - RNA, 22 nt, Mycobacterium bovis subsp bovis AF2122/97
gagcagacgcagaagucgccga

SEQ ID NO: 26509 - RNA, 22 nt, Mycobacterium bovis subsp bovis AF2122/97
gagcagacgcagaaucgcauga

SEQ ID NO: 26510 - RNA, 22 nt, Mycobacterium bovis subsp bovis AF2122/97
gagcagacgcagaaucgcaugc

SEQ ID NO: 26511 - RNA, 22 nt, Mycobacterium bovis subsp bovis AF2122/97
gagcagacgcauaagcgcccau

SEQ ID NO: 26512 - RNA, 22 nt, Mycobacterium bovis subsp bovis AF2122/97
gagcaugggcguggacguuguc

SEQ ID NO: 26513 - RNA, 22 nt, Mycobacterium bovis subsp bovis AF2122/97
gagccgaaccacggcgacucug

SEQ ID NO: 26514 - RNA, 20 nt, Mycobacterium bovis subsp bovis AF2122/97
gagccgcagcgggacccggu

SEQ ID NO: 26515 - RNA, 22 nt, Mycobacterium bovis subsp bovis AF2122/97
gagcgagcccggugaugcggug

SEQ ID NO: 26516 - RNA, 22 nt, Mycobacterium bovis subsp bovis AF2122/97
gagcgcagcccggcaugggugg

SEQ ID NO: 26517 - RNA, 22 nt, Mycobacterium bovis subsp bovis AF2122/97
gagcggauuuuucgcaccggga

SEQ ID NO: 26518 - RNA, 22 nt, Mycobacterium bovis subsp bovis AF2122/97
gagcgguucgugcugggggugg

SEQ ID NO: 26519 - RNA, 22 nt, Mycobacterium bovis subsp bovis AF2122/97
gagcucggucagaucagcagca

SEQ ID NO: 26520 - RNA, 22 nt, Mycobacterium bovis subsp bovis AF2122/97
gaggacgcaaaaucgcccgaaa

SEQ ID NO: 26521 - RNA, 23 nt, Mycobacterium bovis subsp bovis AF2122/97
gaggcgcuggcagcggcccgguu

SEQ ID NO: 26522 - RNA, 22 nt, Mycobacterium bovis subsp bovis AF2122/97
gagggcacugaacggucgguca

SEQ ID NO: 26523 - RNA, 22 nt, Mycobacterium bovis subsp bovis AF2122/97
gaggggauuuugcgucugcuca

SEQ ID NO: 26524 - RNA, 22 nt, Mycobacterium bovis subsp bovis AF2122/97
gaggugacucgaugcuggagcu

SEQ ID NO: 26525 - RNA, 22 nt, Mycobacterium bovis subsp bovis AF2122/97
gaggugaugagggcggcgagua

SEQ ID NO: 26526 - RNA, 22 nt, Mycobacterium bovis subsp bovis AF2122/97
gagucagccgcgguauggcgca

SEQ ID NO: 26527 - RNA, 22 nt, Mycobacterium bovis subsp bovis AF2122/97
gagugugaaucccgcgacgccg

SEQ ID NO: 26528 - RNA, 22 nt, Mycobacterium bovis subsp bovis AF2122/97
gaguucuucgcgguggccaaga

SEQ ID NO: 26529 - RNA, 22 nt, Mycobacterium bovis subsp bovis AF2122/97
gaucaccgaauugguagaugac

SEQ ID NO: 26530 - RNA, 22 nt, Mycobacterium bovis subsp bovis AF2122/97
gaucaguccggcccgggcgaua

SEQ ID NO: 26531 - RNA, 22 nt, Mycobacterium bovis subsp bovis AF2122/97
gaucgaaugcguaccgcggcuu

SEQ ID NO: 26532 - RNA, 22 nt, Mycobacterium bovis subsp bovis AF2122/97
gaucggcgccagguccgaucgc

SEQ ID NO: 26533 - RNA, 22 nt, Mycobacterium bovis subsp bovis AF2122/97
gaucgugacgccacgggugcgg

SEQ ID NO: 26534 - RNA, 22 nt, Mycobacterium bovis subsp bovis AF2122/97
gaucuacgcgcgcaucgucgac

SEQ ID NO: 26535 - RNA, 22 nt, Mycobacterium bovis subsp bovis AF2122/97
gaucuagcgaacgugggaucga

SEQ ID NO: 26536 - RNA, 22 nt, Mycobacterium bovis subsp bovis AF2122/97
gaucugguguguuggcgcgccg

SEQ ID NO: 26537 - RNA, 20 nt, Mycobacterium bovis subsp bovis AF2122/97
gaucuugucccggcgguggc

SEQ ID NO: 26538 - RNA, 22 nt, Mycobacterium bovis subsp bovis AF2122/97
gaugaccgggcucgaucugggu

SEQ ID NO: 26539 - RNA, 22 nt, Mycobacterium bovis subsp bovis AF2122/97
gaugcaccggugucggugaccg

SEQ ID NO: 26540 - RNA, 22 nt, Mycobacterium bovis subsp bovis AF2122/97
gaugcccacgacgacgauaucg

SEQ ID NO: 26541 - RNA, 22 nt, Mycobacterium bovis subsp bovis AF2122/97
gaugccgcgguuuguccgggag

SEQ ID NO: 26542 - RNA, 22 nt, Mycobacterium bovis subsp bovis AF2122/97
gaugcgauuccgcgucugcucg

SEQ ID NO: 26543 - RNA, 22 nt, Mycobacterium bovis subsp bovis AF2122/97
gauggacaagccggacgucgac

SEQ ID NO: 26544 - RNA, 22 nt, Mycobacterium bovis subsp bovis AF2122/97
gauggcgaugcgcaccccgucg

SEQ ID NO: 26545 - RNA, 22 nt, Mycobacterium bovis subsp bovis AF2122/97
gaugggugccacggugaauggu

SEQ ID NO: 26546 - RNA, 22 nt, Mycobacterium bovis subsp bovis AF2122/97
gauuguucuggaugaucguggu

SEQ ID NO: 26547 - RNA, 22 nt, Mycobacterium bovis subsp bovis AF2122/97
gcaaaacgucagucucggugaa

SEQ ID NO: 26548 - RNA, 22 nt, Mycobacterium bovis subsp bovis AF2122/97
gcaagcugcgggcgcuuggugu

SEQ ID NO: 26549 - RNA, 22 nt, Mycobacterium bovis subsp bovis AF2122/97
gcaaucucgguggucaugauga

SEQ ID NO: 26550 - RNA, 22 nt, Mycobacterium bovis subsp bovis AF2122/97
gcaccccagagcacugauacgc

SEQ ID NO: 26551 - RNA, 22 nt, Mycobacterium bovis subsp bovis AF2122/97
gcacccuggacaagcuggaauc

SEQ ID NO: 26552 - RNA, 22 nt, Mycobacterium bovis subsp bovis AF2122/97
gcaccggcugccugguggcggc

SEQ ID NO: 26553 - RNA, 22 nt, Mycobacterium bovis subsp bovis AF2122/97
gcagacgcaaaaggccccgaau

SEQ ID NO: 26554 - RNA, 22 nt, Mycobacterium bovis subsp bovis AF2122/97
gcagacguaaaagcccccgaca

SEQ ID NO: 26555 - RNA, 22 nt, Mycobacterium bovis subsp bovis AF2122/97
gcagcaaaccugagguggcuga

SEQ ID NO: 26556 - RNA, 22 nt, Mycobacterium bovis subsp bovis AF2122/97
gcagcaccgcugcugacgcacu

SEQ ID NO: 26557 - RNA, 22 nt, Mycobacterium bovis subsp bovis AF2122/97
gcagcgccaaacucaaguuccg

SEQ ID NO: 26558 - RNA, 22 nt, Mycobacterium bovis subsp bovis AF2122/97
gcagcggaaccgcgauacgucc

SEQ ID NO: 26559 - RNA, 22 nt, Mycobacterium bovis subsp bovis AF2122/97
gcagcugauugcguucgcggcg

SEQ ID NO: 26560 - RNA, 22 nt, Mycobacterium bovis subsp bovis AF2122/97
gcagcugcucgacuugcucgga

SEQ ID NO: 26561 - RNA, 22 nt, Mycobacterium bovis subsp bovis AF2122/97
gcagcuucgaugacuacgacca

SEQ ID NO: 26562 - RNA, 22 nt, Mycobacterium bovis subsp bovis AF2122/97
gcaggccgauguugguaccgca

SEQ ID NO: 26563 - RNA, 22 nt, Mycobacterium bovis subsp bovis AF2122/97
gcagucgacagcguugcuaccg

SEQ ID NO: 26564 - RNA, 22 nt, Mycobacterium bovis subsp bovis AF2122/97
gcagugcgauucugcgucugcu

SEQ ID NO: 26565 - RNA, 22 nt, Mycobacterium bovis subsp bovis AF2122/97
gcaucgacgucuauucgcugcg

SEQ ID NO: 26566 - RNA, 22 nt, Mycobacterium bovis subsp bovis AF2122/97
gcaucguccagcugcuuugugc

SEQ ID NO: 26567 - RNA, 22 nt, Mycobacterium bovis subsp bovis AF2122/97
gcaugcccgaucggaucguucu

SEQ ID NO: 26568 - RNA, 22 nt, Mycobacterium bovis subsp bovis AF2122/97
gccaaaucgagccgagaguggg

SEQ ID NO: 26569 - RNA, 21 nt, Mycobacterium bovis subsp bovis AF2122/97
gccaacucaggcggacgaauc

SEQ ID NO: 26570 - RNA, 22 nt, Mycobacterium bovis subsp bovis AF2122/97
gccaacuguguaaugguugccc

SEQ ID NO: 26571 - RNA, 22 nt, Mycobacterium bovis subsp bovis AF2122/97
gccaccggcgagaucgucucgg

SEQ ID NO: 26572 - RNA, 22 nt, Mycobacterium bovis subsp bovis AF2122/97
gccacggcccuucguuuucggg

SEQ ID NO: 26573 - RNA, 20 nt, Mycobacterium bovis subsp bovis AF2122/97
gccacguuguaauugacggc

SEQ ID NO: 26574 - RNA, 22 nt, Mycobacterium bovis subsp bovis AF2122/97
gccagccagcgagcaugccggg

SEQ ID NO: 26575 - RNA, 22 nt, Mycobacterium bovis subsp bovis AF2122/97
gccagggucgcuucgggcagag

SEQ ID NO: 26576 - RNA, 22 nt, Mycobacterium bovis subsp bovis AF2122/97
gccagguugacguugguuucgg

SEQ ID NO: 26577 - RNA, 20 nt, Mycobacterium bovis subsp bovis AF2122/97
gccaugggcucucaccuccu

SEQ ID NO: 26578 - RNA, 22 nt, Mycobacterium bovis subsp bovis AF2122/97
gcccaaggaaugcccccagguc

SEQ ID NO: 26579 - RNA, 22 nt, Mycobacterium bovis subsp bovis AF2122/97
gcccagcgguucauugccgacg

SEQ ID NO: 26580 - RNA, 19 nt, Mycobacterium bovis subsp bovis AF2122/97
gcccgaacccacggccggc

SEQ ID NO: 26581 - RNA, 22 nt, Mycobacterium bovis subsp bovis AF2122/97
gcccgauaccgauggccgccgu

SEQ ID NO: 26582 - RNA, 22 nt, Mycobacterium bovis subsp bovis AF2122/97
gcccgauuuccucggugaaugg

SEQ ID NO: 26583 - RNA, 18 nt, Mycobacterium bovis subsp bovis AF2122/97
gcccgcuacggucgcugg

SEQ ID NO: 26584 - RNA, 22 nt, Mycobacterium bovis subsp bovis AF2122/97
gcccggagagaucggcgcugac

SEQ ID NO: 26585 - RNA, 22 nt, Mycobacterium bovis subsp bovis AF2122/97
gcccggagauguaguccucggu

SEQ ID NO: 26586 - RNA, 22 nt, Mycobacterium bovis subsp bovis AF2122/97
gcccggcuguugguccgacugg

SEQ ID NO: 26587 - RNA, 22 nt, Mycobacterium bovis subsp bovis AF2122/97
gcccggggccuuggucacaugu

SEQ ID NO: 26588 - RNA, 22 nt, Mycobacterium bovis subsp bovis AF2122/97
gcccuggcgaguguggccggag

SEQ ID NO: 26589 - RNA, 22 nt, Mycobacterium bovis subsp bovis AF2122/97
gccgaacagacacaaaaccacc

SEQ ID NO: 26590 - RNA, 22 nt, Mycobacterium bovis subsp bovis AF2122/97
gccgaacgugaacugacggcgg

SEQ ID NO: 26591 - RNA, 22 nt, Mycobacterium bovis subsp bovis AF2122/97
gccgaacgugcaaccauggcgg

SEQ ID NO: 26592 - RNA, 22 nt, Mycobacterium bovis subsp bovis AF2122/97
gccgaagccaagacagugcugg

SEQ ID NO: 26593 - RNA, 22 nt, Mycobacterium bovis subsp bovis AF2122/97
gccgaauccagccaggagugug

SEQ ID NO: 26594 - RNA, 20 nt, Mycobacterium bovis subsp bovis AF2122/97
gccgaauucacuaucggcgg

SEQ ID NO: 26595 - RNA, 22 nt, Mycobacterium bovis subsp bovis AF2122/97
gccgagcagacgcaaaagcacc

SEQ ID NO: 26596 - RNA, 22 nt, Mycobacterium bovis subsp bovis AF2122/97
gccgagcguaacgccacugcga

SEQ ID NO: 26597 - RNA, 22 nt, Mycobacterium bovis subsp bovis AF2122/97
gccgagcgugaagucacggcgg

SEQ ID NO: 26598 - RNA, 22 nt, Mycobacterium bovis subsp bovis AF2122/97
gccgaguucaucggccucgacg

SEQ ID NO: 26599 - RNA, 22 nt, Mycobacterium bovis subsp bovis AF2122/97
gccgcacugcagcgacggccgg

SEQ ID NO: 26600 - RNA, 22 nt, Mycobacterium bovis subsp bovis AF2122/97
gccgccaccucgauguucuuga

SEQ ID NO: 26601 - RNA, 22 nt, Mycobacterium bovis subsp bovis AF2122/97
gccgccaggauuucguucgagc

SEQ ID NO: 26602 - RNA, 21 nt, Mycobacterium bovis subsp bovis AF2122/97
gccgccgcgacgaccgucacc

SEQ ID NO: 26603 - RNA, 22 nt, Mycobacterium bovis subsp bovis AF2122/97
gccgccgucauagccgacacca

SEQ ID NO: 26604 - RNA, 22 nt, Mycobacterium bovis subsp bovis AF2122/97
gccgccugcucggcggccugaa

SEQ ID NO: 26605 - RNA, 20 nt, Mycobacterium bovis subsp bovis AF2122/97
gccgcgcacgaggcuucggu

SEQ ID NO: 26606 - RNA, 22 nt, Mycobacterium bovis subsp bovis AF2122/97
gccgcuggauggcaccggcggu

SEQ ID NO: 26607 - RNA, 20 nt, Mycobacterium bovis subsp bovis AF2122/97
ucgcuguguggucaucgaca

SEQ ID NO: 26608 - RNA, 22 nt, Mycobacterium bovis subsp bovis AF2122/97
ucggcaggcugcgccagcugcc

SEQ ID NO: 26609 - RNA, 22 nt, Mycobacterium bovis subsp bovis AF2122/97
ucggccagcgccgagagcuggc

SEQ ID NO: 26610 - RNA, 22 nt, Mycobacterium bovis subsp bovis AF2122/97
ucggccucccaugcggcgaucu

SEQ ID NO: 26611 - RNA, 22 nt, Mycobacterium bovis subsp bovis AF2122/97
ucggccugucgcgcgaggugau

SEQ ID NO: 26612 - RNA, 22 nt, Mycobacterium bovis subsp bovis AF2122/97
ucggccuguuggucgccgccgg

SEQ ID NO: 26613 - RNA, 21 nt, Mycobacterium bovis subsp bovis AF2122/97
ucggcgaaccccgcggccggc

SEQ ID NO: 26614 - RNA, 22 nt, Mycobacterium bovis subsp bovis AF2122/97
ucggcgacuucugcgucugcuc

SEQ ID NO: 26615 - RNA, 22 nt, Mycobacterium bovis subsp bovis AF2122/97
ucggcgaucugcccgauggcgg

SEQ ID NO: 26616 - RNA, 22 nt, Mycobacterium bovis subsp bovis AF2122/97
ucggcgcgaaucuuucugaagc

SEQ ID NO: 26617 - RNA, 22 nt, Mycobacterium bovis subsp bovis AF2122/97
ucggcgcgguugucccgguucg

SEQ ID NO: 26618 - RNA, 22 nt, Mycobacterium bovis subsp bovis AF2122/97
ucggcggucgccuaggcggcaa

SEQ ID NO: 26619 - RNA, 22 nt, Mycobacterium bovis subsp bovis AF2122/97
ucgggcauggucagcacgcacc

SEQ ID NO: 26620 - RNA, 22 nt, Mycobacterium bovis subsp bovis AF2122/97
ucgggcggcaaacccccggagc

SEQ ID NO: 26621 - RNA, 22 nt, Mycobacterium bovis subsp bovis AF2122/97
ucggggucguucagggcacgau

SEQ ID NO: 26622 - RNA, 22 nt, Mycobacterium bovis subsp bovis AF2122/97
ucgggguuuaacgucuucuccg

SEQ ID NO: 26623 - RNA, 22 nt, Mycobacterium bovis subsp bovis AF2122/97
ucgggugcuacgacuuugccgc

SEQ ID NO: 26624 - RNA, 22 nt, Mycobacterium bovis subsp bovis AF2122/97
ucgguccaccgacggcauagga

SEQ ID NO: 26625 - RNA, 21 nt, Mycobacterium bovis subsp bovis AF2122/97
ucggugaauggcaacgugguc

SEQ ID NO: 26626 - RNA, 22 nt, Mycobacterium bovis subsp bovis AF2122/97
ucggugagcgccugcuucaggg

SEQ ID NO: 26627 - RNA, 22 nt, Mycobacterium bovis subsp bovis AF2122/97
ucggugcggaaucguugugagu

SEQ ID NO: 26628 - RNA, 22 nt, Mycobacterium bovis subsp bovis AF2122/97
ucgguggcgccgacaugccggu

SEQ ID NO: 26629 - RNA, 22 nt, Mycobacterium bovis subsp bovis AF2122/97
ucgguguguuggucacccgcgg

SEQ ID NO: 26630 - RNA, 22 nt, Mycobacterium bovis subsp bovis AF2122/97
ucgguguucgaacugcaggccc

SEQ ID NO: 26631 - RNA, 23 nt, Mycobacterium bovis subsp bovis AF2122/97
ucguaucucccugucccgcaacg

SEQ ID NO: 26632 - RNA, 22 nt, Mycobacterium bovis subsp bovis AF2122/97
ucguccaaugaaccacaacccc

SEQ ID NO: 26633 - RNA, 22 nt, Mycobacterium bovis subsp bovis AF2122/97
ucguccugcgcgaggugaccau

SEQ ID NO: 26634 - RNA, 22 nt, Mycobacterium bovis subsp bovis AF2122/97
ucgucgacgugaucaccgauac

SEQ ID NO: 26635 - RNA, 22 nt, Mycobacterium bovis subsp bovis AF2122/97
ucgucgagggcgucaccgccgc

SEQ ID NO: 26636 - RNA, 21 nt, Mycobacterium bovis subsp bovis AF2122/97
ucgucgagguaacgcaugcgc

SEQ ID NO: 26637 - RNA, 22 nt, Mycobacterium bovis subsp bovis AF2122/97
ucgucgccgguguaguccagcc

SEQ ID NO: 26638 - RNA, 22 nt, Mycobacterium bovis subsp bovis AF2122/97
ucgucggcucagcuucaccggc

SEQ ID NO: 26639 - RNA, 22 nt, Mycobacterium bovis subsp bovis AF2122/97
ucgucgguggacaaggcggccc

SEQ ID NO: 26640 - RNA, 22 nt, Mycobacterium bovis subsp bovis AF2122/97
ucgucguccuugggucgcacgu

SEQ ID NO: 26641 - RNA, 22 nt, Mycobacterium bovis subsp bovis AF2122/97
ucgucgucgcgguccugcuggu

SEQ ID NO: 26642 - RNA, 22 nt, Mycobacterium bovis subsp bovis AF2122/97
ucgugcugucuugcuguuguaa

SEQ ID NO: 26643 - RNA, 21 nt, Mycobacterium bovis subsp bovis AF2122/97
ucguggccgccgagggugacc

SEQ ID NO: 26644 - RNA, 18 nt, Mycobacterium bovis subsp bovis AF2122/97
ucguugauacagcgacca

SEQ ID NO: 26645 - RNA, 22 nt, Mycobacterium bovis subsp bovis AF2122/97
ucguuguuccuguuggccagca

SEQ ID NO: 26646 - RNA, 22 nt, Mycobacterium bovis subsp bovis AF2122/97
ucuccgcccucaguucacguug

SEQ ID NO: 26647 - RNA, 22 nt, Mycobacterium bovis subsp bovis AF2122/97
ucucgaucagcaccgcaaggcc

SEQ ID NO: 26648 - RNA, 22 nt, Mycobacterium bovis subsp bovis AF2122/97
ucucgcccucagugcacgcucg

SEQ ID NO: 26649 - RNA, 22 nt, Mycobacterium bovis subsp bovis AF2122/97
ucucggcgaaagucgacgacgu

SEQ ID NO: 26650 - RNA, 20 nt, Mycobacterium bovis subsp bovis AF2122/97
ucucuccguugcugcagcug

SEQ ID NO: 26651 - RNA, 22 nt, Mycobacterium bovis subsp bovis AF2122/97
ucugcuggucgaugcgggacug

SEQ ID NO: 26652 - RNA, 22 nt, Mycobacterium bovis subsp bovis AF2122/97
ucuggucaccgacgugcaauuc

SEQ ID NO: 26653 - RNA, 23 nt, Mycobacterium bovis subsp bovis AF2122/97
ucuguacgcggagccggacgugc

SEQ ID NO: 26654 - RNA, 22 nt, Mycobacterium bovis subsp bovis AF2122/97
ucuguugguguugcagccggug

SEQ ID NO: 26655 - RNA, 22 nt, Mycobacterium bovis subsp bovis AF2122/97
ucuucgaucugauugccgaacc

SEQ ID NO: 26656 - RNA, 22 nt, Mycobacterium bovis subsp bovis AF2122/97
ucuucgucgaggaacucggcga

SEQ ID NO: 26657 - RNA, 22 nt, Mycobacterium bovis subsp bovis AF2122/97
ugaacgggugcguugaucgcau

SEQ ID NO: 26658 - RNA, 22 nt, Mycobacterium bovis subsp bovis AF2122/97
ugacaacacggcggugguguga

SEQ ID NO: 26659 - RNA, 23 nt, Mycobacterium bovis subsp bovis AF2122/97
ugacaguguggaccagcugagcg

SEQ ID NO: 26660 - RNA, 22 nt, Mycobacterium bovis subsp bovis AF2122/97
ugaccgagagcaugcuggaguu

SEQ ID NO: 26661 - RNA, 22 nt, Mycobacterium bovis subsp bovis AF2122/97
ugaccucgaugcggcgcagcga

SEQ ID NO: 26662 - RNA, 22 nt, Mycobacterium bovis subsp bovis AF2122/97
ugaccucguugaaacgagucga

SEQ ID NO: 26663 - RNA, 22 nt, Mycobacterium bovis subsp bovis AF2122/97
ugagccgauccaggaacgauuc

SEQ ID NO: 26664 - RNA, 22 nt, Mycobacterium bovis subsp bovis AF2122/97
ugaucgaacaucugcccagagg

SEQ ID NO: 26665 - RNA, 22 nt, Mycobacterium bovis subsp bovis AF2122/97
ugaucgacuucgaagacgaugg

SEQ ID NO: 26666 - RNA, 22 nt, Mycobacterium bovis subsp bovis AF2122/97
ugaucgagacggcgaagcggcu

SEQ ID NO: 26667 - RNA, 22 nt, Mycobacterium bovis subsp bovis AF2122/97
ugaucgaucaggaacuggccgc

SEQ ID NO: 26668 - RNA, 22 nt, Mycobacterium bovis subsp bovis AF2122/97
ugaucgcuaggugcucgccggc

SEQ ID NO: 26669 - RNA, 20 nt, Mycobacterium bovis subsp bovis AF2122/97
ugaugggcccagucgugggu

SEQ ID NO: 26670 - RNA, 22 nt, Mycobacterium bovis subsp bovis AF2122/97
ugauguccgucgggaaggugau

SEQ ID NO: 26671 - RNA, 22 nt, Mycobacterium bovis subsp bovis AF2122/97
ugauuccgcucggcucgugcac

SEQ ID NO: 26672 - RNA, 22 nt, Mycobacterium bovis subsp bovis AF2122/97
ugcaccaugggcggcaagcgcu

SEQ ID NO: 26673 - RNA, 22 nt, Mycobacterium bovis subsp bovis AF2122/97
ugcaccugcggaccaugcauca

SEQ ID NO: 26674 - RNA, 22 nt, Mycobacterium bovis subsp bovis AF2122/97
ugcacggcgaugcggucuggca

SEQ ID NO: 26675 - RNA, 22 nt, Mycobacterium bovis subsp bovis AF2122/97
ugcacuccgacccgccgacguu

SEQ ID NO: 26676 - RNA, 18 nt, Mycobacterium bovis subsp bovis AF2122/97
ugcagguugguggcaucc

SEQ ID NO: 26677 - RNA, 22 nt, Mycobacterium bovis subsp bovis AF2122/97
ugcugguagagagugccguacg

SEQ ID NO: 26678 - RNA, 22 nt, Mycobacterium bovis subsp bovis AF2122/97
ugcuggugcccaacgucucgac

SEQ ID NO: 26679 - RNA, 20 nt, Mycobacterium bovis subsp bovis AF2122/97
ugcuguguccgucggcgccc

SEQ ID NO: 26680 - RNA, 22 nt, Mycobacterium bovis subsp bovis AF2122/97
ugcuguucguaguuguuggcgu

SEQ ID NO: 26681 - RNA, 22 nt, Mycobacterium bovis subsp bovis AF2122/97
uggaccaccggugugcucgacg

SEQ ID NO: 26682 - RNA, 21 nt, Mycobacterium bovis subsp bovis AF2122/97
uggacgcagagucaacgugua

SEQ ID NO: 26683 - RNA, 19 nt, Mycobacterium bovis subsp bovis AF2122/97
uggacgguaccggucuucg

SEQ ID NO: 26684 - RNA, 22 nt, Mycobacterium bovis subsp bovis AF2122/97
uggcagccaucacuuugucgcg

SEQ ID NO: 26685 - RNA, 22 nt, Mycobacterium bovis subsp bovis AF2122/97
uggccgcuuuucgauggugucg

SEQ ID NO: 26686 - RNA, 22 nt, Mycobacterium bovis subsp bovis AF2122/97
uggccuugcguagaaugucggc

SEQ ID NO: 26687 - RNA, 22 nt, Mycobacterium bovis subsp bovis AF2122/97
uggcgcaaccccugacccgaga

SEQ ID NO: 26688 - RNA, 22 nt, Mycobacterium bovis subsp bovis AF2122/97
uggcgcuuggccuugucuacgu

SEQ ID NO: 26689 - RNA, 22 nt, Mycobacterium bovis subsp bovis AF2122/97
uggcggacuaccugccggguga

SEQ ID NO: 26690 - RNA, 22 nt, Mycobacterium bovis subsp bovis AF2122/97
uggcgggcgauccgcggagagg

SEQ ID NO: 26691 - RNA, 22 nt, Mycobacterium bovis subsp bovis AF2122/97
uggcucagcgggucaacgaggc

SEQ ID NO: 26692 - RNA, 22 nt, Mycobacterium bovis subsp bovis AF2122/97
ugggacagcuggaaguuaucgg

SEQ ID NO: 26693 - RNA, 22 nt, Mycobacterium bovis subsp bovis AF2122/97
ugggacuucugacagaccugca

SEQ ID NO: 26694 - RNA, 22 nt, Mycobacterium bovis subsp bovis AF2122/97
ugggaugaguccaccuggcggc

SEQ ID NO: 26695 - RNA, 22 nt, Mycobacterium bovis subsp bovis AF2122/97
ugggaugguuuucagcgcccga

SEQ ID NO: 26696 - RNA, 22 nt, Mycobacterium bovis subsp bovis AF2122/97
ugggcacugaauaccggccagg

SEQ ID NO: 26697 - RNA, 23 nt, Mycobacterium bovis subsp bovis AF2122/97
ugggccggcacugcugucgugcg

SEQ ID NO: 26698 - RNA, 22 nt, Mycobacterium bovis subsp bovis AF2122/97
ugggcgauucugugucugcucg

SEQ ID NO: 26699 - RNA, 22 nt, Mycobacterium bovis subsp bovis AF2122/97
ugggcgccuucgacgugacguu

SEQ ID NO: 26700 - RNA, 20 nt, Mycobacterium bovis subsp bovis AF2122/97
ugggcggccgcgaccucuag

SEQ ID NO: 26701 - RNA, 22 nt, Mycobacterium bovis subsp bovis AF2122/97
ugggcuaccgaggucagggcgc

SEQ ID NO: 26702 - RNA, 22 nt, Mycobacterium bovis subsp bovis AF2122/97
uggggcuauggcgcagcuggua

SEQ ID NO: 26703 - RNA, 22 nt, Mycobacterium bovis subsp bovis AF2122/97
ugggggcuuuacgucugcucgc

SEQ ID NO: 26704 - RNA, 22 nt, Mycobacterium bovis subsp bovis AF2122/97
ugggggcuuuuacgucugcucg

SEQ ID NO: 26705 - RNA, 21 nt, Mycobacterium bovis subsp bovis AF2122/97
ugggggcuuuugcgucugcuc

SEQ ID NO: 26706 - RNA, 22 nt, Mycobacterium bovis subsp bovis AF2122/97
ugggguggugccgcugcucgag

SEQ ID NO: 26707 - RNA, 22 nt, Mycobacterium bovis subsp bovis AF2122/97
ugggugccguugcgucugcucg

SEQ ID NO: 26708 - RNA, 22 nt, Mycobacterium bovis subsp bovis AF2122/97
uggguuacccaccgagacugau

SEQ ID NO: 26709 - RNA, 22 nt, Mycobacterium bovis subsp bovis AF2122/97
uggucacgcugauugccgggcc

SEQ ID NO: 26710 - RNA, 22 nt, Mycobacterium bovis subsp bovis AF2122/97
ugguccgauucgaacuccucgc

SEQ ID NO: 26711 - RNA, 22 nt, Mycobacterium bovis subsp bovis AF2122/97
ugguccggucggucgggacgua

SEQ ID NO: 26712 - RNA, 22 nt, Mycobacterium bovis subsp bovis AF2122/97
uggucgaugaucaaggggcgcg

SEQ ID NO: 26713 - RNA, 20 nt, Mycobacterium bovis subsp bovis AF2122/97
uggucgccuugaagaccgac

SEQ ID NO: 26714 - RNA, 18 nt, Mycobacterium bovis subsp bovis AF2122/97
uggucgcgacggccuggc

SEQ ID NO: 26715 - RNA, 22 nt, Mycobacterium bovis subsp bovis AF2122/97
uggucgcuguaaugcguugcuc

SEQ ID NO: 26716 - RNA, 18 nt, Mycobacterium bovis subsp bovis AF2122/97
uggugcaccuuguuuggg

SEQ ID NO: 26717 - RNA, 22 nt, Mycobacterium bovis subsp bovis AF2122/97
uggugccgggcacaaucacggc

SEQ ID NO: 26718 - RNA, 22 nt, Mycobacterium bovis subsp bovis AF2122/97
ugguggacgcagagucaacacg

SEQ ID NO: 26719 - RNA, 22 nt, Mycobacterium bovis subsp bovis AF2122/97
ugguggcaucacaguaggccuc

SEQ ID NO: 26720 - RNA, 22 nt, Mycobacterium bovis subsp bovis AF2122/97
ugguggccgggaucggcauggc

SEQ ID NO: 26721 - RNA, 22 nt, Mycobacterium bovis subsp bovis AF2122/97
ugguggcugugucgaccgggaa

SEQ ID NO: 26722 - RNA, 22 nt, Mycobacterium bovis subsp bovis AF2122/97
uggugucgcgggucgcggucug

SEQ ID NO: 26723 - RNA, 22 nt, Mycobacterium bovis subsp bovis AF2122/97
ugguucggcaaucagaucgaag

SEQ ID NO: 26724 - RNA, 22 nt, Mycobacterium bovis subsp bovis AF2122/97
ugguuucccgugaggugaucgc

SEQ ID NO: 26725 - RNA, 22 nt, Mycobacterium bovis subsp bovis AF2122/97
uguacagcuggaucgugcugca

SEQ ID NO: 26726 - RNA, 22 nt, Mycobacterium bovis subsp bovis AF2122/97
uguagcgagcgaucuugucgau

SEQ ID NO: 26727 - RNA, 22 nt, Mycobacterium bovis subsp bovis AF2122/97
ugucgccgcaaccgucguuauc

SEQ ID NO: 26728 - RNA, 22 nt, Mycobacterium bovis subsp bovis AF2122/97
ugucgcgcaagcucuccggcac

SEQ ID NO: 26729 - RNA, 22 nt, Mycobacterium bovis subsp bovis AF2122/97
ugucgcgucgccagguucacgc

SEQ ID NO: 26730 - RNA, 22 nt, Mycobacterium bovis subsp bovis AF2122/97
ugucgggggcuuuuacgucugc

SEQ ID NO: 26731 - RNA, 22 nt, Mycobacterium bovis subsp bovis AF2122/97
ugucgucggucacucaagccgc

SEQ ID NO: 26732 - RNA, 22 nt, Mycobacterium bovis subsp bovis AF2122/97
ugugacgccaaccucgcgguca

SEQ ID NO: 26733 - RNA, 22 nt, Mycobacterium bovis subsp bovis AF2122/97
ugugcaccuccaccggccagcg

SEQ ID NO: 26734 - RNA, 22 nt, Mycobacterium bovis subsp bovis AF2122/97
ugugcggcugguaugccgcucg

SEQ ID NO: 26735 - RNA, 22 nt, Mycobacterium bovis subsp bovis AF2122/97
uguuggggcuguccgguccggu

SEQ ID NO: 26736 - RNA, 22 nt, Mycobacterium bovis subsp bovis AF2122/97
uguuggugcgguuugcgccugc

SEQ ID NO: 26737 - RNA, 22 nt, Mycobacterium bovis subsp bovis AF2122/97
uuacgccgguugugguuggccg

SEQ ID NO: 26738 - RNA, 22 nt, Mycobacterium bovis subsp bovis AF2122/97
uuaggggcuuuugcgucugcuc

SEQ ID NO: 26739 - RNA, 21 nt, Mycobacterium bovis subsp bovis AF2122/97
uucagcacgcuggccgugauc

SEQ ID NO: 26740 - RNA, 22 nt, Mycobacterium bovis subsp bovis AF2122/97
uucagccgugacguuacgcucg

SEQ ID NO: 26741 - RNA, 22 nt, Mycobacterium bovis subsp bovis AF2122/97
uucaggcuacgguagcggugcg

SEQ ID NO: 26742 - RNA, 22 nt, Mycobacterium bovis subsp bovis AF2122/97
uucaucaguuggucgagguuga

SEQ ID NO: 26743 - RNA, 22 nt, Mycobacterium bovis subsp bovis AF2122/97
uuccggcgcgaccggucugauc

SEQ ID NO: 26744 - RNA, 22 nt, Mycobacterium bovis subsp bovis AF2122/97
uuccucacaugcgcugaucggc

SEQ ID NO: 26745 - RNA, 22 nt, Mycobacterium bovis subsp bovis AF2122/97
uucgaacucgccgcgcaccgug

SEQ ID NO: 26746 - RNA, 22 nt, Mycobacterium bovis subsp bovis AF2122/97
uucgauguggcggaucagggcu

SEQ ID NO: 26747 - RNA, 22 nt, Mycobacterium bovis subsp bovis AF2122/97
uucgcagugcgugcacguucgg

SEQ ID NO: 26748 - RNA, 22 nt, Mycobacterium bovis subsp bovis AF2122/97
uucgccgccgagaucggugcgg

SEQ ID NO: 26749 - RNA, 22 nt, Mycobacterium bovis subsp bovis AF2122/97
uucgcgcacuggguggcggccg

SEQ ID NO: 26750 - RNA, 22 nt, Mycobacterium bovis subsp bovis AF2122/97
gccggacugggugcggcggugg

SEQ ID NO: 26751 - RNA, 22 nt, Mycobacterium bovis subsp bovis AF2122/97
gccggaucuugccgcugguggu

SEQ ID NO: 26752 - RNA, 19 nt, Mycobacterium bovis subsp bovis AF2122/97
gccggccacuccgucggcg

SEQ ID NO: 26753 - RNA, 21 nt, Mycobacterium bovis subsp bovis AF2122/97
gccggccauuuguucgaugcg

SEQ ID NO: 26754 - RNA, 22 nt, Mycobacterium bovis subsp bovis AF2122/97
gccggccuggauucgauauggg

SEQ ID NO: 26755 - RNA, 22 nt, Mycobacterium bovis subsp bovis AF2122/97
gccggcgccggcacucccgacg

SEQ ID NO: 26756 - RNA, 22 nt, Mycobacterium bovis subsp bovis AF2122/97
gccggcuuggacgguuccccgg

SEQ ID NO: 26757 - RNA, 22 nt, Mycobacterium bovis subsp bovis AF2122/97
gccgggaugcacgcacgucacc

SEQ ID NO: 26758 - RNA, 22 nt, Mycobacterium bovis subsp bovis AF2122/97
gccgggcauuacggccgucguu

SEQ ID NO: 26759 - RNA, 22 nt, Mycobacterium bovis subsp bovis AF2122/97
gccggucgccuaagccccgggu

SEQ ID NO: 26760 - RNA, 22 nt, Mycobacterium bovis subsp bovis AF2122/97
gccggugcuggcgaguuggcgg

SEQ ID NO: 26761 - RNA, 22 nt, Mycobacterium bovis subsp bovis AF2122/97
gccgucggccugcgugggguga

SEQ ID NO: 26762 - RNA, 22 nt, Mycobacterium bovis subsp bovis AF2122/97
gccgugccuccccggcgagucc

SEQ ID NO: 26763 - RNA, 22 nt, Mycobacterium bovis subsp bovis AF2122/97
gccgugcuggauuuggccggcg

SEQ ID NO: 26764 - RNA, 22 nt, Mycobacterium bovis subsp bovis AF2122/97
gccuccccaauacagguccugc

SEQ ID NO: 26765 - RNA, 22 nt, Mycobacterium bovis subsp bovis AF2122/97
gccugaucuugccgcugguggu

SEQ ID NO: 26766 - RNA, 20 nt, Mycobacterium bovis subsp bovis AF2122/97
gccugcagaacguugaucuc

SEQ ID NO: 26767 - RNA, 22 nt, Mycobacterium bovis subsp bovis AF2122/97
gccugccgaggacuucgcgggc

SEQ ID NO: 26768 - RNA, 22 nt, Mycobacterium bovis subsp bovis AF2122/97
gccuggacuccgcuuuuggcac

SEQ ID NO: 26769 - RNA, 22 nt, Mycobacterium bovis subsp bovis AF2122/97
gccugguugggugaucgggacg

SEQ ID NO: 26770 - RNA, 22 nt, Mycobacterium bovis subsp bovis AF2122/97
gccuucgacucggcgccgagcg

SEQ ID NO: 26771 - RNA, 22 nt, Mycobacterium bovis subsp bovis AF2122/97
gcgaaaaugccgaccaggcacc

SEQ ID NO: 26772 - RNA, 22 nt, Mycobacterium bovis subsp bovis AF2122/97
gcgacagcggagucgaugccga

SEQ ID NO: 26773 - RNA, 22 nt, Mycobacterium bovis subsp bovis AF2122/97
gcgaccgcaggaccaagcgcgg

SEQ ID NO: 26774 - RNA, 22 nt, Mycobacterium bovis subsp bovis AF2122/97
gcgaccgggaugucgauguuca

SEQ ID NO: 26775 - RNA, 22 nt, Mycobacterium bovis subsp bovis AF2122/97
gcgaccgugaaucuggcgacgc

SEQ ID NO: 26776 - RNA, 19 nt, Mycobacterium bovis subsp bovis AF2122/97
gcgacgcccgcgccaccau

SEQ ID NO: 26777 - RNA, 22 nt, Mycobacterium bovis subsp bovis AF2122/97
gcgacgcugaagagcccgacga

SEQ ID NO: 26778 - RNA, 22 nt, Mycobacterium bovis subsp bovis AF2122/97
gcgacggcaccgaucaucacgg

SEQ ID NO: 26779 - RNA, 22 nt, Mycobacterium bovis subsp bovis AF2122/97
gcgacgucaugaucgcgcuggg

SEQ ID NO: 26780 - RNA, 22 nt, Mycobacterium bovis subsp bovis AF2122/97
gcgacucgcuggguguggguaa

SEQ ID NO: 26781 - RNA, 22 nt, Mycobacterium bovis subsp bovis AF2122/97
gcgagacgcaaaaucgcccaaa

SEQ ID NO: 26782 - RNA, 22 nt, Mycobacterium bovis subsp bovis AF2122/97
gcgagcguaacgccacggcgag

SEQ ID NO: 26783 - RNA, 22 nt, Mycobacterium bovis subsp bovis AF2122/97
gcgagcuggccacccggugugu

SEQ ID NO: 26784 - RNA, 22 nt, Mycobacterium bovis subsp bovis AF2122/97
gcgaucagguucgacgcgcauc

SEQ ID NO: 26785 - RNA, 19 nt, Mycobacterium bovis subsp bovis AF2122/97
gcgauccggcggcuaucac

SEQ ID NO: 26786 - RNA, 22 nt, Mycobacterium bovis subsp bovis AF2122/97
gcgaucgacgacagcccgauca

SEQ ID NO: 26787 - RNA, 22 nt, Mycobacterium bovis subsp bovis AF2122/97
gcgaucgcaagcucggcgcuug

SEQ ID NO: 26788 - RNA, 20 nt, Mycobacterium bovis subsp bovis AF2122/97
gcgauucugauuugcccagc

SEQ ID NO: 26789 - RNA, 22 nt, Mycobacterium bovis subsp bovis AF2122/97
gcgauucugcgucugcucgccg

SEQ ID NO: 26790 - RNA, 21 nt, Mycobacterium bovis subsp bovis AF2122/97
gcgauucugcgucugcucgcg

SEQ ID NO: 26791 - RNA, 22 nt, Mycobacterium bovis subsp bovis AF2122/97
gcgauuuugcgucugcucgccg

SEQ ID NO: 26792 - RNA, 23 nt, Mycobacterium bovis subsp bovis AF2122/97
gcgauuuugcgucugcucgcgcc

SEQ ID NO: 26793 - RNA, 22 nt, Mycobacterium bovis subsp bovis AF2122/97
gcgcacgucguugucggcuccu

SEQ ID NO: 26794 - RNA, 22 nt, Mycobacterium bovis subsp bovis AF2122/97
gcgcagcagcgacaggguggcg

SEQ ID NO: 26795 - RNA, 22 nt, Mycobacterium bovis subsp bovis AF2122/97
gcgcaguacgucgagaccuucg

SEQ ID NO: 26796 - RNA, 22 nt, Mycobacterium bovis subsp bovis AF2122/97
gcgcccggaccuggugaucggc

SEQ ID NO: 26797 - RNA, 22 nt, Mycobacterium bovis subsp bovis AF2122/97
gcgccgcggagauugaucgcga

SEQ ID NO: 26798 - RNA, 22 nt, Mycobacterium bovis subsp bovis AF2122/97
gcgccgguuggcugccgugguu

SEQ ID NO: 26799 - RNA, 22 nt, Mycobacterium bovis subsp bovis AF2122/97
gcgccuaugacgguccgcagga

SEQ ID NO: 26800 - RNA, 22 nt, Mycobacterium bovis subsp bovis AF2122/97
gcgcgaugugcugcucgggucu

SEQ ID NO: 26801 - RNA, 19 nt, Mycobacterium bovis subsp bovis AF2122/97
gcgcgcaaggcgucccugc

SEQ ID NO: 26802 - RNA, 22 nt, Mycobacterium bovis subsp bovis AF2122/97
gcgcggacuaccgggucugcac

SEQ ID NO: 26803 - RNA, 22 nt, Mycobacterium bovis subsp bovis AF2122/97
gcgcggucgacuuacgcgaugg

SEQ ID NO: 26804 - RNA, 22 nt, Mycobacterium bovis subsp bovis AF2122/97
gcgcggugugcugcacucggcg

SEQ ID NO: 26805 - RNA, 22 nt, Mycobacterium bovis subsp bovis AF2122/97
gcgcuaucgguuugagcgcccg

SEQ ID NO: 26806 - RNA, 21 nt, Mycobacterium bovis subsp bovis AF2122/97
gcgcucgaucacuagcgcccc

SEQ ID NO: 26807 - RNA, 22 nt, Mycobacterium bovis subsp bovis AF2122/97
gcgcugaccgcggcucaguuug

SEQ ID NO: 26808 - RNA, 18 nt, Mycobacterium bovis subsp bovis AF2122/97
gcgcugcugucgauuucg

SEQ ID NO: 26809 - RNA, 20 nt, Mycobacterium bovis subsp bovis AF2122/97
gcgcugucccggccugcugg

SEQ ID NO: 26810 - RNA, 22 nt, Mycobacterium bovis subsp bovis AF2122/97
gcgcuguggcucacgacgacga

SEQ ID NO: 26811 - RNA, 22 nt, Mycobacterium bovis subsp bovis AF2122/97
gcggacacgaucgcgucggcua

SEQ ID NO: 26812 - RNA, 22 nt, Mycobacterium bovis subsp bovis AF2122/97
gcggacagaauacgcugccgau

SEQ ID NO: 26813 - RNA, 22 nt, Mycobacterium bovis subsp bovis AF2122/97
gcggacgucgaugucgagcugu

SEQ ID NO: 26814 - RNA, 22 nt, Mycobacterium bovis subsp bovis AF2122/97
gcggaucgacaaccaguugcgu

SEQ ID NO: 26815 - RNA, 22 nt, Mycobacterium bovis subsp bovis AF2122/97
gcggaugcggcaguucaucacc

SEQ ID NO: 26816 - RNA, 22 nt, Mycobacterium bovis subsp bovis AF2122/97
gcggcagcagugagcacccgca

SEQ ID NO: 26817 - RNA, 22 nt, Mycobacterium bovis subsp bovis AF2122/97
gcggccaacgaggcagcggcgg

SEQ ID NO: 26818 - RNA, 22 nt, Mycobacterium bovis subsp bovis AF2122/97
gcggcccgccgaugugcugguc

SEQ ID NO: 26819 - RNA, 22 nt, Mycobacterium bovis subsp bovis AF2122/97
gcggcgaaggugagcuggggau

SEQ ID NO: 26820 - RNA, 22 nt, Mycobacterium bovis subsp bovis AF2122/97
gcggcgaccuguccggcgguua

SEQ ID NO: 26821 - RNA, 22 nt, Mycobacterium bovis subsp bovis AF2122/97
gcggcgccgauguggaagccgu

SEQ ID NO: 26822 - RNA, 22 nt, Mycobacterium bovis subsp bovis AF2122/97
gcggcgcgccuuggucuuggug

SEQ ID NO: 26823 - RNA, 22 nt, Mycobacterium bovis subsp bovis AF2122/97
ucaggaucgggguagcugagcg

SEQ ID NO: 26824 - RNA, 22 nt, Mycobacterium bovis subsp bovis AF2122/97
ucaggcugggcgaaccugggca

SEQ ID NO: 26825 - RNA, 23 nt, Mycobacterium bovis subsp bovis AF2122/97
ucauaccgaccaccuguccuagg

SEQ ID NO: 26826 - RNA, 22 nt, Mycobacterium bovis subsp bovis AF2122/97
ucaucaccggaucgccgccgac

SEQ ID NO: 26827 - RNA, 18 nt, Mycobacterium bovis subsp bovis AF2122/97
ucaucgagcacggguuga

SEQ ID NO: 26828 - RNA, 20 nt, Mycobacterium bovis subsp bovis AF2122/97
ucaucgccgguuacgaagcc

SEQ ID NO: 26829 - RNA, 22 nt, Mycobacterium bovis subsp bovis AF2122/97
ucaucgggcacaucgucgcggu

SEQ ID NO: 26830 - RNA, 22 nt, Mycobacterium bovis subsp bovis AF2122/97
ucaugcgacucugcgucugcuc

SEQ ID NO: 26831 - RNA, 23 nt, Mycobacterium bovis subsp bovis AF2122/97
uccaacuccaagaugccgccccc

SEQ ID NO: 26832 - RNA, 22 nt, Mycobacterium bovis subsp bovis AF2122/97
uccacgcaacuggccgcgacac

SEQ ID NO: 26833 - RNA, 22 nt, Mycobacterium bovis subsp bovis AF2122/97
uccaggguggugcggaucaggu

SEQ ID NO: 26834 - RNA, 23 nt, Mycobacterium bovis subsp bovis AF2122/97
ucccaggugccauacgagcugaa

SEQ ID NO: 26835 - RNA, 22 nt, Mycobacterium bovis subsp bovis AF2122/97
ucccggcguaguucaccgcggu

SEQ ID NO: 26836 - RNA, 22 nt, Mycobacterium bovis subsp bovis AF2122/97
uccgcccucaguucacguucgg

SEQ ID NO: 26837 - RNA, 22 nt, Mycobacterium bovis subsp bovis AF2122/97
uccgcgcaccacgaccgaaccg

SEQ ID NO: 26838 - RNA, 22 nt, Mycobacterium bovis subsp bovis AF2122/97
uccgcugaccgagggcugggcu

SEQ ID NO: 26839 - RNA, 22 nt, Mycobacterium bovis subsp bovis AF2122/97
uccggacgcggucaugggcguu

SEQ ID NO: 26840 - RNA, 22 nt, Mycobacterium bovis subsp bovis AF2122/97
uccggcgucugguggcgguggc

SEQ ID NO: 26841 - RNA, 22 nt, Mycobacterium bovis subsp bovis AF2122/97
uccgggucuaugucgagaccgu

SEQ ID NO: 26842 - RNA, 22 nt, Mycobacterium bovis subsp bovis AF2122/97
uccgguagagccgguuucgccg

SEQ ID NO: 26843 - RNA, 22 nt, Mycobacterium bovis subsp bovis AF2122/97
uccgucaaacguugaaucgacu

SEQ ID NO: 26844 - RNA, 22 nt, Mycobacterium bovis subsp bovis AF2122/97
uccguccggucugaccacuaau

SEQ ID NO: 26845 - RNA, 21 nt, Mycobacterium bovis subsp bovis AF2122/97
uccguggugaugaccgcccga

SEQ ID NO: 26846 - RNA, 22 nt, Mycobacterium bovis subsp bovis AF2122/97
uccgugugucacgacgucgccu

SEQ ID NO: 26847 - RNA, 22 nt, Mycobacterium bovis subsp bovis AF2122/97
uccguugacucugcguccacca

SEQ ID NO: 26848 - RNA, 18 nt, Mycobacterium bovis subsp bovis AF2122/97
uccguugcgccucgucga

SEQ ID NO: 26849 - RNA, 22 nt, Mycobacterium bovis subsp bovis AF2122/97
uccucgacggcgucgggguacg

SEQ ID NO: 26850 - RNA, 22 nt, Mycobacterium bovis subsp bovis AF2122/97
ucgaaacccagccaccucuugg

SEQ ID NO: 26851 - RNA, 22 nt, Mycobacterium bovis subsp bovis AF2122/97
ucgaacgugaacggcuggaguc

SEQ ID NO: 26852 - RNA, 22 nt, Mycobacterium bovis subsp bovis AF2122/97
ucgaagccgaacggcgccgggu

SEQ ID NO: 26853 - RNA, 21 nt, Mycobacterium bovis subsp bovis AF2122/97
ucgaaggaucacgcgaugacc

SEQ ID NO: 26854 - RNA, 21 nt, Mycobacterium bovis subsp bovis AF2122/97
ucgaaugugugggaucggccg

SEQ ID NO: 26855 - RNA, 22 nt, Mycobacterium bovis subsp bovis AF2122/97
ucgacgagcacgcguaggaccg

SEQ ID NO: 26856 - RNA, 22 nt, Mycobacterium bovis subsp bovis AF2122/97
ucgacgcgggaacaccguuggg

SEQ ID NO: 26857 - RNA, 22 nt, Mycobacterium bovis subsp bovis AF2122/97
ucgacgguguaacccgccgcga

SEQ ID NO: 26858 - RNA, 22 nt, Mycobacterium bovis subsp bovis AF2122/97
ucgacgugaucaaugcugaucg

SEQ ID NO: 26859 - RNA, 22 nt, Mycobacterium bovis subsp bovis AF2122/97
ucgacuccuauggugcggagca

SEQ ID NO: 26860 - RNA, 22 nt, Mycobacterium bovis subsp bovis AF2122/97
ucgagcccggcgacuucgugau

SEQ ID NO: 26861 - RNA, 22 nt, Mycobacterium bovis subsp bovis AF2122/97
ucgagcggcauaccagccgcac

SEQ ID NO: 26862 - RNA, 19 nt, Mycobacterium bovis subsp bovis AF2122/97
ucgagcguuggcgcgccga

SEQ ID NO: 26863 - RNA, 22 nt, Mycobacterium bovis subsp bovis AF2122/97
ucgagcucacccaggguggccg

SEQ ID NO: 26864 - RNA, 22 nt, Mycobacterium bovis subsp bovis AF2122/97
ucgauaucgagggcuacgugcg

SEQ ID NO: 26865 - RNA, 22 nt, Mycobacterium bovis subsp bovis AF2122/97
ucgaugacuaucugcggauggc

SEQ ID NO: 26866 - RNA, 22 nt, Mycobacterium bovis subsp bovis AF2122/97
ucgaugagcgauuggaacaacg

SEQ ID NO: 26867 - RNA, 22 nt, Mycobacterium bovis subsp bovis AF2122/97
ucgaugggcacaccgcuggcgc

SEQ ID NO: 26868 - RNA, 22 nt, Mycobacterium bovis subsp bovis AF2122/97
ucgaugucgaccagcuuggugu

SEQ ID NO: 26869 - RNA, 21 nt, Mycobacterium bovis subsp bovis AF2122/97
ucgaugugccggaaugcgccc

SEQ ID NO: 26870 - RNA, 22 nt, Mycobacterium bovis subsp bovis AF2122/97
ucgaugugcuccaugaucccgc

SEQ ID NO: 26871 - RNA, 22 nt, Mycobacterium bovis subsp bovis AF2122/97
ucgcaccgcggucauuuucacc

SEQ ID NO: 26872 - RNA, 20 nt, Mycobacterium bovis subsp bovis AF2122/97
ucgcagccagguuacgcucg

SEQ ID NO: 26873 - RNA, 20 nt, Mycobacterium bovis subsp bovis AF2122/97
ucgcagugcgguuacgcucg

SEQ ID NO: 26874 - RNA, 22 nt, Mycobacterium bovis subsp bovis AF2122/97
ucgcaguggcgucacgcuggcg

SEQ ID NO: 26875 - RNA, 20 nt, Mycobacterium bovis subsp bovis AF2122/97
ucgcaguggcguuacgcucg

SEQ ID NO: 26876 - RNA, 22 nt, Mycobacterium bovis subsp bovis AF2122/97
ucgccagccguuggcguggaaa

SEQ ID NO: 26877 - RNA, 20 nt, Mycobacterium bovis subsp bovis AF2122/97
ucgccaggccguagaugccg

SEQ ID NO: 26878 - RNA, 22 nt, Mycobacterium bovis subsp bovis AF2122/97
ucgccaucguugcugauccccg

SEQ ID NO: 26879 - RNA, 22 nt, Mycobacterium bovis subsp bovis AF2122/97
ucgcccugacgucacguucggc

SEQ ID NO: 26880 - RNA, 22 nt, Mycobacterium bovis subsp bovis AF2122/97
ucgccgaacgugaacugagggc

SEQ ID NO: 26881 - RNA, 22 nt, Mycobacterium bovis subsp bovis AF2122/97
ucgccgaccugcgcacugucgc

SEQ ID NO: 26882 - RNA, 22 nt, Mycobacterium bovis subsp bovis AF2122/97
ucgccgagccuuuaguuaucgu

SEQ ID NO: 26883 - RNA, 22 nt, Mycobacterium bovis subsp bovis AF2122/97
ucgccgccaugaaaccacuuga

SEQ ID NO: 26884 - RNA, 22 nt, Mycobacterium bovis subsp bovis AF2122/97
ucgccggcgaauccgguaccug

SEQ ID NO: 26885 - RNA, 22 nt, Mycobacterium bovis subsp bovis AF2122/97
ucgccgggccaucguggagcgg

SEQ ID NO: 26886 - RNA, 22 nt, Mycobacterium bovis subsp bovis AF2122/97
ucgccggucagcgugcagguag

SEQ ID NO: 26887 - RNA, 22 nt, Mycobacterium bovis subsp bovis AF2122/97
ucgcgaggcaacgucgugaucg

SEQ ID NO: 26888 - RNA, 22 nt, Mycobacterium bovis subsp bovis AF2122/97
ucgcgcccgugcaacagugacu

SEQ ID NO: 26889 - RNA, 22 nt, Mycobacterium bovis subsp bovis AF2122/97
ucgcgcugacgucgaucucgac

SEQ ID NO: 26890 - RNA, 22 nt, Mycobacterium bovis subsp bovis AF2122/97
ucgcggcgauguggagcacgau

SEQ ID NO: 26891 - RNA, 22 nt, Mycobacterium bovis subsp bovis AF2122/97
ucgcggugcccacccagcauga

SEQ ID NO: 26892 - RNA, 22 nt, Mycobacterium bovis subsp bovis AF2122/97
ucgcugaggcuguaacucugca

SEQ ID NO: 26893 - RNA, 22 nt, Mycobacterium bovis subsp bovis AF2122/97
ucgcugauagucgcuccauccg

SEQ ID NO: 26894 - RNA, 22 nt, Mycobacterium leprae
acccgaucaacaauggacaggc

SEQ ID NO: 26895 - RNA, 19 nt, Mycobacterium leprae
acccgcaacugcuugcggu

SEQ ID NO: 26896 - RNA, 19 nt, Mycobacterium leprae
acccgcucugccagcgccg

SEQ ID NO: 26897 - RNA, 22 nt, Mycobacterium leprae
acccgguugauugcguaggcgg

SEQ ID NO: 26898 - RNA, 22 nt, Mycobacterium leprae
acccguuggagacugacgcugc

SEQ ID NO: 26899 - RNA, 20 nt, Mycobacterium leprae
accgaaagugugcucgaccc

SEQ ID NO: 26900 - RNA, 22 nt, Mycobacterium leprae
accgacuacggaucaccuggca

SEQ ID NO: 26901 - RNA, 22 nt, Mycobacterium leprae
accgcucccuuaagcacgguga

SEQ ID NO: 26902 - RNA, 22 nt, Mycobacterium leprae
accggccgcgggauggcguucc

SEQ ID NO: 26903 - RNA, 22 nt, Mycobacterium leprae
accgggaaugcacgaugccuaa

SEQ ID NO: 26904 - RNA, 22 nt, Mycobacterium leprae
accgggaucgggucagcaguca

SEQ ID NO: 26905 - RNA, 22 nt, Mycobacterium leprae
accggucgcggcaauccuuucg

SEQ ID NO: 26906 - RNA, 20 nt, Mycobacterium leprae
accguucguuuugacaggug

SEQ ID NO: 26907 - RNA, 22 nt, Mycobacterium leprae
accuccgggauugaauacaugc

SEQ ID NO: 26908 - RNA, 22 nt, Mycobacterium leprae
accucgcgguggaagaucgcuc

SEQ ID NO: 26909 - RNA, 22 nt, Mycobacterium leprae
accucggcgaucuguaguccaa

SEQ ID NO: 26910 - RNA, 19 nt, Mycobacterium leprae
accucggugaucgcgguga

SEQ ID NO: 26911 - RNA, 22 nt, Mycobacterium leprae
accuugguguugaugccgauuc

SEQ ID NO: 26912 - RNA, 22 nt, Mycobacterium leprae
acgacugcguuguacucagcac

SEQ ID NO: 26913 - RNA, 22 nt, Mycobacterium leprae
acgagugguggucgccaaugcc

SEQ ID NO: 26914 - RNA, 22 nt, Mycobacterium leprae
acgaugcgguaccacucgaucg

SEQ ID NO: 26915 - RNA, 22 nt, Mycobacterium leprae
acgcacgagaucggggcgggcu

SEQ ID NO: 26916 - RNA, 22 nt, Mycobacterium leprae
acgcaugaauguguugcgcuac

SEQ ID NO: 26917 - RNA, 22 nt, Mycobacterium leprae
acgcgaccggugaacucgucga

SEQ ID NO: 26918 - RNA, 22 nt, Mycobacterium leprae
acgcuaucgucacgcuggacgg

SEQ ID NO: 26919 - RNA, 22 nt, Mycobacterium leprae
acgcucgaaauacgcgcagcug

SEQ ID NO: 26920 - RNA, 22 nt, Mycobacterium leprae
acgcuugcuucccucgauuggc

SEQ ID NO: 26921 - RNA, 22 nt, Mycobacterium leprae
acggaccagcgcaccgccgucu

SEQ ID NO: 26922 - RNA, 22 nt, Mycobacterium leprae
acggaucaauaccgacgcgaug

SEQ ID NO: 26923 - RNA, 22 nt, Mycobacterium leprae
acggauuuggcuugcugggagu

SEQ ID NO: 26924 - RNA, 22 nt, Mycobacterium leprae
acggcgagggcagguagucgau

SEQ ID NO: 26925 - RNA, 22 nt, Mycobacterium leprae
acgggcaccgaucacaauguug

SEQ ID NO: 26926 - RNA, 22 nt, Mycobacterium leprae
acguccuguugcgguaccgccc

SEQ ID NO: 26927 - RNA, 19 nt, Mycobacterium leprae
acgucgacgccagacccgg

SEQ ID NO: 26928 - RNA, 22 nt, Mycobacterium leprae
acgugcugacauucggcgggcu

SEQ ID NO: 26929 - RNA, 21 nt, Mycobacterium leprae
acgugcuguucuggcgagagg

SEQ ID NO: 26930 - RNA, 22 nt, Mycobacterium leprae
acguuugccuuuaggacaggcu

SEQ ID NO: 26931 - RNA, 22 nt, Mycobacterium leprae
acuaugccaaaaggcuguauag

SEQ ID NO: 26932 - RNA, 22 nt, Mycobacterium leprae
acucaaccagauugcucaccac

SEQ ID NO: 26933 - RNA, 22 nt, Mycobacterium leprae
acucgacacucucgaugccgga

SEQ ID NO: 26934 - RNA, 22 nt, Mycobacterium leprae
acucggcgcaucaauagcuccc

SEQ ID NO: 26935 - RNA, 22 nt, Mycobacterium leprae
acucuugcguccacaucgcguu

SEQ ID NO: 26936 - RNA, 22 nt, Mycobacterium leprae
acugaugcagugagcuuuaccg

SEQ ID NO: 26937 - RNA, 22 nt, Mycobacterium leprae
acugcgaucgaccuccuuaccu

SEQ ID NO: 26938 - RNA, 22 nt, Mycobacterium leprae
acuggucgaugcugaugguugg

SEQ ID NO: 26939 - RNA, 22 nt, Mycobacterium leprae
acuucccaagggcuaugaugug

SEQ ID NO: 26940 - RNA, 22 nt, Mycobacterium leprae
acuucgccggcggacuucggau

SEQ ID NO: 26941 - RNA, 22 nt, Mycobacterium leprae
acuucucgauaacggcauccga

SEQ ID NO: 26942 - RNA, 17 nt, Mycobacterium leprae
agaucgaccggaugucg

SEQ ID NO: 26943 - RNA, 22 nt, Mycobacterium leprae
agaucggcacaguggugaugcu

SEQ ID NO: 26944 - RNA, 22 nt, Mycobacterium leprae
agauggauaagccucgcagcga

SEQ ID NO: 26945 - RNA, 22 nt, Mycobacterium leprae
agcaacugccgggcuggcgaaa

SEQ ID NO: 26946 - RNA, 23 nt, Mycobacterium leprae
agcaccggcccggcgcaucggag

SEQ ID NO: 26947 - RNA, 22 nt, Mycobacterium leprae
agcaucgaucgucgccacccgc

SEQ ID NO: 26948 - RNA, 22 nt, Mycobacterium leprae
agccauccuggugagcuuucuu

SEQ ID NO: 26949 - RNA, 20 nt, Mycobacterium leprae
agcccggaucaccgaugcug

SEQ ID NO: 26950 - RNA, 21 nt, Mycobacterium leprae
agccgccguggggcugccggu

SEQ ID NO: 26951 - RNA, 22 nt, Mycobacterium leprae
agcgacaccauagccgccauga

SEQ ID NO: 26952 - RNA, 22 nt, Mycobacterium leprae
agcgaucacaccuucgugccga

SEQ ID NO: 26953 - RNA, 22 nt, Mycobacterium leprae
agcgcaucacuucagcgacagg

SEQ ID NO: 26954 - RNA, 22 nt, Mycobacterium leprae
agcgccgcugguccagcgguua

SEQ ID NO: 26955 - RNA, 22 nt, Mycobacterium leprae
agcggcccgaugucgcuggaga

SEQ ID NO: 26956 - RNA, 22 nt, Mycobacterium leprae
agcggucauacugcgcuggcuc

SEQ ID NO: 26957 - RNA, 22 nt, Mycobacterium leprae
agcguguuauaauuagccaacg

SEQ ID NO: 26958 - RNA, 22 nt, Mycobacterium leprae
agcugcguuggaccggauugcu

SEQ ID NO: 26959 - RNA, 22 nt, Mycobacterium leprae
agcuggacguuucgacggcaaa

SEQ ID NO: 26960 - RNA, 22 nt, Mycobacterium leprae
agcuggccgagguugacagugc

SEQ ID NO: 26961 - RNA, 22 nt, Mycobacterium leprae
agcuugacaucgggugguuuca

SEQ ID NO: 26962 - RNA, 22 nt, Mycobacterium leprae
agcuugcccaagacaaaccgcg

SEQ ID NO: 26963 - RNA, 22 nt, Mycobacterium leprae
agcuugcuuggcuuggccgagg

SEQ ID NO: 26964 - RNA, 22 nt, Mycobacterium leprae
aggccaccgccggcgaagccgg

SEQ ID NO: 26965 - RNA, 22 nt, Mycobacterium leprae
aggcccagucgcugcugcuguc

SEQ ID NO: 26966 - RNA, 22 nt, Mycobacterium leprae
aggcuaucguuucggcugcgau

SEQ ID NO: 26967 - RNA, 22 nt, Mycobacterium leprae
aggcugaccucggucacuacuu

SEQ ID NO: 26968 - RNA, 22 nt, Mycobacterium leprae
agggcagcgucaucguccucgg

SEQ ID NO: 26969 - RNA, 22 nt, Mycobacterium leprae
agggcgccaaauugggcgugcc

SEQ ID NO: 26970 - RNA, 22 nt, Mycobacterium leprae
agggcggaauuccaucgaggua

SEQ ID NO: 26971 - RNA, 23 nt, Mycobacterium leprae
aggguuugaaguuuggguggcug

SEQ ID NO: 26972 - RNA, 22 nt, Mycobacterium leprae
agguaauggucgagauugcaaa

SEQ ID NO: 26973 - RNA, 22 nt, Mycobacterium leprae
aggugugguuaggcgacaccgc

SEQ ID NO: 26974 - RNA, 22 nt, Mycobacterium leprae
agucaguuccuuagcgaugccg

SEQ ID NO: 26975 - RNA, 22 nt, Mycobacterium leprae
agucgagaucaacguuuugccg

SEQ ID NO: 26976 - RNA, 22 nt, Mycobacterium leprae
agucgguaucggcagcgucgaa

SEQ ID NO: 26977 - RNA, 19 nt, Mycobacterium leprae
agucguccuugaucguguc

SEQ ID NO: 26978 - RNA, 22 nt, Mycobacterium leprae
agugauuccuugccuggacguc

SEQ ID NO: 26979 - RNA, 22 nt, Mycobacterium leprae
agugggcgacaucugagugauc

SEQ ID NO: 26980 - RNA, 22 nt, Mycobacterium leprae
agugugguccggggucggcuag

SEQ ID NO: 26981 - RNA, 23 nt, Mycobacterium leprae
aguucggugucaccugcacauuu

SEQ ID NO: 26982 - RNA, 22 nt, Mycobacterium leprae
aguucuuggccgaccucguacu

SEQ ID NO: 26983 - RNA, 22 nt, Mycobacterium leprae
aucaacgccagacgggugaacg

SEQ ID NO: 26984 - RNA, 22 nt, Mycobacterium leprae
ccgcacaccaucaugcggauuu

SEQ ID NO: 26985 - RNA, 22 nt, Mycobacterium leprae
ccgcacauguugcggcauuccu

SEQ ID NO: 26986 - RNA, 22 nt, Mycobacterium leprae
ccgcagcuucgauauaucgaau

SEQ ID NO: 26987 - RNA, 22 nt, Mycobacterium leprae
ccgcagucguucgacaccguuu

SEQ ID NO: 26988 - RNA, 22 nt, Mycobacterium leprae
ccgcauagcgaacauugucgcc

SEQ ID NO: 26989 - RNA, 22 nt, Mycobacterium leprae
ccgccgacgagaucaagacggu

SEQ ID NO: 26990 - RNA, 22 nt, Mycobacterium leprae
ccgcggucgacacagcugcaac

SEQ ID NO: 26991 - RNA, 22 nt, Mycobacterium leprae
ccgcugcaggcgguuaggcucc

SEQ ID NO: 26992 - RNA, 22 nt, Mycobacterium leprae
ccgcuugaucgagggugugcug

SEQ ID NO: 26993 - RNA, 22 nt, Mycobacterium leprae
ccggcagugucguuggugcuua

SEQ ID NO: 26994 - RNA, 22 nt, Mycobacterium leprae
ccggcugacagugucgcugcug

SEQ ID NO: 26995 - RNA, 22 nt, Mycobacterium leprae
ccgggcuagcgaucgacguaac

SEQ ID NO: 26996 - RNA, 22 nt, Mycobacterium leprae
ccggggguggaguuccguaccu

SEQ ID NO: 26997 - RNA, 22 nt, Mycobacterium leprae
ccgggucgagacggcuuucagg

SEQ ID NO: 26998 - RNA, 22 nt, Mycobacterium leprae
ccgguacucggaauggcggcag

SEQ ID NO: 26999 - RNA, 22 nt, Mycobacterium leprae
ccggucggugaauaugguggcu

SEQ ID NO: 27000 - RNA, 22 nt, Mycobacterium leprae
ccggucugcuggucggcaucgg

SEQ ID NO: 27001 - RNA, 22 nt, Mycobacterium leprae
ccucggcucuauaccgguuugu

SEQ ID NO: 27002 - RNA, 22 nt, Mycobacterium leprae
ccuggcgcagucuaaggugguu

SEQ ID NO: 27003 - RNA, 22 nt, Mycobacterium leprae
ccugugcuggccgacugcacuc

SEQ ID NO: 27004 - RNA, 22 nt, Mycobacterium leprae
ccuuguccaaacucgaggcgau

SEQ ID NO: 27005 - RNA, 22 nt, Mycobacterium leprae
cgacaccauagccgccaugacg

SEQ ID NO: 27006 - RNA, 22 nt, Mycobacterium leprae
cgacacgcugaacuuguguugu

SEQ ID NO: 27007 - RNA, 22 nt, Mycobacterium leprae
cgacgggucggaauaccgcgga

SEQ ID NO: 27008 - RNA, 22 nt, Mycobacterium leprae
cgagacgaccuguugugguguc

SEQ ID NO: 27009 - RNA, 22 nt, Mycobacterium leprae
cgagcauugcaugcucgcguug

SEQ ID NO: 27010 - RNA, 22 nt, Mycobacterium leprae
cgagcugcgacuagcugaugcc

SEQ ID NO: 27011 - RNA, 22 nt, Mycobacterium leprae
cgauggcugcaucgaggucgcg

SEQ ID NO: 27012 - RNA, 22 nt, Mycobacterium leprae
cgaugucgcuuuguuugccauc

SEQ ID NO: 27013 - RNA, 23 nt, Mycobacterium leprae
cgcauucaugauuuuauccgcac

SEQ ID NO: 27014 - RNA, 20 nt, Mycobacterium leprae
cgccacucuaagucaccgac

SEQ ID NO: 27015 - RNA, 22 nt, Mycobacterium leprae
cgccagcugcgcgaggugccgg

SEQ ID NO: 27016 - RNA, 22 nt, Mycobacterium leprae
cgccagguugaucaacggggac

SEQ ID NO: 27017 - RNA, 21 nt, Mycobacterium leprae
cgccgaccaacgggucuuggu

SEQ ID NO: 27018 - RNA, 22 nt, Mycobacterium leprae
cgccggcugcggucaagucgac

SEQ ID NO: 27019 - RNA, 22 nt, Mycobacterium leprae
cgccgugaccggaucccgauca

SEQ ID NO: 27020 - RNA, 22 nt, Mycobacterium leprae
cgccuaguaaccgcgccagauu

SEQ ID NO: 27021 - RNA, 22 nt, Mycobacterium leprae
cgccugauagcggcuuuuagca

SEQ ID NO: 27022 - RNA, 22 nt, Mycobacterium leprae
cgcgagaucgaucgugagcugg

SEQ ID NO: 27023 - RNA, 22 nt, Mycobacterium leprae
cgcgaugguauaagcccuggcg

SEQ ID NO: 27024 - RNA, 22 nt, Mycobacterium leprae
cgcgcggaucacggccguuucc

SEQ ID NO: 27025 - RNA, 23 nt, Mycobacterium leprae
cgcgcuugucuaagucuucauuc

SEQ ID NO: 27026 - RNA, 22 nt, Mycobacterium leprae
cgcggagggacgcugggaugau

SEQ ID NO: 27027 - RNA, 22 nt, Mycobacterium leprae
cgcggauucgccaugaacugac

SEQ ID NO: 27028 - RNA, 22 nt, Mycobacterium leprae
cgcgguuguccaacacacacau

SEQ ID NO: 27029 - RNA, 22 nt, Mycobacterium leprae
cgcgucgcaguauccauacucg

SEQ ID NO: 27030 - RNA, 22 nt, Mycobacterium leprae
cgcgugcucaaccuuugacaua

SEQ ID NO: 27031 - RNA, 22 nt, Mycobacterium leprae
cgcguggugaugacggccccgg

SEQ ID NO: 27032 - RNA, 20 nt, Mycobacterium leprae
cgcuggucacguggauccuc

SEQ ID NO: 27033 - RNA, 22 nt, Mycobacterium leprae
cgcuguggcaucagcuacccga

SEQ ID NO: 27034 - RNA, 22 nt, Mycobacterium leprae
cggaaacugacgcaccuuggca

SEQ ID NO: 27035 - RNA, 22 nt, Mycobacterium leprae
cggaauccuguugacguguuuu

SEQ ID NO: 27036 - RNA, 22 nt, Mycobacterium leprae
cggacguuugcaccuggugcug

SEQ ID NO: 27037 - RNA, 18 nt, Mycobacterium leprae
cggagagcgucgcgccga

SEQ ID NO: 27038 - RNA, 19 nt, Mycobacterium leprae
cggccagcuucacguucgc

SEQ ID NO: 27039 - RNA, 22 nt, Mycobacterium leprae
cggccggaacucgucggaucca

SEQ ID NO: 27040 - RNA, 22 nt, Mycobacterium leprae
cggccuggcggagauccagcug

SEQ ID NO: 27041 - RNA, 22 nt, Mycobacterium leprae
cggcgagauuugucguugcgag

SEQ ID NO: 27042 - RNA, 22 nt, Mycobacterium leprae
cggcggcaccaaucgcgacguc

SEQ ID NO: 27043 - RNA, 22 nt, Mycobacterium leprae
cggcuuccuugucggcgcggau

SEQ ID NO: 27044 - RNA, 19 nt, Mycobacterium leprae
cggcuucgaauuauugugc

SEQ ID NO: 27045 - RNA, 22 nt, Mycobacterium leprae
cggcuuguaccugugggccagc

SEQ ID NO: 27046 - RNA, 22 nt, Mycobacterium leprae
cgggaacuuggugacgacgcga

SEQ ID NO: 27047 - RNA, 22 nt, Mycobacterium leprae
cgggaaguggccgcagcgguag

SEQ ID NO: 27048 - RNA, 22 nt, Mycobacterium leprae
cgggaaucgccuuguucuucag

SEQ ID NO: 27049 - RNA, 22 nt, Mycobacterium leprae
cgggcgggaucgacgacgaugu

SEQ ID NO: 27050 - RNA, 22 nt, Mycobacterium leprae
cgggcggugaccuucccgcgca

SEQ ID NO: 27051 - RNA, 22 nt, Mycobacterium leprae
cgggguggucgaccggcauguu

SEQ ID NO: 27052 - RNA, 22 nt, Mycobacterium leprae
cgggguuucgucgcgccagcag

SEQ ID NO: 27053 - RNA, 22 nt, Mycobacterium leprae
cgggugacuugcaaucucugga

SEQ ID NO: 27054 - RNA, 22 nt, Mycobacterium leprae
cgguacgguuauaucuugcauc

SEQ ID NO: 27055 - RNA, 22 nt, Mycobacterium leprae
cggucgacuucaucgacggugu

SEQ ID NO: 27056 - RNA, 22 nt, Mycobacterium leprae
cggucguguaguuuucgcggga

SEQ ID NO: 27057 - RNA, 22 nt, Mycobacterium leprae
cggucuccgacauguccugcua

SEQ ID NO: 27058 - RNA, 22 nt, Mycobacterium leprae
cggugccauugcaguggucacc

SEQ ID NO: 27059 - RNA, 22 nt, Mycobacterium leprae
cggugguggucaauuuccugcu

SEQ ID NO: 27060 - RNA, 22 nt, Mycobacterium leprae
cgguguguaccggugagucggu

SEQ ID NO: 27061 - RNA, 22 nt, Mycobacterium leprae
cgguuaccagggauggcagugg

SEQ ID NO: 27062 - RNA, 22 nt, Mycobacterium leprae
cgucgccauggcgaaugacccg

SEQ ID NO: 27063 - RNA, 21 nt, Mycobacterium leprae
cgucgcugaucgcgagucugc

SEQ ID NO: 27064 - RNA, 22 nt, Mycobacterium leprae
cgucggacacaucgagugcaua

SEQ ID NO: 27065 - RNA, 22 nt, Mycobacterium leprae
cgucggucgugacacgcgccgc

SEQ ID NO: 27066 - RNA, 22 nt, Mycobacterium leprae
cgucggugcgaguuuugcguca

SEQ ID NO: 27067 - RNA, 22 nt, Mycobacterium leprae
cgugaugucgcuuugcaguucg

SEQ ID NO: 27068 - RNA, 22 nt, Mycobacterium leprae
cgugcgcugucgcuguucaucg

SEQ ID NO: 27069 - RNA, 19 nt, Mycobacterium leprae
cguggcggccguccgguca

SEQ ID NO: 27070 - RNA, 22 nt, Mycobacterium leprae
cguucgaucgcagcgaacacac

SEQ ID NO: 27071 - RNA, 22 nt, Mycobacterium leprae
cguugaucgauaguacgucggu

SEQ ID NO: 27072 - RNA, 20 nt, Mycobacterium leprae
cguugcgcgauaaucuucgc

SEQ ID NO: 27073 - RNA, 22 nt, Mycobacterium leprae
cguuggaugcuuggcuuaaagu

SEQ ID NO: 27074 - RNA, 22 nt, Mycobacterium leprae
gccacgcuggcuugcaccgcgg

SEQ ID NO: 27075 - RNA, 22 nt, Mycobacterium leprae
gccagccagauucuccaucaag

SEQ ID NO: 27076 - RNA, 22 nt, Mycobacterium leprae
gccaggcgggccguacuggcca

SEQ ID NO: 27077 - RNA, 22 nt, Mycobacterium leprae
gccagguucgccaggcaggacg

SEQ ID NO: 27078 - RNA, 22 nt, Mycobacterium leprae
gccauacgccacgguggcgauc

SEQ ID NO: 27079 - RNA, 22 nt, Mycobacterium leprae
gccauggcuucuaccgcagaug

SEQ ID NO: 27080 - RNA, 22 nt, Mycobacterium leprae
gcccacaacgcaacugagccga

SEQ ID NO: 27081 - RNA, 19 nt, Mycobacterium leprae
gcccggugcgcaugcagga

SEQ ID NO: 27082 - RNA, 22 nt, Mycobacterium leprae
gcccucuccugaggacaucgac

SEQ ID NO: 27083 - RNA, 22 nt, Mycobacterium leprae
gccgaacauccggugcgugucg

SEQ ID NO: 27084 - RNA, 22 nt, Mycobacterium leprae
gccgaacuagccacacgcgcgc

SEQ ID NO: 27085 - RNA, 22 nt, Mycobacterium leprae
gccgaccauggcaaucgcauag

SEQ ID NO: 27086 - RNA, 22 nt, Mycobacterium leprae
gccgacgucuggcugcuacugu

SEQ ID NO: 27087 - RNA, 22 nt, Mycobacterium leprae
gccgagauagagcaguuggcgg

SEQ ID NO: 27088 - RNA, 22 nt, Mycobacterium leprae
gccgaucgacccgcgcgacguc

SEQ ID NO: 27089 - RNA, 22 nt, Mycobacterium leprae
gccgcaguggucgacagugguu

SEQ ID NO: 27090 - RNA, 22 nt, Mycobacterium leprae
gccgcggccuguugcgcuguac

SEQ ID NO: 27091 - RNA, 22 nt, Mycobacterium leprae
gccugacgaugauugcgguguu

SEQ ID NO: 27092 - RNA, 22 nt, Mycobacterium leprae
gccugcggugaccgaucuuguc

SEQ ID NO: 27093 - RNA, 22 nt, Mycobacterium leprae
gccuuaggugcggugccagguu

SEQ ID NO: 27094 - RNA, 22 nt, Mycobacterium leprae
gcgacaccaucgugccggaagu

SEQ ID NO: 27095 - RNA, 22 nt, Mycobacterium leprae
gcgacgcugugcuauuggcuuc

SEQ ID NO: 27096 - RNA, 23 nt, Mycobacterium leprae
gcgacggcuuuggcgaugucugg

SEQ ID NO: 27097 - RNA, 22 nt, Mycobacterium leprae
gcgaugauuuagcaccgaucgg

SEQ ID NO: 27098 - RNA, 22 nt, Mycobacterium leprae
gcgaugcguugaccggcuauga

SEQ ID NO: 27099 - RNA, 22 nt, Mycobacterium leprae
gcgauggugggaucgcagaagu

SEQ ID NO: 27100 - RNA, 22 nt, Mycobacterium leprae
gcgcagcgugaagucggggcgg

SEQ ID NO: 27101 - RNA, 22 nt, Mycobacterium leprae
gcgcagucguugaagccguugg

SEQ ID NO: 27102 - RNA, 22 nt, Mycobacterium leprae
gcgcgagcgccugcguagguua

SEQ ID NO: 27103 - RNA, 22 nt, Mycobacterium leprae
gcggcgcuggugccgcguaccu

SEQ ID NO: 27104 - RNA, 22 nt, Mycobacterium leprae
gcggcgucagcugacaaaggcc

SEQ ID NO: 27105 - RNA, 22 nt, Mycobacterium leprae
gcggcguggauguguugcuggc

SEQ ID NO: 27106 - RNA, 22 nt, Mycobacterium leprae
gcgggcggcgugauauccgccg

SEQ ID NO: 27107 - RNA, 22 nt, Mycobacterium leprae
gcggguauggauacugcgacgg

SEQ ID NO: 27108 - RNA, 18 nt, Mycobacterium leprae
gcggucgccgaaggucgg

SEQ ID NO: 27109 - RNA, 22 nt, Mycobacterium leprae
gcggucugcucauggauggugu

SEQ ID NO: 27110 - RNA, 19 nt, Mycobacterium leprae
gcggugacugaucgcggug

SEQ ID NO: 27111 - RNA, 22 nt, Mycobacterium leprae
gcgugcuuaccguggugcugau

SEQ ID NO: 27112 - RNA, 22 nt, Mycobacterium leprae
gcuaccgguaucacagugacga

SEQ ID NO: 27113 - RNA, 22 nt, Mycobacterium leprae
gcuaucguugucgaugcccgug

SEQ ID NO: 27114 - RNA, 22 nt, Mycobacterium leprae
gcucaacguaaaucucauguag

SEQ ID NO: 27115 - RNA, 22 nt, Mycobacterium leprae
gcucaccugucugauacuggcc

SEQ ID NO: 27116 - RNA, 22 nt, Mycobacterium leprae
gcucggcgcccgcuccggccaa

SEQ ID NO: 27117 - RNA, 22 nt, Mycobacterium leprae
gcucggcgugaaggacauggug

SEQ ID NO: 27118 - RNA, 22 nt, Mycobacterium leprae
gcugaucucuaaggacgccacg

SEQ ID NO: 27119 - RNA, 22 nt, Mycobacterium leprae
gcugcagugacggcacucugga

SEQ ID NO: 27120 - RNA, 22 nt, Mycobacterium leprae
gcugcuggaauuccucgaggua

SEQ ID NO: 27121 - RNA, 22 nt, Mycobacterium leprae
gcuggacccgacagccgaguua

SEQ ID NO: 27122 - RNA, 22 nt, Mycobacterium leprae
gcugguauucggugucgguuuc

SEQ ID NO: 27123 - RNA, 22 nt, Mycobacterium leprae
gcuuauuugcguuucgcgucgg

SEQ ID NO: 27124 - RNA, 22 nt, Mycobacterium leprae
gcuucggucagcuugcaguagg

SEQ ID NO: 27125 - RNA, 22 nt, Mycobacterium leprae
gcuugcuucagcgccgaccgca

SEQ ID NO: 27126 - RNA, 22 nt, Mycobacterium leprae
gcuuucgaguuuauccaagauc

SEQ ID NO: 27127 - RNA, 22 nt, Mycobacterium leprae
ggaagaauggcuaccacgucga

SEQ ID NO: 27128 - RNA, 22 nt, Mycobacterium leprae
ggacgccgucugugaucuuuag

SEQ ID NO: 27129 - RNA, 19 nt, Mycobacterium leprae
ggagaacuccgagacuucc

SEQ ID NO: 27130 - RNA, 22 nt, Mycobacterium leprae
ggcaaggaagaauucgacacug

SEQ ID NO: 27131 - RNA, 22 nt, Mycobacterium leprae
ggcacgccaaguucggcaccgu

SEQ ID NO: 27132 - RNA, 22 nt, Mycobacterium leprae
ggcagcaagacagcgagauccg

SEQ ID NO: 27133 - RNA, 22 nt, Mycobacterium leprae
ggcagcugaacgucgauaugcc

SEQ ID NO: 27134 - RNA, 22 nt, Mycobacterium leprae
ggcauucgcgucaaucgcagca

SEQ ID NO: 27135 - RNA, 22 nt, Mycobacterium leprae
ggcauugcgaguguaggcgggg

SEQ ID NO: 27136 - RNA, 22 nt, Mycobacterium leprae
ggcauuggugguucagaccugg

SEQ ID NO: 27137 - RNA, 22 nt, Mycobacterium leprae
ggccaauucuuccgcuauguug

SEQ ID NO: 27138 - RNA, 19 nt, Mycobacterium leprae
ggccgagcgaacgucgagc

SEQ ID NO: 27139 - RNA, 20 nt, Mycobacterium leprae
ggccgauuucgguaucgucc

SEQ ID NO: 27140 - RNA, 22 nt, Mycobacterium leprae
ggccgucguuguucaccaacaa

SEQ ID NO: 27141 - RNA, 22 nt, Mycobacterium leprae
ggcgaccaucacgacgggguca

SEQ ID NO: 27142 - RNA, 22 nt, Mycobacterium leprae
ggcgaugaggaagcgcugcgga

SEQ ID NO: 27143 - RNA, 22 nt, Mycobacterium leprae
ggcgauggcugacgcgaccgug

SEQ ID NO: 27144 - RNA, 22 nt, Mycobacterium leprae
ggcgccgaucucgcccgguggc

SEQ ID NO: 27145 - RNA, 20 nt, Mycobacterium leprae
ggcgccucugucggcuucuu

SEQ ID NO: 27146 - RNA, 22 nt, Mycobacterium leprae
ggcgcggcaucuggaguugcgg

SEQ ID NO: 27147 - RNA, 22 nt, Mycobacterium leprae
ggcgcgguuacuacuggugauu

SEQ ID NO: 27148 - RNA, 22 nt, Mycobacterium leprae
ggcgggcagggucaucgccucg

SEQ ID NO: 27149 - RNA, 20 nt, Mycobacterium leprae
ggcgguguccacggcgaggu

SEQ ID NO: 27150 - RNA, 22 nt, Mycobacterium leprae
ggcugacaguugcaugagaagg

SEQ ID NO: 27151 - RNA, 22 nt, Mycobacterium leprae
ggcugaucaccgaccgguuguu

SEQ ID NO: 27152 - RNA, 22 nt, Mycobacterium leprae
ggcugcaguuccgugccguugu

SEQ ID NO: 27153 - RNA, 22 nt, Mycobacterium leprae
ggcugggagcggauaucgagca

SEQ ID NO: 27154 - RNA, 22 nt, Mycobacterium leprae
ggcuggucggguucgaggcagc

SEQ ID NO: 27155 - RNA, 22 nt, Mycobacterium leprae
gggagcuauugaugcgccgagu

SEQ ID NO: 27156 - RNA, 22 nt, Mycobacterium leprae
gggccucggugcggguaucgau

SEQ ID NO: 27157 - RNA, 22 nt, Mycobacterium leprae
gggcugaucgcgcuacaggaau

SEQ ID NO: 27158 - RNA, 22 nt, Mycobacterium leprae
ggguugauccgcgcgauggaga

SEQ ID NO: 27159 - RNA, 22 nt, Mycobacterium leprae
ggguugcauuucaucugucgcg

SEQ ID NO: 27160 - RNA, 22 nt, Mycobacterium leprae
gguaaugauugcguaacaacca

SEQ ID NO: 27161 - RNA, 22 nt, Mycobacterium leprae
gguagacaucgacgcgcacauc

SEQ ID NO: 27162 - RNA, 22 nt, Mycobacterium leprae
gguagauugccugcgcgucgug

SEQ ID NO: 27163 - RNA, 22 nt, Mycobacterium leprae
gguagccgaagucauggaccgg

SEQ ID NO: 27164 - RNA, 22 nt, Mycobacterium leprae
uccguugccgggagauagcggc

SEQ ID NO: 27165 - RNA, 22 nt, Mycobacterium leprae
uccguuguuugucaucgacgaa

SEQ ID NO: 27166 - RNA, 22 nt, Mycobacterium leprae
uccuacgacccgaucaacaaug

SEQ ID NO: 27167 - RNA, 20 nt, Mycobacterium leprae
uccucaucaaucauacgcgc

SEQ ID NO: 27168 - RNA, 22 nt, Mycobacterium leprae
uccuggggaauguggcuugacg

SEQ ID NO: 27169 - RNA, 22 nt, Mycobacterium leprae
uccuggugugcaguaucgggcg

SEQ ID NO: 27170 - RNA, 22 nt, Mycobacterium leprae
ucgaacgauugucuucuugcca

SEQ ID NO: 27171 - RNA, 22 nt, Mycobacterium leprae
ucgaacgugaagcgccuggccg

SEQ ID NO: 27172 - RNA, 22 nt, Mycobacterium leprae
ucgacacugcagagcaccgugg

SEQ ID NO: 27173 - RNA, 19 nt, Mycobacterium leprae
ucgaccgccgagcagcuca

SEQ ID NO: 27174 - RNA, 22 nt, Mycobacterium leprae
ucgacgcagcgguugggggcaa

SEQ ID NO: 27175 - RNA, 22 nt, Mycobacterium leprae
ucgacguauucccgccgaccuu

SEQ ID NO: 27176 - RNA, 22 nt, Mycobacterium leprae
ucgacgucgacgagaaguucug

SEQ ID NO: 27177 - RNA, 22 nt, Mycobacterium leprae
ucgagagcuacugacgcuucau

SEQ ID NO: 27178 - RNA, 22 nt, Mycobacterium leprae
ucgagauggucaccggucggau

SEQ ID NO: 27179 - RNA, 22 nt, Mycobacterium leprae
ucgagcuguucucaacaucuac

SEQ ID NO: 27180 - RNA, 22 nt, Mycobacterium leprae
ucgaggcgcucaauccggagau

SEQ ID NO: 27181 - RNA, 22 nt, Mycobacterium leprae
ucgaugaauucgguuuuucuau

SEQ ID NO: 27182 - RNA, 22 nt, Mycobacterium leprae
ucgauucuggaaaggcguaguu

SEQ ID NO: 27183 - RNA, 22 nt, Mycobacterium leprae
ucgauuucgcugaaucuggcaa

SEQ ID NO: 27184 - RNA, 22 nt, Mycobacterium leprae
ucgcacuggggggagcgcucgu

SEQ ID NO: 27185 - RNA, 22 nt, Mycobacterium leprae
ucgccaacggugaacgggccag

SEQ ID NO: 27186 - RNA, 22 nt, Mycobacterium leprae
ucgccaaguuagcucgguuagu

SEQ ID NO: 27187 - RNA, 23 nt, Mycobacterium leprae
ucgccagggcuuauaccaucgcg

SEQ ID NO: 27188 - RNA, 23 nt, Mycobacterium leprae
ucgcccugauacuggcccccgac

SEQ ID NO: 27189 - RNA, 22 nt, Mycobacterium leprae
ucgccgaauucaucggccugga

SEQ ID NO: 27190 - RNA, 22 nt, Mycobacterium leprae
ucgccgagcgccuugcugaggg

SEQ ID NO: 27191 - RNA, 20 nt, Mycobacterium leprae
ucgccgugggcgggucugga

SEQ ID NO: 27192 - RNA, 22 nt, Mycobacterium leprae
ucgccguuaguacucgucgagg

SEQ ID NO: 27193 - RNA, 22 nt, Mycobacterium leprae
ucgcgagggcgcgugucuguac

SEQ ID NO: 27194 - RNA, 22 nt, Mycobacterium leprae
ucgcgcaggccuggucuuugac

SEQ ID NO: 27195 - RNA, 23 nt, Mycobacterium leprae
ucgcggaaaucaaucgcgcagcc

SEQ ID NO: 27196 - RNA, 20 nt, Mycobacterium leprae
ucgcggacauggucugcaag

SEQ ID NO: 27197 - RNA, 21 nt, Mycobacterium leprae
ucgcuaguuggaugcagucga

SEQ ID NO: 27198 - RNA, 22 nt, Mycobacterium leprae
ucgcugacccagguuggcuacc

SEQ ID NO: 27199 - RNA, 22 nt, Mycobacterium leprae
ucgcugcuuauccuggugccga

SEQ ID NO: 27200 - RNA, 22 nt, Mycobacterium leprae
ucggaaagucuuugcggucagg

SEQ ID NO: 27201 - RNA, 22 nt, Mycobacterium leprae
ucggauucagugcggauccgcc

SEQ ID NO: 27202 - RNA, 22 nt, Mycobacterium leprae
ucggccauuggugcugggcguc

SEQ ID NO: 27203 - RNA, 22 nt, Mycobacterium leprae
ucggccgacauacgcuaccgca

SEQ ID NO: 27204 - RNA, 22 nt, Mycobacterium leprae
ucggcgaacaucgccagccagg

SEQ ID NO: 27205 - RNA, 22 nt, Mycobacterium leprae
ucggcgaaggauaggcgggcag

SEQ ID NO: 27206 - RNA, 22 nt, Mycobacterium leprae
ucggcguggugagcaaucuggu

SEQ ID NO: 27207 - RNA, 22 nt, Mycobacterium leprae
ucgggccggugacguggauaug

SEQ ID NO: 27208 - RNA, 22 nt, Mycobacterium leprae
ucgggugauuaugcuuagcagg

SEQ ID NO: 27209 - RNA, 22 nt, Mycobacterium leprae
ucgguauccgggucgggcauug

SEQ ID NO: 27210 - RNA, 23 nt, Mycobacterium leprae
ucggucgacgggugcgccagcuc

SEQ ID NO: 27211 - RNA, 22 nt, Mycobacterium leprae
ucggucgccgauuugauggcgc

SEQ ID NO: 27212 - RNA, 22 nt, Mycobacterium leprae
ucggucgugcuauccggaaugg

SEQ ID NO: 27213 - RNA, 22 nt, Mycobacterium leprae
ucggugucuacgucaacgcccu

SEQ ID NO: 27214 - RNA, 22 nt, Mycobacterium leprae
ucgguguggugcaucgcaggca

SEQ ID NO: 27215 - RNA, 19 nt, Mycobacterium leprae
ucguagcgaaacucagccu

SEQ ID NO: 27216 - RNA, 22 nt, Mycobacterium leprae
ucgucgguugagucaugccuau

SEQ ID NO: 27217 - RNA, 22 nt, Mycobacterium leprae
ucgugcgcugacgaugaucgcc

SEQ ID NO: 27218 - RNA, 22 nt, Mycobacterium leprae
ucguggucuuugucgucuucag

SEQ ID NO: 27219 - RNA, 22 nt, Mycobacterium leprae
ucgugugcggucgucgcagauc

SEQ ID NO: 27220 - RNA, 22 nt, Mycobacterium leprae
ucuacgaggucgagcgcgccaa

SEQ ID NO: 27221 - RNA, 22 nt, Mycobacterium leprae
ucucaauuugcugggauuguuc

SEQ ID NO: 27222 - RNA, 22 nt, Mycobacterium leprae
ucuccgaccgcugugccaauga

SEQ ID NO: 27223 - RNA, 22 nt, Mycobacterium leprae
ucuccgguaucaaagcccagcg

SEQ ID NO: 27224 - RNA, 22 nt, Mycobacterium leprae
ucugaucguccugcucgcggua

SEQ ID NO: 27225 - RNA, 22 nt, Mycobacterium leprae
ucugcaguucauuccgcagauu

SEQ ID NO: 27226 - RNA, 22 nt, Mycobacterium leprae
ucugccgcacuaggugcucgac

SEQ ID NO: 27227 - RNA, 20 nt, Mycobacterium leprae
ucuggacgaccacguuuggu

SEQ ID NO: 27228 - RNA, 22 nt, Mycobacterium leprae
ucuggcauaguugguugcauga

SEQ ID NO: 27229 - RNA, 22 nt, Mycobacterium leprae
ucuggcgggugguguacucgcg

SEQ ID NO: 27230 - RNA, 22 nt, Mycobacterium leprae
ugaacgcgacagccuggcgacg

SEQ ID NO: 27231 - RNA, 22 nt, Mycobacterium leprae
ugaacugacuacgcucagagcg

SEQ ID NO: 27232 - RNA, 22 nt, Mycobacterium leprae
ugacagcagugcaccgcugugc

SEQ ID NO: 27233 - RNA, 22 nt, Mycobacterium leprae
ugacagugcgaggucugggcua

SEQ ID NO: 27234 - RNA, 22 nt, Mycobacterium leprae
ugacauacagcugcaugccgau

SEQ ID NO: 27235 - RNA, 22 nt, Mycobacterium leprae
ugaccgcgccggcgacgugcug

SEQ ID NO: 27236 - RNA, 21 nt, Mycobacterium leprae
ugaccuagauaugaccugagc

SEQ ID NO: 27237 - RNA, 22 nt, Mycobacterium leprae
ugaccuuguauuucgacgggag

SEQ ID NO: 27238 - RNA, 22 nt, Mycobacterium leprae
ugacgcggcggcugcugacgag

SEQ ID NO: 27239 - RNA, 22 nt, Mycobacterium leprae
ugacgucagcuaccguccuggu

SEQ ID NO: 27240 - RNA, 22 nt, Mycobacterium leprae
ugacgugucgcgcgugucgccu

SEQ ID NO: 27241 - RNA, 22 nt, Mycobacterium leprae
ugacguugacaaauugguugug

SEQ ID NO: 27242 - RNA, 22 nt, Mycobacterium leprae
ugacuucgcaagcgcguaucga

SEQ ID NO: 27243 - RNA, 22 nt, Mycobacterium leprae
ugagggccaaacugacccaggc

SEQ ID NO: 27244 - RNA, 23 nt, Mycobacterium leprae
ugaggucuugcaccuggcccggc

SEQ ID NO: 27245 - RNA, 22 nt, Mycobacterium leprae
ugauaucuauacgcgaccaggu

SEQ ID NO: 27246 - RNA, 22 nt, Mycobacterium leprae
ugaucgccgcaccauugggcga

SEQ ID NO: 27247 - RNA, 22 nt, Mycobacterium leprae
ugaugauuggcauggcagugaa

SEQ ID NO: 27248 - RNA, 22 nt, Mycobacterium leprae
ugauggcgguauguaauguugg

SEQ ID NO: 27249 - RNA, 22 nt, Mycobacterium leprae
ugaugucuguaacauuucugua

SEQ ID NO: 27250 - RNA, 21 nt, Mycobacterium leprae
ugcaaaacgucaaucucgacg

SEQ ID NO: 27251 - RNA, 22 nt, Mycobacterium leprae
ugcaaaacgucgaucucgacgc

SEQ ID NO: 27252 - RNA, 22 nt, Mycobacterium leprae
ugcacgugggcagugcccagca

SEQ ID NO: 27253 - RNA, 22 nt, Mycobacterium leprae
ugcagaugacgaugguggugcg

SEQ ID NO: 27254 - RNA, 22 nt, Mycobacterium leprae
uuggacuuguaauuuggccugu

SEQ ID NO: 27255 - RNA, 22 nt, Mycobacterium leprae
uugguccgccauggcgcgggug

SEQ ID NO: 27256 - RNA, 22 nt, Mycobacterium leprae
uuggugaugcagucgagaauuu

SEQ ID NO: 27257 - RNA, 22 nt, Mycobacterium leprae
uugucagugacgucagggccgg

SEQ ID NO: 27258 - RNA, 22 nt, Mycobacterium leprae
uuguucguggccgaccgccucc

SEQ ID NO: 27259 - RNA, 22 nt, Mycobacterium leprae
uuguugcuuaacuggauaacga

SEQ ID NO: 27260 - RNA, 22 nt, Mycobacterium leprae
uuuacccgccuaagcgauuccu

SEQ ID NO: 27261 - RNA, 22 nt, Mycobacterium leprae
uuuaucacccgaagcgcuugca

SEQ ID NO: 27262 - RNA, 19 nt, Mycobacterium leprae
uuucgcacagguuccggcg

SEQ ID NO: 27263 - RNA, 22 nt, Mycobacterium leprae
uuucgucgacgagucagcuggg

SEQ ID NO: 27264 - RNA, 22 nt, Mycobacterium leprae
uuuggccaacuugaccaucauu

SEQ ID NO: 27265 - RNA, 22 nt, Mycobacterium leprae
uuuuguguggacguguucuccc

SEQ ID NO: 27266 - RNA, 22 nt, Mycobacterium leprae
uuuuucgccggacagucgcuuc

SEQ ID NO: 27267 - RNA, 22 nt, Mycobacterium leprae
aagcugcgggugcacgaacguc

SEQ ID NO: 27268 - RNA, 22 nt, Mycobacterium leprae
aaguucgguuuugucgguaacc

SEQ ID NO: 27269 - RNA, 22 nt, Mycobacterium leprae
aauacgcuggacgcgccgaugu

SEQ ID NO: 27270 - RNA, 22 nt, Mycobacterium leprae
aaugauggucguugccgauaac

SEQ ID NO: 27271 - RNA, 22 nt, Mycobacterium leprae
aaugcgaugcgcugcugguuga

SEQ ID NO: 27272 - RNA, 22 nt, Mycobacterium leprae
aaugugaacgugcaagaagcga

SEQ ID NO: 27273 - RNA, 22 nt, Mycobacterium leprae
aauugaccaccacccgggcagc

SEQ ID NO: 27274 - RNA, 22 nt, Mycobacterium leprae
acaacggcacggaauuccgauc

SEQ ID NO: 27275 - RNA, 22 nt, Mycobacterium leprae
acaccauccaugagcagaccgc

SEQ ID NO: 27276 - RNA, 22 nt, Mycobacterium leprae
acacgccgagcaggucgagcgg

SEQ ID NO: 27277 - RNA, 22 nt, Mycobacterium leprae
acagcacgaucccgucauccag

SEQ ID NO: 27278 - RNA, 22 nt, Mycobacterium leprae
acagcgacauucuucagggcau

SEQ ID NO: 27279 - RNA, 22 nt, Mycobacterium leprae
acagcggaugcaagcugaugug

SEQ ID NO: 27280 - RNA, 22 nt, Mycobacterium leprae
acaucgguguaaugaucagcca

SEQ ID NO: 27281 - RNA, 22 nt, Mycobacterium leprae
accaacaugcucgacgguggcg

SEQ ID NO: 27282 - RNA, 23 nt, Mycobacterium leprae
accaagcccaucgucaguuugcg

SEQ ID NO: 27283 - RNA, 22 nt, Mycobacterium leprae
accaccgauaccgauugcgguc

SEQ ID NO: 27284 - RNA, 22 nt, Mycobacterium leprae
acccgcgggcgugaugcuguca

SEQ ID NO: 27285 - RNA, 22 nt, Mycobacterium leprae
acccgcucggucucggugguga

SEQ ID NO: 27286 - RNA, 22 nt, Mycobacterium leprae
acccucgacauccucagcaaug

SEQ ID NO: 27287 - RNA, 22 nt, Mycobacterium leprae
accgacgucgcgauuggugccg

SEQ ID NO: 27288 - RNA, 21 nt, Mycobacterium leprae
accgagggcggcaagcgcagc

SEQ ID NO: 27289 - RNA, 22 nt, Mycobacterium leprae
accgcccugaucgauggcgaug

SEQ ID NO: 27290 - RNA, 22 nt, Mycobacterium leprae
accgcgcuaagguggcccguuc

SEQ ID NO: 27291 - RNA, 22 nt, Mycobacterium leprae
accgcggaccgaccuggauugc

SEQ ID NO: 27292 - RNA, 19 nt, Mycobacterium leprae
accgcguagcgaguggguc

SEQ ID NO: 27293 - RNA, 22 nt, Mycobacterium leprae
accggauuuccuccgguucugu

SEQ ID NO: 27294 - RNA, 18 nt, Mycobacterium leprae
accggccagcgcgguucg

SEQ ID NO: 27295 - RNA, 22 nt, Mycobacterium leprae
accggcguccggauugaggaug

SEQ ID NO: 27296 - RNA, 22 nt, Mycobacterium leprae
accggcuaccucugaagcgugu

SEQ ID NO: 27297 - RNA, 22 nt, Mycobacterium leprae
accggcucugguggucgccacc

SEQ ID NO: 27298 - RNA, 22 nt, Mycobacterium leprae
accgggugacaucgagccuguc

SEQ ID NO: 27299 - RNA, 22 nt, Mycobacterium leprae
accucgguggauuucgauacua

SEQ ID NO: 27300 - RNA, 22 nt, Mycobacterium leprae
accugcuuggcugacgagguuu

SEQ ID NO: 27301 - RNA, 22 nt, Mycobacterium leprae
acgacugcguuguacucagcag

SEQ ID NO: 27302 - RNA, 23 nt, Mycobacterium leprae
acgaucucuucggcaucggucag

SEQ ID NO: 27303 - RNA, 20 nt, Mycobacterium leprae
acgcccgcgcaguggccgcu

SEQ ID NO: 27304 - RNA, 19 nt, Mycobacterium leprae
acgcgucgagagccagcag

SEQ ID NO: 27305 - RNA, 22 nt, Mycobacterium leprae
acgcuggcgaauaccaggaaac

SEQ ID NO: 27306 - RNA, 22 nt, Mycobacterium leprae
acggaacgaugcgauagcaacg

SEQ ID NO: 27307 - RNA, 22 nt, Mycobacterium leprae
acggcaaggcuguuccgguaac

SEQ ID NO: 27308 - RNA, 22 nt, Mycobacterium leprae
acggugggcaaaccgacgcucu

SEQ ID NO: 27309 - RNA, 22 nt, Mycobacterium leprae
acggugucuuccuaucacggug

SEQ ID NO: 27310 - RNA, 22 nt, Mycobacterium leprae
acgguuuuggugcauggcgcag

SEQ ID NO: 27311 - RNA, 23 nt, Mycobacterium leprae
acgucgagauagucgccggcugc

SEQ ID NO: 27312 - RNA, 22 nt, Mycobacterium leprae
acgucgguugaucauggguggu

SEQ ID NO: 27313 - RNA, 22 nt, Mycobacterium leprae
acguugaccaccuggcgcacaa

SEQ ID NO: 27314 - RNA, 22 nt, Mycobacterium leprae
acuacugccguucauggcuggu

SEQ ID NO: 27315 - RNA, 22 nt, Mycobacterium leprae
acucgccgacgcagugggacua

SEQ ID NO: 27316 - RNA, 22 nt, Mycobacterium leprae
acucggcacguaaguugaacag

SEQ ID NO: 27317 - RNA, 22 nt, Mycobacterium leprae
acucggcgguccggucaacagc

SEQ ID NO: 27318 - RNA, 22 nt, Mycobacterium leprae
acucuagguguucaaugcuccc

SEQ ID NO: 27319 - RNA, 22 nt, Mycobacterium leprae
acugccgcgcuugaucaauguc

SEQ ID NO: 27320 - RNA, 22 nt, Mycobacterium leprae
acugccgucggugcuggugcau

SEQ ID NO: 27321 - RNA, 22 nt, Mycobacterium leprae
acugggcagaucauaucgauuu

SEQ ID NO: 27322 - RNA, 22 nt, Mycobacterium leprae
acuggggauacugcucacgcgc

SEQ ID NO: 27323 - RNA, 22 nt, Mycobacterium leprae
agaaagucaggaacccagcgac

SEQ ID NO: 27324 - RNA, 22 nt, Mycobacterium leprae
agacgcuagaauauacuugaga

SEQ ID NO: 27325 - RNA, 22 nt, Mycobacterium leprae
agagcacauucugcggacuaua

SEQ ID NO: 27326 - RNA, 22 nt, Mycobacterium leprae
agaggccgccgaaccaggugag

SEQ ID NO: 27327 - RNA, 22 nt, Mycobacterium leprae
agaucgaucacgucgugcuggu

SEQ ID NO: 27328 - RNA, 22 nt, Mycobacterium leprae
agcaccgcauuggucaacgugu

SEQ ID NO: 27329 - RNA, 22 nt, Mycobacterium leprae
agcaccugcccgacgcggcggg

SEQ ID NO: 27330 - RNA, 22 nt, Mycobacterium leprae
agcacgacacuucgacgcuggc

SEQ ID NO: 27331 - RNA, 22 nt, Mycobacterium leprae
agcacggucggugucauccagu

SEQ ID NO: 27332 - RNA, 22 nt, Mycobacterium leprae
agcagcguaacauugcugguuu

SEQ ID NO: 27333 - RNA, 20 nt, Mycobacterium leprae
agcagugggcccaguggcuu

SEQ ID NO: 27334 - RNA, 22 nt, Mycobacterium leprae
agcccaccagcuaggcguugga

SEQ ID NO: 27335 - RNA, 22 nt, Mycobacterium leprae
agccggcuugcugcgcucgauc

SEQ ID NO: 27336 - RNA, 22 nt, Mycobacterium leprae
agccgucgcaguauugaucgcg

SEQ ID NO: 27337 - RNA, 22 nt, Mycobacterium leprae
agcgaaacgcgcgacgauuguu

SEQ ID NO: 27338 - RNA, 22 nt, Mycobacterium leprae
agcgacuguacgucgucggugu

SEQ ID NO: 27339 - RNA, 22 nt, Mycobacterium leprae
agcgagucaucacaaucgauuu

SEQ ID NO: 27340 - RNA, 22 nt, Mycobacterium leprae
agcgcucaggguuaagggcgag

SEQ ID NO: 27341 - RNA, 22 nt, Mycobacterium leprae
agcggaugaagcuggacgcggc

SEQ ID NO: 27342 - RNA, 22 nt, Mycobacterium leprae
agcggcuuggugcauugcugac

SEQ ID NO: 27343 - RNA, 22 nt, Mycobacterium leprae
agcuggcgcacccgucgaccga

SEQ ID NO: 27344 - RNA, 22 nt, Mycobacterium leprae
agcuuugucaaugucgcgguag

SEQ ID NO: 27345 - RNA, 22 nt, Mycobacterium leprae
aggauaucgacccggcguggcu

SEQ ID NO: 27346 - RNA, 22 nt, Mycobacterium leprae
aggaucgauucgccacaaucug

SEQ ID NO: 27347 - RNA, 22 nt, Mycobacterium leprae
aggcccuccuuggaggugucgg

SEQ ID NO: 27348 - RNA, 22 nt, Mycobacterium leprae
aggccguagucgacgacgccga

SEQ ID NO: 27349 - RNA, 22 nt, Mycobacterium leprae
aggcgaugaagcucgggaggug

SEQ ID NO: 27350 - RNA, 22 nt, Mycobacterium leprae
aggcgaugcuggauucucaggc

SEQ ID NO: 27351 - RNA, 22 nt, Mycobacterium leprae
aggcuuggcuccgugaugcuua

SEQ ID NO: 27352 - RNA, 22 nt, Mycobacterium leprae
agggucugcuugaucugaugca

SEQ ID NO: 27353 - RNA, 22 nt, Mycobacterium leprae
agguaaucccggacugaccgca

SEQ ID NO: 27354 - RNA, 22 nt, Mycobacterium leprae
aggucggcgcauugaauagucc

SEQ ID NO: 27355 - RNA, 20 nt, Mycobacterium leprae
aguaccgaaagcgcgcauac

SEQ ID NO: 27356 - RNA, 22 nt, Mycobacterium leprae
aguaccgcgaauagccggguac

SEQ ID NO: 27357 - RNA, 22 nt, Mycobacterium leprae
ccacaucuggcagaagagcugu

SEQ ID NO: 27358 - RNA, 22 nt, Mycobacterium leprae
ccaccagguaccgagccggucg

SEQ ID NO: 27359 - RNA, 22 nt, Mycobacterium leprae
ccaccgcugcuugcucugguuc

SEQ ID NO: 27360 - RNA, 22 nt, Mycobacterium leprae
ccaccggacgcuguugauuggu

SEQ ID NO: 27361 - RNA, 23 nt, Mycobacterium leprae
ccacugcauuguaggcgcgggua

SEQ ID NO: 27362 - RNA, 22 nt, Mycobacterium leprae
ccagccacgcugaauggucgcc

SEQ ID NO: 27363 - RNA, 22 nt, Mycobacterium leprae
ccagcggcucagucuuggcggc

SEQ ID NO: 27364 - RNA, 22 nt, Mycobacterium leprae
ccagcuugcgugucguguucgu

SEQ ID NO: 27365 - RNA, 22 nt, Mycobacterium leprae
ccaggacguucaucgcauccac

SEQ ID NO: 27366 - RNA, 22 nt, Mycobacterium leprae
ccaggauguucaucagcaucac

SEQ ID NO: 27367 - RNA, 22 nt, Mycobacterium leprae
cccaggcggcgaucagugcaca

SEQ ID NO: 27368 - RNA, 22 nt, Mycobacterium leprae
ccccggaagcauuguguuagcc

SEQ ID NO: 27369 - RNA, 18 nt, Mycobacterium leprae
cccgucaagccgucgucu

SEQ ID NO: 27370 - RNA, 22 nt, Mycobacterium leprae
cccugcucaguagucggacccg

SEQ ID NO: 27371 - RNA, 22 nt, Mycobacterium leprae
ccgaaguugcggugguuccgcg

SEQ ID NO: 27372 - RNA, 23 nt, Mycobacterium leprae
ccgaccaaguggugguuuaccag

SEQ ID NO: 27373 - RNA, 22 nt, Mycobacterium leprae
ccgagcggcuacgguccaucag

SEQ ID NO: 27374 - RNA, 22 nt, Mycobacterium leprae
ccgauccgcgacuucggcugaa

SEQ ID NO: 27375 - RNA, 22 nt, Mycobacterium leprae
ccgcaaaacagacacggccgcc

SEQ ID NO: 27376 - RNA, 22 nt, Mycobacterium leprae
ccgcgcaauguuucugcggaag

SEQ ID NO: 27377 - RNA, 22 nt, Mycobacterium leprae
ccgcggcgauucugguguucau

SEQ ID NO: 27378 - RNA, 23 nt, Mycobacterium leprae
ccgcggugcuagccacgaugauc

SEQ ID NO: 27379 - RNA, 21 nt, Mycobacterium leprae
ccgcggugcuuagagacgucg

SEQ ID NO: 27380 - RNA, 22 nt, Mycobacterium leprae
ccgcguguggacuugacgaaua

SEQ ID NO: 27381 - RNA, 22 nt, Mycobacterium leprae
ccggaccaucgagcucaaucag

SEQ ID NO: 27382 - RNA, 22 nt, Mycobacterium leprae
ccggcaguuggcugcgcagggg

SEQ ID NO: 27383 - RNA, 22 nt, Mycobacterium leprae
ccggccagaagcgaugcccgua

SEQ ID NO: 27384 - RNA, 22 nt, Mycobacterium leprae
ccgggcgacgcuuauuggcugc

SEQ ID NO: 27385 - RNA, 22 nt, Mycobacterium leprae
ccgggucuggcgucgacguaau

SEQ ID NO: 27386 - RNA, 22 nt, Mycobacterium leprae
ccgguggucacgccuaccccgu

SEQ ID NO: 27387 - RNA, 22 nt, Mycobacterium leprae
ccgguggucugguugaucgauu

SEQ ID NO: 27388 - RNA, 23 nt, Mycobacterium leprae
ccguacccggccaugguccggca

SEQ ID NO: 27389 - RNA, 22 nt, Mycobacterium leprae
ccguugcaguaguucuuagcag

SEQ ID NO: 27390 - RNA, 22 nt, Mycobacterium leprae
ccuacgcccgcucaguuaucuu

SEQ ID NO: 27391 - RNA, 22 nt, Mycobacterium leprae
ccuacggcaacuccggcccgcg

SEQ ID NO: 27392 - RNA, 22 nt, Mycobacterium leprae
ccuggcugauccaauccggcag

SEQ ID NO: 27393 - RNA, 22 nt, Mycobacterium leprae
ccugggcacaguggaugucgcg

SEQ ID NO: 27394 - RNA, 22 nt, Mycobacterium leprae
cgaaggaaugcaggcuucaguc

SEQ ID NO: 27395 - RNA, 22 nt, Mycobacterium leprae
cgaauucggcuacugggccgau

SEQ ID NO: 27396 - RNA, 22 nt, Mycobacterium leprae
cgacaaucaggucauugaucuc

SEQ ID NO: 27397 - RNA, 22 nt, Mycobacterium leprae
cgaccgcuguuaggacuagcag

SEQ ID NO: 27398 - RNA, 22 nt, Mycobacterium leprae
cgaccugcaggucguuaucgcg

SEQ ID NO: 27399 - RNA, 22 nt, Mycobacterium leprae
cgacgacuuugggggcugaccu

SEQ ID NO: 27400 - RNA, 22 nt, Mycobacterium leprae
cgagaugcggauguuuucggug

SEQ ID NO: 27401 - RNA, 22 nt, Mycobacterium leprae
cgagauggaaacugggucaggu

SEQ ID NO: 27402 - RNA, 22 nt, Mycobacterium leprae
cgagcugcgcuuccucgagcgu

SEQ ID NO: 27403 - RNA, 22 nt, Mycobacterium leprae
cgauaagcggaugacggugcug

SEQ ID NO: 27404 - RNA, 22 nt, Mycobacterium leprae
cgauauugccuucaggauugua

SEQ ID NO: 27405 - RNA, 22 nt, Mycobacterium leprae
cgaugcaggccaucacuaccgg

SEQ ID NO: 27406 - RNA, 22 nt, Mycobacterium leprae
cgaugcguggguagguggugca

SEQ ID NO: 27407 - RNA, 20 nt, Mycobacterium leprae
cgauggcaucgucgcggcuc

SEQ ID NO: 27408 - RNA, 22 nt, Mycobacterium leprae
cgauggcgucgaugugcguggu

SEQ ID NO: 27409 - RNA, 22 nt, Mycobacterium leprae
cgauggguuuacggugcauacc

SEQ ID NO: 27410 - RNA, 22 nt, Mycobacterium leprae
cgauggugcgucggugaucacc

SEQ ID NO: 27411 - RNA, 22 nt, Mycobacterium leprae
cgaugguguuuaggugacgggg

SEQ ID NO: 27412 - RNA, 22 nt, Mycobacterium leprae
cgcacauggacagcgguucauu

SEQ ID NO: 27413 - RNA, 22 nt, Mycobacterium leprae
cgcagaaaaauggucaagaauc

SEQ ID NO: 27414 - RNA, 22 nt, Mycobacterium leprae
cgcaucugagguugcagcgcau

SEQ ID NO: 27415 - RNA, 21 nt, Mycobacterium leprae
cgccaccaguagcaccgcugu

SEQ ID NO: 27416 - RNA, 19 nt, Mycobacterium leprae
cgccgcggaccugauaggc

SEQ ID NO: 27417 - RNA, 22 nt, Mycobacterium leprae
cgccggcugccgaccuaguuuu

SEQ ID NO: 27418 - RNA, 22 nt, Mycobacterium leprae
cgccucgaguauggcgauccgg

SEQ ID NO: 27419 - RNA, 22 nt, Mycobacterium leprae
cgcgcuugcgcucaucacuagc

SEQ ID NO: 27420 - RNA, 22 nt, Mycobacterium leprae
cgcggcagguguuugccccgca

SEQ ID NO: 27421 - RNA, 22 nt, Mycobacterium leprae
cgcggcgguggcguugcacccg

SEQ ID NO: 27422 - RNA, 22 nt, Mycobacterium leprae
cgcgggaucaccgacauucgcg

SEQ ID NO: 27423 - RNA, 22 nt, Mycobacterium leprae
cgcgucaacacaccggauauau

SEQ ID NO: 27424 - RNA, 22 nt, Mycobacterium leprae
cgcucugcacuggaccgacugg

SEQ ID NO: 27425 - RNA, 20 nt, Mycobacterium leprae
cgcugcacaccugcugcugg

SEQ ID NO: 27426 - RNA, 22 nt, Mycobacterium leprae
cgcugcgaggcuuauccaucug

SEQ ID NO: 27427 - RNA, 22 nt, Mycobacterium leprae
cgcugggccaggcgcugucaga

SEQ ID NO: 27428 - RNA, 19 nt, Mycobacterium leprae
cggauucaucuguaucgcu

SEQ ID NO: 27429 - RNA, 21 nt, Mycobacterium leprae
cggcaaaauccuucgcgccgc

SEQ ID NO: 27430 - RNA, 22 nt, Mycobacterium leprae
cggcaugagcugaucgcagucg

SEQ ID NO: 27431 - RNA, 22 nt, Mycobacterium leprae
cggccaacagcuucgugggcgg

SEQ ID NO: 27432 - RNA, 18 nt, Mycobacterium leprae
cggccagcgagagcagca

SEQ ID NO: 27433 - RNA, 22 nt, Mycobacterium leprae
cggcgacucacuggcgugagcg

SEQ ID NO: 27434 - RNA, 23 nt, Mycobacterium leprae
cggcgauguccugguggcaaguc

SEQ ID NO: 27435 - RNA, 22 nt, Mycobacterium leprae
cggcgccgacggugucguuguu

SEQ ID NO: 27436 - RNA, 22 nt, Mycobacterium leprae
cggcggcggugguugaguuguu

SEQ ID NO: 27437 - RNA, 22 nt, Mycobacterium leprae
cgggaacaccagugcaucgaug

SEQ ID NO: 27438 - RNA, 23 nt, Mycobacterium leprae
cggggcucaaacuucugcgcugc

SEQ ID NO: 27439 - RNA, 22 nt, Mycobacterium leprae
cgggucgacguuguugggccuu

SEQ ID NO: 27440 - RNA, 22 nt, Mycobacterium leprae
cggucagauuucuugugcgccg

SEQ ID NO: 27441 - RNA, 22 nt, Mycobacterium leprae
cggugcccgcgaucggaugcgg

SEQ ID NO: 27442 - RNA, 22 nt, Mycobacterium leprae
cggugcgcagaacgucggauga

SEQ ID NO: 27443 - RNA, 22 nt, Mycobacterium leprae
cggugcugaaguggcguuggcu

SEQ ID NO: 27444 - RNA, 22 nt, Mycobacterium leprae
cgguuagacguuaacggguaug

SEQ ID NO: 27445 - RNA, 22 nt, Mycobacterium leprae
cgucaucgacugccuugccguu

SEQ ID NO: 27446 - RNA, 22 nt, Mycobacterium leprae
cgucauggcggcuauggugucg

SEQ ID NO: 27447 - RNA, 21 nt, Mycobacterium leprae
gccaaauugcagaucucgagc

SEQ ID NO: 27448 - RNA, 22 nt, Mycobacterium leprae
gccaccgcgacaucgucgcacc

SEQ ID NO: 27449 - RNA, 22 nt, Mycobacterium leprae
gccagcguuugugaacagcugu

SEQ ID NO: 27450 - RNA, 19 nt, Mycobacterium leprae
gccaguacuccaguuguuu

SEQ ID NO: 27451 - RNA, 21 nt, Mycobacterium leprae
gccauccgggucaccccgaag

SEQ ID NO: 27452 - RNA, 22 nt, Mycobacterium leprae
gccccgucgugugcgaucucgu

SEQ ID NO: 27453 - RNA, 22 nt, Mycobacterium leprae
gccccuccgaucugcucggucu

SEQ ID NO: 27454 - RNA, 22 nt, Mycobacterium leprae
gcccgagcagggugcggguaug

SEQ ID NO: 27455 - RNA, 22 nt, Mycobacterium leprae
gcccgcuagcguuugccgagcu

SEQ ID NO: 27456 - RNA, 22 nt, Mycobacterium leprae
gccgacgucgaaauccggcggc

SEQ ID NO: 27457 - RNA, 22 nt, Mycobacterium leprae
gccgccucagccggugcgcacu

SEQ ID NO: 27458 - RNA, 22 nt, Mycobacterium leprae
gccgcgauccgguucgccaugu

SEQ ID NO: 27459 - RNA, 22 nt, Mycobacterium leprae
gccgcggccauguggcugaccg

SEQ ID NO: 27460 - RNA, 22 nt, Mycobacterium leprae
gccgcugugcacgcgucguggu

SEQ ID NO: 27461 - RNA, 22 nt, Mycobacterium leprae
gccggcgucgugacugucaacg

SEQ ID NO: 27462 - RNA, 22 nt, Mycobacterium leprae
gccggucacggucugggugccg

SEQ ID NO: 27463 - RNA, 22 nt, Mycobacterium leprae
gccggucggccgcgaacuucgu

SEQ ID NO: 27464 - RNA, 22 nt, Mycobacterium leprae
gccgguugccgauucugaaagg

SEQ ID NO: 27465 - RNA, 22 nt, Mycobacterium leprae
gccgugaucuccccggaccgca

SEQ ID NO: 27466 - RNA, 22 nt, Mycobacterium leprae
gccgugucgguaggcuguuguc

SEQ ID NO: 27467 - RNA, 19 nt, Mycobacterium leprae
gccucagacaucagcagcu

SEQ ID NO: 27468 - RNA, 22 nt, Mycobacterium leprae
gccugccaacacgcugcggcag

SEQ ID NO: 27469 - RNA, 22 nt, Mycobacterium leprae
gccugguucgccgacgaagcac

SEQ ID NO: 27470 - RNA, 22 nt, Mycobacterium leprae
gcgaacgugaagcuggccgcga

SEQ ID NO: 27471 - RNA, 22 nt, Mycobacterium leprae
gcgaguauggauacugcgacgc

SEQ ID NO: 27472 - RNA, 22 nt, Mycobacterium leprae
gcgagugcuugaccagaagcga

SEQ ID NO: 27473 - RNA, 22 nt, Mycobacterium leprae
gcgcacuagaagacaagucggg

SEQ ID NO: 27474 - RNA, 22 nt, Mycobacterium leprae
gcgcaggugcggcccggugaua

SEQ ID NO: 27475 - RNA, 22 nt, Mycobacterium leprae
gcgcgguuugauaguucgugga

SEQ ID NO: 27476 - RNA, 22 nt, Mycobacterium leprae
gcgcugaucugggugaggauau

SEQ ID NO: 27477 - RNA, 22 nt, Mycobacterium leprae
gcgcugguccugcucgaucaac

SEQ ID NO: 27478 - RNA, 22 nt, Mycobacterium leprae
gcgcuggugcgcgcaucuugcu

SEQ ID NO: 27479 - RNA, 22 nt, Mycobacterium leprae
gcggaacaauagaguuggacac

SEQ ID NO: 27480 - RNA, 22 nt, Mycobacterium leprae
gcggagauucgcgcgaugaaug

SEQ ID NO: 27481 - RNA, 22 nt, Mycobacterium leprae
gcggcaacucgcgcagugacgu

SEQ ID NO: 27482 - RNA, 22 nt, Mycobacterium leprae
gcggcgagugagcgaugcuuuu

SEQ ID NO: 27483 - RNA, 22 nt, Mycobacterium leprae
gcggcgaucugggcuggccgug

SEQ ID NO: 27484 - RNA, 22 nt, Mycobacterium leprae
gcggcggugaggauggccgagu

SEQ ID NO: 27485 - RNA, 22 nt, Mycobacterium leprae
gcggcuguuggucagugggcca

SEQ ID NO: 27486 - RNA, 22 nt, Mycobacterium leprae
gcgggcgucaucuugaucgcgg

SEQ ID NO: 27487 - RNA, 22 nt, Mycobacterium leprae
ggcuggauccgaagugucgacg

SEQ ID NO: 27488 - RNA, 22 nt, Mycobacterium leprae
gggagcucaaguucuuuggcua

SEQ ID NO: 27489 - RNA, 22 nt, Mycobacterium leprae
gggcaggacccuguugcucgcc

SEQ ID NO: 27490 - RNA, 22 nt, Mycobacterium leprae
gggcgaugcuagucggcuacgg

SEQ ID NO: 27491 - RNA, 22 nt, Mycobacterium leprae
gggcggccauucugcacgcgau

SEQ ID NO: 27492 - RNA, 22 nt, Mycobacterium leprae
ggggcaacacagugacccauuc

SEQ ID NO: 27493 - RNA, 22 nt, Mycobacterium leprae
gggguugcuggauugcccuggu

SEQ ID NO: 27494 - RNA, 22 nt, Mycobacterium leprae
gggucggcauaggcuaccggug

SEQ ID NO: 27495 - RNA, 22 nt, Mycobacterium leprae
gggugaaaccgaguguuaguau

SEQ ID NO: 27496 - RNA, 22 nt, Mycobacterium leprae
gggugcgauugccauggucggc

SEQ ID NO: 27497 - RNA, 22 nt, Mycobacterium leprae
gggugcuaacuggugucauccg

SEQ ID NO: 27498 - RNA, 22 nt, Mycobacterium leprae
gguagcugcuaaggacaugacg

SEQ ID NO: 27499 - RNA, 22 nt, Mycobacterium leprae
gguccagcgucagcgcagccau

SEQ ID NO: 27500 - RNA, 22 nt, Mycobacterium leprae
gguccgggaccugcgucccgaa

SEQ ID NO: 27501 - RNA, 22 nt, Mycobacterium leprae
ggucgauggugcggucgcugau

SEQ ID NO: 27502 - RNA, 22 nt, Mycobacterium leprae
ggugaacugcucggcugcuucg

SEQ ID NO: 27503 - RNA, 22 nt, Mycobacterium leprae
ggugaugguauugaugcgcggc

SEQ ID NO: 27504 - RNA, 22 nt, Mycobacterium leprae
ggugcaccgcccggcuacauug

SEQ ID NO: 27505 - RNA, 22 nt, Mycobacterium leprae
ggugcagucgcuacguuccggu

SEQ ID NO: 27506 - RNA, 22 nt, Mycobacterium leprae
ggugcugacugaugcgggucgg

SEQ ID NO: 27507 - RNA, 22 nt, Mycobacterium leprae
gguggccgcuucgaggugauca

SEQ ID NO: 27508 - RNA, 22 nt, Mycobacterium leprae
gguggcuuugaucgacgccgga

SEQ ID NO: 27509 - RNA, 22 nt, Mycobacterium leprae
gguucgagucacagccguacga

SEQ ID NO: 27510 - RNA, 22 nt, Mycobacterium leprae
gguuucuggcguuuugucagcg

SEQ ID NO: 27511 - RNA, 22 nt, Mycobacterium leprae
gguuuugcccguugcggguggg

SEQ ID NO: 27512 - RNA, 22 nt, Mycobacterium leprae
guacccgaucgucggcuaccag

SEQ ID NO: 27513 - RNA, 22 nt, Mycobacterium leprae
guacgcggccagguaucaggaa

SEQ ID NO: 27514 - RNA, 22 nt, Mycobacterium leprae
guacugcgcgcuuucgguacug

SEQ ID NO: 27515 - RNA, 20 nt, Mycobacterium leprae
gucagcaucccggugguggc

SEQ ID NO: 27516 - RNA, 22 nt, Mycobacterium leprae
gucagccaaguuccuagauuga

SEQ ID NO: 27517 - RNA, 22 nt, Mycobacterium leprae
gucagccggguaaacuucgucg

SEQ ID NO: 27518 - RNA, 22 nt, Mycobacterium leprae
gucagcgcuaacagaucggcac

SEQ ID NO: 27519 - RNA, 22 nt, Mycobacterium leprae
gucauaucgcuguuggcgauca

SEQ ID NO: 27520 - RNA, 22 nt, Mycobacterium leprae
guccaacggcaugaccgcgccu

SEQ ID NO: 27521 - RNA, 22 nt, Mycobacterium leprae
gucgaucggauuguccgaauug

SEQ ID NO: 27522 - RNA, 19 nt, Mycobacterium leprae
gucgcacuguuccgagcug

SEQ ID NO: 27523 - RNA, 22 nt, Mycobacterium leprae
gucggaaagucuuugcggucag

SEQ ID NO: 27524 - RNA, 22 nt, Mycobacterium leprae
gucggcuaccggauagucgucg

SEQ ID NO: 27525 - RNA, 22 nt, Mycobacterium leprae
gucgguaccuaggcggcugcca

SEQ ID NO: 27526 - RNA, 22 nt, Mycobacterium leprae
gucgguguugcugaugcggacg

SEQ ID NO: 27527 - RNA, 22 nt, Mycobacterium leprae
gucugauuaguggcgauccuaa

SEQ ID NO: 27528 - RNA, 22 nt, Mycobacterium leprae
gucuggcggccucgucggugua

SEQ ID NO: 27529 - RNA, 22 nt, Mycobacterium leprae
gugacgauggguaggacgcucg

SEQ ID NO: 27530 - RNA, 22 nt, Mycobacterium leprae
gugcagauugugggcgauccgu

SEQ ID NO: 27531 - RNA, 22 nt, Mycobacterium leprae
gugcgaucgucgccuacgcugg

SEQ ID NO: 27532 - RNA, 22 nt, Mycobacterium leprae
gugcgccgggaugaacgauguu

SEQ ID NO: 27533 - RNA, 22 nt, Mycobacterium leprae
gugcgcgaucguggauagcgau

SEQ ID NO: 27534 - RNA, 22 nt, Mycobacterium leprae
gugcgugggguguugauggcga

SEQ ID NO: 27535 - RNA, 22 nt, Mycobacterium leprae
gugcugaguacaacgcagucgu

SEQ ID NO: 27536 - RNA, 22 nt, Mycobacterium leprae
guggcggcaaacaagcgcuggc

SEQ ID NO: 27537 - RNA, 22 nt, Mycobacterium leprae
guggcuaguggcaucggacaac

SEQ ID NO: 27538 - RNA, 16 nt, Mycobacterium leprae
gugguucaccgucgac

SEQ ID NO: 27539 - RNA, 22 nt, Mycobacterium leprae
gugguucgucgugauuacguug

SEQ ID NO: 27540 - RNA, 22 nt, Mycobacterium leprae
gugguugcugacagcacugaug

SEQ ID NO: 27541 - RNA, 22 nt, Mycobacterium leprae
gugugagcggcgaucagcagua

SEQ ID NO: 27542 - RNA, 22 nt, Mycobacterium leprae
gugugaugcccuauaccaccac

SEQ ID NO: 27543 - RNA, 22 nt, Mycobacterium leprae
guguggugaguugcucacaaag

SEQ ID NO: 27544 - RNA, 22 nt, Mycobacterium leprae
guugacuuuuuccggguugccg

SEQ ID NO: 27545 - RNA, 22 nt, Mycobacterium leprae
guugguggcguagugacucgcu

SEQ ID NO: 27546 - RNA, 22 nt, Mycobacterium leprae
guuguccgaugccaagcaaguu

SEQ ID NO: 27547 - RNA, 22 nt, Mycobacterium leprae
guuguggggccgucauggcggg

SEQ ID NO: 27548 - RNA, 22 nt, Mycobacterium leprae
guuugguuuuucaggcuauucu

SEQ ID NO: 27549 - RNA, 22 nt, Mycobacterium leprae
guuugucacgauuccugcuagc

SEQ ID NO: 27550 - RNA, 22 nt, Mycobacterium leprae
uaaugacccaaguuaagucuuc

SEQ ID NO: 27551 - RNA, 22 nt, Mycobacterium leprae
uaaugcccuucgagggggauag

SEQ ID NO: 27552 - RNA, 23 nt, Mycobacterium leprae
uacagaccggugauuacggcacc

SEQ ID NO: 27553 - RNA, 22 nt, Mycobacterium leprae
uacccguggacuagauccggca

SEQ ID NO: 27554 - RNA, 22 nt, Mycobacterium leprae
uacgacgucgagauugucgcgg

SEQ ID NO: 27555 - RNA, 20 nt, Mycobacterium leprae
uacgucgaucgcuagcccgg

SEQ ID NO: 27556 - RNA, 22 nt, Mycobacterium leprae
uagcaaggccauggcgccgacc

SEQ ID NO: 27557 - RNA, 22 nt, Mycobacterium leprae
uagccgguuacggugcgucuuc

SEQ ID NO: 27558 - RNA, 22 nt, Mycobacterium leprae
uagccugugcaccgcacuguga

SEQ ID NO: 27559 - RNA, 22 nt, Mycobacterium leprae
uagcgguaguggcgcacggagg

SEQ ID NO: 27560 - RNA, 22 nt, Mycobacterium leprae
uagcucgaucaugccaggcaag

SEQ ID NO: 27561 - RNA, 23 nt, Mycobacterium leprae
uagcuugcugcgcuggcuuauuc

SEQ ID NO: 27562 - RNA, 22 nt, Mycobacterium leprae
uaugaagugucuccugccauua

SEQ ID NO: 27563 - RNA, 23 nt, Mycobacterium leprae
uaugaguucggacuggcccugcc

SEQ ID NO: 27564 - RNA, 22 nt, Mycobacterium leprae
uaugcgauccaaacugucuuga

SEQ ID NO: 27565 - RNA, 22 nt, Mycobacterium leprae
uauguccugggacuugcuucug

SEQ ID NO: 27566 - RNA, 22 nt, Mycobacterium leprae
ucaaccgagucggucgcgucac

SEQ ID NO: 27567 - RNA, 22 nt, Mycobacterium leprae
ucaacguugccgucgacaugcu

SEQ ID NO: 27568 - RNA, 22 nt, Mycobacterium leprae
ucaagcaggcggucgggguauu

SEQ ID NO: 27569 - RNA, 22 nt, Mycobacterium leprae
ucaccgauccugcggcggcaau

SEQ ID NO: 27570 - RNA, 22 nt, Mycobacterium leprae
ucaccgcagaucacucggucca

SEQ ID NO: 27571 - RNA, 22 nt, Mycobacterium leprae
ucaccuuucggguagacuugaa

SEQ ID NO: 27572 - RNA, 22 nt, Mycobacterium leprae
ucacucccauucgugcugacgc

SEQ ID NO: 27573 - RNA, 17 nt, Mycobacterium leprae
ucagcacuaagaguccc

SEQ ID NO: 27574 - RNA, 19 nt, Mycobacterium leprae
ucagccacauggccgcggc

SEQ ID NO: 27575 - RNA, 22 nt, Mycobacterium leprae
ucagccgcagugacacguaucc

SEQ ID NO: 27576 - RNA, 22 nt, Mycobacterium leprae
ucagcgacaacccgguagcaag

SEQ ID NO: 27577 - RNA, 21 nt, Mycobacterium leprae
ugcuuggccgcaauccggugc

SEQ ID NO: 27578 - RNA, 22 nt, Mycobacterium leprae
uggaaacgccgugguugaaguc

SEQ ID NO: 27579 - RNA, 22 nt, Mycobacterium leprae
uggaagacgagcucgaugagau

SEQ ID NO: 27580 - RNA, 22 nt, Mycobacterium leprae
uggaucgggaucuggugcucua

SEQ ID NO: 27581 - RNA, 22 nt, Mycobacterium leprae
uggcaagccuacggaauugggc

SEQ ID NO: 27582 - RNA, 22 nt, Mycobacterium leprae
uggcacuaauggaggaccgcgc

SEQ ID NO: 27583 - RNA, 22 nt, Mycobacterium leprae
uggcagaugaaaucauagucag

SEQ ID NO: 27584 - RNA, 23 nt, Mycobacterium leprae
uggcaggaugccuuaacggcguu

SEQ ID NO: 27585 - RNA, 22 nt, Mycobacterium leprae
uggccaccgcaagcacguuguc

SEQ ID NO: 27586 - RNA, 22 nt, Mycobacterium leprae
uggccaggcgggccguacuggc

SEQ ID NO: 27587 - RNA, 22 nt, Mycobacterium leprae
uggccggaccgugcgagcuacg

SEQ ID NO: 27588 - RNA, 22 nt, Mycobacterium leprae
uggccgguccggcaaagccgaa

SEQ ID NO: 27589 - RNA, 22 nt, Mycobacterium leprae
uggcgcugggugguagcgaugu

SEQ ID NO: 27590 - RNA, 22 nt, Mycobacterium leprae
uggcggcguuguugcuggggcu

SEQ ID NO: 27591 - RNA, 22 nt, Mycobacterium leprae
uggcgggugcaccugacguggu

SEQ ID NO: 27592 - RNA, 22 nt, Mycobacterium leprae
uggcggucucacggcugcgugu

SEQ ID NO: 27593 - RNA, 22 nt, Mycobacterium leprae
uggcugcguugccggcgaacca

SEQ ID NO: 27594 - RNA, 22 nt, Mycobacterium leprae
uggcugcuucggcggucgacuc

SEQ ID NO: 27595 - RNA, 22 nt, Mycobacterium leprae
uggcugugguucgugguucggc

SEQ ID NO: 27596 - RNA, 22 nt, Mycobacterium leprae
uggcuguucccaggugcagggc

SEQ ID NO: 27597 - RNA, 22 nt, Mycobacterium leprae
uggcuuuuggcugaaacugacc

SEQ ID NO: 27598 - RNA, 22 nt, Mycobacterium leprae
ugggacgucccgucacgagcaa

SEQ ID NO: 27599 - RNA, 22 nt, Mycobacterium leprae
uggucagcaccgcccuagucgg

SEQ ID NO: 27600 - RNA, 19 nt, Mycobacterium leprae
ugguccaguuacuggcccc

SEQ ID NO: 27601 - RNA, 22 nt, Mycobacterium leprae
uggugauggcggucguuuggca

SEQ ID NO: 27602 - RNA, 22 nt, Mycobacterium leprae
uggugcucgucgaacaaccuca

SEQ ID NO: 27603 - RNA, 22 nt, Mycobacterium leprae
ugguggcaggcgccgcucagcu

SEQ ID NO: 27604 - RNA, 22 nt, Mycobacterium leprae
ugguguucguggcugcgcauca

SEQ ID NO: 27605 - RNA, 22 nt, Mycobacterium leprae
uguaccgcuucgauuaccuggc

SEQ ID NO: 27606 - RNA, 22 nt, Mycobacterium leprae
uguccggugacggguuggccac

SEQ ID NO: 27607 - RNA, 20 nt, Mycobacterium leprae
ugugagguaccggcucguuc

SEQ ID NO: 27608 - RNA, 22 nt, Mycobacterium leprae
ugugcugguagugcauggcgau

SEQ ID NO: 27609 - RNA, 22 nt, Mycobacterium leprae
ugugggcaucccguauagaugu

SEQ ID NO: 27610 - RNA, 22 nt, Mycobacterium leprae
uguuaggucuagcggacauuga

SEQ ID NO: 27611 - RNA, 20 nt, Mycobacterium leprae
uguucaugagcgucggacau

SEQ ID NO: 27612 - RNA, 22 nt, Mycobacterium leprae
uguugcugaccgccgcucaagu

SEQ ID NO: 27613 - RNA, 22 nt, Mycobacterium leprae
uuagcguaagacaacgccagcg

SEQ ID NO: 27614 - RNA, 23 nt, Mycobacterium leprae
uuaucagaacccagcgugagacg

SEQ ID NO: 27615 - RNA, 22 nt, Mycobacterium leprae
uuaugcgucauuagcggguacc

SEQ ID NO: 27616 - RNA, 22 nt, Mycobacterium leprae
uucaguacagcgucccggugag

SEQ ID NO: 27617 - RNA, 20 nt, Mycobacterium leprae
uucaucuugcaagucccggu

SEQ ID NO: 27618 - RNA, 18 nt, Mycobacterium leprae
uuccggaagccgaucgau

SEQ ID NO: 27619 - RNA, 22 nt, Mycobacterium leprae
uucgacuggcucaacuaugaag

SEQ ID NO: 27620 - RNA, 22 nt, Mycobacterium leprae
uucgacuuaguggcagguguug

SEQ ID NO: 27621 - RNA, 22 nt, Mycobacterium leprae
uucgagaacuucguguguuugu

SEQ ID NO: 27622 - RNA, 22 nt, Mycobacterium leprae
uucgcgcagguaacccucgacc

SEQ ID NO: 27623 - RNA, 22 nt, Mycobacterium leprae
uucggcuuugccggaccgguuc

SEQ ID NO: 27624 - RNA, 22 nt, Mycobacterium leprae
uucgggguguucuuuggcaugc

SEQ ID NO: 27625 - RNA, 22 nt, Mycobacterium leprae
uucugagugauccgcacgaugg

SEQ ID NO: 27626 - RNA, 22 nt, Mycobacterium leprae
uugaaguagaacuugucgggau

SEQ ID NO: 27627 - RNA, 22 nt, Mycobacterium leprae
uugaccgaugcugcugcccgag

SEQ ID NO: 27628 - RNA, 22 nt, Mycobacterium leprae
uugaccgcaacacgaucggcua

SEQ ID NO: 27629 - RNA, 22 nt, Mycobacterium leprae
uugaucaaguacaccgacgagg

SEQ ID NO: 27630 - RNA, 22 nt, Mycobacterium leprae
uugaugcugcgccgauucggcg

SEQ ID NO: 27631 - RNA, 22 nt, Mycobacterium leprae
uugccgaugauuacaucauccg

SEQ ID NO: 27632 - RNA, 20 nt, Mycobacterium leprae
uugccgcccuugaccggugg

SEQ ID NO: 27633 - RNA, 22 nt, Mycobacterium leprae
uugcgacggcaccuaucauaau

SEQ ID NO: 27634 - RNA, 21 nt, Mycobacterium leprae
uugcgaucgccacuaguugac

SEQ ID NO: 27635 - RNA, 22 nt, Mycobacterium leprae
uugcggcgggugguugaccgcg

SEQ ID NO: 27636 - RNA, 22 nt, Mycobacterium leprae
uugcuggaccgcaugcguggcg

SEQ ID NO: 27637 - RNA, 22 nt, Mycobacterium leprae
uuggccacgaaucugugcgcca

SEQ ID NO: 27638 - RNA, 22 nt, Mycobacterium leprae
uuggcgauugcccgcgaauaug

SEQ ID NO: 27639 - RNA, 22 nt, Mycobacterium leprae
uuggcgccaucggcagcgguca

SEQ ID NO: 27640 - RNA, 22 nt, Mycobacterium leprae
uuggcggugagcuugccguggu

SEQ ID NO: 27641 - RNA, 22 nt, Mycobacterium leprae
uuggcuguucaacaugggcaug

SEQ ID NO: 27642 - RNA, 22 nt, Mycobacterium leprae
uugggucauugcugccgccggg

SEQ ID NO: 27643 - RNA, 22 nt, Mycobacterium leprae
uugguaccguccccgggcgcag

SEQ ID NO: 27644 - RNA, 22 nt, Mycobacterium leprae
uuggucgggugcuccuggucag

SEQ ID NO: 27645 - RNA, 22 nt, Mycobacterium leprae
uugguggccgguaccgucccgg

SEQ ID NO: 27646 - RNA, 22 nt, Mycobacterium leprae
uugugcggguggugucgaugcc

SEQ ID NO: 27647 - RNA, 23 nt, Mycobacterium leprae
uuguucuccgguggugcgcugcu

SEQ ID NO: 27648 - RNA, 22 nt, Mycobacterium leprae
uuguuugucguuucugcaguag

SEQ ID NO: 27649 - RNA, 21 nt, Mycobacterium leprae
uuuagccgauugccggccgga

SEQ ID NO: 27650 - RNA, 22 nt, Mycobacterium leprae
uuucggcggggccaaucagcgu

SEQ ID NO: 27651 - RNA, 22 nt, Mycobacterium leprae
uuugaugaugucgcauucgcug

SEQ ID NO: 27652 - RNA, 22 nt, Mycobacterium leprae
uuuggcugggaauguggucgcu

SEQ ID NO: 27653 - RNA, 22 nt, Mycobacterium leprae
aaaacugugcggcccggccauu

SEQ ID NO: 27654 - RNA, 22 nt, Mycobacterium leprae
aaacaacgucguaguggccgcc

SEQ ID NO: 27655 - RNA, 20 nt, Mycobacterium leprae
aacacugagaauucuaccgc

SEQ ID NO: 27656 - RNA, 22 nt, Mycobacterium leprae
aacccgaauuugcagcaggucc

SEQ ID NO: 27657 - RNA, 22 nt, Mycobacterium leprae
aaccuuggcaaucgaguuauau

SEQ ID NO: 27658 - RNA, 22 nt, Mycobacterium leprae
aacgaccgcagauugacuucga

SEQ ID NO: 27659 - RNA, 22 nt, Mycobacterium leprae
aacgacucgguguaugagcuaa

SEQ ID NO: 27660 - RNA, 22 nt, Mycobacterium leprae
aacggcuauuggguggcuggcg

SEQ ID NO: 27661 - RNA, 22 nt, Mycobacterium leprae
aacgggcguuggacugcggagc

SEQ ID NO: 27662 - RNA, 22 nt, Mycobacterium leprae
aacgucuuugucugggcguuca

SEQ ID NO: 27663 - RNA, 22 nt, Mycobacterium leprae
aacuguuuucuccagcuagcuc

SEQ ID NO: 27664 - RNA, 22 nt, Mycobacterium leprae
aagcucugaccauggcacgcga

SEQ ID NO: 27665 - RNA, 22 nt, Mycobacterium leprae
aagucgaucaccacagggcggu

SEQ ID NO: 27666 - RNA, 22 nt, Mycobacterium leprae
aaguugcuguucgugccggugu

SEQ ID NO: 27667 - RNA, 22 nt, Mycobacterium leprae
aaugcuaugauaauuuggcuga

SEQ ID NO: 27668 - RNA, 22 nt, Mycobacterium leprae
acaccacauccuauugggcugc

SEQ ID NO: 27669 - RNA, 23 nt, Mycobacterium leprae
acacugcuacgugacugcggcgc

SEQ ID NO: 27670 - RNA, 22 nt, Mycobacterium leprae
acagaucgaacucgacgcggcc

SEQ ID NO: 27671 - RNA, 22 nt, Mycobacterium leprae
acagucugacauagccuaccgg

SEQ ID NO: 27672 - RNA, 22 nt, Mycobacterium leprae
acaucgaugcguaucccuugac

SEQ ID NO: 27673 - RNA, 22 nt, Mycobacterium leprae
acaugcucgacagccugucgag

SEQ ID NO: 27674 - RNA, 22 nt, Mycobacterium leprae
accaaaccaccgagauccgguc

SEQ ID NO: 27675 - RNA, 22 nt, Mycobacterium leprae
accaccaccagcaucccgcugc

SEQ ID NO: 27676 - RNA, 22 nt, Mycobacterium leprae
accacggccucggcgccugcuu

SEQ ID NO: 27677 - RNA, 22 nt, Mycobacterium leprae
accagccagcacaaacgcguac

SEQ ID NO: 27678 - RNA, 23 nt, Mycobacterium leprae
accagcccgaaaucagucagggu

SEQ ID NO: 27679 - RNA, 20 nt, Mycobacterium leprae
accagcgccagcaaucuacu

SEQ ID NO: 27680 - RNA, 22 nt, Mycobacterium leprae
accagcuaucuggcugggucga

SEQ ID NO: 27681 - RNA, 22 nt, Mycobacterium leprae
accauguccaaggcgcucggca

SEQ ID NO: 27682 - RNA, 18 nt, Mycobacterium leprae
auccagcucagccagcuc

SEQ ID NO: 27683 - RNA, 21 nt, Mycobacterium leprae
auccaucacuucgccgaccac

SEQ ID NO: 27684 - RNA, 22 nt, Mycobacterium leprae
auccgguuucgcugcuucguuu

SEQ ID NO: 27685 - RNA, 22 nt, Mycobacterium leprae
auccgguuuggcucccggcugg

SEQ ID NO: 27686 - RNA, 22 nt, Mycobacterium leprae
aucgaacgcugguggcugcucg

SEQ ID NO: 27687 - RNA, 22 nt, Mycobacterium leprae
aucgccauacucgaggcggcgu

SEQ ID NO: 27688 - RNA, 22 nt, Mycobacterium leprae
aucgccgaacaccgacucaaac

SEQ ID NO: 27689 - RNA, 19 nt, Mycobacterium leprae
aucgccgacugggcgcggu

SEQ ID NO: 27690 - RNA, 22 nt, Mycobacterium leprae
aucggaaucaaggguccggcag

SEQ ID NO: 27691 - RNA, 22 nt, Mycobacterium leprae
aucggcuaaugaacugcucgcc

SEQ ID NO: 27692 - RNA, 22 nt, Mycobacterium leprae
aucgguggggcggcugucuugg

SEQ ID NO: 27693 - RNA, 22 nt, Mycobacterium leprae
aucgguuucuuaccggagucga

SEQ ID NO: 27694 - RNA, 22 nt, Mycobacterium leprae
aucucgcccuuuucucgugugu

SEQ ID NO: 27695 - RNA, 22 nt, Mycobacterium leprae
aucuggcggcauacgaucugcc

SEQ ID NO: 27696 - RNA, 21 nt, Mycobacterium leprae
aucuucgcgguggugcuguug

SEQ ID NO: 27697 - RNA, 22 nt, Mycobacterium leprae
aucuuggagaacccggccuggu

SEQ ID NO: 27698 - RNA, 22 nt, Mycobacterium leprae
aucuuggauaaacucgaaagcc

SEQ ID NO: 27699 - RNA, 22 nt, Mycobacterium leprae
augacguugugcuucgcaacca

SEQ ID NO: 27700 - RNA, 22 nt, Mycobacterium leprae
augagcacgggaggcuggcgaa

SEQ ID NO: 27701 - RNA, 22 nt, Mycobacterium leprae
augccauugcuggaccuaaucc

SEQ ID NO: 27702 - RNA, 22 nt, Mycobacterium leprae
augcgaugguagcggggcuggu

SEQ ID NO: 27703 - RNA, 22 nt, Mycobacterium leprae
augcgcgcgucgggcauguggu

SEQ ID NO: 27704 - RNA, 22 nt, Mycobacterium leprae
augcgcgcuuucgguacugauc

SEQ ID NO: 27705 - RNA, 22 nt, Mycobacterium leprae
augcucaugguguugaugcuaa

SEQ ID NO: 27706 - RNA, 22 nt, Mycobacterium leprae
augcugucgcggagcuccgcgu

SEQ ID NO: 27707 - RNA, 22 nt, Mycobacterium leprae
augcuguguuucaaccguauug

SEQ ID NO: 27708 - RNA, 22 nt, Mycobacterium leprae
augcuguucccagcggccgagc

SEQ ID NO: 27709 - RNA, 22 nt, Mycobacterium leprae
auggcggcaugcacucgcugug

SEQ ID NO: 27710 - RNA, 22 nt, Mycobacterium leprae
auggugugacugguccgagcug

SEQ ID NO: 27711 - RNA, 22 nt, Mycobacterium leprae
augguugagaucucgacggaua

SEQ ID NO: 27712 - RNA, 22 nt, Mycobacterium leprae
augguugguggucuggcaggca

SEQ ID NO: 27713 - RNA, 22 nt, Mycobacterium leprae
auguauuggugcaaguguccug

SEQ ID NO: 27714 - RNA, 22 nt, Mycobacterium leprae
augucacuucccgugccgauuu

SEQ ID NO: 27715 - RNA, 22 nt, Mycobacterium leprae
augucgguuuugguaacuuucu

SEQ ID NO: 27716 - RNA, 22 nt, Mycobacterium leprae
augugguuggcagcgcuggaaa

SEQ ID NO: 27717 - RNA, 22 nt, Mycobacterium leprae
auguguucaacgggcggcauua

SEQ ID NO: 27718 - RNA, 22 nt, Mycobacterium leprae
auguucagaucggcaucgguua

SEQ ID NO: 27719 - RNA, 22 nt, Mycobacterium leprae
auugaccaccacuacuaccagu

SEQ ID NO: 27720 - RNA, 22 nt, Mycobacterium leprae
auugauugccauaucacgucca

SEQ ID NO: 27721 - RNA, 22 nt, Mycobacterium leprae
auugggcgaugucgucguugcg

SEQ ID NO: 27722 - RNA, 22 nt, Mycobacterium leprae
auuggucgugaucacggugcug

SEQ ID NO: 27723 - RNA, 22 nt, Mycobacterium leprae
caacaucucggggugcaacuug

SEQ ID NO: 27724 - RNA, 22 nt, Mycobacterium leprae
caacgccaucagacggauguac

SEQ ID NO: 27725 - RNA, 22 nt, Mycobacterium leprae
caacgcuuacccggccggcggu

SEQ ID NO: 27726 - RNA, 20 nt, Mycobacterium leprae
caauccagacggcaaucucg

SEQ ID NO: 27727 - RNA, 22 nt, Mycobacterium leprae
caaucgaucuugacaguguggc

SEQ ID NO: 27728 - RNA, 22 nt, Mycobacterium leprae
caaucguagauggccgccaagu

SEQ ID NO: 27729 - RNA, 22 nt, Mycobacterium leprae
cacaccuuggccgcaucggugu

SEQ ID NO: 27730 - RNA, 20 nt, Mycobacterium leprae
cacaugucgcaaguagccua

SEQ ID NO: 27731 - RNA, 22 nt, Mycobacterium leprae
caccaucgaugcgcccagggua

SEQ ID NO: 27732 - RNA, 22 nt, Mycobacterium leprae
caccugcaacgcacgugucuug

SEQ ID NO: 27733 - RNA, 21 nt, Mycobacterium leprae
cacgaacguccuuggugucuu

SEQ ID NO: 27734 - RNA, 21 nt, Mycobacterium leprae
cacuggccgccaugggaauua

SEQ ID NO: 27735 - RNA, 22 nt, Mycobacterium leprae
cagcaccgaaagaauggccgcu

SEQ ID NO: 27736 - RNA, 22 nt, Mycobacterium leprae
cagccaggcagcugcuaggcgg

SEQ ID NO: 27737 - RNA, 22 nt, Mycobacterium leprae
cagccccgaggcagcucguugg

SEQ ID NO: 27738 - RNA, 22 nt, Mycobacterium leprae
cagccggugguggaaucggugu

SEQ ID NO: 27739 - RNA, 22 nt, Mycobacterium leprae
cagcgccggugcagucaugccg

SEQ ID NO: 27740 - RNA, 22 nt, Mycobacterium leprae
cagcgcugaucucgcaggcgac

SEQ ID NO: 27741 - RNA, 21 nt, Mycobacterium leprae
cagcucgagggcuauuggcua

SEQ ID NO: 27742 - RNA, 22 nt, Mycobacterium leprae
caggaucacuaguugcgccgga

SEQ ID NO: 27743 - RNA, 22 nt, Mycobacterium leprae
caggauuacgcauguuagucgc

SEQ ID NO: 27744 - RNA, 22 nt, Mycobacterium leprae
caggucagcuccauccuggccg

SEQ ID NO: 27745 - RNA, 22 nt, Mycobacterium leprae
caguaguucaccgcgcugccgu

SEQ ID NO: 27746 - RNA, 22 nt, Mycobacterium leprae
cauccaguuuuccaccgguggu

SEQ ID NO: 27747 - RNA, 22 nt, Mycobacterium leprae
caucccguccaguacaccagca

SEQ ID NO: 27748 - RNA, 22 nt, Mycobacterium leprae
caucgacgucucagugcuugcg

SEQ ID NO: 27749 - RNA, 22 nt, Mycobacterium leprae
caucgcgucgguauugauccgu

SEQ ID NO: 27750 - RNA, 22 nt, Mycobacterium leprae
caucgucuggggcgcggcagcu

SEQ ID NO: 27751 - RNA, 22 nt, Mycobacterium leprae
cauucuggucucgcgugccaag

SEQ ID NO: 27752 - RNA, 22 nt, Mycobacterium leprae
ccaagcugcuccggucggugcu

SEQ ID NO: 27753 - RNA, 22 nt, Mycobacterium leprae
ccacguuguuggaucugcgggc

SEQ ID NO: 27754 - RNA, 22 nt, Mycobacterium leprae
ccacucagcggucagcagcacu

SEQ ID NO: 27755 - RNA, 17 nt, Mycobacterium leprae
ccagcgcgugcacguug

SEQ ID NO: 27756 - RNA, 22 nt, Mycobacterium leprae
ccagcgggaugcuggugguggu

SEQ ID NO: 27757 - RNA, 22 nt, Mycobacterium leprae
ccagcggggcgugcaacgcggu

SEQ ID NO: 27758 - RNA, 22 nt, Mycobacterium leprae
ccagcuacgacaggcccgcgaa

SEQ ID NO: 27759 - RNA, 22 nt, Mycobacterium leprae
ccaggcacugcgccacuaugcc

SEQ ID NO: 27760 - RNA, 22 nt, Mycobacterium leprae
ccaggguuuuguuguggcucgc

SEQ ID NO: 27761 - RNA, 22 nt, Mycobacterium leprae
ccaguacggcccgccuggccag

SEQ ID NO: 27762 - RNA, 22 nt, Mycobacterium leprae
ccaugcgauuggcgcagauuuu

SEQ ID NO: 27763 - RNA, 22 nt, Mycobacterium leprae
cccagguguugcuagcgcaggu

SEQ ID NO: 27764 - RNA, 22 nt, Mycobacterium leprae
ccccgccaguugcuuggcuaca

SEQ ID NO: 27765 - RNA, 21 nt, Mycobacterium leprae
ccccggaaccgcccagcacau

SEQ ID NO: 27766 - RNA, 22 nt, Mycobacterium leprae
cccgaucaguggucggccuggc

SEQ ID NO: 27767 - RNA, 22 nt, Mycobacterium leprae
cccgcgacgucguaaucgaagu

SEQ ID NO: 27768 - RNA, 20 nt, Mycobacterium leprae
ccgaccggaagggcaugcac

SEQ ID NO: 27769 - RNA, 22 nt, Mycobacterium leprae
ccgacugcaagagauauucgac

SEQ ID NO: 27770 - RNA, 22 nt, Mycobacterium leprae
ccgaggcgcccacaccgcgguu

SEQ ID NO: 27771 - RNA, 22 nt, Mycobacterium leprae
ccgauguccgagcucgacacau

SEQ ID NO: 27772 - RNA, 22 nt, Mycobacterium leprae
cguugggauaggcguuuugcag

SEQ ID NO: 27773 - RNA, 22 nt, Mycobacterium leprae
cuacggcguaugggcaucagcg

SEQ ID NO: 27774 - RNA, 22 nt, Mycobacterium leprae
cuaguugacgaagaucggugcg

SEQ ID NO: 27775 - RNA, 22 nt, Mycobacterium leprae
cuaugaaaccaaccgaacaacu

SEQ ID NO: 27776 - RNA, 22 nt, Mycobacterium leprae
cucaccaaaggcuucgcguucu

SEQ ID NO: 27777 - RNA, 18 nt, Mycobacterium leprae
cucccacuucugcuugcu

SEQ ID NO: 27778 - RNA, 22 nt, Mycobacterium leprae
cucgaugucauccggauagugg

SEQ ID NO: 27779 - RNA, 22 nt, Mycobacterium leprae
cucgcggcuagguaggcuuuca

SEQ ID NO: 27780 - RNA, 22 nt, Mycobacterium leprae
cucggcgaagugagcgagggau

SEQ ID NO: 27781 - RNA, 19 nt, Mycobacterium leprae
cucggugagguggacggca

SEQ ID NO: 27782 - RNA, 22 nt, Mycobacterium leprae
cucuggcugcuaucacggccau

SEQ ID NO: 27783 - RNA, 22 nt, Mycobacterium leprae
cugaccgcaaagacuuuccgag

SEQ ID NO: 27784 - RNA, 22 nt, Mycobacterium leprae
cugaggccggugaaugguccgg

SEQ ID NO: 27785 - RNA, 22 nt, Mycobacterium leprae
cugcauacccggaugaacguua

SEQ ID NO: 27786 - RNA, 22 nt, Mycobacterium leprae
cugccaccagguacggucgucg

SEQ ID NO: 27787 - RNA, 22 nt, Mycobacterium leprae
cugccgcguuuccaugccucgu

SEQ ID NO: 27788 - RNA, 22 nt, Mycobacterium leprae
cugcugcugacacgccguuccg

SEQ ID NO: 27789 - RNA, 22 nt, Mycobacterium leprae
cuggagacaccguaaccggagu

SEQ ID NO: 27790 - RNA, 22 nt, Mycobacterium leprae
cuggccaguacggcccgccugg

SEQ ID NO: 27791 - RNA, 22 nt, Mycobacterium leprae
cuggcuggauauccgcagccug

SEQ ID NO: 27792 - RNA, 22 nt, Mycobacterium leprae
cugggcaccaggccgucgucgg

SEQ ID NO: 27793 - RNA, 22 nt, Mycobacterium leprae
cugggccgcaagaucccgucug

SEQ ID NO: 27794 - RNA, 22 nt, Mycobacterium leprae
cuggucguuucauugcagcggu

SEQ ID NO: 27795 - RNA, 22 nt, Mycobacterium leprae
cugguggauacucaacuguuua

SEQ ID NO: 27796 - RNA, 22 nt, Mycobacterium leprae
cugguuuugguccuggggcagg

SEQ ID NO: 27797 - RNA, 22 nt, Mycobacterium leprae
cugugggugaucaccgacgcac

SEQ ID NO: 27798 - RNA, 22 nt, Mycobacterium leprae
cuuaagaaucggcuugcgacgg

SEQ ID NO: 27799 - RNA, 22 nt, Mycobacterium leprae
cuucgcugugcuugcgaccgcc

SEQ ID NO: 27800 - RNA, 22 nt, Mycobacterium leprae
cuugcccgggaucggcgcccac

SEQ ID NO: 27801 - RNA, 22 nt, Mycobacterium leprae
cuugccgaggucggagugguua

SEQ ID NO: 27802 - RNA, 22 nt, Mycobacterium leprae
cuugggaguccuucuuguuggu

SEQ ID NO: 27803 - RNA, 22 nt, Mycobacterium leprae
cuuucguauugaccggcguuag

SEQ ID NO: 27804 - RNA, 22 nt, Mycobacterium leprae
gaaaaugacgaugucgccgggc

SEQ ID NO: 27805 - RNA, 22 nt, Mycobacterium leprae
gaaaugacucucccggaaccga

SEQ ID NO: 27806 - RNA, 22 nt, Mycobacterium leprae
gaacaccgucuugaucucgucg

SEQ ID NO: 27807 - RNA, 21 nt, Mycobacterium leprae
gaaccuugcauugucuagccg

SEQ ID NO: 27808 - RNA, 22 nt, Mycobacterium leprae
gaacugaccgcgaccgucauca

SEQ ID NO: 27809 - RNA, 22 nt, Mycobacterium leprae
gaaucgguacuacaagcgacgc

SEQ ID NO: 27810 - RNA, 22 nt, Mycobacterium leprae
gacaauuuuuugcucaugucuc

SEQ ID NO: 27811 - RNA, 21 nt, Mycobacterium leprae
gacagcggugcuguucaucga

SEQ ID NO: 27812 - RNA, 22 nt, Mycobacterium leprae
gacaugacggugcgacuguugu

SEQ ID NO: 27813 - RNA, 22 nt, Mycobacterium leprae
gaccggguugaaaagcaucgcu

SEQ ID NO: 27814 - RNA, 22 nt, Mycobacterium leprae
gaccuggucuuugacacuguga

SEQ ID NO: 27815 - RNA, 22 nt, Mycobacterium leprae
gacgacguggcggucaccacag

SEQ ID NO: 27816 - RNA, 22 nt, Mycobacterium leprae
gacgauacgaaaccggucccug

SEQ ID NO: 27817 - RNA, 22 nt, Mycobacterium leprae
gacgaucggauaggugacguac

SEQ ID NO: 27818 - RNA, 22 nt, Mycobacterium leprae
gacgcggucaaggacugcgacu

SEQ ID NO: 27819 - RNA, 22 nt, Mycobacterium leprae
gacgcuagcccaguugcgcgcg

SEQ ID NO: 27820 - RNA, 22 nt, Mycobacterium leprae
gacggaugcguucgcggguuac

SEQ ID NO: 27821 - RNA, 22 nt, Mycobacterium leprae
gacgucaucuucuacggcccgg

SEQ ID NO: 27822 - RNA, 22 nt, Mycobacterium leprae
gacugccucggacgaugagcug

SEQ ID NO: 27823 - RNA, 22 nt, Mycobacterium leprae
gacugguguucuuggcgaauuc

SEQ ID NO: 27824 - RNA, 22 nt, Mycobacterium leprae
gagauauaccgcaucgacgacg

SEQ ID NO: 27825 - RNA, 22 nt, Mycobacterium leprae
gagcacccauuucugcagcauc

SEQ ID NO: 27826 - RNA, 22 nt, Mycobacterium leprae
gagcaugcgcgaaccggucggc

SEQ ID NO: 27827 - RNA, 22 nt, Mycobacterium leprae
gagccuguccgacgccggccgu

SEQ ID NO: 27828 - RNA, 22 nt, Mycobacterium leprae
gagcgaaugugaucacggccac

SEQ ID NO: 27829 - RNA, 16 nt, Mycobacterium leprae
gagcggugaaucacuu

SEQ ID NO: 27830 - RNA, 22 nt, Mycobacterium leprae
gagcucugcugguugaguuuug

SEQ ID NO: 27831 - RNA, 22 nt, Mycobacterium leprae
gaggaugaagucgacgagcuac

SEQ ID NO: 27832 - RNA, 22 nt, Mycobacterium leprae
gaggcgaugaaggcgcugacgg

SEQ ID NO: 27833 - RNA, 22 nt, Mycobacterium leprae
gaggucggagucguaguccgca

SEQ ID NO: 27834 - RNA, 22 nt, Mycobacterium leprae
gagucggugucgaagcagccga

SEQ ID NO: 27835 - RNA, 22 nt, Mycobacterium leprae
gaguggucaguuugccgguguc

SEQ ID NO: 27836 - RNA, 22 nt, Mycobacterium leprae
gaguuggccaagcaccgugccg

SEQ ID NO: 27837 - RNA, 22 nt, Mycobacterium leprae
gaucgcgcgaugaguuucggga

SEQ ID NO: 27838 - RNA, 22 nt, Mycobacterium leprae
gaucgcgcucuaagcaggauua

SEQ ID NO: 27839 - RNA, 22 nt, Mycobacterium leprae
gaucgcugcgguugguauuguc

SEQ ID NO: 27840 - RNA, 22 nt, Mycobacterium leprae
gaucggcggcaggucgaaaucg

SEQ ID NO: 27841 - RNA, 22 nt, Mycobacterium leprae
gaucgucaguuuuuuugcucau

SEQ ID NO: 27842 - RNA, 22 nt, Mycobacterium leprae
gaugcagccgugcacaugugcg

SEQ ID NO: 27843 - RNA, 22 nt, Mycobacterium leprae
gauggcgcgucuucggugcggu

SEQ ID NO: 27844 - RNA, 22 nt, Mycobacterium leprae
gauggcuggcgauguucgccga

SEQ ID NO: 27845 - RNA, 22 nt, Mycobacterium leprae
gauguccgacgcucaugaacaa

SEQ ID NO: 27846 - RNA, 22 nt, Mycobacterium leprae
gaugucgacgacauccuguggc

SEQ ID NO: 27847 - RNA, 22 nt, Mycobacterium leprae
gaugugucgguuggauauucgg

SEQ ID NO: 27848 - RNA, 22 nt, Mycobacterium leprae
gauguugcucaccgcuaucgug

SEQ ID NO: 27849 - RNA, 23 nt, Mycobacterium leprae
gauuggccgagacgaugacggug

SEQ ID NO: 27850 - RNA, 22 nt, Mycobacterium leprae
gauuggugauguagccgauguc

SEQ ID NO: 27851 - RNA, 22 nt, Mycobacterium leprae
gcacaguuaaggucguguagag

SEQ ID NO: 27852 - RNA, 20 nt, Mycobacterium leprae
gcacccgagcuucaucgccu

SEQ ID NO: 27853 - RNA, 22 nt, Mycobacterium leprae
gcaccggccggucaaacgcacc

SEQ ID NO: 27854 - RNA, 22 nt, Mycobacterium leprae
gcacgagcucaggggucaacuc

SEQ ID NO: 27855 - RNA, 22 nt, Mycobacterium leprae
gcagcgagauugcgcaagaacg

SEQ ID NO: 27856 - RNA, 22 nt, Mycobacterium leprae
gcaggcgaauauaaaauucuaa

SEQ ID NO: 27857 - RNA, 22 nt, Mycobacterium leprae
gcagugugcgggucggccaauu

SEQ ID NO: 27858 - RNA, 22 nt, Mycobacterium leprae
gcauccgguuagcugaccgcgc

SEQ ID NO: 27859 - RNA, 22 nt, Mycobacterium leprae
gcauccuggggccucgcccgau

SEQ ID NO: 27860 - RNA, 22 nt, Mycobacterium leprae
gccaaucggaagcgggcugcac

SEQ ID NO: 27861 - RNA, 22 nt, Mycobacterium leprae
gccaauuccuacgaugcuccaa

SEQ ID NO: 27862 - RNA, 22 nt, Mycobacterium leprae
ggucaugcgcuaauuguggcgg

SEQ ID NO: 27863 - RNA, 20 nt, Mycobacterium leprae
ggucgcucucgguguguggu

SEQ ID NO: 27864 - RNA, 22 nt, Mycobacterium leprae
ggucgggaaccuugcacgcucc

SEQ ID NO: 27865 - RNA, 22 nt, Mycobacterium leprae
ggugcaucauuccggugucgac

SEQ ID NO: 27866 - RNA, 22 nt, Mycobacterium leprae
ggugccgcguucagucgcaaca

SEQ ID NO: 27867 - RNA, 22 nt, Mycobacterium leprae
ggugcggacagucaaucgcgug

SEQ ID NO: 27868 - RNA, 21 nt, Mycobacterium leprae
ggugcggcguucugagauuga

SEQ ID NO: 27869 - RNA, 21 nt, Mycobacterium leprae
gguggcguugagcgaggacau

SEQ ID NO: 27870 - RNA, 23 nt, Mycobacterium leprae
gguggucuacguggucaaaguac

SEQ ID NO: 27871 - RNA, 22 nt, Mycobacterium leprae
ggugguggugcaaagguuugau

SEQ ID NO: 27872 - RNA, 22 nt, Mycobacterium leprae
gguucgugcacauggaaugggu

SEQ ID NO: 27873 - RNA, 23 nt, Mycobacterium leprae
guaaggauggcgcucugguuggu

SEQ ID NO: 27874 - RNA, 22 nt, Mycobacterium leprae
guagaucauuacccugcugguc

SEQ ID NO: 27875 - RNA, 22 nt, Mycobacterium leprae
guaucgcuguagcgcuucuccu

SEQ ID NO: 27876 - RNA, 22 nt, Mycobacterium leprae
guaugcugucgacgucuucggu

SEQ ID NO: 27877 - RNA, 22 nt, Mycobacterium leprae
guauuugggaacucuggugacu

SEQ ID NO: 27878 - RNA, 22 nt, Mycobacterium leprae
gucaccgagcaacucaaucgaa

SEQ ID NO: 27879 - RNA, 22 nt, Mycobacterium leprae
gucacguuucucgcagauggug

SEQ ID NO: 27880 - RNA, 22 nt, Mycobacterium leprae
guccaaguuuuucgacugcaag

SEQ ID NO: 27881 - RNA, 22 nt, Mycobacterium leprae
guccaggugagccagcaccgua

SEQ ID NO: 27882 - RNA, 22 nt, Mycobacterium leprae
gucgaauacugugaucucaccc

SEQ ID NO: 27883 - RNA, 22 nt, Mycobacterium leprae
gucgagaucgacguuuugcaag

SEQ ID NO: 27884 - RNA, 22 nt, Mycobacterium leprae
gucgaggguguagggaccacca

SEQ ID NO: 27885 - RNA, 22 nt, Mycobacterium leprae
gucgcggucuugaacggucuca

SEQ ID NO: 27886 - RNA, 22 nt, Mycobacterium leprae
gucggccaggugaccguagaug

SEQ ID NO: 27887 - RNA, 22 nt, Mycobacterium leprae
gucggcgagcgugccggggugc

SEQ ID NO: 27888 - RNA, 20 nt, Mycobacterium leprae
gucguacgcaauucaugcuc

SEQ ID NO: 27889 - RNA, 19 nt, Mycobacterium leprae
gucguuggccucggcgacg

SEQ ID NO: 27890 - RNA, 22 nt, Mycobacterium leprae
gugaccggugcaaugaucgcag

SEQ ID NO: 27891 - RNA, 22 nt, Mycobacterium leprae
gugacgaccccguugcgguuca

SEQ ID NO: 27892 - RNA, 22 nt, Mycobacterium leprae
gugauggauuggaugaccggug

SEQ ID NO: 27893 - RNA, 22 nt, Mycobacterium leprae
gugcaacuuaugcuagcgguuu

SEQ ID NO: 27894 - RNA, 22 nt, Mycobacterium leprae
gugccaagcgguccugcugcug

SEQ ID NO: 27895 - RNA, 22 nt, Mycobacterium leprae
gugccacagucguugcgcgaua

SEQ ID NO: 27896 - RNA, 22 nt, Mycobacterium leprae
gugccgcaagcaccgaagugcg

SEQ ID NO: 27897 - RNA, 22 nt, Mycobacterium leprae
gugcggccaucaaucagucuac

SEQ ID NO: 27898 - RNA, 22 nt, Mycobacterium leprae
gugcggugccaccucgauguug

SEQ ID NO: 27899 - RNA, 22 nt, Mycobacterium leprae
guggagaccaacuuccuuccgc

SEQ ID NO: 27900 - RNA, 22 nt, Mycobacterium leprae
guggccaggcugucggcggacg

SEQ ID NO: 27901 - RNA, 22 nt, Mycobacterium leprae
guggcgaugucggucggucggc

SEQ ID NO: 27902 - RNA, 22 nt, Mycobacterium leprae
guggcggcuggucccggaauua

SEQ ID NO: 27903 - RNA, 22 nt, Mycobacterium leprae
guggugcugcuagucgacgauu

SEQ ID NO: 27904 - RNA, 22 nt, Mycobacterium leprae
guguauccuuuccaguacgcag

SEQ ID NO: 27905 - RNA, 22 nt, Mycobacterium leprae
guguucggcucaguacgccgua

SEQ ID NO: 27906 - RNA, 22 nt, Mycobacterium leprae
guguugccaacagaaccgacuu

SEQ ID NO: 27907 - RNA, 22 nt, Mycobacterium leprae
guuaucggcaacgaccaucauu

SEQ ID NO: 27908 - RNA, 20 nt, Mycobacterium leprae
guucaugagcgucggacauu

SEQ ID NO: 27909 - RNA, 22 nt, Mycobacterium leprae
guucgaggcacugucggcguug

SEQ ID NO: 27910 - RNA, 22 nt, Mycobacterium leprae
guugcgcuuccaccucgguacc

SEQ ID NO: 27911 - RNA, 22 nt, Mycobacterium leprae
guuggcauaguuagaaccgaag

SEQ ID NO: 27912 - RNA, 22 nt, Mycobacterium leprae
guuggcgaucucaccgcgggcg

SEQ ID NO: 27913 - RNA, 22 nt, Mycobacterium leprae
guugggugaugacgccaaagaa

SEQ ID NO: 27914 - RNA, 20 nt, Mycobacterium leprae
guugguugaccuuuauccuu

SEQ ID NO: 27915 - RNA, 22 nt, Mycobacterium leprae
guuguugugauaaccgcauaga

SEQ ID NO: 27916 - RNA, 22 nt, Mycobacterium leprae
guuucaggucuaaguuaacaua

SEQ ID NO: 27917 - RNA, 22 nt, Mycobacterium leprae
guuugcgguaugcguugcgcca

SEQ ID NO: 27918 - RNA, 22 nt, Mycobacterium leprae
guuuuauuuaacuagacaucca

SEQ ID NO: 27919 - RNA, 21 nt, Mycobacterium leprae
uaaugcccuucgagggggaua

SEQ ID NO: 27920 - RNA, 22 nt, Mycobacterium leprae
uacauugugaucgguugcccgu

SEQ ID NO: 27921 - RNA, 22 nt, Mycobacterium leprae
uaccgcggugauuuuugcaccc

SEQ ID NO: 27922 - RNA, 22 nt, Mycobacterium leprae
uacggccgguagacccgcuggc

SEQ ID NO: 27923 - RNA, 22 nt, Mycobacterium leprae
uagccagugaucgccgcccuga

SEQ ID NO: 27924 - RNA, 22 nt, Mycobacterium leprae
uagcgauucacuauguugagug

SEQ ID NO: 27925 - RNA, 22 nt, Mycobacterium leprae
uagcgcacuuuuccagccugac

SEQ ID NO: 27926 - RNA, 22 nt, Mycobacterium leprae
uaggcgcugcguagccauucga

SEQ ID NO: 27927 - RNA, 22 nt, Mycobacterium leprae
uaggcgugguguucggguuggc

SEQ ID NO: 27928 - RNA, 22 nt, Mycobacterium leprae
uagggaucagugccacgucguc

SEQ ID NO: 27929 - RNA, 22 nt, Mycobacterium leprae
uagguagauugucuccaggcag

SEQ ID NO: 27930 - RNA, 22 nt, Mycobacterium leprae
uaucccagugauguggccuucg

SEQ ID NO: 27931 - RNA, 22 nt, Mycobacterium leprae
uaugccaauuuugugcggcgga

SEQ ID NO: 27932 - RNA, 22 nt, Mycobacterium leprae
ucaaucacuucggagcuugauc

SEQ ID NO: 27933 - RNA, 21 nt, Mycobacterium leprae
ucaccgucaaucaggucgucg

SEQ ID NO: 27934 - RNA, 22 nt, Mycobacterium leprae
ucaccucgaccauguggaccgg

SEQ ID NO: 27935 - RNA, 22 nt, Mycobacterium leprae
ucacuagcaggcgaacggucac

SEQ ID NO: 27936 - RNA, 22 nt, Mycobacterium leprae
ucagcggugucagacaccgagu

SEQ ID NO: 27937 - RNA, 22 nt, Mycobacterium leprae
ucagcguguuaucgccuuuggc

SEQ ID NO: 27938 - RNA, 22 nt, Mycobacterium leprae
ucaggccgaucggcggcgguuc

SEQ ID NO: 27939 - RNA, 22 nt, Mycobacterium leprae
ucauccuggaaaacgaaauguu

SEQ ID NO: 27940 - RNA, 22 nt, Mycobacterium leprae
ucauggcggcuauggugucggc

SEQ ID NO: 27941 - RNA, 22 nt, Mycobacterium leprae
uccaaaacuaaguugaucccug

SEQ ID NO: 27942 - RNA, 22 nt, Mycobacterium leprae
uccaccaggcaauggcuugcca

SEQ ID NO: 27943 - RNA, 22 nt, Mycobacterium leprae
uccaguauuucuacgagucugc

SEQ ID NO: 27944 - RNA, 22 nt, Mycobacterium leprae
uccaugcugccguggauuucga

SEQ ID NO: 27945 - RNA, 21 nt, Mycobacterium leprae
ucccggccaccuucgucccgu

SEQ ID NO: 27946 - RNA, 22 nt, Mycobacterium leprae
uccgauggcgcugucgcggaua

SEQ ID NO: 27947 - RNA, 22 nt, Mycobacterium leprae
uccgcgacaaucucgacgucgu

SEQ ID NO: 27948 - RNA, 22 nt, Mycobacterium leprae
uccgcgcacgccuuuggucgca

SEQ ID NO: 27949 - RNA, 22 nt, Mycobacterium leprae
uccggcggcgugggugaggacc

SEQ ID NO: 27950 - RNA, 21 nt, Mycobacterium leprae
uccgguuguuaugucucgggc

SEQ ID NO: 27951 - RNA, 22 nt, Mycobacterium leprae
uccgucgcagcucuggcccgau

SEQ ID NO: 27952 - RNA, 22 nt, Mycobacterium leprae
ugcagccgcgaccgcggugggc

SEQ ID NO: 27953 - RNA, 22 nt, Mycobacterium leprae
ugcaucgccggcaugaccacuu

SEQ ID NO: 27954 - RNA, 22 nt, Mycobacterium leprae
ugccagugaccgaguuccgccu

SEQ ID NO: 27955 - RNA, 22 nt, Mycobacterium leprae
ugcccgcgucuacgguaagugg

SEQ ID NO: 27956 - RNA, 22 nt, Mycobacterium leprae
ugcccguagcuuggguggccgg

SEQ ID NO: 27957 - RNA, 19 nt, Mycobacterium leprae
ugcccgucugaucggggua

SEQ ID NO: 27958 - RNA, 22 nt, Mycobacterium leprae
ugccgccgggacgcgucaccau

SEQ ID NO: 27959 - RNA, 22 nt, Mycobacterium leprae
ugccgggugccgcugcgacccc

SEQ ID NO: 27960 - RNA, 22 nt, Mycobacterium leprae
ugccggucgggucuugguuaac

SEQ ID NO: 27961 - RNA, 19 nt, Mycobacterium leprae
ugccucguuaggugagggu

SEQ ID NO: 27962 - RNA, 22 nt, Mycobacterium leprae
ugccuggcagcaugcgcuccag

SEQ ID NO: 27963 - RNA, 22 nt, Mycobacterium leprae
ugcgcacuggcguccagcuggg

SEQ ID NO: 27964 - RNA, 22 nt, Mycobacterium leprae
ugcgcgacaucgaggcugacca

SEQ ID NO: 27965 - RNA, 22 nt, Mycobacterium leprae
ugcgcuacuucgcuggaucgcc

SEQ ID NO: 27966 - RNA, 22 nt, Mycobacterium leprae
ugcggcauggaaaucgcuguug

SEQ ID NO: 27967 - RNA, 21 nt, Mycobacterium leprae
ugcggcggccauguggcaggc

SEQ ID NO: 27968 - RNA, 22 nt, Mycobacterium leprae
ugcggcuuucguucgggaaguu

SEQ ID NO: 27969 - RNA, 22 nt, Mycobacterium leprae
ugcgggugauaucgaccucgac

SEQ ID NO: 27970 - RNA, 22 nt, Mycobacterium leprae
ugcgguucuguguagccgauag

SEQ ID NO: 27971 - RNA, 22 nt, Mycobacterium leprae
ugcguucgucggcgcggagaau

SEQ ID NO: 27972 - RNA, 22 nt, Mycobacterium leprae
ugcugaugucgaagacaaugua

SEQ ID NO: 27973 - RNA, 22 nt, Mycobacterium leprae
ugcugccgguauagaggcaaug

SEQ ID NO: 27974 - RNA, 20 nt, Mycobacterium leprae
ugcugccgugcucgacuugg

SEQ ID NO: 27975 - RNA, 23 nt, Mycobacterium leprae
ugcugcugaugaucgcauccagc

SEQ ID NO: 27976 - RNA, 22 nt, Mycobacterium leprae
ugcuggcucaauugugugaugu

SEQ ID NO: 27977 - RNA, 22 nt, Mycobacterium leprae
uggaagccaaccugcggcuggu

SEQ ID NO: 27978 - RNA, 22 nt, Mycobacterium leprae
uggacggcaucgcgguauucga

SEQ ID NO: 27979 - RNA, 18 nt, Mycobacterium leprae
uggaggucaucugcugcu

SEQ ID NO: 27980 - RNA, 22 nt, Mycobacterium leprae
uggauaucaaugauguuauuug

SEQ ID NO: 27981 - RNA, 21 nt, Mycobacterium leprae
uggauccggacagcaauccga

SEQ ID NO: 27982 - RNA, 21 nt, Mycobacterium leprae
uggaugacgcguggcugcggc

SEQ ID NO: 27983 - RNA, 22 nt, Mycobacterium leprae
uggcagccgugaagacgauguc

SEQ ID NO: 27984 - RNA, 22 nt, Mycobacterium leprae
uggccacggugauuggugaggu

SEQ ID NO: 27985 - RNA, 22 nt, Mycobacterium leprae
uggccgcuggcggacaguuguc

SEQ ID NO: 27986 - RNA, 22 nt, Mycobacterium leprae
uggcggccuuuagugucgguga

SEQ ID NO: 27987 - RNA, 22 nt, Mycobacterium leprae
uggcggucaagacgguagcugc

SEQ ID NO: 27988 - RNA, 22 nt, Mycobacterium leprae
uggcguucaucggggggaguag

SEQ ID NO: 27989 - RNA, 22 nt, Mycobacterium leprae
uggcugcugugguaccaccccg

SEQ ID NO: 27990 - RNA, 22 nt, Mycobacterium leprae
ugggaaaaugggcuucgucuuc

SEQ ID NO: 27991 - RNA, 22 nt, Mycobacterium leprae
ugggaugcccgaugcuguuugg

SEQ ID NO: 27992 - RNA, 23 nt, Mycobacterium leprae
ugggcgaugguuaauguuagcgc

SEQ ID NO: 27993 - RNA, 22 nt, Mycobacterium leprae
ugggcgguugucgaccugcucg

SEQ ID NO: 27994 - RNA, 22 nt, Mycobacterium leprae
ugggcuaugugguucauucugg

SEQ ID NO: 27995 - RNA, 22 nt, Mycobacterium leprae
uggucacugaagcagcgccgca

SEQ ID NO: 27996 - RNA, 22 nt, Mycobacterium leprae
uggucggggucuaucuggaugc

SEQ ID NO: 27997 - RNA, 22 nt, Mycobacterium leprae
uggucgguauguugucgucacc

SEQ ID NO: 27998 - RNA, 22 nt, Mycobacterium leprae
uggugaccagccagcggcuauu

SEQ ID NO: 27999 - RNA, 22 nt, Mycobacterium leprae
uggugcgcaaucacguugccga

SEQ ID NO: 28000 - RNA, 19 nt, Mycobacterium leprae
uggugcgccagcuuuuucc

SEQ ID NO: 28001 - RNA, 22 nt, Mycobacterium leprae
ugguggaaguugguuacggcga

SEQ ID NO: 28002 - RNA, 20 nt, Mycobacterium leprae
ugguguacgcgcucaaccag

SEQ ID NO: 28003 - RNA, 22 nt, Mycobacterium leprae
ugguuggguuacuggcuggcgu

SEQ ID NO: 28004 - RNA, 23 nt, Mycobacterium leprae
ugguuucguggcccagcagccgc

SEQ ID NO: 28005 - RNA, 23 nt, Mycobacterium leprae
ugucaacacuauccccauugcgc

SEQ ID NO: 28006 - RNA, 22 nt, Mycobacterium leprae
ugucaaggaugccaucgagugu

SEQ ID NO: 28007 - RNA, 22 nt, Mycobacterium leprae
ugucacggcugaagaguucggu

SEQ ID NO: 28008 - RNA, 22 nt, Mycobacterium leprae
ugucgacgcgugucgacugacu

SEQ ID NO: 28009 - RNA, 22 nt, Mycobacterium leprae
ugucgaucggaauccgaugcuc

SEQ ID NO: 28010 - RNA, 22 nt, Mycobacterium leprae
ugugagugugcaggcagcgacg

SEQ ID NO: 28011 - RNA, 23 nt, Mycobacterium leprae
uguguugcaacuaagucccggag

SEQ ID NO: 28012 - RNA, 22 nt, Mycobacterium leprae
uguucgcauauaaacauguguu

SEQ ID NO: 28013 - RNA, 22 nt, Mycobacterium leprae
uguugccauaucgucuaauccg

SEQ ID NO: 28014 - RNA, 22 nt, Mycobacterium leprae
uguuugguccagcuuagcguga

SEQ ID NO: 28015 - RNA, 22 nt, Mycobacterium leprae
uguuuuucuagauaagcaccaa

SEQ ID NO: 28016 - RNA, 22 nt, Mycobacterium leprae
uuaccgacgacaccaugcggug

SEQ ID NO: 28017 - RNA, 22 nt, Mycobacterium leprae
uuaccucgauggaauuccgccc

SEQ ID NO: 28018 - RNA, 22 nt, Mycobacterium leprae
uucaccuuguucgcaacguuau

SEQ ID NO: 28019 - RNA, 22 nt, Mycobacterium leprae
uucagacuaguaauuagaguua

SEQ ID NO: 28020 - RNA, 21 nt, Mycobacterium leprae
uucagugaaccacgccauggc

SEQ ID NO: 28021 - RNA, 22 nt, Mycobacterium leprae
uuccgacauuuuucggacgaug

SEQ ID NO: 28022 - RNA, 22 nt, Mycobacterium leprae
uuccgcacaccggugcgacugc

SEQ ID NO: 28023 - RNA, 22 nt, Mycobacterium leprae
uuccgcuggguggcagugugug

SEQ ID NO: 28024 - RNA, 22 nt, Mycobacterium leprae
uuccgguagcauguugugcugg

SEQ ID NO: 28025 - RNA, 22 nt, Mycobacterium leprae
uucgaccgccgagcugguagcu

SEQ ID NO: 28026 - RNA, 22 nt, Mycobacterium leprae
uucgaccuuuuccugcugcgcu

SEQ ID NO: 28027 - RNA, 22 nt, Mycobacterium leprae
uucgaguugcucucaauagcau

SEQ ID NO: 28028 - RNA, 22 nt, Mycobacterium leprae
uucgcccaugccgggucauuga

SEQ ID NO: 28029 - RNA, 22 nt, Mycobacterium leprae
uucgccgccgggccugucgcag

SEQ ID NO: 28030 - RNA, 22 nt, Mycobacterium leprae
uucgcgaucgccgccgucagcu

SEQ ID NO: 28031 - RNA, 22 nt, Mycobacterium leprae
uucgcugacguggacgugcugg

SEQ ID NO: 28032 - RNA, 22 nt, Mycobacterium leprae
uucggcagcaugccgaucguau

SEQ ID NO: 28033 - RNA, 22 nt, Mycobacterium leprae
uucgggagaggaucagcgcugc

SEQ ID NO: 28034 - RNA, 22 nt, Mycobacterium leprae
uucugccguuuugcauaccggg

SEQ ID NO: 28035 - RNA, 22 nt, Mycobacterium leprae
uucuuauaaauccauucuguuu

SEQ ID NO: 28036 - RNA, 22 nt, Mycobacterium leprae
uucuugacuugcuugcgcguau

SEQ ID NO: 28037 - RNA, 22 nt, Mycobacterium leprae
uugagcucgaugguccggaggu

SEQ ID NO: 28038 - RNA, 22 nt, Mycobacterium leprae
uugaggaucagguucagcuggc

SEQ ID NO: 28039 - RNA, 22 nt, Mycobacterium leprae
uugaucagacccgcgauuccgg

SEQ ID NO: 28040 - RNA, 22 nt, Mycobacterium leprae
uugcaguagccggucguuacca

SEQ ID NO: 28041 - RNA, 22 nt, Mycobacterium leprae
uugcgguuuugccgcugcgcga

SEQ ID NO: 28042 - RNA, 22 nt, Mycobacterium leprae
aaauguucgaaguaguucgcgg

SEQ ID NO: 28043 - RNA, 22 nt, Mycobacterium leprae
aacacgacccgaucggcggcgg

SEQ ID NO: 28044 - RNA, 21 nt, Mycobacterium leprae
aaccacugucgaccacugcgg

SEQ ID NO: 28045 - RNA, 22 nt, Mycobacterium leprae
aaccgguuguccaucaucgaca

SEQ ID NO: 28046 - RNA, 22 nt, Mycobacterium leprae
aacgcaucaaggucaucgaacg

SEQ ID NO: 28047 - RNA, 22 nt, Mycobacterium leprae
aacgcauccggaugagacagag

SEQ ID NO: 28048 - RNA, 22 nt, Mycobacterium leprae
aacggugucgaacgacugcggu

SEQ ID NO: 28049 - RNA, 22 nt, Mycobacterium leprae
aacucacagcuuuagcugcucu

SEQ ID NO: 28050 - RNA, 21 nt, Mycobacterium leprae
aacuccacaucuagcguuguc

SEQ ID NO: 28051 - RNA, 17 nt, Mycobacterium leprae
aagauuuaacuguaccg

SEQ ID NO: 28052 - RNA, 22 nt, Mycobacterium leprae
aagcuccgaagugauugaugca

SEQ ID NO: 28053 - RNA, 22 nt, Mycobacterium leprae
agucaccgaguuacugaccgau

SEQ ID NO: 28054 - RNA, 22 nt, Mycobacterium leprae
agucagugacucgagcgauaca

SEQ ID NO: 28055 - RNA, 20 nt, Mycobacterium leprae
aguccggucccaaguguuau

SEQ ID NO: 28056 - RNA, 22 nt, Mycobacterium leprae
agucgauucgauggauccgacg

SEQ ID NO: 28057 - RNA, 22 nt, Mycobacterium leprae
agugcugcugaucgucgguguc

SEQ ID NO: 28058 - RNA, 22 nt, Mycobacterium leprae
aguggucgucaaaaauaugucc

SEQ ID NO: 28059 - RNA, 22 nt, Mycobacterium leprae
aguggugcaucaguggaaagga

SEQ ID NO: 28060 - RNA, 17 nt, Mycobacterium leprae
aguguuggcggcggcau

SEQ ID NO: 28061 - RNA, 20 nt, Mycobacterium leprae
aguucggggucugucgcggu

SEQ ID NO: 28062 - RNA, 22 nt, Mycobacterium leprae
aguugcugucgucuuggguggu

SEQ ID NO: 28063 - RNA, 22 nt, Mycobacterium leprae
auaccuggaacgguucggcugu

SEQ ID NO: 28064 - RNA, 22 nt, Mycobacterium leprae
auagcgcgucgucaccggcaug

SEQ ID NO: 28065 - RNA, 22 nt, Mycobacterium leprae
auagucuaucgugccguccgcg

SEQ ID NO: 28066 - RNA, 17 nt, Mycobacterium leprae
auaguggugcgcggauc

SEQ ID NO: 28067 - RNA, 22 nt, Mycobacterium leprae
auaucggcgucgccgacguagg

SEQ ID NO: 28068 - RNA, 22 nt, Mycobacterium leprae
auaugggcucagggcaccaucc

SEQ ID NO: 28069 - RNA, 22 nt, Mycobacterium leprae
auauugucggcgaguuugaucc

SEQ ID NO: 28070 - RNA, 22 nt, Mycobacterium leprae
aucaccauggucaccaucgccu

SEQ ID NO: 28071 - RNA, 22 nt, Mycobacterium leprae
aucaccgacgcaccaucggcug

SEQ ID NO: 28072 - RNA, 21 nt, Mycobacterium leprae
aucaccuguagaguguuuuga

SEQ ID NO: 28073 - RNA, 22 nt, Mycobacterium leprae
aucagcaugaacgcggucguca

SEQ ID NO: 28074 - RNA, 19 nt, Mycobacterium leprae
aucagcgaccgcaccaucg

SEQ ID NO: 28075 - RNA, 22 nt, Mycobacterium leprae
auccaccgcggcgcuggcugca

SEQ ID NO: 28076 - RNA, 21 nt, Mycobacterium leprae
auccaguuacacgccgaccac

SEQ ID NO: 28077 - RNA, 22 nt, Mycobacterium leprae
aucgaccgucgguauuccgauu

SEQ ID NO: 28078 - RNA, 22 nt, Mycobacterium leprae
aucgacgaccugauuggcgaaa

SEQ ID NO: 28079 - RNA, 22 nt, Mycobacterium leprae
aucgcccuggccugauugauca

SEQ ID NO: 28080 - RNA, 22 nt, Mycobacterium leprae
aucgccgaagcggaacgaugga

SEQ ID NO: 28081 - RNA, 22 nt, Mycobacterium leprae
aucgcuguauucuauaacgccg

SEQ ID NO: 28082 - RNA, 22 nt, Mycobacterium leprae
aucggcuggacaccuuuguucu

SEQ ID NO: 28083 - RNA, 22 nt, Mycobacterium leprae
aucgguugucggcgaucacugg

SEQ ID NO: 28084 - RNA, 22 nt, Mycobacterium leprae
aucgucaggucccccgacggca

SEQ ID NO: 28085 - RNA, 22 nt, Mycobacterium leprae
aucgugguuacaaugcacucgu

SEQ ID NO: 28086 - RNA, 22 nt, Mycobacterium leprae
aucugcugcuagcauugucguu

SEQ ID NO: 28087 - RNA, 22 nt, Mycobacterium leprae
aucuguccauuguugaucgggu

SEQ ID NO: 28088 - RNA, 22 nt, Mycobacterium leprae
aucuugccgcccaucugucgcg

SEQ ID NO: 28089 - RNA, 23 nt, Mycobacterium leprae
augaccuggcccaucgcccaagc

SEQ ID NO: 28090 - RNA, 22 nt, Mycobacterium leprae
augaccuuguuggaacuuucgg

SEQ ID NO: 28091 - RNA, 22 nt, Mycobacterium leprae
augccggugacccgcuuugcgg

SEQ ID NO: 28092 - RNA, 22 nt, Mycobacterium leprae
augccguagcuucaauacuaaa

SEQ ID NO: 28093 - RNA, 22 nt, Mycobacterium leprae
augcgucaacacaccggauaua

SEQ ID NO: 28094 - RNA, 22 nt, Mycobacterium leprae
augcugccauuagcugaugcag

SEQ ID NO: 28095 - RNA, 20 nt, Mycobacterium leprae
augcuucgaauagcucaucg

SEQ ID NO: 28096 - RNA, 22 nt, Mycobacterium leprae
augggaaaguacccgacgaucc

SEQ ID NO: 28097 - RNA, 22 nt, Mycobacterium leprae
augguaugugguguugagacau

SEQ ID NO: 28098 - RNA, 22 nt, Mycobacterium leprae
augguggugacucgcuagcccg

SEQ ID NO: 28099 - RNA, 22 nt, Mycobacterium leprae
auguccgacgcucaugaacagu

SEQ ID NO: 28100 - RNA, 22 nt, Mycobacterium leprae
auguccguuucuuaaugcagcc

SEQ ID NO: 28101 - RNA, 22 nt, Mycobacterium leprae
augugugaauuuaacauguuga

SEQ ID NO: 28102 - RNA, 22 nt, Mycobacterium leprae
auguugacugucgaggaagcca

SEQ ID NO: 28103 - RNA, 21 nt, Mycobacterium leprae
auguuggcgucgauuucgaug

SEQ ID NO: 28104 - RNA, 22 nt, Mycobacterium leprae
auuagcgggugggugucaacuu

SEQ ID NO: 28105 - RNA, 22 nt, Mycobacterium leprae
auucuguuguggacgggaguga

SEQ ID NO: 28106 - RNA, 22 nt, Mycobacterium leprae
auugcucgcgaacuuuuuccgu

SEQ ID NO: 28107 - RNA, 22 nt, Mycobacterium leprae
auugugauuggguccaccgggg

SEQ ID NO: 28108 - RNA, 22 nt, Mycobacterium leprae
caacgugcuugcgguggccaac

SEQ ID NO: 28109 - RNA, 22 nt, Mycobacterium leprae
caagaccgaggucaucgggcgg

SEQ ID NO: 28110 - RNA, 22 nt, Mycobacterium leprae
caagggugagugaugagcguga

SEQ ID NO: 28111 - RNA, 22 nt, Mycobacterium leprae
caaugauuucagucaccgccua

SEQ ID NO: 28112 - RNA, 19 nt, Mycobacterium leprae
caaugcugagacauaaguu

SEQ ID NO: 28113 - RNA, 22 nt, Mycobacterium leprae
caaugucagaauaggaugccau

SEQ ID NO: 28114 - RNA, 22 nt, Mycobacterium leprae
caaugucgauaccgcgcagugc

SEQ ID NO: 28115 - RNA, 22 nt, Mycobacterium leprae
cacaacggcgucgucgguguaa

SEQ ID NO: 28116 - RNA, 22 nt, Mycobacterium leprae
cacaguucgacuccacggccga

SEQ ID NO: 28117 - RNA, 22 nt, Mycobacterium leprae
caccaacagccgcaccuagaug

SEQ ID NO: 28118 - RNA, 22 nt, Mycobacterium leprae
caccacgugguagacacacgga

SEQ ID NO: 28119 - RNA, 22 nt, Mycobacterium leprae
caccacuguugaggaaggugau

SEQ ID NO: 28120 - RNA, 22 nt, Mycobacterium leprae
caccgcggucgcggcugcaauc

SEQ ID NO: 28121 - RNA, 22 nt, Mycobacterium leprae
cacgguuugauguggccguuaa

SEQ ID NO: 28122 - RNA, 22 nt, Mycobacterium leprae
cagauaacagucacgacaucac

SEQ ID NO: 28123 - RNA, 22 nt, Mycobacterium leprae
cagcaccuacgucgacgguauc

SEQ ID NO: 28124 - RNA, 22 nt, Mycobacterium leprae
cagcagcugaugcuuacgugcu

SEQ ID NO: 28125 - RNA, 22 nt, Mycobacterium leprae
cagcccggaugcuuaucaaaaa

SEQ ID NO: 28126 - RNA, 22 nt, Mycobacterium leprae
cagcgggaaugaugcccgccgc

SEQ ID NO: 28127 - RNA, 22 nt, Mycobacterium leprae
cagcgugguguucugcggcuuu

SEQ ID NO: 28128 - RNA, 22 nt, Mycobacterium leprae
cagcguuacugcaaguugacac

SEQ ID NO: 28129 - RNA, 22 nt, Mycobacterium leprae
cagcugaccgaggcggugcgcc

SEQ ID NO: 28130 - RNA, 22 nt, Mycobacterium leprae
caggaaacauagaagcgaacaa

SEQ ID NO: 28131 - RNA, 18 nt, Mycobacterium leprae
caggggcuucgaugcggu

SEQ ID NO: 28132 - RNA, 22 nt, Mycobacterium leprae
cagucgcuggcgugcuggauga

SEQ ID NO: 28133 - RNA, 22 nt, Mycobacterium leprae
cagugccgccgaucgguauugg

SEQ ID NO: 28134 - RNA, 22 nt, Mycobacterium leprae
cagugccggccgaaguguuacg

SEQ ID NO: 28135 - RNA, 22 nt, Mycobacterium leprae
cauccguguugaaggccgcuga

SEQ ID NO: 28136 - RNA, 22 nt, Mycobacterium leprae
cauccuggcgcauugacgugcc

SEQ ID NO: 28137 - RNA, 22 nt, Mycobacterium leprae
caucgaaauccacggcagcaug

SEQ ID NO: 28138 - RNA, 22 nt, Mycobacterium leprae
caucgauuuggugucgauggac

SEQ ID NO: 28139 - RNA, 22 nt, Mycobacterium leprae
caucggcgaguucauugaugac

SEQ ID NO: 28140 - RNA, 22 nt, Mycobacterium leprae
caucggucgcgagguguucgcg

SEQ ID NO: 28141 - RNA, 19 nt, Mycobacterium leprae
caugaugacguaccuaguc

SEQ ID NO: 28142 - RNA, 22 nt, Mycobacterium leprae
ccacaaacccgucaucgcgcau

SEQ ID NO: 28143 - RNA, 22 nt, Mycobacterium leprae
cguccgugaugagagcgauccg

SEQ ID NO: 28144 - RNA, 22 nt, Mycobacterium leprae
cgucgaugaugaugucgcuggg

SEQ ID NO: 28145 - RNA, 21 nt, Mycobacterium leprae
cgucgcaguauccauacccgc

SEQ ID NO: 28146 - RNA, 22 nt, Mycobacterium leprae
cgucgccaggcugucgcguuca

SEQ ID NO: 28147 - RNA, 22 nt, Mycobacterium leprae
cgucggaucggauaucggcguu

SEQ ID NO: 28148 - RNA, 22 nt, Mycobacterium leprae
cgucggcgguaggguaccagcc

SEQ ID NO: 28149 - RNA, 22 nt, Mycobacterium leprae
cgucgggcagaugcacaaccuc

SEQ ID NO: 28150 - RNA, 22 nt, Mycobacterium leprae
cgucggugagcucacgccgucg

SEQ ID NO: 28151 - RNA, 22 nt, Mycobacterium leprae
cgucucgucgacuacgauuuca

SEQ ID NO: 28152 - RNA, 21 nt, Mycobacterium leprae
cguggcacaacagcuggcguc

SEQ ID NO: 28153 - RNA, 22 nt, Mycobacterium leprae
cguggugaucccgagcaccgau

SEQ ID NO: 28154 - RNA, 22 nt, Mycobacterium leprae
cgugguggccgugaucgcgaca

SEQ ID NO: 28155 - RNA, 22 nt, Mycobacterium leprae
cguguugugcgguucgaccguu

SEQ ID NO: 28156 - RNA, 22 nt, Mycobacterium leprae
cguuaucggaacgcgguucggc

SEQ ID NO: 28157 - RNA, 22 nt, Mycobacterium leprae
cguuaugggguguaccgcaguu

SEQ ID NO: 28158 - RNA, 22 nt, Mycobacterium leprae
cguucgagguugccgaugcggu

SEQ ID NO: 28159 - RNA, 22 nt, Mycobacterium leprae
cuaguucggcgccgagcguguc

SEQ ID NO: 28160 - RNA, 22 nt, Mycobacterium leprae
cuccgccgucuuuggcuguguu

SEQ ID NO: 28161 - RNA, 22 nt, Mycobacterium leprae
cucgcggcugccucaucgaugc

SEQ ID NO: 28162 - RNA, 22 nt, Mycobacterium leprae
cucggcaugcucgccgaacuac

SEQ ID NO: 28163 - RNA, 20 nt, Mycobacterium leprae
cucggccucgacgcgcgccu

SEQ ID NO: 28164 - RNA, 22 nt, Mycobacterium leprae
cucggcuggccgucgguguagu

SEQ ID NO: 28165 - RNA, 22 nt, Mycobacterium leprae
cucguucgaugcgugcgugcaa

SEQ ID NO: 28166 - RNA, 22 nt, Mycobacterium leprae
cugaggcugugcugccgcgcga

SEQ ID NO: 28167 - RNA, 23 nt, Mycobacterium leprae
cugcccaacccugccuuugccga

SEQ ID NO: 28168 - RNA, 22 nt, Mycobacterium leprae
cugcggauuucuggaacuucgc

SEQ ID NO: 28169 - RNA, 22 nt, Mycobacterium leprae
cugcgguaucugguccaacgau

SEQ ID NO: 28170 - RNA, 23 nt, Mycobacterium leprae
cugcucaggaugacggacgacgg

SEQ ID NO: 28171 - RNA, 22 nt, Mycobacterium leprae
cugcugaguacaacgcagucgu

SEQ ID NO: 28172 - RNA, 22 nt, Mycobacterium leprae
cugcuuggucaucaccguguuc

SEQ ID NO: 28173 - RNA, 22 nt, Mycobacterium leprae
cuggcgauacuguucuugugau

SEQ ID NO: 28174 - RNA, 22 nt, Mycobacterium leprae
cuggcguggauucgguuccgug

SEQ ID NO: 28175 - RNA, 20 nt, Mycobacterium leprae
cugucgaugcguggaggcgc

SEQ ID NO: 28176 - RNA, 22 nt, Mycobacterium leprae
cugucgaugguguugccucauc

SEQ ID NO: 28177 - RNA, 22 nt, Mycobacterium leprae
cugucgauguggauuacgacau

SEQ ID NO: 28178 - RNA, 22 nt, Mycobacterium leprae
cuuagcgcugaccuguucggcg

SEQ ID NO: 28179 - RNA, 22 nt, Mycobacterium leprae
cuuccgcaaggggggccauguc

SEQ ID NO: 28180 - RNA, 22 nt, Mycobacterium leprae
cuucgacgaauugacuaccgag

SEQ ID NO: 28181 - RNA, 22 nt, Mycobacterium leprae
cuucggcgagcaguuagucgaa

SEQ ID NO: 28182 - RNA, 22 nt, Mycobacterium leprae
cuugccgguccaccgguaugug

SEQ ID NO: 28183 - RNA, 22 nt, Mycobacterium leprae
cuugcgaaccgugccgccgaaa

SEQ ID NO: 28184 - RNA, 22 nt, Mycobacterium leprae
cuuuugaagcugcuggcugagg

SEQ ID NO: 28185 - RNA, 19 nt, Mycobacterium leprae
gaaaagugugauuuauuga

SEQ ID NO: 28186 - RNA, 22 nt, Mycobacterium leprae
gaagcgcugauccucucccgaa

SEQ ID NO: 28187 - RNA, 21 nt, Mycobacterium leprae
gacacggcguugggugcuagc

SEQ ID NO: 28188 - RNA, 22 nt, Mycobacterium leprae
gaccaccacggucggcaaguug

SEQ ID NO: 28189 - RNA, 22 nt, Mycobacterium leprae
gaccacggugcuguuagucgga

SEQ ID NO: 28190 - RNA, 22 nt, Mycobacterium leprae
gaccaguugggaucgucggguu

SEQ ID NO: 28191 - RNA, 22 nt, Mycobacterium leprae
gacccgccacagcgacgaugcc

SEQ ID NO: 28192 - RNA, 22 nt, Mycobacterium leprae
gacgaucguucgcccgugcgcu

SEQ ID NO: 28193 - RNA, 22 nt, Mycobacterium leprae
gacgaugaucuccuucuuacgg

SEQ ID NO: 28194 - RNA, 22 nt, Mycobacterium leprae
gacggccgugccuguuugccgc

SEQ ID NO: 28195 - RNA, 22 nt, Mycobacterium leprae
gacugaauuguaucgcgaucuc

SEQ ID NO: 28196 - RNA, 22 nt, Mycobacterium leprae
gacuggccuggucguagcgucg

SEQ ID NO: 28197 - RNA, 22 nt, Mycobacterium leprae
gagcagcagcacggaugcgucu

SEQ ID NO: 28198 - RNA, 22 nt, Mycobacterium leprae
gaggccgacgugcgcggucugc

SEQ ID NO: 28199 - RNA, 22 nt, Mycobacterium leprae
gaggcgaucgucugccgguuca

SEQ ID NO: 28200 - RNA, 17 nt, Mycobacterium leprae
gaggcggugggccaggu

SEQ ID NO: 28201 - RNA, 22 nt, Mycobacterium leprae
gaguccucuacguggaacagug

SEQ ID NO: 28202 - RNA, 22 nt, Mycobacterium leprae
gagugguucgaguucgucggcg

SEQ ID NO: 28203 - RNA, 22 nt, Mycobacterium leprae
gaucaccaaccagucaccgccc

SEQ ID NO: 28204 - RNA, 18 nt, Mycobacterium leprae
gaucaccuugccuaggga

SEQ ID NO: 28205 - RNA, 22 nt, Mycobacterium leprae
gaucaguaccgaaagcgcgcag

SEQ ID NO: 28206 - RNA, 22 nt, Mycobacterium leprae
gaucaucgucagcgcacgauuc

SEQ ID NO: 28207 - RNA, 22 nt, Mycobacterium leprae
gaucggcgaucgcugaccaugu

SEQ ID NO: 28208 - RNA, 22 nt, Mycobacterium leprae
gaucugggauguugugcugcaa

SEQ ID NO: 28209 - RNA, 22 nt, Mycobacterium leprae
gaugcaucggcgaucguggcgu

SEQ ID NO: 28210 - RNA, 22 nt, Mycobacterium leprae
gaugcccgguacguaucuucga

SEQ ID NO: 28211 - RNA, 22 nt, Mycobacterium leprae
gaugcuguuagcgauccugucg

SEQ ID NO: 28212 - RNA, 22 nt, Mycobacterium leprae
gauguacgaaggucgaccgcag

SEQ ID NO: 28213 - RNA, 19 nt, Mycobacterium leprae
gaugugaucggugaucucc

SEQ ID NO: 28214 - RNA, 22 nt, Mycobacterium leprae
gauguucuccugauauuucugc

SEQ ID NO: 28215 - RNA, 19 nt, Mycobacterium leprae
gcaaaacguugaucucgac

SEQ ID NO: 28216 - RNA, 22 nt, Mycobacterium leprae
gcaacgugcacgcgcuggugca

SEQ ID NO: 28217 - RNA, 22 nt, Mycobacterium leprae
gcacagccgggccucuuguuca

SEQ ID NO: 28218 - RNA, 22 nt, Mycobacterium leprae
gcacugcaccauugacgauuag

SEQ ID NO: 28219 - RNA, 21 nt, Mycobacterium leprae
gcacuucgucgauuaccagca

SEQ ID NO: 28220 - RNA, 23 nt, Mycobacterium leprae
gcacuugacagcaugcuugacug

SEQ ID NO: 28221 - RNA, 22 nt, Mycobacterium leprae
gcacuuguuugccuagcugggu

SEQ ID NO: 28222 - RNA, 22 nt, Mycobacterium leprae
gcagaagcagccgguaugucag

SEQ ID NO: 28223 - RNA, 22 nt, Mycobacterium leprae
gcagauugcccacuuuggcacg

SEQ ID NO: 28224 - RNA, 22 nt, Mycobacterium leprae
gcagcaggccgccucgacuauc

SEQ ID NO: 28225 - RNA, 22 nt, Mycobacterium leprae
gcagcgcgcugggguuuucgcu

SEQ ID NO: 28226 - RNA, 22 nt, Mycobacterium leprae
gcagcuuggcaucgguuuucau

SEQ ID NO: 28227 - RNA, 22 nt, Mycobacterium leprae
gcaguccguccagcgugacgau

SEQ ID NO: 28228 - RNA, 22 nt, Mycobacterium leprae
gcaguuucggauucgccgggac

SEQ ID NO: 28229 - RNA, 22 nt, Mycobacterium leprae
gcaucccaccauaaggugcaag

SEQ ID NO: 28230 - RNA, 22 nt, Mycobacterium leprae
gcaucgacuagauacucgggug

SEQ ID NO: 28231 - RNA, 22 nt, Mycobacterium leprae
gcaugcagcgacauugaccggc

SEQ ID NO: 28232 - RNA, 22 nt, Mycobacterium leprae
gcaugcagcuauuggcgaccau

SEQ ID NO: 28233 - RNA, 22 nt, Mycobacterium leprae
gcggugaccacucuuccgccca

SEQ ID NO: 28234 - RNA, 22 nt, Mycobacterium leprae
gcggugacgcuaaaucgcacug

SEQ ID NO: 28235 - RNA, 22 nt, Mycobacterium leprae
gcguaggugaccaccgcgaucc

SEQ ID NO: 28236 - RNA, 22 nt, Mycobacterium leprae
gcgucgccgacacugcugaugg

SEQ ID NO: 28237 - RNA, 22 nt, Mycobacterium leprae
gcgucgcuguuugccgaguaca

SEQ ID NO: 28238 - RNA, 22 nt, Mycobacterium leprae
gcgucuuuccccugcuugggcg

SEQ ID NO: 28239 - RNA, 22 nt, Mycobacterium leprae
gcgugaguuccaccucgguggu

SEQ ID NO: 28240 - RNA, 22 nt, Mycobacterium leprae
gcguggcggcacucugcgccau

SEQ ID NO: 28241 - RNA, 22 nt, Mycobacterium leprae
gcguuggcuuccugaucgcggc

SEQ ID NO: 28242 - RNA, 22 nt, Mycobacterium leprae
gcuccaacaggugaagcgccgu

SEQ ID NO: 28243 - RNA, 22 nt, Mycobacterium leprae
gcucgcacaugucgcgucccuc

SEQ ID NO: 28244 - RNA, 22 nt, Mycobacterium leprae
gcucggaugggccugcagcgac

SEQ ID NO: 28245 - RNA, 22 nt, Mycobacterium leprae
gcucgguggagagguaucgaug

SEQ ID NO: 28246 - RNA, 22 nt, Mycobacterium leprae
gcucgguguugcggacuucauc

SEQ ID NO: 28247 - RNA, 22 nt, Mycobacterium leprae
gcugacgguaauacuggcccgc

SEQ ID NO: 28248 - RNA, 22 nt, Mycobacterium leprae
gcugcaacgcggucagcaucgc

SEQ ID NO: 28249 - RNA, 22 nt, Mycobacterium leprae
gcugcugggcgcgauaccacga

SEQ ID NO: 28250 - RNA, 22 nt, Mycobacterium leprae
gcugcugucggccaacauugac

SEQ ID NO: 28251 - RNA, 20 nt, Mycobacterium leprae
gcuggacauaaaggcucucc

SEQ ID NO: 28252 - RNA, 19 nt, Mycobacterium leprae
gcuggcccaggcaguagcg

SEQ ID NO: 28253 - RNA, 22 nt, Mycobacterium leprae
gcugggcggauacuagucgggc

SEQ ID NO: 28254 - RNA, 22 nt, Mycobacterium leprae
gcuggucggcuuggugguuugu

SEQ ID NO: 28255 - RNA, 22 nt, Mycobacterium leprae
gcugucagaauuucgcuacgag

SEQ ID NO: 28256 - RNA, 23 nt, Mycobacterium leprae
gcugucagcgguuacuucgacuc

SEQ ID NO: 28257 - RNA, 22 nt, Mycobacterium leprae
gcuguguuuaaaggagccgcgg

SEQ ID NO: 28258 - RNA, 19 nt, Mycobacterium leprae
gcuucgccgaggcguuccg

SEQ ID NO: 28259 - RNA, 22 nt, Mycobacterium leprae
ggaacaacuauugucgauuggg

SEQ ID NO: 28260 - RNA, 22 nt, Mycobacterium leprae
ggacaaugucugggaucucacg

SEQ ID NO: 28261 - RNA, 23 nt, Mycobacterium leprae
ggaccgauauaccguuaaucaga

SEQ ID NO: 28262 - RNA, 22 nt, Mycobacterium leprae
ggacgugccgacggcgaccagu

SEQ ID NO: 28263 - RNA, 22 nt, Mycobacterium leprae
ggacugcgcacccgucgaccga

SEQ ID NO: 28264 - RNA, 22 nt, Mycobacterium leprae
ggagacuucgugacuacugaug

SEQ ID NO: 28265 - RNA, 22 nt, Mycobacterium leprae
ggaggaucuuaugucagcagcu

SEQ ID NO: 28266 - RNA, 22 nt, Mycobacterium leprae
ggaucgauuuuugaugggcgca

SEQ ID NO: 28267 - RNA, 22 nt, Mycobacterium leprae
ggauucggcgagaaugcugacc

SEQ ID NO: 28268 - RNA, 22 nt, Mycobacterium leprae
ggcagcauuuucgucgaucucc

SEQ ID NO: 28269 - RNA, 18 nt, Mycobacterium leprae
ggcagccggugcacuuug

SEQ ID NO: 28270 - RNA, 22 nt, Mycobacterium leprae
ggcaucgcgauugcugggcggc

SEQ ID NO: 28271 - RNA, 22 nt, Mycobacterium leprae
ggcauugaggccgcuuacggug

SEQ ID NO: 28272 - RNA, 22 nt, Mycobacterium leprae
ggccaucaucaccccggcguug

SEQ ID NO: 28273 - RNA, 22 nt, Mycobacterium leprae
ggccggcgugcgacagcugaug

SEQ ID NO: 28274 - RNA, 22 nt, Mycobacterium leprae
ggccgggcgcagucggaggcuc

SEQ ID NO: 28275 - RNA, 22 nt, Mycobacterium leprae
ggcgacggugaaauggacgagc

SEQ ID NO: 28276 - RNA, 22 nt, Mycobacterium leprae
ggcgcgguguuacgguuggucg

SEQ ID NO: 28277 - RNA, 22 nt, Mycobacterium leprae
ggcggcggugaugccggguuug

SEQ ID NO: 28278 - RNA, 22 nt, Mycobacterium leprae
ggcgugugguuaaaggggucaa

SEQ ID NO: 28279 - RNA, 22 nt, Mycobacterium leprae
ggcguugagcacguugugcggg

SEQ ID NO: 28280 - RNA, 22 nt, Mycobacterium leprae
ggcugaagagcauccaagaccu

SEQ ID NO: 28281 - RNA, 23 nt, Mycobacterium leprae
ggcugcgugcugauagcgacgcc

SEQ ID NO: 28282 - RNA, 22 nt, Mycobacterium leprae
ucagcgcaaagcuagccguccu

SEQ ID NO: 28283 - RNA, 22 nt, Mycobacterium leprae
ucagcgguggucggcgagcagc

SEQ ID NO: 28284 - RNA, 22 nt, Mycobacterium leprae
ucaucaugaccaucagcguguu

SEQ ID NO: 28285 - RNA, 23 nt, Mycobacterium leprae
uccacgagucaacggcguggucg

SEQ ID NO: 28286 - RNA, 22 nt, Mycobacterium leprae
ucccagggggugcucgcugucg

SEQ ID NO: 28287 - RNA, 22 nt, Mycobacterium leprae
uccggccgacaguggcaagauc

SEQ ID NO: 28288 - RNA, 22 nt, Mycobacterium leprae
uccggcgagaaacgcucggugc

SEQ ID NO: 28289 - RNA, 22 nt, Mycobacterium leprae
uccgggucguauccgggucagu

SEQ ID NO: 28290 - RNA, 22 nt, Mycobacterium leprae
uccggucacuucaucaucccgg

SEQ ID NO: 28291 - RNA, 22 nt, Mycobacterium leprae
uccuggugcucaggcucggccu

SEQ ID NO: 28292 - RNA, 22 nt, Mycobacterium leprae
ucgaaaucgacgccaacaugua

SEQ ID NO: 28293 - RNA, 22 nt, Mycobacterium leprae
ucgaacuugcugcacaccgugu

SEQ ID NO: 28294 - RNA, 22 nt, Mycobacterium leprae
ucgacccaagcugcgggcugcc

SEQ ID NO: 28295 - RNA, 22 nt, Mycobacterium leprae
ucgacgucgaucucgauauugu

SEQ ID NO: 28296 - RNA, 22 nt, Mycobacterium leprae
ucgaggcgugugcucagcguuc

SEQ ID NO: 28297 - RNA, 22 nt, Mycobacterium leprae
ucgaucgcuggcgaugucguug

SEQ ID NO: 28298 - RNA, 22 nt, Mycobacterium leprae
ucgaugaacaacguuacugcgg

SEQ ID NO: 28299 - RNA, 22 nt, Mycobacterium leprae
ucgcaguuacuuuguggccguu

SEQ ID NO: 28300 - RNA, 22 nt, Mycobacterium leprae
ucgcccggugucaaucgcgguc

SEQ ID NO: 28301 - RNA, 22 nt, Mycobacterium leprae
ucgccgacacugcugauggauc

SEQ ID NO: 28302 - RNA, 22 nt, Mycobacterium leprae
ucgccgcaaaucuagucgucca

SEQ ID NO: 28303 - RNA, 22 nt, Mycobacterium leprae
ucgccucagucaaacccaacgg

SEQ ID NO: 28304 - RNA, 22 nt, Mycobacterium leprae
ucgccucgaguuuggacaaggu

SEQ ID NO: 28305 - RNA, 22 nt, Mycobacterium leprae
ucgcguugagccucucaauggg

SEQ ID NO: 28306 - RNA, 22 nt, Mycobacterium leprae
ucgcuaccuauccgcagaaaaa

SEQ ID NO: 28307 - RNA, 22 nt, Mycobacterium leprae
ucggagaugaucaauaugcccg

SEQ ID NO: 28308 - RNA, 22 nt, Mycobacterium leprae
ucggagucguuaguccagucga

SEQ ID NO: 28309 - RNA, 22 nt, Mycobacterium leprae
ucggaucgauauguacugcgcg

SEQ ID NO: 28310 - RNA, 22 nt, Mycobacterium leprae
ucggcaccggccaggucauggu

SEQ ID NO: 28311 - RNA, 22 nt, Mycobacterium leprae
ucggcaguguguucuuuguuaa

SEQ ID NO: 28312 - RNA, 20 nt, Mycobacterium leprae
ucggcgacguagugauuuuc

SEQ ID NO: 28313 - RNA, 22 nt, Mycobacterium leprae
ucggcgucauccgccgaugcca

SEQ ID NO: 28314 - RNA, 20 nt, Mycobacterium leprae
ucggcugugacuagccggcg

SEQ ID NO: 28315 - RNA, 22 nt, Mycobacterium leprae
ucggcuugaccauagcggccgg

SEQ ID NO: 28316 - RNA, 22 nt, Mycobacterium leprae
ucgggcaguggcgagucguaga

SEQ ID NO: 28317 - RNA, 22 nt, Mycobacterium leprae
ucgggcaucaccucggcgcgcc

SEQ ID NO: 28318 - RNA, 19 nt, Mycobacterium leprae
ucgggcggcgacgauucca

SEQ ID NO: 28319 - RNA, 22 nt, Mycobacterium leprae
ucgggcugugcgugaccggacg

SEQ ID NO: 28320 - RNA, 22 nt, Mycobacterium leprae
ucgggguugacgcugguaucgc

SEQ ID NO: 28321 - RNA, 22 nt, Mycobacterium leprae
ucggucgacgggugcgcagucc

SEQ ID NO: 28322 - RNA, 22 nt, Mycobacterium leprae
ucgguugcucgaaggugccuga

SEQ ID NO: 28323 - RNA, 22 nt, Mycobacterium leprae
ucgucgccuacgcuggguuauc

SEQ ID NO: 28324 - RNA, 22 nt, Mycobacterium leprae
ucgucuucgguuaacgcguccu

SEQ ID NO: 28325 - RNA, 22 nt, Mycobacterium leprae
ucgugugcuugcaggcagcggc

SEQ ID NO: 28326 - RNA, 22 nt, Mycobacterium leprae
ucguuuucugugcacaccucau

SEQ ID NO: 28327 - RNA, 20 nt, Mycobacterium leprae
ucuauuaagauuaacguggc

SEQ ID NO: 28328 - RNA, 20 nt, Mycobacterium leprae
ucucaaacugcucaacacgu

SEQ ID NO: 28329 - RNA, 22 nt, Mycobacterium leprae
ucucgucaguucgacggcagcu

SEQ ID NO: 28330 - RNA, 22 nt, Mycobacterium leprae
ucugccaaguuguccaggcugc

SEQ ID NO: 28331 - RNA, 22 nt, Mycobacterium leprae
ucuuuugacuugucauguucau

SEQ ID NO: 28332 - RNA, 22 nt, Mycobacterium leprae
ugaacgcucggccauagacgug

SEQ ID NO: 28333 - RNA, 22 nt, Mycobacterium leprae
ugacagaacgggggcaccagau

SEQ ID NO: 28334 - RNA, 22 nt, Mycobacterium leprae
ugaccgauccgggcgccgcguc

SEQ ID NO: 28335 - RNA, 20 nt, Mycobacterium leprae
ugaccgcaaagacuuuccga

SEQ ID NO: 28336 - RNA, 22 nt, Mycobacterium leprae
ugaccggugagucgggucgccg

SEQ ID NO: 28337 - RNA, 22 nt, Mycobacterium leprae
ugaccuguucagcggugcgaau

SEQ ID NO: 28338 - RNA, 22 nt, Mycobacterium leprae
ugacgaagucaccguggagacg

SEQ ID NO: 28339 - RNA, 22 nt, Mycobacterium leprae
ugacgcgaauggcuaggcugcu

SEQ ID NO: 28340 - RNA, 22 nt, Mycobacterium leprae
ugacgcugaucuugauguugcc

SEQ ID NO: 28341 - RNA, 22 nt, Mycobacterium leprae
ugagcgcaugcacuguggcgcc

SEQ ID NO: 28342 - RNA, 22 nt, Mycobacterium leprae
ugaguccguggauugcggccag

SEQ ID NO: 28343 - RNA, 22 nt, Mycobacterium leprae
ugaugucgggucggugaaguau

SEQ ID NO: 28344 - RNA, 22 nt, Mycobacterium leprae
ugcagcuggccaguucgaaagu

SEQ ID NO: 28345 - RNA, 23 nt, Mycobacterium leprae
ugcaggaugaauucgaagcacuc

SEQ ID NO: 28346 - RNA, 22 nt, Mycobacterium leprae
ugcaguuggcggucugacgucu

SEQ ID NO: 28347 - RNA, 22 nt, Mycobacterium leprae
ugccaacgguauuucggcgcga

SEQ ID NO: 28348 - RNA, 22 nt, Mycobacterium leprae
ugccacgaacccguggucgucg

SEQ ID NO: 28349 - RNA, 23 nt, Mycobacterium leprae
ugcccgacaucgaucugcaagcu

SEQ ID NO: 28350 - RNA, 22 nt, Mycobacterium leprae
ugcccgccuauccuucgccgau

SEQ ID NO: 28351 - RNA, 22 nt, Mycobacterium leprae
ugcccgcgacgacuucgccggg

SEQ ID NO: 28352 - RNA, 22 nt, Mycobacterium leprae
ugccgcuauccugugccgcaug

SEQ ID NO: 28353 - RNA, 22 nt, Mycobacterium leprae
ugccucugccgucaguuugcug

SEQ ID NO: 28354 - RNA, 22 nt, Mycobacterium leprae
ugcgagaaauccgacagcgaua

SEQ ID NO: 28355 - RNA, 22 nt, Mycobacterium leprae
ugcgauuuggcuuuggccggug

SEQ ID NO: 28356 - RNA, 22 nt, Mycobacterium leprae
ugcgccgcuuagcugguggguu

SEQ ID NO: 28357 - RNA, 22 nt, Mycobacterium leprae
ugcggccaggcgcuucacguuc

SEQ ID NO: 28358 - RNA, 18 nt, Mycobacterium leprae
ugcggcgaaggugguacc

SEQ ID NO: 28359 - RNA, 22 nt, Mycobacterium leprae
ugcgguccaagaagccaguguu

SEQ ID NO: 28360 - RNA, 22 nt, Mycobacterium leprae
ugcggugcuucguugaaggagc

SEQ ID NO: 28361 - RNA, 22 nt, Mycobacterium leprae
ugcgguggggaccaccggagac

SEQ ID NO: 28362 - RNA, 20 nt, Mycobacterium leprae
ugcgucgacggguguugccg

SEQ ID NO: 28363 - RNA, 22 nt, Mycobacterium leprae
ugcucgauaucguguucaguuc

SEQ ID NO: 28364 - RNA, 22 nt, Mycobacterium leprae
ugcucgaugccgcgcggaaaga

SEQ ID NO: 28365 - RNA, 22 nt, Mycobacterium leprae
ugcucgccggggugucggcuca

SEQ ID NO: 28366 - RNA, 22 nt, Mycobacterium leprae
ugcugcaucuugguggcuguag

SEQ ID NO: 28367 - RNA, 22 nt, Mycobacterium leprae
ugcugcuuggcgccaucggaca

SEQ ID NO: 28368 - RNA, 22 nt, Mycobacterium leprae
ugcugggcaagacccgaugagc

SEQ ID NO: 28369 - RNA, 22 nt, Mycobacterium leprae
ugcugggcagccugugcggugu

SEQ ID NO: 28370 - RNA, 22 nt, Mycobacterium leprae
ugcuggugccccagucgccaga

SEQ ID NO: 28371 - RNA, 22 nt, Mycobacterium leprae
ugcuucgucaaggcgugaggca

SEQ ID NO: 28372 - RNA, 22 nt, Mycobacterium tuberculosis CDC1551
agcuggucgacacuggccgaaa

SEQ ID NO: 28373 - RNA, 22 nt, Mycobacterium tuberculosis CDC1551
agcuguccgacaaaguauccga

SEQ ID NO: 28374 - RNA, 22 nt, Mycobacterium tuberculosis CDC1551
aggaucacacuggccugcucaa

SEQ ID NO: 28375 - RNA, 22 nt, Mycobacterium tuberculosis CDC1551
agggcgagcguuuggccgggca

SEQ ID NO: 28376 - RNA, 22 nt, Mycobacterium tuberculosis CDC1551
agguagacgugucccgcauggg

SEQ ID NO: 28377 - RNA, 22 nt, Mycobacterium tuberculosis CDC1551
aucucuguagguggugggugcg

SEQ ID NO: 28378 - RNA, 22 nt, Mycobacterium tuberculosis CDC1551
aucugcagguuccuggguugac

SEQ ID NO: 28379 - RNA, 22 nt, Mycobacterium tuberculosis CDC1551
aucuuguaggucaccgugaacg

SEQ ID NO: 28380 - RNA, 23 nt, Mycobacterium tuberculosis CDC1551
augacgggauucugcuucgcaaa

SEQ ID NO: 28381 - RNA, 22 nt, Mycobacterium tuberculosis CDC1551
augaggcgauuuugcgucugcu

SEQ ID NO: 28382 - RNA, 22 nt, Mycobacterium tuberculosis CDC1551
auugcgagccacgcagguugaa

SEQ ID NO: 28383 - RNA, 21 nt, Mycobacterium tuberculosis CDC1551
auuugcaacgcaacggcgugc

SEQ ID NO: 28384 - RNA, 22 nt, Mycobacterium tuberculosis CDC1551
caacugcccgagucgcagcgcc

SEQ ID NO: 28385 - RNA, 22 nt, Mycobacterium tuberculosis CDC1551
caauguuucgacgggcaccaaa

SEQ ID NO: 28386 - RNA, 22 nt, Mycobacterium tuberculosis CDC1551
cacaccgcgaugacuccggcga

SEQ ID NO: 28387 - RNA, 22 nt, Mycobacterium tuberculosis CDC1551
cagcaaaagccauucauuucua

SEQ ID NO: 28388 - RNA, 22 nt, Mycobacterium tuberculosis CDC1551
cagcguugucucggcgaacacc

SEQ ID NO: 28389 - RNA, 22 nt, Mycobacterium tuberculosis CDC1551
caggacgguuagugcugauggg

SEQ ID NO: 28390 - RNA, 22 nt, Mycobacterium tuberculosis CDC1551
caggaggugcugcgggaggcga

SEQ ID NO: 28391 - RNA, 22 nt, Mycobacterium tuberculosis CDC1551
caggggcucgauccggccgggc

SEQ ID NO: 28392 - RNA, 23 nt, Mycobacterium tuberculosis CDC1551
cauccugcuggugcggaccggca

SEQ ID NO: 28393 - RNA, 22 nt, Mycobacterium tuberculosis CDC1551
ccaagcucuggauggccugccg

SEQ ID NO: 28394 - RNA, 22 nt, Mycobacterium tuberculosis CDC1551
ccaggcucagcgggguaacauc

SEQ ID NO: 28395 - RNA, 22 nt, Mycobacterium tuberculosis CDC1551
ccaugggccggguucuugacca

SEQ ID NO: 28396 - RNA, 22 nt, Mycobacterium tuberculosis CDC1551
cccagcaccugccaggacgggc

SEQ ID NO: 28397 - RNA, 22 nt, Mycobacterium tuberculosis CDC1551
cccagccaggguaaggccuuug

SEQ ID NO: 28398 - RNA, 22 nt, Mycobacterium tuberculosis CDC1551
cccuggugguccgaucguucau

SEQ ID NO: 28399 - RNA, 22 nt, Mycobacterium tuberculosis CDC1551
ccgcccaggcucccgcucgacg

SEQ ID NO: 28400 - RNA, 22 nt, Mycobacterium tuberculosis CDC1551
ccgcccggcugcgcgagcuggg

SEQ ID NO: 28401 - RNA, 22 nt, Mycobacterium tuberculosis CDC1551
cgggcagcgucgggauaaucgg

SEQ ID NO: 28402 - RNA, 22 nt, Mycobacterium tuberculosis CDC1551
cgggucuauggguggaugcucg

SEQ ID NO: 28403 - RNA, 22 nt, Mycobacterium tuberculosis CDC1551
cguggaauuucuucgccauggg

SEQ ID NO: 28404 - RNA, 22 nt, Mycobacterium tuberculosis CDC1551
cuggcuugccuccugccgcgac

SEQ ID NO: 28405 - RNA, 22 nt, Mycobacterium tuberculosis CDC1551
cuggguucgacccaguccaagc

SEQ ID NO: 28406 - RNA, 22 nt, Mycobacterium tuberculosis CDC1551
gaagcugcugggccaguucgug

SEQ ID NO: 28407 - RNA, 22 nt, Mycobacterium tuberculosis CDC1551
gagcuggguccaccggcguuug

SEQ ID NO: 28408 - RNA, 22 nt, Mycobacterium tuberculosis CDC1551
gaggccagcucggccagcugga

SEQ ID NO: 28409 - RNA, 23 nt, Mycobacterium tuberculosis CDC1551
gaggcgcuggcagcggcccgguu

SEQ ID NO: 28410 - RNA, 22 nt, Mycobacterium tuberculosis CDC1551
gaggguagacggggcgagcaug

SEQ ID NO: 28411 - RNA, 22 nt, Mycobacterium tuberculosis CDC1551
gagguguccgacgaaccugguu

SEQ ID NO: 28412 - RNA, 22 nt, Mycobacterium tuberculosis CDC1551
gagguuuggcggggcgugaccu

SEQ ID NO: 28413 - RNA, 22 nt, Mycobacterium tuberculosis CDC1551
gcagagccgaucguccuguugc

SEQ ID NO: 28414 - RNA, 22 nt, Mycobacterium tuberculosis CDC1551
gcagaugauccucggcggugau

SEQ ID NO: 28415 - RNA, 22 nt, Mycobacterium tuberculosis CDC1551
gcaggcagugucaugccgccga

SEQ ID NO: 28416 - RNA, 22 nt, Mycobacterium tuberculosis CDC1551
gcccgaggaggacaugaggcgc

SEQ ID NO: 28417 - RNA, 18 nt, Mycobacterium tuberculosis CDC1551
gcccuggacagguucacc

SEQ ID NO: 28418 - RNA, 22 nt, Mycobacterium tuberculosis CDC1551
gccgagggugaaucucacgacg

SEQ ID NO: 28419 - RNA, 22 nt, Mycobacterium tuberculosis CDC1551
gccgcaccgacuaccaccgacu

SEQ ID NO: 28420 - RNA, 22 nt, Mycobacterium tuberculosis CDC1551
gccuggacuccgcuuuuggcac

SEQ ID NO: 28421 - RNA, 21 nt, Mycobacterium tuberculosis CDC1551
gcgcagcaucucagccagugc

SEQ ID NO: 28422 - RNA, 22 nt, Mycobacterium tuberculosis CDC1551
gcucaugucgccguagaccggg

SEQ ID NO: 28423 - RNA, 22 nt, Mycobacterium tuberculosis CDC1551
gcugccccgcgagcuggugcug

SEQ ID NO: 28424 - RNA, 22 nt, Mycobacterium tuberculosis CDC1551
ggaguucaaugccacggcgucg

SEQ ID NO: 28425 - RNA, 22 nt, Mycobacterium tuberculosis CDC1551
ggcaacuccgggguggccagca

SEQ ID NO: 28426 - RNA, 22 nt, Mycobacterium tuberculosis CDC1551
ggcccggcaccggucaucguca

SEQ ID NO: 28427 - RNA, 22 nt, Mycobacterium tuberculosis CDC1551
ggccgaaacaccgcgcgaaggg

SEQ ID NO: 28428 - RNA, 22 nt, Mycobacterium tuberculosis CDC1551
ggcgagagggagggccaugugg

SEQ ID NO: 28429 - RNA, 22 nt, Mycobacterium tuberculosis CDC1551
gggcggcauccaugucgagauu

SEQ ID NO: 28430 - RNA, 21 nt, Mycobacterium tuberculosis CDC1551
gggcugguuccaacgacagug

SEQ ID NO: 28431 - RNA, 22 nt, Mycobacterium tuberculosis CDC1551
ggguggugaaguuggcggccgg

SEQ ID NO: 28432 - RNA, 22 nt, Mycobacterium tuberculosis CDC1551
gggugguggucgccaacgccga

SEQ ID NO: 28433 - RNA, 22 nt, Mycobacterium tuberculosis CDC1551
gguccgaaggcuucggcaagcc

SEQ ID NO: 28434 - RNA, 22 nt, Mycobacterium tuberculosis CDC1551
ggugaugguggaggcagccgac

SEQ ID NO: 28435 - RNA, 22 nt, Mycobacterium tuberculosis CDC1551
gguggagggacucgagaauguc

SEQ ID NO: 28436 - RNA, 22 nt, Mycobacterium tuberculosis CDC1551
gguggcgcacaucgccgugcac

SEQ ID NO: 28437 - RNA, 19 nt, Mycobacterium tuberculosis CDC1551
gguggcggucgcugcgcug

SEQ ID NO: 28438 - RNA, 22 nt, Mycobacterium tuberculosis CDC1551
ggugguggccaccgcagugggu

SEQ ID NO: 28439 - RNA, 22 nt, Mycobacterium tuberculosis CDC1551
gucauugcgucauuuccuucga

SEQ ID NO: 28440 - RNA, 22 nt, Mycobacterium tuberculosis CDC1551
guggaggcagggaugaagcucg

SEQ ID NO: 28441 - RNA, 22 nt, Mycobacterium tuberculosis CDC1551
gugggcagaugggugauacgca

SEQ ID NO: 28442 - RNA, 22 nt, Mycobacterium tuberculosis CDC1551
gugggugaaagugaaaggccgg

SEQ ID NO: 28443 - RNA, 22 nt, Mycobacterium tuberculosis CDC1551
guggugggaaccgcuccagggc

SEQ ID NO: 28444 - RNA, 22 nt, Mycobacterium tuberculosis CDC1551
gugguggugaguuugagaucgg

SEQ ID NO: 28445 - RNA, 22 nt, Mycobacterium tuberculosis CDC1551
guuacaggucaccacguagcgg

SEQ ID NO: 28446 - RNA, 22 nt, Mycobacterium tuberculosis CDC1551
guuucgggcgauuuugcgucug

SEQ ID NO: 28447 - RNA, 22 nt, Mycobacterium tuberculosis CDC1551
uaagugaaugccgugccguccg

SEQ ID NO: 28448 - RNA, 22 nt, Mycobacterium tuberculosis CDC1551
uauguucaauaaaucauuaugu

SEQ ID NO: 28449 - RNA, 22 nt, Mycobacterium tuberculosis CDC1551
gauguagguucgggcucaugga

SEQ ID NO: 28450 - RNA, 21 nt, Mycobacterium tuberculosis CDC1551
gcacacuggaagccagcacgc

SEQ ID NO: 28451 - RNA, 22 nt, Mycobacterium tuberculosis CDC1551
gcaccccagagcacugauacgc

SEQ ID NO: 28452 - RNA, 22 nt, Mycobacterium tuberculosis CDC1551
gcacggguucguugcugugcau

SEQ ID NO: 28453 - RNA, 22 nt, Mycobacterium tuberculosis CDC1551
gcagacucuuggucaugggcug

SEQ ID NO: 28454 - RNA, 22 nt, Mycobacterium tuberculosis CDC1551
gcagcagguucaccacguaugc

SEQ ID NO: 28455 - RNA, 22 nt, Mycobacterium tuberculosis CDC1551
gccaggcuggugucggcggugg

SEQ ID NO: 28456 - RNA, 22 nt, Mycobacterium tuberculosis CDC1551
gccagguugacguugguuucgg

SEQ ID NO: 28457 - RNA, 21 nt, Mycobacterium tuberculosis CDC1551
gccauauaccagaucgcuggg

SEQ ID NO: 28458 - RNA, 22 nt, Mycobacterium tuberculosis CDC1551
gcccaaggaaugcccccagguc

SEQ ID NO: 28459 - RNA, 22 nt, Mycobacterium tuberculosis CDC1551
gccccggugcguuugugugcuu

SEQ ID NO: 28460 - RNA, 22 nt, Mycobacterium tuberculosis CDC1551
gccgaacgugaagccagggcga

SEQ ID NO: 28461 - RNA, 20 nt, Mycobacterium tuberculosis CDC1551
gccugcagaacguugaucuc

SEQ ID NO: 28462 - RNA, 22 nt, Mycobacterium tuberculosis CDC1551
gcgaaacacgggaucgggcgag

SEQ ID NO: 28463 - RNA, 21 nt, Mycobacterium tuberculosis CDC1551
gcgagcucgucauggucuuuc

SEQ ID NO: 28464 - RNA, 22 nt, Mycobacterium tuberculosis CDC1551
gcgcagcagcgacaggguggcg

SEQ ID NO: 28465 - RNA, 22 nt, Mycobacterium tuberculosis CDC1551
gcggccaacgaggcagcggcgg

SEQ ID NO: 28466 - RNA, 22 nt, Mycobacterium tuberculosis CDC1551
gcgucgucagauucacagucag

SEQ ID NO: 28467 - RNA, 22 nt, Mycobacterium tuberculosis CDC1551
gcguggucggaugcaggccagc

SEQ ID NO: 28468 - RNA, 22 nt, Mycobacterium tuberculosis CDC1551
gcugagacaugacgugccucac

SEQ ID NO: 28469 - RNA, 22 nt, Mycobacterium tuberculosis CDC1551
gcuguccuguggcgcccgcagc

SEQ ID NO: 28470 - RNA, 22 nt, Mycobacterium tuberculosis CDC1551
gcuuuuaugacugcucggcggg

SEQ ID NO: 28471 - RNA, 22 nt, Mycobacterium tuberculosis CDC1551
ggaggugcccacaagguagagg

SEQ ID NO: 28472 - RNA, 19 nt, Mycobacterium tuberculosis CDC1551
ggagugcccggugccggcg

SEQ ID NO: 28473 - RNA, 22 nt, Mycobacterium tuberculosis CDC1551
ggccgcugucggucacguagac

SEQ ID NO: 28474 - RNA, 22 nt, Mycobacterium tuberculosis CDC1551
ggcgagcagacacagagucgca

SEQ ID NO: 28475 - RNA, 22 nt, Mycobacterium tuberculosis CDC1551
ggcgagcuugcggugcaguaug

SEQ ID NO: 28476 - RNA, 22 nt, Mycobacterium tuberculosis CDC1551
ggcucacgauguagucgauccg

SEQ ID NO: 28477 - RNA, 22 nt, Mycobacterium tuberculosis CDC1551
ggcucaggucgauacccgaggg

SEQ ID NO: 28478 - RNA, 22 nt, Mycobacterium tuberculosis CDC1551
ggcuccagccgcgucagcagcg

SEQ ID NO: 28479 - RNA, 22 nt, Mycobacterium tuberculosis CDC1551
gggaguacgcgggccaggugcg

SEQ ID NO: 28480 - RNA, 22 nt, Mycobacterium tuberculosis CDC1551
gggcgagcagacgcagaaucgc

SEQ ID NO: 28481 - RNA, 22 nt, Mycobacterium tuberculosis CDC1551
ggucagcacgcaugugcggugg

SEQ ID NO: 28482 - RNA, 22 nt, Mycobacterium tuberculosis CDC1551
ggugcuuuugcgucugcucggc

SEQ ID NO: 28483 - RNA, 22 nt, Mycobacterium tuberculosis CDC1551
gguggcagcggguccggcgacu

SEQ ID NO: 28484 - RNA, 22 nt, Mycobacterium tuberculosis CDC1551
gguggugccgguacgccaaugc

SEQ ID NO: 28485 - RNA, 22 nt, Mycobacterium tuberculosis CDC1551
gucgcuggugggaucgcagcgc

SEQ ID NO: 28486 - RNA, 22 nt, Mycobacterium tuberculosis CDC1551
gugcagguucguacuggcaugc

SEQ ID NO: 28487 - RNA, 22 nt, Mycobacterium tuberculosis CDC1551
guggcagccagcgccuccggga

SEQ ID NO: 28488 - RNA, 22 nt, Mycobacterium tuberculosis CDC1551
gugguggcgcaauucgaccagg

SEQ ID NO: 28489 - RNA, 22 nt, Mycobacterium tuberculosis CDC1551
gugguggucuccagcgcgcucg

SEQ ID NO: 28490 - RNA, 22 nt, Mycobacterium tuberculosis CDC1551
gugguggugagcaccaacggug

SEQ ID NO: 28491 - RNA, 22 nt, Mycobacterium tuberculosis CDC1551
guugaucagcuuguugagcugc

SEQ ID NO: 28492 - RNA, 22 nt, Mycobacterium tuberculosis CDC1551
guugugaacggaaccgccggga

SEQ ID NO: 28493 - RNA, 22 nt, Mycobacterium tuberculosis CDC1551
guuugguugccuaccgcguggg

SEQ ID NO: 28494 - RNA, 22 nt, Mycobacterium tuberculosis CDC1551
uaaccgcuacaaaugaaguugg

SEQ ID NO: 28495 - RNA, 22 nt, Mycobacterium tuberculosis CDC1551
uagguaaauaaauccguguuug

SEQ ID NO: 28496 - RNA, 19 nt, Mycobacterium tuberculosis CDC1551
ucagcuguacucgaugaau

SEQ ID NO: 28497 - RNA, 22 nt, Mycobacterium tuberculosis CDC1551
ucagcuguguccgcacaaccgg

SEQ ID NO: 28498 - RNA, 22 nt, Mycobacterium tuberculosis CDC1551
ucaggcugggcgaaccugggca

SEQ ID NO: 28499 - RNA, 22 nt, Mycobacterium tuberculosis CDC1551
uccuuuccgucgaugcggaagc

SEQ ID NO: 28500 - RNA, 22 nt, Mycobacterium tuberculosis CDC1551
ucgccagcaccaccugguuggg

SEQ ID NO: 28501 - RNA, 22 nt, Mycobacterium tuberculosis CDC1551
ucgcccagcgagugcgccuggu

SEQ ID NO: 28502 - RNA, 23 nt, Mycobacterium tuberculosis CDC1551
ucgcugucccgaggucacgcuuu

SEQ ID NO: 28503 - RNA, 22 nt, Mycobacterium tuberculosis CDC1551
ucggggacuucugcgucugcuc

SEQ ID NO: 28504 - RNA, 22 nt, Mycobacterium tuberculosis CDC1551
ucggugacggacugcacagcga

SEQ ID NO: 28505 - RNA, 18 nt, Mycobacterium tuberculosis CDC1551
ucgugggcgcgccgccaa

SEQ ID NO: 28506 - RNA, 22 nt, Mycobacterium tuberculosis CDC1551
ucuuucccuccagaucggugcg

SEQ ID NO: 28507 - RNA, 22 nt, Mycobacterium tuberculosis CDC1551
ugacauauaucaaagagauguu

SEQ ID NO: 28508 - RNA, 22 nt, Mycobacterium tuberculosis CDC1551
ugacccaggcgccggucggugu

SEQ ID NO: 28509 - RNA, 22 nt, Mycobacterium tuberculosis CDC1551
ugacucugcguccagcaggcgg

SEQ ID NO: 28510 - RNA, 22 nt, Mycobacterium tuberculosis CDC1551
ugagacccccgucgaagucuag

SEQ ID NO: 28511 - RNA, 22 nt, Mycobacterium tuberculosis CDC1551
ugaggaggaugaguuugcccuc

SEQ ID NO: 28512 - RNA, 22 nt, Mycobacterium tuberculosis CDC1551
ugcacuccgacccgccgacguu

SEQ ID NO: 28513 - RNA, 22 nt, Mycobacterium tuberculosis CDC1551
ugcgccagcgccucccgcagga

SEQ ID NO: 28514 - RNA, 22 nt, Mycobacterium tuberculosis CDC1551
uggccaccgcagugggugugau

SEQ ID NO: 28515 - RNA, 22 nt, Mycobacterium tuberculosis CDC1551
uggcucagcgggucaacgaggc

SEQ ID NO: 28516 - RNA, 22 nt, Mycobacterium tuberculosis CDC1551
uggcuggucggaccgucagcga

SEQ ID NO: 28517 - RNA, 22 nt, Mycobacterium tuberculosis CDC1551
ugggccuccugagcagcggcuu

SEQ ID NO: 28518 - RNA, 23 nt, Mycobacterium tuberculosis CDC1551
ugguggacgcagagucaacggau

SEQ ID NO: 28519 - RNA, 22 nt, Mycobacterium tuberculosis CDC1551
ugguggcugugucgaccgggaa

SEQ ID NO: 28520 - RNA, 22 nt, Mycobacterium tuberculosis CDC1551
ugguggcuguuguugcgccggc

SEQ ID NO: 28521 - RNA, 23 nt, Mycobacterium tuberculosis CDC1551
ugguggucaccccgacgacgcuc

SEQ ID NO: 28522 - RNA, 22 nt, Mycobacterium tuberculosis CDC1551
ugguuucccgugaggugaucgc

SEQ ID NO: 28523 - RNA, 22 nt, Mycobacterium tuberculosis CDC1551
ugucccgcacucgauccgcaag

SEQ ID NO: 28524 - RNA, 22 nt, Mycobacterium tuberculosis CDC1551
uguguacuaccggguucgcgcg

SEQ ID NO: 28525 - RNA, 22 nt, Mycobacterium tuberculosis CDC1551
uucaggcuacgguagcggugcg

SEQ ID NO: 28526 - RNA, 22 nt, Mycobacterium tuberculosis CDC1551
uugacgucagcgccgcccgguc

SEQ ID NO: 28527 - RNA, 22 nt, Mycobacterium tuberculosis CDC1551
aaggcgagcgacgucuuucccg

SEQ ID NO: 28528 - RNA, 22 nt, Mycobacterium tuberculosis CDC1551
aaguccagcagaucgaucucgc

SEQ ID NO: 28529 - RNA, 22 nt, Mycobacterium tuberculosis CDC1551
aauccggccugugucgggucgu

SEQ ID NO: 28530 - RNA, 22 nt, Mycobacterium tuberculosis CDC1551
acaccaaggccgucagcuuggc

SEQ ID NO: 28531 - RNA, 22 nt, Mycobacterium tuberculosis CDC1551
accgcgccgccaaugcagcguc

SEQ ID NO: 28532 - RNA, 22 nt, Mycobacterium tuberculosis CDC1551
acgcagaggacuagcacgucga

SEQ ID NO: 28533 - RNA, 22 nt, Mycobacterium tuberculosis CDC1551
acugcuuuccugucugggcggc

SEQ ID NO: 28534 - RNA, 22 nt, Mycobacterium tuberculosis CDC1551
acuggccagcccgcacaaccac

SEQ ID NO: 28535 - RNA, 22 nt, Mycobacterium tuberculosis CDC1551
agcacugcuuucugagcucgag

SEQ ID NO: 28536 - RNA, 22 nt, Mycobacterium tuberculosis CDC1551
agcagcugcuucauggugacua

SEQ ID NO: 28537 - RNA, 22 nt, Mycobacterium tuberculosis CDC1551
agcccaccggugcuguaggcga

SEQ ID NO: 28538 - RNA, 23 nt, Mycobacterium tuberculosis CDC1551
agccccagcaauaucgccgacau

SEQ ID NO: 28539 - RNA, 22 nt, Mycobacterium tuberculosis CDC1551
ucaccgccgcgguuggugcgca

SEQ ID NO: 28540 - RNA, 18 nt, Mycobacterium tuberculosis CDC1551
ucagcgaucggggugcgg

SEQ ID NO: 28541 - RNA, 22 nt, Mycobacterium tuberculosis CDC1551
ucagcgucgaugaccaugucga

SEQ ID NO: 28542 - RNA, 22 nt, Mycobacterium tuberculosis CDC1551
ucagguacgcgucagcagauug

SEQ ID NO: 28543 - RNA, 23 nt, Mycobacterium tuberculosis CDC1551
ucccaggugccauacgagcugaa

SEQ ID NO: 28544 - RNA, 22 nt, Mycobacterium tuberculosis CDC1551
uccgggccggcuuugccgccgu

SEQ ID NO: 28545 - RNA, 22 nt, Mycobacterium tuberculosis CDC1551
ucgaaacccagccaccucuugg

SEQ ID NO: 28546 - RNA, 22 nt, Mycobacterium tuberculosis CDC1551
ucgcccaggugcaggcucgcgu

SEQ ID NO: 28547 - RNA, 22 nt, Mycobacterium tuberculosis CDC1551
ucggagaccucgccggaccucg

SEQ ID NO: 28548 - RNA, 22 nt, Mycobacterium tuberculosis CDC1551
ucggccucccaugcggcgaucu

SEQ ID NO: 28549 - RNA, 22 nt, Mycobacterium tuberculosis CDC1551
ucgguggcgccgacaugccggu

SEQ ID NO: 28550 - RNA, 22 nt, Mycobacterium tuberculosis CDC1551
ucucagacaucuugggcgccac

SEQ ID NO: 28551 - RNA, 22 nt, Mycobacterium tuberculosis CDC1551
ucugugcgcgguuugugcacag

SEQ ID NO: 28552 - RNA, 22 nt, Mycobacterium tuberculosis CDC1551
ucuugcgguccagcuugagcuc

SEQ ID NO: 28553 - RNA, 21 nt, Mycobacterium tuberculosis CDC1551
ugacccacugggccgagucgg

SEQ ID NO: 28554 - RNA, 22 nt, Mycobacterium tuberculosis CDC1551
ugagggcaucgucggucgccgg

SEQ ID NO: 28555 - RNA, 22 nt, Mycobacterium tuberculosis CDC1551
ugaucucacccgaaguuguguc

SEQ ID NO: 28556 - RNA, 22 nt, Mycobacterium tuberculosis CDC1551
ugcagcugcgaccguucguucu

SEQ ID NO: 28557 - RNA, 22 nt, Mycobacterium tuberculosis CDC1551
ugccgcagauacccggcuagac

SEQ ID NO: 28558 - RNA, 22 nt, Mycobacterium tuberculosis CDC1551
ugcugcccaaagaacagcgagc

SEQ ID NO: 28559 - RNA, 22 nt, Mycobacterium tuberculosis CDC1551
uggagcuccuuucgcugccgca

SEQ ID NO: 28560 - RNA, 22 nt, Mycobacterium tuberculosis CDC1551
uggcagcaaucggguauccgau

SEQ ID NO: 28561 - RNA, 22 nt, Mycobacterium tuberculosis CDC1551
uggcgagcagacgcaaaagccc

SEQ ID NO: 28562 - RNA, 22 nt, Mycobacterium tuberculosis CDC1551
uggcgcgcggaucgacgacagg

SEQ ID NO: 28563 - RNA, 22 nt, Mycobacterium tuberculosis CDC1551
ugggacagcuggaaguuaucgg

SEQ ID NO: 28564 - RNA, 22 nt, Mycobacterium tuberculosis CDC1551
ugggaugguuuucagcgcccga

SEQ ID NO: 28565 - RNA, 22 nt, Mycobacterium tuberculosis CDC1551
ugggcagcggucaaggggccca

SEQ ID NO: 28566 - RNA, 22 nt, Mycobacterium tuberculosis CDC1551
ugggcugaacaggacggccgcc

SEQ ID NO: 28567 - RNA, 22 nt, Mycobacterium tuberculosis CDC1551
ugggcugcugcgccgcaucggc

SEQ ID NO: 28568 - RNA, 22 nt, Mycobacterium tuberculosis CDC1551
uggucggcggucauacccgcgg

SEQ ID NO: 28569 - RNA, 18 nt, Mycobacterium tuberculosis CDC1551
uggugcaccuuguuuggg

SEQ ID NO: 28570 - RNA, 22 nt, Mycobacterium tuberculosis CDC1551
ugguggcuagcaaggucuuccc

SEQ ID NO: 28571 - RNA, 23 nt, Mycobacterium tuberculosis CDC1551
ugguggucgacaugucggccagc

SEQ ID NO: 28572 - RNA, 22 nt, Mycobacterium tuberculosis CDC1551
ugucgcgcaagcucuccggcac

SEQ ID NO: 28573 - RNA, 22 nt, Mycobacterium tuberculosis CDC1551
ugugauggagugaucggcagcc

SEQ ID NO: 28574 - RNA, 21 nt, Mycobacterium tuberculosis CDC1551
uuccggcccggguccagcgac

SEQ ID NO: 28575 - RNA, 22 nt, Mycobacterium tuberculosis CDC1551
uugccugcggugcugccggcgg

SEQ ID NO: 28576 - RNA, 22 nt, Mycobacterium tuberculosis CDC1551
uuguugcuuucgguagugcugg

SEQ ID NO: 28577 - RNA, 22 nt, Mycobacterium tuberculosis CDC1551
uuugguacggaacguaggcaga

SEQ ID NO: 28578 - RNA, 22 nt, Mycobacterium tuberculosis CDC1551
aacacuaugcagcauuugggau

SEQ ID NO: 28579 - RNA, 21 nt, Mycobacterium tuberculosis CDC1551
aagcguccggcgaugaauuga

SEQ ID NO: 28580 - RNA, 21 nt, Mycobacterium tuberculosis CDC1551
aagcugugggucgaggagucu

SEQ ID NO: 28581 - RNA, 22 nt, Mycobacterium tuberculosis CDC1551
aaggugaacucacggcgagguu

SEQ ID NO: 28582 - RNA, 22 nt, Mycobacterium tuberculosis CDC1551
aaguaguaaugugcgagcugag

SEQ ID NO: 28583 - RNA, 22 nt, Mycobacterium tuberculosis CDC1551
aaugccagcgcgaagaccgcca

SEQ ID NO: 28584 - RNA, 22 nt, Mycobacterium tuberculosis CDC1551
acaccaagcgcccgcagcuugc

SEQ ID NO: 28585 - RNA, 22 nt, Mycobacterium tuberculosis CDC1551
acagacgcagaaucgcaucaaa

SEQ ID NO: 28586 - RNA, 19 nt, Mycobacterium tuberculosis CDC1551
acccaggccgucacuucga

SEQ ID NO: 28587 - RNA, 22 nt, Mycobacterium tuberculosis CDC1551
accucauugaacgacauggguu

SEQ ID NO: 28588 - RNA, 22 nt, Mycobacterium tuberculosis CDC1551
acgagcguaacggcacugcgaa

SEQ ID NO: 28589 - RNA, 22 nt, Mycobacterium tuberculosis CDC1551
acugucccgagcgcaccaggaa

SEQ ID NO: 28590 - RNA, 22 nt, Mycobacterium tuberculosis CDC1551
agccaagccguaguccucgacg

SEQ ID NO: 28591 - RNA, 22 nt, Mycobacterium tuberculosis CDC1551
agccccagucgcuuugucucga

SEQ ID NO: 28592 - RNA, 22 nt, Mycobacterium tuberculosis CDC1551
aggccgaguucgucaugcagcu

SEQ ID NO: 28593 - RNA, 22 nt, Mycobacterium tuberculosis CDC1551
agguagagcagcaucagcgcgu

SEQ ID NO: 28594 - RNA, 22 nt, Mycobacterium tuberculosis CDC1551
aggucugucggaccuggccgcg

SEQ ID NO: 28595 - RNA, 22 nt, Mycobacterium tuberculosis CDC1551
aucaacacgcugcuguuguaca

SEQ ID NO: 28596 - RNA, 22 nt, Mycobacterium tuberculosis CDC1551
auccaugagcagcucgccgccg

SEQ ID NO: 28597 - RNA, 22 nt, Mycobacterium tuberculosis CDC1551
aucgcuugccgaugccgucggu

SEQ ID NO: 28598 - RNA, 22 nt, Mycobacterium tuberculosis CDC1551
auggccaaccucccgacuggua

SEQ ID NO: 28599 - RNA, 22 nt, Mycobacterium tuberculosis CDC1551
caagaccagguacguggaccau

SEQ ID NO: 28600 - RNA, 22 nt, Mycobacterium tuberculosis CDC1551
caaguaguaggcgagaucaccg

SEQ ID NO: 28601 - RNA, 22 nt, Mycobacterium tuberculosis CDC1551
caccugccgaucgcacagguug

SEQ ID NO: 28602 - RNA, 22 nt, Mycobacterium tuberculosis CDC1551
cacgagcguaaccccagugcga

SEQ ID NO: 28603 - RNA, 22 nt, Mycobacterium tuberculosis CDC1551
cacgccugcgcgacauggacgc

SEQ ID NO: 28604 - RNA, 20 nt, Mycobacterium tuberculosis CDC1551
cacuccuggcuggauucggc

SEQ ID NO: 28605 - RNA, 22 nt, Mycobacterium tuberculosis CDC1551
cagcugcuccgugacuacggcu

SEQ ID NO: 28606 - RNA, 22 nt, Mycobacterium tuberculosis CDC1551
caugcaucggaagaaccggcau

SEQ ID NO: 28607 - RNA, 22 nt, Mycobacterium tuberculosis CDC1551
cauggucacuggcugugacuga

SEQ ID NO: 28608 - RNA, 22 nt, Mycobacterium tuberculosis CDC1551
cauuggcaccggaaaucgccgg

SEQ ID NO: 28609 - RNA, 22 nt, Mycobacterium tuberculosis CDC1551
ccaccgccacggccagcaccgc

SEQ ID NO: 28610 - RNA, 22 nt, Mycobacterium tuberculosis CDC1551
ccagcgggugccggugguggac

SEQ ID NO: 28611 - RNA, 22 nt, Mycobacterium tuberculosis CDC1551
ccagcucaucgccguagcugag

SEQ ID NO: 28612 - RNA, 22 nt, Mycobacterium tuberculosis CDC1551
ccaugagcacccggauggccug

SEQ ID NO: 28613 - RNA, 22 nt, Mycobacterium tuberculosis CDC1551
cccagcaccgaccagugccggc

SEQ ID NO: 28614 - RNA, 22 nt, Mycobacterium tuberculosis CDC1551
ccccguccgaagugaugcccgc

SEQ ID NO: 28615 - RNA, 22 nt, Mycobacterium tuberculosis CDC1551
ccuccugcgccuggcgcaccga

SEQ ID NO: 28616 - RNA, 22 nt, Mycobacterium tuberculosis CDC1551
ccucuagguccgaugguggcga

SEQ ID NO: 28617 - RNA, 22 nt, Mycobacterium tuberculosis CDC1551
cgaaggucucgacguacugcgc

SEQ ID NO: 28618 - RNA, 21 nt, Mycobacterium tuberculosis CDC1551
cgagcucgcggcccagaguuc

SEQ ID NO: 28619 - RNA, 22 nt, Mycobacterium tuberculosis CDC1551
cgaggccgacgaaagguugccg

SEQ ID NO: 28620 - RNA, 23 nt, Mycobacterium tuberculosis CDC1551
cgagggcuuuagugucugcucgc

SEQ ID NO: 28621 - RNA, 22 nt, Mycobacterium tuberculosis CDC1551
cgauccucgcaccgcucgccgc

SEQ ID NO: 28622 - RNA, 21 nt, Mycobacterium tuberculosis CDC1551
cgccccagaugcacgcucggc

SEQ ID NO: 28623 - RNA, 22 nt, Mycobacterium tuberculosis CDC1551
cgcugggcgaugaagcgcuggg

SEQ ID NO: 28624 - RNA, 22 nt, Mycobacterium tuberculosis CDC1551
cggcaagcccgggcucgccgga

SEQ ID NO: 28625 - RNA, 22 nt, Mycobacterium tuberculosis CDC1551
cggucaccaucucgcagacaua

SEQ ID NO: 28626 - RNA, 22 nt, Mycobacterium tuberculosis CDC1551
cgguggugaccgccgcgacguc

SEQ ID NO: 28627 - RNA, 22 nt, Mycobacterium tuberculosis CDC1551
cucagcaucgccgagcucgagc

SEQ ID NO: 28628 - RNA, 18 nt, Mycobacterium tuberculosis CDC1551
cuccuuggacuacggcug

SEQ ID NO: 28629 - RNA, 22 nt, Mycobacterium tuberculosis CDC1551
cugcccuggcuggccaugggcg

SEQ ID NO: 28630 - RNA, 22 nt, Mycobacterium tuberculosis CDC1551
cuugcugguaugccgggccacc

SEQ ID NO: 28631 - RNA, 22 nt, Mycobacterium tuberculosis CDC1551
cuugggcguuugcguucgccgc

SEQ ID NO: 28632 - RNA, 22 nt, Mycobacterium tuberculosis CDC1551
gaccaugucgcggcguagccgu

SEQ ID NO: 28633 - RNA, 22 nt, Mycobacterium tuberculosis CDC1551
gacgaggucuggggucagcuga

SEQ ID NO: 28634 - RNA, 22 nt, Mycobacterium tuberculosis CDC1551
gacgccgaguaccgcgcgaugu

SEQ ID NO: 28635 - RNA, 22 nt, Mycobacterium tuberculosis CDC1551
gacuccagccguucacguucga

SEQ ID NO: 28636 - RNA, 22 nt, Mycobacterium tuberculosis CDC1551
gagcaugggcguggacguuguc

SEQ ID NO: 28637 - RNA, 22 nt, Mycobacterium tuberculosis CDC1551
gagcggauuuuucgcaccggga

SEQ ID NO: 28638 - RNA, 22 nt, Mycobacterium tuberculosis CDC1551
gaggagaugcuagaggcaacga

SEQ ID NO: 28639 - RNA, 22 nt, Mycobacterium tuberculosis CDC1551
gaggagguguaccggguagagg

SEQ ID NO: 28640 - RNA, 22 nt, Mycobacterium tuberculosis CDC1551
gagggacuuaugcgucugcuag

SEQ ID NO: 28641 - RNA, 22 nt, Mycobacterium tuberculosis CDC1551
gaggggauuuugcgucugcuca

SEQ ID NO: 28642 - RNA, 22 nt, Mycobacterium tuberculosis CDC1551
gaggugaugagggcggcgagua

SEQ ID NO: 28643 - RNA, 20 nt, Mycobacterium tuberculosis CDC1551
gaugaugaucguguaugcga

SEQ ID NO: 28644 - RNA, 22 nt, Mycobacterium tuberculosis CDC1551
uugaggaucagguucagcuggc

SEQ ID NO: 28645 - RNA, 22 nt, Mycobacterium tuberculosis CDC1551
uugauauuaccgauggaauguc

SEQ ID NO: 28646 - RNA, 22 nt, Mycobacterium tuberculosis CDC1551
uugccgggacuuuuuguguggc

SEQ ID NO: 28647 - RNA, 22 nt, Mycobacterium tuberculosis CDC1551
uugcgcaggggcaugucagcgu

SEQ ID NO: 28648 - RNA, 22 nt, Mycobacterium tuberculosis CDC1551
uugcggcaaugccggcaggccg

SEQ ID NO: 28649 - RNA, 22 nt, Mycobacterium tuberculosis CDC1551
uugguguccgccgacgccaagu

SEQ ID NO: 28650 - RNA, 22 nt, Mycobacterium tuberculosis CDC1551
uugucgccgucucgguccagcu

SEQ ID NO: 28651 - RNA, 20 nt, Mycobacterium tuberculosis CDC1551
uuucugagcggcucaugacg

SEQ ID NO: 28652 - RNA, 22 nt, Mycobacterium tuberculosis H37Rv
aacacuaugcagcauuugggau

SEQ ID NO: 28653 - RNA, 22 nt, Mycobacterium tuberculosis H37Rv
aacaguggcgagccgguccgua

SEQ ID NO: 28654 - RNA, 22 nt, Mycobacterium tuberculosis H37Rv
aacccgcuugccgaccucaucc

SEQ ID NO: 28655 - RNA, 22 nt, Mycobacterium tuberculosis H37Rv
aaccggugcaacaacgcacgcu

SEQ ID NO: 28656 - RNA, 22 nt, Mycobacterium tuberculosis H37Rv
aacgcgccgaccacauacggcg

SEQ ID NO: 28657 - RNA, 22 nt, Mycobacterium tuberculosis H37Rv
aacgcgggcaaggagacgguca

SEQ ID NO: 28658 - RNA, 22 nt, Mycobacterium tuberculosis H37Rv
aacgcgguugcgacugcugguc

SEQ ID NO: 28659 - RNA, 22 nt, Mycobacterium tuberculosis H37Rv
aacgcugcgucuuuggucagcg

SEQ ID NO: 28660 - RNA, 22 nt, Mycobacterium tuberculosis H37Rv
aacuccagcaugcucucgguca

SEQ ID NO: 28661 - RNA, 22 nt, Mycobacterium tuberculosis H37Rv
aacuccucgacguccugcaugc

SEQ ID NO: 28662 - RNA, 22 nt, Mycobacterium tuberculosis H37Rv
aacucgucgaaccgcagcgcgu

SEQ ID NO: 28663 - RNA, 22 nt, Mycobacterium tuberculosis H37Rv
aagaccucacggcgcucggcca

SEQ ID NO: 28664 - RNA, 19 nt, Mycobacterium tuberculosis H37Rv
aagaggucaccgagaucaa

SEQ ID NO: 28665 - RNA, 22 nt, Mycobacterium tuberculosis H37Rv
aagcagacgcagaaucgcauua

SEQ ID NO: 28666 - RNA, 22 nt, Mycobacterium tuberculosis H37Rv
aagcccgcguugugggcaucuu

SEQ ID NO: 28667 - RNA, 22 nt, Mycobacterium tuberculosis H37Rv
aagccggucacgcguggccaac

SEQ ID NO: 28668 - RNA, 22 nt, Mycobacterium tuberculosis H37Rv
aagcucgauggauccagcggcc

SEQ ID NO: 28669 - RNA, 22 nt, Mycobacterium tuberculosis H37Rv
aaggccggcaacggcggugccg

SEQ ID NO: 28670 - RNA, 22 nt, Mycobacterium tuberculosis H37Rv
aaggcuuuagggucgcugucau

SEQ ID NO: 28671 - RNA, 22 nt, Mycobacterium tuberculosis H37Rv
aagggucgcagugggcagcgau

SEQ ID NO: 28672 - RNA, 22 nt, Mycobacterium tuberculosis H37Rv
aagucaccgacgaucgcuugag

SEQ ID NO: 28673 - RNA, 22 nt, Mycobacterium tuberculosis H37Rv
aaucggcacuguugcagcgggu

SEQ ID NO: 28674 - RNA, 22 nt, Mycobacterium tuberculosis H37Rv
aaucucgcccccagugcacgcu

SEQ ID NO: 28675 - RNA, 22 nt, Mycobacterium tuberculosis H37Rv
aaugaugccgucgguggccagg

SEQ ID NO: 28676 - RNA, 22 nt, Mycobacterium tuberculosis H37Rv
aaugccagcgcgaagaccgcca

SEQ ID NO: 28677 - RNA, 22 nt, Mycobacterium tuberculosis H37Rv
aauuccucuauuacgacgacgg

SEQ ID NO: 28678 - RNA, 22 nt, Mycobacterium tuberculosis H37Rv
acaagcauccaggaccgguuga

SEQ ID NO: 28679 - RNA, 22 nt, Mycobacterium tuberculosis H37Rv
acaccgaguucauggcgcccgc

SEQ ID NO: 28680 - RNA, 22 nt, Mycobacterium tuberculosis H37Rv
acacgccuugguagccgcugac

SEQ ID NO: 28681 - RNA, 22 nt, Mycobacterium tuberculosis H37Rv
acacggcaaagaucaggaaugc

SEQ ID NO: 28682 - RNA, 22 nt, Mycobacterium tuberculosis H37Rv
acagcccugaacgcaaucuggg

SEQ ID NO: 28683 - RNA, 22 nt, Mycobacterium tuberculosis H37Rv
acagcugcugguuugagucugc

SEQ ID NO: 28684 - RNA, 22 nt, Mycobacterium tuberculosis H37Rv
accaggucgccgccauaggggu

SEQ ID NO: 28685 - RNA, 22 nt, Mycobacterium tuberculosis H37Rv
acccguucgaccagggugucgg

SEQ ID NO: 28686 - RNA, 22 nt, Mycobacterium tuberculosis H37Rv
accgagucgcgaggcguuccgg

SEQ ID NO: 28687 - RNA, 22 nt, Mycobacterium tuberculosis H37Rv
accgaugcugacgaugcggucg

SEQ ID NO: 28688 - RNA, 22 nt, Mycobacterium tuberculosis H37Rv
accgcagcggguugcgggcaug

SEQ ID NO: 28689 - RNA, 22 nt, Mycobacterium tuberculosis H37Rv
accgccagcaucaucgugcagc

SEQ ID NO: 28690 - RNA, 22 nt, Mycobacterium tuberculosis H37Rv
accgcgaucagcgcagcgaucg

SEQ ID NO: 28691 - RNA, 21 nt, Mycobacterium tuberculosis H37Rv
accgcgcacgggcaugcgauc

SEQ ID NO: 28692 - RNA, 22 nt, Mycobacterium tuberculosis H37Rv
accgcgcuguuucggcugcucg

SEQ ID NO: 28693 - RNA, 22 nt, Mycobacterium tuberculosis H37Rv
accgcggacgucuacgccgucc

SEQ ID NO: 28694 - RNA, 22 nt, Mycobacterium tuberculosis H37Rv
accggccacaggcugugcuggu

SEQ ID NO: 28695 - RNA, 22 nt, Mycobacterium tuberculosis H37Rv
accgucagggcaucaccgaggc

SEQ ID NO: 28696 - RNA, 22 nt, Mycobacterium tuberculosis H37Rv
accgugauuguuccgcaccgac

SEQ ID NO: 28697 - RNA, 22 nt, Mycobacterium tuberculosis H37Rv
accucgacgagcaccauccggu

SEQ ID NO: 28698 - RNA, 22 nt, Mycobacterium tuberculosis H37Rv
accugcuccuugcugaucccgg

SEQ ID NO: 28699 - RNA, 22 nt, Mycobacterium tuberculosis H37Rv
acgacgugaccggagcguccga

SEQ ID NO: 28700 - RNA, 22 nt, Mycobacterium tuberculosis H37Rv
acgagcguaacggcacugcgaa

SEQ ID NO: 28701 - RNA, 22 nt, Mycobacterium tuberculosis H37Rv
acgauguuccgccacgccgagc

SEQ ID NO: 28702 - RNA, 18 nt, Mycobacterium tuberculosis H37Rv
acgcaccugcgcuaccag

SEQ ID NO: 28703 - RNA, 22 nt, Mycobacterium tuberculosis H37Rv
acgccagaacucaauaccgucu

SEQ ID NO: 28704 - RNA, 22 nt, Mycobacterium tuberculosis H37Rv
acgccugcgucaugggguucca

SEQ ID NO: 28705 - RNA, 22 nt, Mycobacterium tuberculosis H37Rv
acgcgacgaauccacugcgcuu

SEQ ID NO: 28706 - RNA, 22 nt, Mycobacterium tuberculosis H37Rv
acgcgugugacgcugcggcgaa

SEQ ID NO: 28707 - RNA, 22 nt, Mycobacterium tuberculosis H37Rv
acgcucguggaaccgggucggc

SEQ ID NO: 28708 - RNA, 22 nt, Mycobacterium tuberculosis H37Rv
acgcuggcgacauggcgggcag

SEQ ID NO: 28709 - RNA, 22 nt, Mycobacterium tuberculosis H37Rv
acgcuugacguggugaguauaa

SEQ ID NO: 28710 - RNA, 22 nt, Mycobacterium tuberculosis H37Rv
acggccaugaugcaguucuacg

SEQ ID NO: 28711 - RNA, 22 nt, Mycobacterium tuberculosis H37Rv
acggcccauuguggcggccguc

SEQ ID NO: 28712 - RNA, 20 nt, Mycobacterium tuberculosis H37Rv
acggccuggccugucggcgc

SEQ ID NO: 28713 - RNA, 22 nt, Mycobacterium tuberculosis H37Rv
acggucacucgcacauguucgu

SEQ ID NO: 28714 - RNA, 22 nt, Mycobacterium tuberculosis H37Rv
acggucgccaaccuggcgagca

SEQ ID NO: 28715 - RNA, 22 nt, Mycobacterium tuberculosis H37Rv
acggucgggcgccaucgacgcc

SEQ ID NO: 28716 - RNA, 22 nt, Mycobacterium tuberculosis H37Rv
acggugagggcgucgucgaguu

SEQ ID NO: 28717 - RNA, 22 nt, Mycobacterium tuberculosis H37Rv
acggugaugccguugcggucga

SEQ ID NO: 28718 - RNA, 22 nt, Mycobacterium tuberculosis H37Rv
acggugucauagagcgagaacc

SEQ ID NO: 28719 - RNA, 22 nt, Mycobacterium tuberculosis H37Rv
acgucgaagacgaucaggcguu

SEQ ID NO: 28720 - RNA, 22 nt, Mycobacterium tuberculosis H37Rv
acgucgaguugaccgucgccuu

SEQ ID NO: 28721 - RNA, 22 nt, Mycobacterium tuberculosis H37Rv
acgucgcggugcuguucgugga

SEQ ID NO: 28722 - RNA, 22 nt, Mycobacterium tuberculosis H37Rv
acgugcugcgcggggcacccgg

SEQ ID NO: 28723 - RNA, 22 nt, Mycobacterium tuberculosis H37Rv
augaugggucugggcggagugc

SEQ ID NO: 28724 - RNA, 22 nt, Mycobacterium tuberculosis H37Rv
augcagccggucucggcgccgc

SEQ ID NO: 28725 - RNA, 22 nt, Mycobacterium tuberculosis H37Rv
augccgguucuuccgaugcaug

SEQ ID NO: 28726 - RNA, 22 nt, Mycobacterium tuberculosis H37Rv
auggauggcgaggcguuguggu

SEQ ID NO: 28727 - RNA, 22 nt, Mycobacterium tuberculosis H37Rv
auggccgcgugugcaaguagcg

SEQ ID NO: 28728 - RNA, 22 nt, Mycobacterium tuberculosis H37Rv
auggcgaacgaugccggcgguc

SEQ ID NO: 28729 - RNA, 22 nt, Mycobacterium tuberculosis H37Rv
augggcgauucugcgucugcuc

SEQ ID NO: 28730 - RNA, 23 nt, Mycobacterium tuberculosis H37Rv
augggcgauuuugcgucugcucg

SEQ ID NO: 28731 - RNA, 22 nt, Mycobacterium tuberculosis H37Rv
auggguuagguuuggcggccgc

SEQ ID NO: 28732 - RNA, 21 nt, Mycobacterium tuberculosis H37Rv
augucacgcgguccugaucgc

SEQ ID NO: 28733 - RNA, 22 nt, Mycobacterium tuberculosis H37Rv
auguugaccgagaugccgccga

SEQ ID NO: 28734 - RNA, 22 nt, Mycobacterium tuberculosis H37Rv
auucacuggauagccacacuau

SEQ ID NO: 28735 - RNA, 22 nt, Mycobacterium tuberculosis H37Rv
auucggcuucggcucgcugguu

SEQ ID NO: 28736 - RNA, 22 nt, Mycobacterium tuberculosis H37Rv
auugcgagccacgcagguugaa

SEQ ID NO: 28737 - RNA, 22 nt, Mycobacterium tuberculosis H37Rv
auuggccaugcgcgggcgccgu

SEQ ID NO: 28738 - RNA, 22 nt, Mycobacterium tuberculosis H37Rv
auugugaaaugugcgacgccag

SEQ ID NO: 28739 - RNA, 18 nt, Mycobacterium tuberculosis H37Rv
auugugcguggcuguccg

SEQ ID NO: 28740 - RNA, 22 nt, Mycobacterium tuberculosis H37Rv
auuucggucggcucgucgacua

SEQ ID NO: 28741 - RNA, 22 nt, Mycobacterium tuberculosis H37Rv
auuugggagcuuuugcgucugc

SEQ ID NO: 28742 - RNA, 22 nt, Mycobacterium tuberculosis H37Rv
auuugggcgauuuugcgucugc

SEQ ID NO: 28743 - RNA, 22 nt, Mycobacterium tuberculosis H37Rv
caaccgcgacgcucaggccagc

SEQ ID NO: 28744 - RNA, 22 nt, Mycobacterium tuberculosis H37Rv
caacgcaucagugccggcgccg

SEQ ID NO: 28745 - RNA, 19 nt, Mycobacterium tuberculosis H37Rv
caacggcgacgggcucguc

SEQ ID NO: 28746 - RNA, 20 nt, Mycobacterium tuberculosis H37Rv
caacggcgagcuucccgcac

SEQ ID NO: 28747 - RNA, 21 nt, Mycobacterium tuberculosis H37Rv
caagggcaagguuuggaccgg

SEQ ID NO: 28748 - RNA, 22 nt, Mycobacterium tuberculosis H37Rv
caagucgccaagaccggugacu

SEQ ID NO: 28749 - RNA, 22 nt, Mycobacterium tuberculosis H37Rv
caccacuucagguugcgugacg

SEQ ID NO: 28750 - RNA, 22 nt, Mycobacterium tuberculosis H37Rv
caccgcguucggugugcggcgu

SEQ ID NO: 28751 - RNA, 22 nt, Mycobacterium tuberculosis H37Rv
caccgucaauacgauguugcug

SEQ ID NO: 28752 - RNA, 22 nt, Mycobacterium tuberculosis H37Rv
caccugccgaucgcacagguug

SEQ ID NO: 28753 - RNA, 22 nt, Mycobacterium tuberculosis H37Rv
cacgauguugcgaaacgccuga

SEQ ID NO: 28754 - RNA, 22 nt, Mycobacterium tuberculosis H37Rv
cacggcguguuugagugcgagu

SEQ ID NO: 28755 - RNA, 22 nt, Mycobacterium tuberculosis H37Rv
cacggugaucggggaccggucg

SEQ ID NO: 28756 - RNA, 20 nt, Mycobacterium tuberculosis H37Rv
cacuccuggcuggauucggc

SEQ ID NO: 28757 - RNA, 20 nt, Mycobacterium tuberculosis H37Rv
cacuggguacacgcucggcg

SEQ ID NO: 28758 - RNA, 22 nt, Mycobacterium tuberculosis H37Rv
cagacgcaaaagaacaugaugg

SEQ ID NO: 28759 - RNA, 22 nt, Mycobacterium tuberculosis H37Rv
cagacgcauaagcgcccaauuu

SEQ ID NO: 28760 - RNA, 22 nt, Mycobacterium tuberculosis H37Rv
cagccggaggaucucggcgaac

SEQ ID NO: 28761 - RNA, 22 nt, Mycobacterium tuberculosis H37Rv
cagcgguuuucgcggccaucgg

SEQ ID NO: 28762 - RNA, 22 nt, Mycobacterium tuberculosis H37Rv
cagcguugucucggcgaacacc

SEQ ID NO: 28763 - RNA, 22 nt, Mycobacterium tuberculosis H37Rv
cagguugaccgccacgauuccg

SEQ ID NO: 28764 - RNA, 22 nt, Mycobacterium tuberculosis H37Rv
cauccgcacggugcugauccca

SEQ ID NO: 28765 - RNA, 21 nt, Mycobacterium tuberculosis H37Rv
cauccguucggaggaccggca

SEQ ID NO: 28766 - RNA, 22 nt, Mycobacterium tuberculosis H37Rv
cauccuggccuauuccggcggu

SEQ ID NO: 28767 - RNA, 22 nt, Mycobacterium tuberculosis H37Rv
caucgaggagaugcaggcgugg

SEQ ID NO: 28768 - RNA, 22 nt, Mycobacterium tuberculosis H37Rv
caucgagucgacgauguggugg

SEQ ID NO: 28769 - RNA, 22 nt, Mycobacterium tuberculosis H37Rv
caucgccucgaccggcggaaac

SEQ ID NO: 28770 - RNA, 22 nt, Mycobacterium tuberculosis H37Rv
caucgcgguggugcgcgcuucg

SEQ ID NO: 28771 - RNA, 22 nt, Mycobacterium tuberculosis H37Rv
caucgggaaauuccauggcgug

SEQ ID NO: 28772 - RNA, 21 nt, Mycobacterium tuberculosis H37Rv
caucuugaucaccccggcgac

SEQ ID NO: 28773 - RNA, 22 nt, Mycobacterium tuberculosis H37Rv
caugcccgguagcucguugcgc

SEQ ID NO: 28774 - RNA, 22 nt, Mycobacterium tuberculosis H37Rv
cauggcagguuuucgacgaugg

SEQ ID NO: 28775 - RNA, 22 nt, Mycobacterium tuberculosis H37Rv
caugucgcugcuguacaucggc

SEQ ID NO: 28776 - RNA, 22 nt, Mycobacterium tuberculosis H37Rv
ccaagguggccgaucugcgccg

SEQ ID NO: 28777 - RNA, 22 nt, Mycobacterium tuberculosis H37Rv
ccaccgauugugucgaugcgca

SEQ ID NO: 28778 - RNA, 22 nt, Mycobacterium tuberculosis H37Rv
ccacgcugagccguggcgaauu

SEQ ID NO: 28779 - RNA, 23 nt, Mycobacterium tuberculosis H37Rv
ccacucuggagauucucgcugag

SEQ ID NO: 28780 - RNA, 22 nt, Mycobacterium tuberculosis H37Rv
ccagauacugcagggaaucggg

SEQ ID NO: 28781 - RNA, 22 nt, Mycobacterium tuberculosis H37Rv
ccagcucaucgccguagcugag

SEQ ID NO: 28782 - RNA, 22 nt, Mycobacterium tuberculosis H37Rv
ccaggugcuugccauggcaguu

SEQ ID NO: 28783 - RNA, 22 nt, Mycobacterium tuberculosis H37Rv
ccaucagcaccgucgugccggu

SEQ ID NO: 28784 - RNA, 22 nt, Mycobacterium tuberculosis H37Rv
ccaucgccagcgucgacgugcc

SEQ ID NO: 28785 - RNA, 22 nt, Mycobacterium tuberculosis H37Rv
ccaugagcacccggauggccug

SEQ ID NO: 28786 - RNA, 22 nt, Mycobacterium tuberculosis H37Rv
ccaugucgacgugaucgcugug

SEQ ID NO: 28787 - RNA, 22 nt, Mycobacterium tuberculosis H37Rv
cccagucgugcucgcucucggc

SEQ ID NO: 28788 - RNA, 22 nt, Mycobacterium tuberculosis H37Rv
cccgaagacgaccccggugaca

SEQ ID NO: 28789 - RNA, 22 nt, Mycobacterium tuberculosis H37Rv
cccgauccacggugaccagggg

SEQ ID NO: 28790 - RNA, 22 nt, Mycobacterium tuberculosis H37Rv
cccgcgaagccgccugcugcac

SEQ ID NO: 28791 - RNA, 22 nt, Mycobacterium tuberculosis H37Rv
cccggguuugaccacgaugcug

SEQ ID NO: 28792 - RNA, 22 nt, Mycobacterium tuberculosis H37Rv
cccgguguugaagaagcccgac

SEQ ID NO: 28793 - RNA, 22 nt, Mycobacterium tuberculosis H37Rv
cccgguugaccgaagccggacu

SEQ ID NO: 28794 - RNA, 22 nt, Mycobacterium tuberculosis H37Rv
cccguacggcucgucacgcacc

SEQ ID NO: 28795 - RNA, 22 nt, Mycobacterium tuberculosis H37Rv
cccugcuggagaucugcgcggu

SEQ ID NO: 28796 - RNA, 22 nt, Mycobacterium tuberculosis H37Rv
cccugguugcacguucggcgug

SEQ ID NO: 28797 - RNA, 22 nt, Mycobacterium tuberculosis H37Rv
ccgaacgugaacucacggcgga

SEQ ID NO: 28798 - RNA, 22 nt, Mycobacterium tuberculosis H37Rv
ccgaacgugaacugagggcgga

SEQ ID NO: 28799 - RNA, 22 nt, Mycobacterium tuberculosis H37Rv
ccgaacgugcaaccacggcggc

SEQ ID NO: 28800 - RNA, 22 nt, Mycobacterium tuberculosis H37Rv
ccgaccguguuaaccgcgcggg

SEQ ID NO: 28801 - RNA, 22 nt, Mycobacterium tuberculosis H37Rv
ccgaccguucgaagauguggaa

SEQ ID NO: 28802 - RNA, 20 nt, Mycobacterium tuberculosis H37Rv
cgcuggucguugaugcgcag

SEQ ID NO: 28803 - RNA, 22 nt, Mycobacterium tuberculosis H37Rv
cgcugguggaauucgagcgcuc

SEQ ID NO: 28804 - RNA, 22 nt, Mycobacterium tuberculosis H37Rv
cgcugucgauacagcgucagca

SEQ ID NO: 28805 - RNA, 22 nt, Mycobacterium tuberculosis H37Rv
cgcuugaugcccggucggcaag

SEQ ID NO: 28806 - RNA, 19 nt, Mycobacterium tuberculosis H37Rv
cggaaucgaagcacgcucc

SEQ ID NO: 28807 - RNA, 22 nt, Mycobacterium tuberculosis H37Rv
cggacaccagcggccaccgauu

SEQ ID NO: 28808 - RNA, 22 nt, Mycobacterium tuberculosis H37Rv
cggaccaugguguuggccgguu

SEQ ID NO: 28809 - RNA, 22 nt, Mycobacterium tuberculosis H37Rv
cggacguggaaaauguggucgu

SEQ ID NO: 28810 - RNA, 22 nt, Mycobacterium tuberculosis H37Rv
cggacucuggugaugguguggu

SEQ ID NO: 28811 - RNA, 22 nt, Mycobacterium tuberculosis H37Rv
cggagcgacgucgcgaugguca

SEQ ID NO: 28812 - RNA, 22 nt, Mycobacterium tuberculosis H37Rv
cggaugcgaguggugaguucuu

SEQ ID NO: 28813 - RNA, 22 nt, Mycobacterium tuberculosis H37Rv
cggcaaugugggcguugccggc

SEQ ID NO: 28814 - RNA, 22 nt, Mycobacterium tuberculosis H37Rv
cggccguaucgucgugcagauc

SEQ ID NO: 28815 - RNA, 22 nt, Mycobacterium tuberculosis H37Rv
cggcgcuacuggcggugagagc

SEQ ID NO: 28816 - RNA, 22 nt, Mycobacterium tuberculosis H37Rv
cggcugauccccaucgagggca

SEQ ID NO: 28817 - RNA, 22 nt, Mycobacterium tuberculosis H37Rv
cggcuucugcaccagcggguca

SEQ ID NO: 28818 - RNA, 22 nt, Mycobacterium tuberculosis H37Rv
cgggcgaucaaagccagcaccu

SEQ ID NO: 28819 - RNA, 22 nt, Mycobacterium tuberculosis H37Rv
cgguccuacgcgugcucgucga

SEQ ID NO: 28820 - RNA, 22 nt, Mycobacterium tuberculosis H37Rv
cggucggucaaggucgcgugca

SEQ ID NO: 28821 - RNA, 22 nt, Mycobacterium tuberculosis H37Rv
cggugcacaccaucgcccagua

SEQ ID NO: 28822 - RNA, 21 nt, Mycobacterium tuberculosis H37Rv
cggugcuguucgagcuuuaug

SEQ ID NO: 28823 - RNA, 22 nt, Mycobacterium tuberculosis H37Rv
cgguggaugcggugcucgccgg

SEQ ID NO: 28824 - RNA, 22 nt, Mycobacterium tuberculosis H37Rv
cgguggauucccggccugcaca

SEQ ID NO: 28825 - RNA, 22 nt, Mycobacterium tuberculosis H37Rv
cgguggcuuuugcgucugcucg

SEQ ID NO: 28826 - RNA, 20 nt, Mycobacterium tuberculosis H37Rv
cggugucgccgugcuugccg

SEQ ID NO: 28827 - RNA, 22 nt, Mycobacterium tuberculosis H37Rv
cgguugcggugccagccaaccg

SEQ ID NO: 28828 - RNA, 22 nt, Mycobacterium tuberculosis H37Rv
cguaccgccugcacgccgggcc

SEQ ID NO: 28829 - RNA, 22 nt, Mycobacterium tuberculosis H37Rv
cguccgguugggauugucgagg

SEQ ID NO: 28830 - RNA, 22 nt, Mycobacterium tuberculosis H37Rv
cgucgaccagugagguggcaac

SEQ ID NO: 28831 - RNA, 22 nt, Mycobacterium tuberculosis H37Rv
cgucgagcagguagcgcacggc

SEQ ID NO: 28832 - RNA, 22 nt, Mycobacterium tuberculosis H37Rv
cgucgauguugaacggagcggu

SEQ ID NO: 28833 - RNA, 22 nt, Mycobacterium tuberculosis H37Rv
cgucggcacgcccaacgaggug

SEQ ID NO: 28834 - RNA, 22 nt, Mycobacterium tuberculosis H37Rv
cgucgggaucuccagcacgucc

SEQ ID NO: 28835 - RNA, 22 nt, Mycobacterium tuberculosis H37Rv
cgucguccuuuccgugggggua

SEQ ID NO: 28836 - RNA, 22 nt, Mycobacterium tuberculosis H37Rv
cgucgugaccugccggccggac

SEQ ID NO: 28837 - RNA, 22 nt, Mycobacterium tuberculosis H37Rv
cgucgugauugucaugcaacca

SEQ ID NO: 28838 - RNA, 22 nt, Mycobacterium tuberculosis H37Rv
cgugagcagacgcaaagucgcc

SEQ ID NO: 28839 - RNA, 22 nt, Mycobacterium tuberculosis H37Rv
cgugaucgugugccucggcugg

SEQ ID NO: 28840 - RNA, 22 nt, Mycobacterium tuberculosis H37Rv
cgugaugguggccgugcagucg

SEQ ID NO: 28841 - RNA, 22 nt, Mycobacterium tuberculosis H37Rv
cgugauugugcccggcaccagc

SEQ ID NO: 28842 - RNA, 22 nt, Mycobacterium tuberculosis H37Rv
cguggauuuugaggcgcaccgg

SEQ ID NO: 28843 - RNA, 21 nt, Mycobacterium tuberculosis H37Rv
cguggugcacgccaugcuggc

SEQ ID NO: 28844 - RNA, 22 nt, Mycobacterium tuberculosis H37Rv
cguuggccggcgcugcgggugu

SEQ ID NO: 28845 - RNA, 22 nt, Mycobacterium tuberculosis H37Rv
cuccgaugguggcacggggcug

SEQ ID NO: 28846 - RNA, 22 nt, Mycobacterium tuberculosis H37Rv
cuccgcaguccuuuaggggaca

SEQ ID NO: 28847 - RNA, 22 nt, Mycobacterium tuberculosis H37Rv
cuccguuggccccggugccggg

SEQ ID NO: 28848 - RNA, 22 nt, Mycobacterium tuberculosis H37Rv
cucgaguggucugggcucgacc

SEQ ID NO: 28849 - RNA, 22 nt, Mycobacterium tuberculosis H37Rv
cucgaugaugucguugacgucg

SEQ ID NO: 28850 - RNA, 19 nt, Mycobacterium tuberculosis H37Rv
cucgcgguguuuuccgacc

SEQ ID NO: 28851 - RNA, 22 nt, Mycobacterium tuberculosis H37Rv
cucgggucggguucgccgucga

SEQ ID NO: 28852 - RNA, 22 nt, Mycobacterium tuberculosis H37Rv
cucggugucaaggcgauuagcg

SEQ ID NO: 28853 - RNA, 22 nt, Mycobacterium tuberculosis H37Rv
cucgucguucuacugcccgcga

SEQ ID NO: 28854 - RNA, 22 nt, Mycobacterium tuberculosis H37Rv
cucuggccaaggugucgagcac

SEQ ID NO: 28855 - RNA, 22 nt, Mycobacterium tuberculosis H37Rv
cucugggaccuggaccggcgga

SEQ ID NO: 28856 - RNA, 22 nt, Mycobacterium tuberculosis H37Rv
cugaaugccuauaucgcggcca

SEQ ID NO: 28857 - RNA, 22 nt, Mycobacterium tuberculosis H37Rv
cugacgucgaucucgaugcguc

SEQ ID NO: 28858 - RNA, 22 nt, Mycobacterium tuberculosis H37Rv
cugcacgacagcgucgaagucg

SEQ ID NO: 28859 - RNA, 22 nt, Mycobacterium tuberculosis H37Rv
cugcgacugugaaucucacgac

SEQ ID NO: 28860 - RNA, 22 nt, Mycobacterium tuberculosis H37Rv
cugcgcaucgaggccggcgacg

SEQ ID NO: 28861 - RNA, 19 nt, Mycobacterium tuberculosis H37Rv
cugcgcgacaacgaacccg

SEQ ID NO: 28862 - RNA, 22 nt, Mycobacterium tuberculosis H37Rv
cugcggagaucuaccagcucga

SEQ ID NO: 28863 - RNA, 22 nt, Mycobacterium tuberculosis H37Rv
cugcuggccagcguugcgcugu

SEQ ID NO: 28864 - RNA, 22 nt, Mycobacterium tuberculosis H37Rv
cuggccaucgagggcaucgggc

SEQ ID NO: 28865 - RNA, 22 nt, Mycobacterium tuberculosis H37Rv
cuggccguggugugucgcgcau

SEQ ID NO: 28866 - RNA, 22 nt, Mycobacterium tuberculosis H37Rv
cuggcgauaucagacguucgac

SEQ ID NO: 28867 - RNA, 22 nt, Mycobacterium tuberculosis H37Rv
cuggcgaucaccgugcgccgca

SEQ ID NO: 28868 - RNA, 22 nt, Mycobacterium tuberculosis H37Rv
cuggcgcuguugggacgcccgu

SEQ ID NO: 28869 - RNA, 22 nt, Mycobacterium tuberculosis H37Rv
cuggcgguuuggcugcuguuga

SEQ ID NO: 28870 - RNA, 22 nt, Mycobacterium tuberculosis H37Rv
cugggcacugaauaccggccag

SEQ ID NO: 28871 - RNA, 22 nt, Mycobacterium tuberculosis H37Rv
cuggguucgacccaguccaagc

SEQ ID NO: 28872 - RNA, 22 nt, Mycobacterium tuberculosis H37Rv
cuggucuguaaucggugcccgg

SEQ ID NO: 28873 - RNA, 22 nt, Mycobacterium tuberculosis H37Rv
cuguccgcgcgcacaccaacgg

SEQ ID NO: 28874 - RNA, 22 nt, Mycobacterium tuberculosis H37Rv
cugugcaucgucgccggcgcga

SEQ ID NO: 28875 - RNA, 22 nt, Mycobacterium tuberculosis H37Rv
cuucgacgauaagggccggccg

SEQ ID NO: 28876 - RNA, 23 nt, Mycobacterium tuberculosis H37Rv
cuucgcgacugggagaaccacug

SEQ ID NO: 28877 - RNA, 22 nt, Mycobacterium tuberculosis H37Rv
gaaauugggcgauuuugcgucu

SEQ ID NO: 28878 - RNA, 22 nt, Mycobacterium tuberculosis H37Rv
gaaccuggcacggcgggcugca

SEQ ID NO: 28879 - RNA, 22 nt, Mycobacterium tuberculosis H37Rv
gaacgucucgugcuuggguggg

SEQ ID NO: 28880 - RNA, 22 nt, Mycobacterium tuberculosis H37Rv
gaagcgcucggguugcaacgua

SEQ ID NO: 28881 - RNA, 22 nt, Mycobacterium tuberculosis H37Rv
gccgagaaagucgaccugcgag

SEQ ID NO: 28882 - RNA, 22 nt, Mycobacterium tuberculosis H37Rv
gccgaguugcgucgcugggauc

SEQ ID NO: 28883 - RNA, 22 nt, Mycobacterium tuberculosis H37Rv
gccgauuaucgagauggcgucg

SEQ ID NO: 28884 - RNA, 19 nt, Mycobacterium tuberculosis H37Rv
gccgggaaucgugcuuggc

SEQ ID NO: 28885 - RNA, 22 nt, Mycobacterium tuberculosis H37Rv
gccguacgucuucgaugcugac

SEQ ID NO: 28886 - RNA, 22 nt, Mycobacterium tuberculosis H37Rv
gccugcaaaauguugaucucac

SEQ ID NO: 28887 - RNA, 20 nt, Mycobacterium tuberculosis H37Rv
gccugcagaacguugaucuc

SEQ ID NO: 28888 - RNA, 22 nt, Mycobacterium tuberculosis H37Rv
gccugcuggcaccgaaucuguu

SEQ ID NO: 28889 - RNA, 22 nt, Mycobacterium tuberculosis H37Rv
gccuggucaccgugccgaaggu

SEQ ID NO: 28890 - RNA, 22 nt, Mycobacterium tuberculosis H37Rv
gccuucgacucggcgccgagcg

SEQ ID NO: 28891 - RNA, 22 nt, Mycobacterium tuberculosis H37Rv
gccuugcugggaucggucagcu

SEQ ID NO: 28892 - RNA, 22 nt, Mycobacterium tuberculosis H37Rv
gcgaaccgggugaaccugcccu

SEQ ID NO: 28893 - RNA, 22 nt, Mycobacterium tuberculosis H37Rv
gcgaauccgggucaccgugcac

SEQ ID NO: 28894 - RNA, 22 nt, Mycobacterium tuberculosis H37Rv
gcgacagcggagucgaugccga

SEQ ID NO: 28895 - RNA, 22 nt, Mycobacterium tuberculosis H37Rv
gcgacagugaugcccagucugc

SEQ ID NO: 28896 - RNA, 22 nt, Mycobacterium tuberculosis H37Rv
gcgaccaccguuugagcggcca

SEQ ID NO: 28897 - RNA, 22 nt, Mycobacterium tuberculosis H37Rv
gcgaccgugaaucuggcgacgc

SEQ ID NO: 28898 - RNA, 22 nt, Mycobacterium tuberculosis H37Rv
gcgacgucaugaucgcgcuggg

SEQ ID NO: 28899 - RNA, 22 nt, Mycobacterium tuberculosis H37Rv
gcgagcguaacgccacggcgaa

SEQ ID NO: 28900 - RNA, 22 nt, Mycobacterium tuberculosis H37Rv
gcgagcuggaaugcggugugcu

SEQ ID NO: 28901 - RNA, 22 nt, Mycobacterium tuberculosis H37Rv
gcgauagccgaaccacccgccg

SEQ ID NO: 28902 - RNA, 22 nt, Mycobacterium tuberculosis H37Rv
gcgauccggauuccggggaaga

SEQ ID NO: 28903 - RNA, 22 nt, Mycobacterium tuberculosis H37Rv
gcgaucgacgacagcccgauca

SEQ ID NO: 28904 - RNA, 22 nt, Mycobacterium tuberculosis H37Rv
gcgaugcgcgauuacgucgaac

SEQ ID NO: 28905 - RNA, 20 nt, Mycobacterium tuberculosis H37Rv
gcgauucugacuugcccagc

SEQ ID NO: 28906 - RNA, 21 nt, Mycobacterium tuberculosis H37Rv
gcgauucugcgucugcucgcc

SEQ ID NO: 28907 - RNA, 22 nt, Mycobacterium tuberculosis H37Rv
gcgcacgauuucaaaucuaagg

SEQ ID NO: 28908 - RNA, 22 nt, Mycobacterium tuberculosis H37Rv
gcgccgaacgugcccugguggc

SEQ ID NO: 28909 - RNA, 22 nt, Mycobacterium tuberculosis H37Rv
gcgcuggucggaauuccucgaa

SEQ ID NO: 28910 - RNA, 22 nt, Mycobacterium tuberculosis H37Rv
gcgcuguggcucacgacgacga

SEQ ID NO: 28911 - RNA, 22 nt, Mycobacterium tuberculosis H37Rv
gcggacagaauacgcugccgau

SEQ ID NO: 28912 - RNA, 22 nt, Mycobacterium tuberculosis H37Rv
gcggacgucgaugucgagcugu

SEQ ID NO: 28913 - RNA, 22 nt, Mycobacterium tuberculosis H37Rv
gcggaguccuugcucaccauga

SEQ ID NO: 28914 - RNA, 22 nt, Mycobacterium tuberculosis H37Rv
gcggaucgacaaccaguugcgu

SEQ ID NO: 28915 - RNA, 22 nt, Mycobacterium tuberculosis H37Rv
gcggauuggaucaaggugaugg

SEQ ID NO: 28916 - RNA, 22 nt, Mycobacterium tuberculosis H37Rv
gcggcaguucgccaguggcgag

SEQ ID NO: 28917 - RNA, 21 nt, Mycobacterium tuberculosis H37Rv
gcggcguucagguugagcagg

SEQ ID NO: 28918 - RNA, 22 nt, Mycobacterium tuberculosis H37Rv
gcggcuucuuacgagcaguugu

SEQ ID NO: 28919 - RNA, 22 nt, Mycobacterium tuberculosis H37Rv
gcgggaucgagaugcuccagca

SEQ ID NO: 28920 - RNA, 22 nt, Mycobacterium tuberculosis H37Rv
gcggucgauguuccguugguga

SEQ ID NO: 28921 - RNA, 22 nt, Mycobacterium tuberculosis H37Rv
gcggugaccgggucguggauau

SEQ ID NO: 28922 - RNA, 22 nt, Mycobacterium tuberculosis H37Rv
gcgguggaucucggcgccgauu

SEQ ID NO: 28923 - RNA, 22 nt, Mycobacterium tuberculosis H37Rv
gcgguguccgcguucgggauga

SEQ ID NO: 28924 - RNA, 21 nt, Mycobacterium tuberculosis H37Rv
gcgguugauuggucuucgguc

SEQ ID NO: 28925 - RNA, 22 nt, Mycobacterium tuberculosis H37Rv
gcgucgagacgaagcucaacaa

SEQ ID NO: 28926 - RNA, 22 nt, Mycobacterium tuberculosis H37Rv
gcgugaacugagggcggaaaau

SEQ ID NO: 28927 - RNA, 22 nt, Mycobacterium tuberculosis H37Rv
gcguggacaagugcuugugcua

SEQ ID NO: 28928 - RNA, 22 nt, Mycobacterium tuberculosis H37Rv
gcgugguacggugguguaccgu

SEQ ID NO: 28929 - RNA, 22 nt, Mycobacterium tuberculosis H37Rv
gcguucguuucaagcggaucga

SEQ ID NO: 28930 - RNA, 22 nt, Mycobacterium tuberculosis H37Rv
gcguugaacugauaggugcggc

SEQ ID NO: 28931 - RNA, 21 nt, Mycobacterium tuberculosis H37Rv
gcuaccgcgcccgugagcgcc

SEQ ID NO: 28932 - RNA, 20 nt, Mycobacterium tuberculosis H37Rv
gcuaccggcauuauucagcc

SEQ ID NO: 28933 - RNA, 23 nt, Mycobacterium tuberculosis H37Rv
gcuacuggcggcgagagcgucgg

SEQ ID NO: 28934 - RNA, 22 nt, Mycobacterium tuberculosis H37Rv
gcucaucgcaguguucugcugg

SEQ ID NO: 28935 - RNA, 21 nt, Mycobacterium tuberculosis H37Rv
gcucccgaucucccggggaga

SEQ ID NO: 28936 - RNA, 22 nt, Mycobacterium tuberculosis H37Rv
gcuccuuggacuacggcugugu

SEQ ID NO: 28937 - RNA, 22 nt, Mycobacterium tuberculosis H37Rv
gcucggaucaucaucuuguccg

SEQ ID NO: 28938 - RNA, 22 nt, Mycobacterium tuberculosis H37Rv
gcugacaucgucgaacaccagg

SEQ ID NO: 28939 - RNA, 22 nt, Mycobacterium tuberculosis H37Rv
gcugacucgguuuggugcgacg

SEQ ID NO: 28940 - RNA, 22 nt, Mycobacterium tuberculosis H37Rv
gcugaugcggugacgguggccg

SEQ ID NO: 28941 - RNA, 22 nt, Mycobacterium tuberculosis H37Rv
gcugcagcggcucguggguggu

SEQ ID NO: 28942 - RNA, 22 nt, Mycobacterium tuberculosis H37Rv
gcuggaauucuuuggauucgcc

SEQ ID NO: 28943 - RNA, 22 nt, Mycobacterium tuberculosis H37Rv
gcuggacguucgucggcggccc

SEQ ID NO: 28944 - RNA, 22 nt, Mycobacterium tuberculosis H37Rv
gcuggugagugcggcgaccgcu

SEQ ID NO: 28945 - RNA, 22 nt, Mycobacterium tuberculosis H37Rv
gcuggugccggacgacgucgca

SEQ ID NO: 28946 - RNA, 22 nt, Mycobacterium tuberculosis H37Rv
gcugucaacggggguagcgcug

SEQ ID NO: 28947 - RNA, 22 nt, Mycobacterium tuberculosis H37Rv
gcuguccuguggcgcccgcagc

SEQ ID NO: 28948 - RNA, 22 nt, Mycobacterium tuberculosis H37Rv
gcugugccgagggcuucgcugg

SEQ ID NO: 28949 - RNA, 22 nt, Mycobacterium tuberculosis H37Rv
ggacaugaccgaacacgguugg

SEQ ID NO: 28950 - RNA, 22 nt, Mycobacterium tuberculosis H37Rv
ggaccaccgugaagaucgucca

SEQ ID NO: 28951 - RNA, 22 nt, Mycobacterium tuberculosis H37Rv
ggacugccaacuucggguuguu

SEQ ID NO: 28952 - RNA, 19 nt, Mycobacterium tuberculosis H37Rv
ggagugcccggugccggcg

SEQ ID NO: 28953 - RNA, 22 nt, Mycobacterium tuberculosis H37Rv
ggaugcaccggccagcaugaag

SEQ ID NO: 28954 - RNA, 21 nt, Mycobacterium tuberculosis H37Rv
ggaugccguaaccgauugccc

SEQ ID NO: 28955 - RNA, 22 nt, Mycobacterium tuberculosis H37Rv
ggauucgggucuuggugagccg

SEQ ID NO: 28956 - RNA, 22 nt, Mycobacterium tuberculosis H37Rv
ggcaacuccgggguggccagca

SEQ ID NO: 28957 - RNA, 22 nt, Mycobacterium tuberculosis H37Rv
ggcaggugcgcuaggucccggu

SEQ ID NO: 28958 - RNA, 22 nt, Mycobacterium tuberculosis H37Rv
ggcaugagucgaagccucaacg

SEQ ID NO: 28959 - RNA, 21 nt, Mycobacterium tuberculosis H37Rv
ggccaucgcugcuugcugcgc

SEQ ID NO: 28960 - RNA, 22 nt, Mycobacterium tuberculosis H37Rv
gugcagcgagcgcacuggccgu

SEQ ID NO: 28961 - RNA, 22 nt, Mycobacterium tuberculosis H37Rv
gugcagguucguacuggcaugc

SEQ ID NO: 28962 - RNA, 22 nt, Mycobacterium tuberculosis H37Rv
gugccgacgacgugguguucag

SEQ ID NO: 28963 - RNA, 22 nt, Mycobacterium tuberculosis H37Rv
gugccgagcgugcaucuggggc

SEQ ID NO: 28964 - RNA, 22 nt, Mycobacterium tuberculosis H37Rv
gugccgugggucggcaauagca

SEQ ID NO: 28965 - RNA, 22 nt, Mycobacterium tuberculosis H37Rv
gugcgucaccggaucaaagaca

SEQ ID NO: 28966 - RNA, 22 nt, Mycobacterium tuberculosis H37Rv
gugcucaugaccggccaaugcg

SEQ ID NO: 28967 - RNA, 22 nt, Mycobacterium tuberculosis H37Rv
gugcugcagcgcggugagggcc

SEQ ID NO: 28968 - RNA, 22 nt, Mycobacterium tuberculosis H37Rv
guggcacaccacccgacgucgc

SEQ ID NO: 28969 - RNA, 22 nt, Mycobacterium tuberculosis H37Rv
guggccaccaacgccgagggcg

SEQ ID NO: 28970 - RNA, 22 nt, Mycobacterium tuberculosis H37Rv
guggccgaacguggucauggcc

SEQ ID NO: 28971 - RNA, 22 nt, Mycobacterium tuberculosis H37Rv
guggccgucgaccaccgugacg

SEQ ID NO: 28972 - RNA, 22 nt, Mycobacterium tuberculosis H37Rv
guggcgacaagagccguaaacu

SEQ ID NO: 28973 - RNA, 22 nt, Mycobacterium tuberculosis H37Rv
guggcgaccgacguugucgcgg

SEQ ID NO: 28974 - RNA, 19 nt, Mycobacterium tuberculosis H37Rv
guggcucgccugaucaccu

SEQ ID NO: 28975 - RNA, 22 nt, Mycobacterium tuberculosis H37Rv
gugucggcggcaacgccgugcu

SEQ ID NO: 28976 - RNA, 22 nt, Mycobacterium tuberculosis H37Rv
gugugagccugacagcccgaca

SEQ ID NO: 28977 - RNA, 22 nt, Mycobacterium tuberculosis H37Rv
guguggcagucgcugcggcaug

SEQ ID NO: 28978 - RNA, 23 nt, Mycobacterium tuberculosis H37Rv
guuccgucaccgaagacgucgcc

SEQ ID NO: 28979 - RNA, 22 nt, Mycobacterium tuberculosis H37Rv
guucguagagcgccucggcgcg

SEQ ID NO: 28980 - RNA, 22 nt, Mycobacterium tuberculosis H37Rv
guugaagcuggaaaucuggccg

SEQ ID NO: 28981 - RNA, 22 nt, Mycobacterium tuberculosis H37Rv
guugacucugcguccaccaggc

SEQ ID NO: 28982 - RNA, 22 nt, Mycobacterium tuberculosis H37Rv
guugaucagcuuguugagcugc

SEQ ID NO: 28983 - RNA, 22 nt, Mycobacterium tuberculosis H37Rv
guugcccgagggugcgaccuug

SEQ ID NO: 28984 - RNA, 17 nt, Mycobacterium tuberculosis H37Rv
guugccggugggacgga

SEQ ID NO: 28985 - RNA, 22 nt, Mycobacterium tuberculosis H37Rv
guugggcagcgucacggucguc

SEQ ID NO: 28986 - RNA, 22 nt, Mycobacterium tuberculosis H37Rv
guuucgcugucgcuggccgugu

SEQ ID NO: 28987 - RNA, 22 nt, Mycobacterium tuberculosis H37Rv
uaacagucugccaggaaucgcc

SEQ ID NO: 28988 - RNA, 22 nt, Mycobacterium tuberculosis H37Rv
uaaccgcauacgaugucgcugc

SEQ ID NO: 28989 - RNA, 22 nt, Mycobacterium tuberculosis H37Rv
uaaccggacgugaccagaucac

SEQ ID NO: 28990 - RNA, 22 nt, Mycobacterium tuberculosis H37Rv
uaaugcgauucugcgucugcuu

SEQ ID NO: 28991 - RNA, 22 nt, Mycobacterium tuberculosis H37Rv
uacccagguugaaguugccgau

SEQ ID NO: 28992 - RNA, 22 nt, Mycobacterium tuberculosis H37Rv
uacccggucgguguucgaccau

SEQ ID NO: 28993 - RNA, 22 nt, Mycobacterium tuberculosis H37Rv
uaccggcggcaacggcgcugac

SEQ ID NO: 28994 - RNA, 22 nt, Mycobacterium tuberculosis H37Rv
uacggaccgaucaugacgaugc

SEQ ID NO: 28995 - RNA, 22 nt, Mycobacterium tuberculosis H37Rv
uacggcauggucuuucugcugc

SEQ ID NO: 28996 - RNA, 23 nt, Mycobacterium tuberculosis H37Rv
uacggcgucacgauguugaaggc

SEQ ID NO: 28997 - RNA, 22 nt, Mycobacterium tuberculosis H37Rv
uacguugcaacccgagcgcuuc

SEQ ID NO: 28998 - RNA, 22 nt, Mycobacterium tuberculosis H37Rv
uacugcugcagcgucugccgca

SEQ ID NO: 28999 - RNA, 22 nt, Mycobacterium tuberculosis H37Rv
uagaccggcaaacgugacggca

SEQ ID NO: 29000 - RNA, 22 nt, Mycobacterium tuberculosis H37Rv
uagaccggcuguucgguggccg

SEQ ID NO: 29001 - RNA, 22 nt, Mycobacterium tuberculosis H37Rv
uagcccaguucacgugccaaau

SEQ ID NO: 29002 - RNA, 22 nt, Mycobacterium tuberculosis H37Rv
uagccgacaucgccggcgccuu

SEQ ID NO: 29003 - RNA, 22 nt, Mycobacterium tuberculosis H37Rv
uagcgcgcauugagacuuucaa

SEQ ID NO: 29004 - RNA, 22 nt, Mycobacterium tuberculosis H37Rv
uaucgugggaugcgcuacuccu

SEQ ID NO: 29005 - RNA, 22 nt, Mycobacterium tuberculosis H37Rv
uauguucaauaaaucauuaugu

SEQ ID NO: 29006 - RNA, 22 nt, Mycobacterium tuberculosis H37Rv
ucaccgccgcgguuggugcgca

SEQ ID NO: 29007 - RNA, 22 nt, Mycobacterium tuberculosis H37Rv
ucaccggacugcgcgaauugau

SEQ ID NO: 29008 - RNA, 22 nt, Mycobacterium tuberculosis H37Rv
ucaccgggaugcacgucgaguu

SEQ ID NO: 29009 - RNA, 19 nt, Mycobacterium tuberculosis H37Rv
ucacgcgguuguucuacga

SEQ ID NO: 29010 - RNA, 22 nt, Mycobacterium tuberculosis H37Rv
ucagcgucgaugaccaugucga

SEQ ID NO: 29011 - RNA, 22 nt, Mycobacterium tuberculosis H37Rv
ucagcuaccaaggcaacgacau

SEQ ID NO: 29012 - RNA, 22 nt, Mycobacterium tuberculosis H37Rv
ucaguugugcggccugaccggg

SEQ ID NO: 29013 - RNA, 18 nt, Mycobacterium tuberculosis H37Rv
ucaucgagcacggguuga

SEQ ID NO: 29014 - RNA, 20 nt, Mycobacterium tuberculosis H37Rv
ucaucgugucuucgggcgcc

SEQ ID NO: 29015 - RNA, 22 nt, Mycobacterium tuberculosis H37Rv
ucaugcggcccgagccagacga

SEQ ID NO: 29016 - RNA, 22 nt, Mycobacterium tuberculosis H37Rv
uccaucgguuccugcucgaagc

SEQ ID NO: 29017 - RNA, 22 nt, Mycobacterium tuberculosis H37Rv
ucccgacguuucguucgguguc

SEQ ID NO: 29018 - RNA, 22 nt, Mycobacterium tuberculosis H37Rv
ucccgcugaccugcuguguuag

SEQ ID NO: 29019 - RNA, 22 nt, Mycobacterium tuberculosis H37Rv
uccgcgucacaagauccgcucg

SEQ ID NO: 29020 - RNA, 22 nt, Mycobacterium tuberculosis H37Rv
uccgcugaccgagggcugggcu

SEQ ID NO: 29021 - RNA, 22 nt, Mycobacterium tuberculosis H37Rv
uccgggugaauaccgccauguc

SEQ ID NO: 29022 - RNA, 22 nt, Mycobacterium tuberculosis H37Rv
uccgucaaacguugaaucgacu

SEQ ID NO: 29023 - RNA, 22 nt, Mycobacterium tuberculosis H37Rv
uccgucggugauccuggccacc

SEQ ID NO: 29024 - RNA, 22 nt, Mycobacterium tuberculosis H37Rv
uccgugauggaacgucuggaga

SEQ ID NO: 29025 - RNA, 22 nt, Mycobacterium tuberculosis H37Rv
uccgugucaugcggcggaucug

SEQ ID NO: 29026 - RNA, 22 nt, Mycobacterium tuberculosis H37Rv
uccgugugucacgacgucgccu

SEQ ID NO: 29027 - RNA, 22 nt, Mycobacterium tuberculosis H37Rv
uccguugcaacaccuucggaug

SEQ ID NO: 29028 - RNA, 22 nt, Mycobacterium tuberculosis H37Rv
uccucagucguugacagcgcuc

SEQ ID NO: 29029 - RNA, 22 nt, Mycobacterium tuberculosis H37Rv
ucgaacauccacagcgccgcgg

SEQ ID NO: 29030 - RNA, 22 nt, Mycobacterium tuberculosis H37Rv
ucgaacgugaacggcuggaguc

SEQ ID NO: 29031 - RNA, 23 nt, Mycobacterium tuberculosis H37Rv
ucgaaggaaaugacgcaaugacc

SEQ ID NO: 29032 - RNA, 21 nt, Mycobacterium tuberculosis H37Rv
ucgaaggaucacgcgaugacc

SEQ ID NO: 29033 - RNA, 22 nt, Mycobacterium tuberculosis H37Rv
ucgacaaaacgcgguauccgcc

SEQ ID NO: 29034 - RNA, 22 nt, Mycobacterium tuberculosis H37Rv
ucgaccaagccaagcguguugu

SEQ ID NO: 29035 - RNA, 22 nt, Mycobacterium tuberculosis H37Rv
ucgaccgugacggcaggggcgu

SEQ ID NO: 29036 - RNA, 23 nt, Mycobacterium tuberculosis H37Rv
ucgacggacguggucgcgcuaug

SEQ ID NO: 29037 - RNA, 22 nt, Mycobacterium tuberculosis H37Rv
ucgacgguguaacccgccgcga

SEQ ID NO: 29038 - RNA, 22 nt, Mycobacterium tuberculosis H37Rv
ucgagacgauuugucggcagau

SEQ ID NO: 29039 - RNA, 22 nt, Mycobacterium tuberculosis H37Rv
ugcaccgucgccgaccaucacu

SEQ ID NO: 29040 - RNA, 22 nt, Mycobacterium tuberculosis H37Rv
ugcacggcgaugcggucuggca

SEQ ID NO: 29041 - RNA, 22 nt, Mycobacterium tuberculosis H37Rv
ugcagaauccguucgacgaguu

SEQ ID NO: 29042 - RNA, 22 nt, Mycobacterium tuberculosis H37Rv
ugcagcuagcaccggcggauuu

SEQ ID NO: 29043 - RNA, 22 nt, Mycobacterium tuberculosis H37Rv
ugccagccgccgacgagcagca

SEQ ID NO: 29044 - RNA, 22 nt, Mycobacterium tuberculosis H37Rv
ugccaguaccucucgaugccaa

SEQ ID NO: 29045 - RNA, 22 nt, Mycobacterium tuberculosis H37Rv
ugcccgucgccaaguacgacug

SEQ ID NO: 29046 - RNA, 22 nt, Mycobacterium tuberculosis H37Rv
ugccgacuguggauccugcgac

SEQ ID NO: 29047 - RNA, 22 nt, Mycobacterium tuberculosis H37Rv
ugccgauugugaaucuggcgac

SEQ ID NO: 29048 - RNA, 22 nt, Mycobacterium tuberculosis H37Rv
ugccgcauucuucagcucgucg

SEQ ID NO: 29049 - RNA, 22 nt, Mycobacterium tuberculosis H37Rv
ugccgcuggauccggaagccgu

SEQ ID NO: 29050 - RNA, 22 nt, Mycobacterium tuberculosis H37Rv
ugccgucacuggugucggccgg

SEQ ID NO: 29051 - RNA, 22 nt, Mycobacterium tuberculosis H37Rv
ugccugguauccgcagagucaa

SEQ ID NO: 29052 - RNA, 22 nt, Mycobacterium tuberculosis H37Rv
ugcgacucugcgucugcucgcg

SEQ ID NO: 29053 - RNA, 22 nt, Mycobacterium tuberculosis H37Rv
ugcgacucugugucugcucgcc

SEQ ID NO: 29054 - RNA, 22 nt, Mycobacterium tuberculosis H37Rv
ugcgagccgauuucgauuuggc

SEQ ID NO: 29055 - RNA, 22 nt, Mycobacterium tuberculosis H37Rv
ugcgagcgugcgggugcucguc

SEQ ID NO: 29056 - RNA, 22 nt, Mycobacterium tuberculosis H37Rv
ugcgaucuggacggcggcgguc

SEQ ID NO: 29057 - RNA, 22 nt, Mycobacterium tuberculosis H37Rv
ugcgauucugcgucugcucgcg

SEQ ID NO: 29058 - RNA, 20 nt, Mycobacterium tuberculosis H37Rv
ugcgauugugugucugcucg

SEQ ID NO: 29059 - RNA, 20 nt, Mycobacterium tuberculosis H37Rv
ugcgcagcuggacgcggugc

SEQ ID NO: 29060 - RNA, 22 nt, Mycobacterium tuberculosis H37Rv
ugcgcccuugccugucgucgac

SEQ ID NO: 29061 - RNA, 22 nt, Mycobacterium tuberculosis H37Rv
ugcgccgaaugugcacuggugg

SEQ ID NO: 29062 - RNA, 22 nt, Mycobacterium tuberculosis H37Rv
ugcgccgagaucgacguuagcg

SEQ ID NO: 29063 - RNA, 22 nt, Mycobacterium tuberculosis H37Rv
ugcgcugacucugcguccacca

SEQ ID NO: 29064 - RNA, 22 nt, Mycobacterium tuberculosis H37Rv
ugcgcuugcccuugccgaguuu

SEQ ID NO: 29065 - RNA, 22 nt, Mycobacterium tuberculosis H37Rv
ugcggcagcgaaaggagcucca

SEQ ID NO: 29066 - RNA, 21 nt, Mycobacterium tuberculosis H37Rv
ugcgucagcagcggugcugcc

SEQ ID NO: 29067 - RNA, 22 nt, Mycobacterium tuberculosis H37Rv
ugcguuaucccacggcagauag

SEQ ID NO: 29068 - RNA, 22 nt, Mycobacterium tuberculosis H37Rv
ugcucgaccaaugcgacgcggc

SEQ ID NO: 29069 - RNA, 22 nt, Mycobacterium tuberculosis H37Rv
ugcucgacgugauggccgccca

SEQ ID NO: 29070 - RNA, 18 nt, Mycobacterium tuberculosis H37Rv
ugcuggagaucccgacga

SEQ ID NO: 29071 - RNA, 22 nt, Mycobacterium tuberculosis H37Rv
ugcuggcccgagaaccgaugac

SEQ ID NO: 29072 - RNA, 22 nt, Mycobacterium tuberculosis H37Rv
ugcuggcuaccuacucggaguu

SEQ ID NO: 29073 - RNA, 22 nt, Mycobacterium tuberculosis H37Rv
ugcugugcaccgaugucgguuc

SEQ ID NO: 29074 - RNA, 22 nt, Mycobacterium tuberculosis H37Rv
ugcuugccacuucuuguucgga

SEQ ID NO: 29075 - RNA, 22 nt, Mycobacterium tuberculosis H37Rv
uggaagacgagcucgacgagau

SEQ ID NO: 29076 - RNA, 22 nt, Mycobacterium tuberculosis H37Rv
uggacgagcaucgcgagcacgc

SEQ ID NO: 29077 - RNA, 19 nt, Mycobacterium tuberculosis H37Rv
uggacgguaccggucuucg

SEQ ID NO: 29078 - RNA, 22 nt, Mycobacterium tuberculosis H37Rv
uggagauuggagacgucggccg

SEQ ID NO: 29079 - RNA, 22 nt, Mycobacterium tuberculosis H37Rv
uggccgucgauugcgguggcgu

SEQ ID NO: 29080 - RNA, 22 nt, Mycobacterium tuberculosis H37Rv
uggcgagcagacgcaaaagccc

SEQ ID NO: 29081 - RNA, 22 nt, Mycobacterium tuberculosis H37Rv
uggcgcugcaguacuuucacgc

SEQ ID NO: 29082 - RNA, 22 nt, Mycobacterium tuberculosis H37Rv
ugggccgacccgcgcauggucg

SEQ ID NO: 29083 - RNA, 22 nt, Mycobacterium tuberculosis H37Rv
ugggcgacggcgaacauggucg

SEQ ID NO: 29084 - RNA, 21 nt, Mycobacterium tuberculosis H37Rv
ugggcgauuuugcgucugcuc

SEQ ID NO: 29085 - RNA, 22 nt, Mycobacterium tuberculosis H37Rv
ugggcgauuuugcgucugcucg

SEQ ID NO: 29086 - RNA, 22 nt, Mycobacterium tuberculosis H37Rv
ugggcugcugcgccgcaucggc

SEQ ID NO: 29087 - RNA, 22 nt, Mycobacterium tuberculosis H37Rv
ugggcuucugggacaucgcggu

SEQ ID NO: 29088 - RNA, 20 nt, Mycobacterium tuberculosis H37Rv
uggucgacgacgagcuuggc

SEQ ID NO: 29089 - RNA, 23 nt, Mycobacterium tuberculosis H37Rv
uggucgaugcggucaaagcacgc

SEQ ID NO: 29090 - RNA, 22 nt, Mycobacterium tuberculosis H37Rv
uggugcagcuugagcugcgggc

SEQ ID NO: 29091 - RNA, 22 nt, Mycobacterium tuberculosis H37Rv
ugguggcaucacaguaggccuc

SEQ ID NO: 29092 - RNA, 23 nt, Mycobacterium tuberculosis H37Rv
ugguggccgggaucggcauggcc

SEQ ID NO: 29093 - RNA, 22 nt, Mycobacterium tuberculosis H37Rv
ugguucucggcgauaccucgac

SEQ ID NO: 29094 - RNA, 22 nt, Mycobacterium tuberculosis H37Rv
uguaaccgaccgacgugccccg

SEQ ID NO: 29095 - RNA, 22 nt, Mycobacterium tuberculosis H37Rv
uguacagcuggaucgugcugca

SEQ ID NO: 29096 - RNA, 22 nt, Mycobacterium tuberculosis H37Rv
uguagaucuccugaugcgccuu

SEQ ID NO: 29097 - RNA, 22 nt, Mycobacterium tuberculosis H37Rv
ugucagggugcacaccgucgcc

SEQ ID NO: 29098 - RNA, 22 nt, Mycobacterium tuberculosis H37Rv
ugucgaucugcugauggugguc

SEQ ID NO: 29099 - RNA, 22 nt, Mycobacterium tuberculosis H37Rv
ugucgcagccugcacgagggug

SEQ ID NO: 29100 - RNA, 22 nt, Mycobacterium tuberculosis H37Rv
ugucgccgcaaccgucguuauc

SEQ ID NO: 29101 - RNA, 22 nt, Mycobacterium tuberculosis H37Rv
ugucggagccgacuuucgccgc

SEQ ID NO: 29102 - RNA, 20 nt, Mycobacterium tuberculosis H37Rv
ugucuccggcgguguccauc

SEQ ID NO: 29103 - RNA, 22 nt, Mycobacterium tuberculosis H37Rv
ugugaucggguugcggaucgcc

SEQ ID NO: 29104 - RNA, 20 nt, Mycobacterium tuberculosis H37Rv
ugugcaccuccaccggccag

SEQ ID NO: 29105 - RNA, 22 nt, Mycobacterium tuberculosis H37Rv
ugugcgacgacgauccggucau

SEQ ID NO: 29106 - RNA, 22 nt, Mycobacterium tuberculosis H37Rv
uuaggccuggccugcgccccga

SEQ ID NO: 29107 - RNA, 22 nt, Mycobacterium tuberculosis H37Rv
uucaaccgguccuggaugcuug

SEQ ID NO: 29108 - RNA, 22 nt, Mycobacterium tuberculosis H37Rv
uucaccggugcucuccgcgauc

SEQ ID NO: 29109 - RNA, 22 nt, Mycobacterium tuberculosis H37Rv
uucaggccgaucggaggacgcc

SEQ ID NO: 29110 - RNA, 19 nt, Mycobacterium tuberculosis H37Rv
uucccgcguccacgucggc

SEQ ID NO: 29111 - RNA, 22 nt, Mycobacterium tuberculosis H37Rv
uuccgcaauccuucgucggcgu

SEQ ID NO: 29112 - RNA, 22 nt, Mycobacterium tuberculosis H37Rv
uuccggcgcgaccggucugauc

SEQ ID NO: 29113 - RNA, 22 nt, Mycobacterium tuberculosis H37Rv
uuccggcgcugacggugagcag

SEQ ID NO: 29114 - RNA, 22 nt, Mycobacterium tuberculosis H37Rv
uuccgggaagguggugguggcg

SEQ ID NO: 29115 - RNA, 22 nt, Mycobacterium tuberculosis H37Rv
uucgaccaguucauguugcggc

SEQ ID NO: 29116 - RNA, 22 nt, Mycobacterium tuberculosis H37Rv
uucgcccgccuugucccagauc

SEQ ID NO: 29117 - RNA, 22 nt, Mycobacterium tuberculosis H37Rv
uucgccgagcagacgcaaaagc

SEQ ID NO: 29118 - RNA, 22 nt, Mycobacterium tuberculosis H37Rv
aaagacgcaaaagcucccaaau

SEQ ID NO: 29119 - RNA, 22 nt, Mycobacterium tuberculosis H37Rv
aaaggccuuacccuggcugggu

SEQ ID NO: 29120 - RNA, 22 nt, Mycobacterium tuberculosis H37Rv
aaaugggcgcuuaugcgucugc

SEQ ID NO: 29121 - RNA, 22 nt, Mycobacterium tuberculosis H37Rv
aacaccuuggguuccuggcugc

SEQ ID NO: 29122 - RNA, 19 nt, Mycobacterium tuberculosis H37Rv
aacaggcgggauucgccga

SEQ ID NO: 29123 - RNA, 22 nt, Mycobacterium tuberculosis H37Rv
aacagucgaccgacgcguucgu

SEQ ID NO: 29124 - RNA, 22 nt, Mycobacterium tuberculosis H37Rv
aacccggugcuggccgugcccg

SEQ ID NO: 29125 - RNA, 22 nt, Mycobacterium tuberculosis H37Rv
aaccgagcguugggccugccgu

SEQ ID NO: 29126 - RNA, 22 nt, Mycobacterium tuberculosis H37Rv
aaccgcuacaaaugaaguuggu

SEQ ID NO: 29127 - RNA, 22 nt, Mycobacterium tuberculosis H37Rv
aaccggcuguccagggccaucu

SEQ ID NO: 29128 - RNA, 22 nt, Mycobacterium tuberculosis H37Rv
aacgauguugggccggaaaugc

SEQ ID NO: 29129 - RNA, 22 nt, Mycobacterium tuberculosis H37Rv
aacgccgacgguuggggugucg

SEQ ID NO: 29130 - RNA, 22 nt, Mycobacterium tuberculosis H37Rv
aacgcgcgccccgcuuugucaa

SEQ ID NO: 29131 - RNA, 22 nt, Mycobacterium tuberculosis H37Rv
aacgcggugucggcggccugcc

SEQ ID NO: 29132 - RNA, 20 nt, Mycobacterium tuberculosis H37Rv
aacggcaacacgucgucgcg

SEQ ID NO: 29133 - RNA, 22 nt, Mycobacterium tuberculosis H37Rv
aacggccuggcggccgcgucga

SEQ ID NO: 29134 - RNA, 22 nt, Mycobacterium tuberculosis H37Rv
aacgggcgcugcgugagcacgu

SEQ ID NO: 29135 - RNA, 20 nt, Mycobacterium tuberculosis H37Rv
aacggucgcuacagcauugc

SEQ ID NO: 29136 - RNA, 22 nt, Mycobacterium tuberculosis H37Rv
aacggucugcgguugccagucg

SEQ ID NO: 29137 - RNA, 22 nt, Mycobacterium tuberculosis H37Rv
aacucgacgugcaucccgguga

SEQ ID NO: 29138 - RNA, 22 nt, Mycobacterium tuberculosis H37Rv
aacuggccgugcucggcccgcu

SEQ ID NO: 29139 - RNA, 22 nt, Mycobacterium tuberculosis H37Rv
aagaacgcgucguagcgcucgu

SEQ ID NO: 29140 - RNA, 22 nt, Mycobacterium tuberculosis H37Rv
aagaucguugauccccagugcu

SEQ ID NO: 29141 - RNA, 22 nt, Mycobacterium tuberculosis H37Rv
aagcagacgcagaaucgcacaa

SEQ ID NO: 29142 - RNA, 22 nt, Mycobacterium tuberculosis H37Rv
aagcggcccgauauggugcugc

SEQ ID NO: 29143 - RNA, 19 nt, Mycobacterium tuberculosis H37Rv
aagcugacggccuuggugu

SEQ ID NO: 29144 - RNA, 22 nt, Mycobacterium tuberculosis H37Rv
aagcugauucugauggcgauug

SEQ ID NO: 29145 - RNA, 22 nt, Mycobacterium tuberculosis H37Rv
aagcuggaagaugccggugcgg

SEQ ID NO: 29146 - RNA, 22 nt, Mycobacterium tuberculosis H37Rv
aaggcugcggguaugaaacgca

SEQ ID NO: 29147 - RNA, 22 nt, Mycobacterium tuberculosis H37Rv
aaggcuguggccggcgucgucg

SEQ ID NO: 29148 - RNA, 22 nt, Mycobacterium tuberculosis H37Rv
aaggugcggucaaugcgcucga

SEQ ID NO: 29149 - RNA, 22 nt, Mycobacterium tuberculosis H37Rv
aauccgcuugcaccagugugca

SEQ ID NO: 29150 - RNA, 22 nt, Mycobacterium tuberculosis H37Rv
aaucggccggcgacacuguugu

SEQ ID NO: 29151 - RNA, 22 nt, Mycobacterium tuberculosis H37Rv
aaucuggugaaugcaccccaua

SEQ ID NO: 29152 - RNA, 22 nt, Mycobacterium tuberculosis H37Rv
aaugggcgauuuugcgucugcu

SEQ ID NO: 29153 - RNA, 20 nt, Mycobacterium tuberculosis H37Rv
aauguggucgaugcccuggc

SEQ ID NO: 29154 - RNA, 22 nt, Mycobacterium tuberculosis H37Rv
aauucgccguggcguuacgcuc

SEQ ID NO: 29155 - RNA, 23 nt, Mycobacterium tuberculosis H37Rv
acaacgagcguugcagaaucugc

SEQ ID NO: 29156 - RNA, 22 nt, Mycobacterium tuberculosis H37Rv
acacggucacgguggcgacguc

SEQ ID NO: 29157 - RNA, 22 nt, Mycobacterium tuberculosis H37Rv
agccaagccguaguccucgacg

SEQ ID NO: 29158 - RNA, 22 nt, Mycobacterium tuberculosis H37Rv
agccauggucgaccgcgccguc

SEQ ID NO: 29159 - RNA, 22 nt, Mycobacterium tuberculosis H37Rv
agccgagcaggugcgcuuccuc

SEQ ID NO: 29160 - RNA, 22 nt, Mycobacterium tuberculosis H37Rv
agcgaccggacugguggucgga

SEQ ID NO: 29161 - RNA, 22 nt, Mycobacterium tuberculosis H37Rv
agcgcggugauggccacccgcu

SEQ ID NO: 29162 - RNA, 22 nt, Mycobacterium tuberculosis H37Rv
agcgcggugcgcuccaagguaa

SEQ ID NO: 29163 - RNA, 22 nt, Mycobacterium tuberculosis H37Rv
agcggacgcgaguguucuucug

SEQ ID NO: 29164 - RNA, 22 nt, Mycobacterium tuberculosis H37Rv
agcggugaucguggugcagagg

SEQ ID NO: 29165 - RNA, 22 nt, Mycobacterium tuberculosis H37Rv
agcgucucggcggcguugcaga

SEQ ID NO: 29166 - RNA, 22 nt, Mycobacterium tuberculosis H37Rv
agcgugaucaggcucggcucgc

SEQ ID NO: 29167 - RNA, 22 nt, Mycobacterium tuberculosis H37Rv
agcgugcacugggggcgagauu

SEQ ID NO: 29168 - RNA, 19 nt, Mycobacterium tuberculosis H37Rv
agcgugcguuguugcaccg

SEQ ID NO: 29169 - RNA, 22 nt, Mycobacterium tuberculosis H37Rv
agcugcaugacgaacucggccu

SEQ ID NO: 29170 - RNA, 22 nt, Mycobacterium tuberculosis H37Rv
agcugcgacgggccgggcugga

SEQ ID NO: 29171 - RNA, 22 nt, Mycobacterium tuberculosis H37Rv
agcuguccgacaaaguauccga

SEQ ID NO: 29172 - RNA, 22 nt, Mycobacterium tuberculosis H37Rv
aggaccguuucgauuuugacag

SEQ ID NO: 29173 - RNA, 22 nt, Mycobacterium tuberculosis H37Rv
aggacgaugaacuuuuacuccg

SEQ ID NO: 29174 - RNA, 22 nt, Mycobacterium tuberculosis H37Rv
aggacgucgucgauuucgucga

SEQ ID NO: 29175 - RNA, 22 nt, Mycobacterium tuberculosis H37Rv
aggcaaucagucaggucgcuau

SEQ ID NO: 29176 - RNA, 22 nt, Mycobacterium tuberculosis H37Rv
aggcuucagcggggggcuuauc

SEQ ID NO: 29177 - RNA, 23 nt, Mycobacterium tuberculosis H37Rv
agggaugugguagccccggcgag

SEQ ID NO: 29178 - RNA, 22 nt, Mycobacterium tuberculosis H37Rv
agggcgauuuugcgucugcucg

SEQ ID NO: 29179 - RNA, 22 nt, Mycobacterium tuberculosis H37Rv
aggucgaugacucguuggccgc

SEQ ID NO: 29180 - RNA, 22 nt, Mycobacterium tuberculosis H37Rv
aggucggcguaugggaaguacc

SEQ ID NO: 29181 - RNA, 22 nt, Mycobacterium tuberculosis H37Rv
agguggcggucaucggcuugcc

SEQ ID NO: 29182 - RNA, 22 nt, Mycobacterium tuberculosis H37Rv
aguccgagugccgcgaucgcgu

SEQ ID NO: 29183 - RNA, 22 nt, Mycobacterium tuberculosis H37Rv
agucgcaaaagcccccgacacg

SEQ ID NO: 29184 - RNA, 22 nt, Mycobacterium tuberculosis H37Rv
agucggccagguacggcaucag

SEQ ID NO: 29185 - RNA, 22 nt, Mycobacterium tuberculosis H37Rv
agucggcucccuucaucaauuc

SEQ ID NO: 29186 - RNA, 22 nt, Mycobacterium tuberculosis H37Rv
agucguggauuugccagggggc

SEQ ID NO: 29187 - RNA, 22 nt, Mycobacterium tuberculosis H37Rv
agucuuggugaccguccgguac

SEQ ID NO: 29188 - RNA, 22 nt, Mycobacterium tuberculosis H37Rv
agugcggcuauccgccgccgac

SEQ ID NO: 29189 - RNA, 22 nt, Mycobacterium tuberculosis H37Rv
aguucgcccacggcuguguguc

SEQ ID NO: 29190 - RNA, 22 nt, Mycobacterium tuberculosis H37Rv
aguugccgaggauguugggcuu

SEQ ID NO: 29191 - RNA, 22 nt, Mycobacterium tuberculosis H37Rv
aguuugucgggaucuugaccaa

SEQ ID NO: 29192 - RNA, 22 nt, Mycobacterium tuberculosis H37Rv
auaccgcgaucgcuuuggccgc

SEQ ID NO: 29193 - RNA, 22 nt, Mycobacterium tuberculosis H37Rv
auagcggcgcugaucuccgaca

SEQ ID NO: 29194 - RNA, 22 nt, Mycobacterium tuberculosis H37Rv
auaucaccguuaucggagcgau

SEQ ID NO: 29195 - RNA, 22 nt, Mycobacterium tuberculosis H37Rv
aucaaugccgauccccggacgg

SEQ ID NO: 29196 - RNA, 22 nt, Mycobacterium tuberculosis H37Rv
aucagcagcgugguugccgcgu

SEQ ID NO: 29197 - RNA, 23 nt, Mycobacterium tuberculosis H37Rv
aucagcuggauaggcaaggagac

SEQ ID NO: 29198 - RNA, 20 nt, Mycobacterium tuberculosis H37Rv
aucaggccggcugcccccgc

SEQ ID NO: 29199 - RNA, 22 nt, Mycobacterium tuberculosis H37Rv
aucccuugguaugucacgguuc

SEQ ID NO: 29200 - RNA, 22 nt, Mycobacterium tuberculosis H37Rv
auccgcgcgacgaacuugucga

SEQ ID NO: 29201 - RNA, 20 nt, Mycobacterium tuberculosis H37Rv
aucgacacaaucgguggauc

SEQ ID NO: 29202 - RNA, 22 nt, Mycobacterium tuberculosis H37Rv
aucgacggcgucguuggcgaac

SEQ ID NO: 29203 - RNA, 22 nt, Mycobacterium tuberculosis H37Rv
aucgagauugagccggccccga

SEQ ID NO: 29204 - RNA, 22 nt, Mycobacterium tuberculosis H37Rv
aucgaggcguucagcacccgga

SEQ ID NO: 29205 - RNA, 22 nt, Mycobacterium tuberculosis H37Rv
aucgaguugaugcgccaucgcg

SEQ ID NO: 29206 - RNA, 22 nt, Mycobacterium tuberculosis H37Rv
aucgcacguucugcugcagcgc

SEQ ID NO: 29207 - RNA, 22 nt, Mycobacterium tuberculosis H37Rv
aucgccggugaccgcugacccc

SEQ ID NO: 29208 - RNA, 22 nt, Mycobacterium tuberculosis H37Rv
aucgcuuggcugggucaaucgu

SEQ ID NO: 29209 - RNA, 22 nt, Mycobacterium tuberculosis H37Rv
aucggcacggcgagacggccga

SEQ ID NO: 29210 - RNA, 22 nt, Mycobacterium tuberculosis H37Rv
aucggcauuggguuaaccggca

SEQ ID NO: 29211 - RNA, 22 nt, Mycobacterium tuberculosis H37Rv
aucggcugccaccgcucgcggu

SEQ ID NO: 29212 - RNA, 21 nt, Mycobacterium tuberculosis H37Rv
aucgggauucagcagcagggu

SEQ ID NO: 29213 - RNA, 22 nt, Mycobacterium tuberculosis H37Rv
aucgggucggcaauggccgccg

SEQ ID NO: 29214 - RNA, 22 nt, Mycobacterium tuberculosis H37Rv
aucggucugcuggccagcgucg

SEQ ID NO: 29215 - RNA, 22 nt, Mycobacterium tuberculosis H37Rv
aucgguguucgccgcgaccguu

SEQ ID NO: 29216 - RNA, 22 nt, Mycobacterium tuberculosis H37Rv
aucgugguggaggagaaccgcu

SEQ ID NO: 29217 - RNA, 22 nt, Mycobacterium tuberculosis H37Rv
aucugcacaccgagagaguucc

SEQ ID NO: 29218 - RNA, 23 nt, Mycobacterium tuberculosis H37Rv
augacgggauucugcuucgcaaa

SEQ ID NO: 29219 - RNA, 22 nt, Mycobacterium tuberculosis H37Rv
augaggcgauuuugcgucugcu

SEQ ID NO: 29220 - RNA, 22 nt, Mycobacterium tuberculosis H37Rv
augcgggugaugccgaacucgg

SEQ ID NO: 29221 - RNA, 22 nt, Mycobacterium tuberculosis H37Rv
augcugccggcauugaccacau

SEQ ID NO: 29222 - RNA, 22 nt, Mycobacterium tuberculosis H37Rv
augcugcucggacccagcggcu

SEQ ID NO: 29223 - RNA, 22 nt, Mycobacterium tuberculosis H37Rv
augcugcuggccgacaugcucg

SEQ ID NO: 29224 - RNA, 23 nt, Mycobacterium tuberculosis H37Rv
auggacggcgcgcagguugcggc

SEQ ID NO: 29225 - RNA, 22 nt, Mycobacterium tuberculosis H37Rv
auggccaaccucccgacuggua

SEQ ID NO: 29226 - RNA, 22 nt, Mycobacterium tuberculosis H37Rv
auggcugaacgggcgccacgcg

SEQ ID NO: 29227 - RNA, 22 nt, Mycobacterium tuberculosis H37Rv
augggcgauuuugcgucugcuc

SEQ ID NO: 29228 - RNA, 22 nt, Mycobacterium tuberculosis H37Rv
auggguucgaacguccaggugg

SEQ ID NO: 29229 - RNA, 21 nt, Mycobacterium tuberculosis H37Rv
auggucugacguucuggagca

SEQ ID NO: 29230 - RNA, 22 nt, Mycobacterium tuberculosis H37Rv
augucacggucgugacccgcug

SEQ ID NO: 29231 - RNA, 22 nt, Mycobacterium tuberculosis H37Rv
augucgagucgaacucggcgcu

SEQ ID NO: 29232 - RNA, 21 nt, Mycobacterium tuberculosis H37Rv
augucguccaccggcuuaugg

SEQ ID NO: 29233 - RNA, 22 nt, Mycobacterium tuberculosis H37Rv
augucguuaugagaacaucgcc

SEQ ID NO: 29234 - RNA, 22 nt, Mycobacterium tuberculosis H37Rv
augugccgcucaucgcccggug

SEQ ID NO: 29235 - RNA, 22 nt, Mycobacterium tuberculosis H37Rv
auucagguguugagaaaaugua

SEQ ID NO: 29236 - RNA, 22 nt, Mycobacterium tuberculosis H37Rv
gcaguucaacgagcccgucgac

SEQ ID NO: 29237 - RNA, 22 nt, Mycobacterium tuberculosis H37Rv
gcaugcgauucugcgucugcuc

SEQ ID NO: 29238 - RNA, 22 nt, Mycobacterium tuberculosis H37Rv
gccacucgccgcugguguugug

SEQ ID NO: 29239 - RNA, 22 nt, Mycobacterium tuberculosis H37Rv
gccacugugaauggcacgacgc

SEQ ID NO: 29240 - RNA, 22 nt, Mycobacterium tuberculosis H37Rv
gccaggcuggugucggcggugg

SEQ ID NO: 29241 - RNA, 22 nt, Mycobacterium tuberculosis H37Rv
gccagggucgcuucgggcagag

SEQ ID NO: 29242 - RNA, 22 nt, Mycobacterium tuberculosis H37Rv
gccaugguugcacguucggcgu

SEQ ID NO: 29243 - RNA, 23 nt, Mycobacterium tuberculosis H37Rv
gccauugcgucagcggugcuguc

SEQ ID NO: 29244 - RNA, 22 nt, Mycobacterium tuberculosis H37Rv
gcccagcaggaaaggccuuugu

SEQ ID NO: 29245 - RNA, 22 nt, Mycobacterium tuberculosis H37Rv
gcccaucauguucuuuugcgcc

SEQ ID NO: 29246 - RNA, 22 nt, Mycobacterium tuberculosis H37Rv
gcccauuugcccgacgucgcau

SEQ ID NO: 29247 - RNA, 22 nt, Mycobacterium tuberculosis H37Rv
gcccgauuuccucggugaaugg

SEQ ID NO: 29248 - RNA, 22 nt, Mycobacterium tuberculosis H37Rv
gcccguucgaucgucggcaucg

SEQ ID NO: 29249 - RNA, 22 nt, Mycobacterium tuberculosis H37Rv
gccgaacgugaagccagggcga

SEQ ID NO: 29250 - RNA, 22 nt, Mycobacterium tuberculosis H37Rv
gccgaauccagccaggagugug

SEQ ID NO: 29251 - RNA, 22 nt, Mycobacterium tuberculosis H37Rv
gccgauggaccgccuggaugac

SEQ ID NO: 29252 - RNA, 22 nt, Mycobacterium tuberculosis H37Rv
gccgccuaugugccguaugugg

SEQ ID NO: 29253 - RNA, 22 nt, Mycobacterium tuberculosis H37Rv
gccgcgaugucgaucucggucu

SEQ ID NO: 29254 - RNA, 22 nt, Mycobacterium tuberculosis H37Rv
gccggaacgguguagucgauga

SEQ ID NO: 29255 - RNA, 22 nt, Mycobacterium tuberculosis H37Rv
gccggacugggugcggcggugg

SEQ ID NO: 29256 - RNA, 22 nt, Mycobacterium tuberculosis H37Rv
gccggcaugccgcgacauucac

SEQ ID NO: 29257 - RNA, 22 nt, Mycobacterium tuberculosis H37Rv
gccgggaugcacgcacgucacc

SEQ ID NO: 29258 - RNA, 22 nt, Mycobacterium tuberculosis H37Rv
gccgguuauuggaugugcacgc

SEQ ID NO: 29259 - RNA, 22 nt, Mycobacterium tuberculosis H37Rv
gccgucuggaucugcgaacgga

SEQ ID NO: 29260 - RNA, 22 nt, Mycobacterium tuberculosis H37Rv
gccuggaggaccuggacucggc

SEQ ID NO: 29261 - RNA, 22 nt, Mycobacterium tuberculosis H37Rv
gcgaaacacgggaucgggcgag

SEQ ID NO: 29262 - RNA, 22 nt, Mycobacterium tuberculosis H37Rv
gcgacgcugaagagcccgacga

SEQ ID NO: 29263 - RNA, 21 nt, Mycobacterium tuberculosis H37Rv
gcgagcagggcaucaccgccg

SEQ ID NO: 29264 - RNA, 21 nt, Mycobacterium tuberculosis H37Rv
gcgagcucgucauggucuuuc

SEQ ID NO: 29265 - RNA, 23 nt, Mycobacterium tuberculosis H37Rv
gcgaguugccgacgcaggcgacc

SEQ ID NO: 29266 - RNA, 22 nt, Mycobacterium tuberculosis H37Rv
gcgaguugguguuuccgcugca

SEQ ID NO: 29267 - RNA, 22 nt, Mycobacterium tuberculosis H37Rv
gcgaucagguucgacgcgcauc

SEQ ID NO: 29268 - RNA, 22 nt, Mycobacterium tuberculosis H37Rv
gcgauucugcgcgguguguggg

SEQ ID NO: 29269 - RNA, 22 nt, Mycobacterium tuberculosis H37Rv
gcgauucugcgucugcucgccg

SEQ ID NO: 29270 - RNA, 22 nt, Mycobacterium tuberculosis H37Rv
gcgauucugcgucugcucgcgc

SEQ ID NO: 29271 - RNA, 22 nt, Mycobacterium tuberculosis H37Rv
gcgcacgucguugucggcuccu

SEQ ID NO: 29272 - RNA, 22 nt, Mycobacterium tuberculosis H37Rv
gcgcagcagcgacaggguggcg

SEQ ID NO: 29273 - RNA, 21 nt, Mycobacterium tuberculosis H37Rv
gcgcagcaucucagccagugc

SEQ ID NO: 29274 - RNA, 22 nt, Mycobacterium tuberculosis H37Rv
gcgcgaugugcugcucgggucu

SEQ ID NO: 29275 - RNA, 22 nt, Mycobacterium tuberculosis H37Rv
gcgcuacaaccagcugaucgcc

SEQ ID NO: 29276 - RNA, 22 nt, Mycobacterium tuberculosis H37Rv
gcgcucaacgggauauugauac

SEQ ID NO: 29277 - RNA, 18 nt, Mycobacterium tuberculosis H37Rv
gcgcugcugucgauuucg

SEQ ID NO: 29278 - RNA, 22 nt, Mycobacterium tuberculosis H37Rv
gcggacacgaucgcgucggcua

SEQ ID NO: 29279 - RNA, 22 nt, Mycobacterium tuberculosis H37Rv
gcggagucgcgccaauggcuug

SEQ ID NO: 29280 - RNA, 22 nt, Mycobacterium tuberculosis H37Rv
gcggcacugugucgggcgcgag

SEQ ID NO: 29281 - RNA, 22 nt, Mycobacterium tuberculosis H37Rv
gcggccaacgaggcagcggcgg

SEQ ID NO: 29282 - RNA, 22 nt, Mycobacterium tuberculosis H37Rv
gcggcgaaggugagcuggggau

SEQ ID NO: 29283 - RNA, 22 nt, Mycobacterium tuberculosis H37Rv
gcggcgaucaagcccgacuagu

SEQ ID NO: 29284 - RNA, 22 nt, Mycobacterium tuberculosis H37Rv
gcggcguaccacccagcgcguc

SEQ ID NO: 29285 - RNA, 22 nt, Mycobacterium tuberculosis H37Rv
gcgggaguugcgggauugauga

SEQ ID NO: 29286 - RNA, 22 nt, Mycobacterium tuberculosis H37Rv
gcgggucugaugcaggaucgcg

SEQ ID NO: 29287 - RNA, 22 nt, Mycobacterium tuberculosis H37Rv
gcgguaguagaggucccgguag

SEQ ID NO: 29288 - RNA, 22 nt, Mycobacterium tuberculosis H37Rv
gcggugcucaacgccucgguga

SEQ ID NO: 29289 - RNA, 22 nt, Mycobacterium tuberculosis H37Rv
gcggugucgccgagcguuggga

SEQ ID NO: 29290 - RNA, 18 nt, Mycobacterium tuberculosis H37Rv
gcgucaccccggggugua

SEQ ID NO: 29291 - RNA, 22 nt, Mycobacterium tuberculosis H37Rv
gcgucauugggcccaacggggu

SEQ ID NO: 29292 - RNA, 22 nt, Mycobacterium tuberculosis H37Rv
gcgucgacgguguggguucgga

SEQ ID NO: 29293 - RNA, 22 nt, Mycobacterium tuberculosis H37Rv
gcgucgacucagucgccgccga

SEQ ID NO: 29294 - RNA, 22 nt, Mycobacterium tuberculosis H37Rv
gcgucgaggucuuccugauggg

SEQ ID NO: 29295 - RNA, 22 nt, Mycobacterium tuberculosis H37Rv
gcgucgauugccuccgccucgg

SEQ ID NO: 29296 - RNA, 22 nt, Mycobacterium tuberculosis H37Rv
gcgucgugagauucacagucgg

SEQ ID NO: 29297 - RNA, 22 nt, Mycobacterium tuberculosis H37Rv
gcgucgugccauucacaguggc

SEQ ID NO: 29298 - RNA, 22 nt, Mycobacterium tuberculosis H37Rv
gcgugagguccgcggccuguag

SEQ ID NO: 29299 - RNA, 22 nt, Mycobacterium tuberculosis H37Rv
gcgugcgauucugugucuguuc

SEQ ID NO: 29300 - RNA, 20 nt, Mycobacterium tuberculosis H37Rv
gcguggucggaugcaggcca

SEQ ID NO: 29301 - RNA, 22 nt, Mycobacterium tuberculosis H37Rv
gcguugcuggcgaucggauuca

SEQ ID NO: 29302 - RNA, 22 nt, Mycobacterium tuberculosis H37Rv
gcuacggauuucgcccgucgaa

SEQ ID NO: 29303 - RNA, 22 nt, Mycobacterium tuberculosis H37Rv
gcuacgucggaucugucggccg

SEQ ID NO: 29304 - RNA, 22 nt, Mycobacterium tuberculosis H37Rv
gcucaugucgccguagaccggg

SEQ ID NO: 29305 - RNA, 22 nt, Mycobacterium tuberculosis H37Rv
gcuccgguaaaccgauggccgc

SEQ ID NO: 29306 - RNA, 22 nt, Mycobacterium tuberculosis H37Rv
gcucgguuaucaguugauaaca

SEQ ID NO: 29307 - RNA, 22 nt, Mycobacterium tuberculosis H37Rv
gcucuaccacguccugcacgcg

SEQ ID NO: 29308 - RNA, 21 nt, Mycobacterium tuberculosis H37Rv
gcucugcaucgucgccggcgg

SEQ ID NO: 29309 - RNA, 22 nt, Mycobacterium tuberculosis H37Rv
gcugaaccugauccucaagggc

SEQ ID NO: 29310 - RNA, 22 nt, Mycobacterium tuberculosis H37Rv
gcugaccgggacgccggccugg

SEQ ID NO: 29311 - RNA, 22 nt, Mycobacterium tuberculosis H37Rv
gcugacucagacuccggcugcg

SEQ ID NO: 29312 - RNA, 22 nt, Mycobacterium tuberculosis H37Rv
gcugcaacaucaaaccgacucc

SEQ ID NO: 29313 - RNA, 22 nt, Mycobacterium tuberculosis H37Rv
gcugccucgcugggcgcccagg

SEQ ID NO: 29314 - RNA, 22 nt, Mycobacterium tuberculosis H37Rv
gcuggcgaugcuccugaauuca

SEQ ID NO: 29315 - RNA, 22 nt, Mycobacterium tuberculosis H37Rv
gcuggucgaugggcggcuacgg

SEQ ID NO: 29316 - RNA, 22 nt, Mycobacterium tuberculosis H37Rv
gcuucacaucauuuucuggaag

SEQ ID NO: 29317 - RNA, 20 nt, Mycobacterium tuberculosis H37Rv
gcuugccgacccggcgccgu

SEQ ID NO: 29318 - RNA, 22 nt, Mycobacterium tuberculosis H37Rv
ggagacguuguauggcgagauc

SEQ ID NO: 29319 - RNA, 22 nt, Mycobacterium tuberculosis H37Rv
ggagccguguucgcgauucugc

SEQ ID NO: 29320 - RNA, 22 nt, Mycobacterium tuberculosis H37Rv
ggaguucaaugccacggcgucg

SEQ ID NO: 29321 - RNA, 22 nt, Mycobacterium tuberculosis H37Rv
ggcaacggcggcaacgccggca

SEQ ID NO: 29322 - RNA, 21 nt, Mycobacterium tuberculosis H37Rv
ggcaccuaccgacaggacgua

SEQ ID NO: 29323 - RNA, 22 nt, Mycobacterium tuberculosis H37Rv
ggcacgauggaaugucgcaacc

SEQ ID NO: 29324 - RNA, 22 nt, Mycobacterium tuberculosis H37Rv
ggcacugucagccuguccucac

SEQ ID NO: 29325 - RNA, 22 nt, Mycobacterium tuberculosis H37Rv
ggcaucuacugaacugcgccgu

SEQ ID NO: 29326 - RNA, 22 nt, Mycobacterium tuberculosis H37Rv
ggccgaaacaccgcgcgaaggg

SEQ ID NO: 29327 - RNA, 22 nt, Mycobacterium tuberculosis H37Rv
ggccuggacgccgcagaccugg

SEQ ID NO: 29328 - RNA, 22 nt, Mycobacterium tuberculosis H37Rv
ggcgacguuggcaccucggugc

SEQ ID NO: 29329 - RNA, 22 nt, Mycobacterium tuberculosis H37Rv
ggcgagaucgccgccgccaucg

SEQ ID NO: 29330 - RNA, 22 nt, Mycobacterium tuberculosis H37Rv
ggcgagcagacgcagaaucgca

SEQ ID NO: 29331 - RNA, 22 nt, Mycobacterium tuberculosis H37Rv
ggcgaucgguugucccgcgaca

SEQ ID NO: 29332 - RNA, 22 nt, Mycobacterium tuberculosis H37Rv
ggcgauuuugcgucugcucgcc

SEQ ID NO: 29333 - RNA, 22 nt, Mycobacterium tuberculosis H37Rv
ggcggcuugaacuccggugccg

SEQ ID NO: 29334 - RNA, 22 nt, Mycobacterium tuberculosis H37Rv
ggcgggaucuccuucggugcgu

SEQ ID NO: 29335 - RNA, 22 nt, Mycobacterium tuberculosis H37Rv
ggcgguacaggcauugcgcgau

SEQ ID NO: 29336 - RNA, 22 nt, Mycobacterium tuberculosis H37Rv
ggcggucuggcugcugggcguc

SEQ ID NO: 29337 - RNA, 22 nt, Mycobacterium tuberculosis H37Rv
ggcugaguuuagucaagcgcgu

SEQ ID NO: 29338 - RNA, 22 nt, Mycobacterium tuberculosis H37Rv
ggcugauggccaacgaguuuua

SEQ ID NO: 29339 - RNA, 23 nt, Mycobacterium tuberculosis H37Rv
ggcugcugcggaguccacaccga

SEQ ID NO: 29340 - RNA, 22 nt, Mycobacterium tuberculosis H37Rv
ggcuggaucgugccgcgcuggc

SEQ ID NO: 29341 - RNA, 22 nt, Mycobacterium tuberculosis H37Rv
ggcuugucgguacucggaccga

SEQ ID NO: 29342 - RNA, 22 nt, Mycobacterium tuberculosis H37Rv
gggccgaugcggaacucgauca

SEQ ID NO: 29343 - RNA, 22 nt, Mycobacterium tuberculosis H37Rv
gggcuuccguaccgccgacauu

SEQ ID NO: 29344 - RNA, 22 nt, Mycobacterium tuberculosis H37Rv
ggguccguuucccguggccgcc

SEQ ID NO: 29345 - RNA, 23 nt, Mycobacterium tuberculosis H37Rv
ggguccguuucccguggccgccc

SEQ ID NO: 29346 - RNA, 22 nt, Mycobacterium tuberculosis H37Rv
ggucaaccgggcauugcuggcg

SEQ ID NO: 29347 - RNA, 22 nt, Mycobacterium tuberculosis H37Rv
ggucacagcagagcggccgucg

SEQ ID NO: 29348 - RNA, 22 nt, Mycobacterium tuberculosis H37Rv
gguccgaaggcuucggcaagcc

SEQ ID NO: 29349 - RNA, 22 nt, Mycobacterium tuberculosis H37Rv
gguccgugcgucgaucgccgcg

SEQ ID NO: 29350 - RNA, 22 nt, Mycobacterium tuberculosis H37Rv
gguccucugauccgcaccgcau

SEQ ID NO: 29351 - RNA, 22 nt, Mycobacterium tuberculosis H37Rv
ggucgagucguggucgcaugag

SEQ ID NO: 29352 - RNA, 22 nt, Mycobacterium tuberculosis H37Rv
ggucgcaaugggcaggacuuug

SEQ ID NO: 29353 - RNA, 22 nt, Mycobacterium tuberculosis H37Rv
ggucggauucgaggcagccggc

SEQ ID NO: 29354 - RNA, 22 nt, Mycobacterium tuberculosis H37Rv
ggucugcgcccuccgggcgauc

SEQ ID NO: 29355 - RNA, 22 nt, Mycobacterium tuberculosis H37Rv
ggugaccgucgccgcgucguug

SEQ ID NO: 29356 - RNA, 22 nt, Mycobacterium tuberculosis H37Rv
ggugagcagacgcagagucgca

SEQ ID NO: 29357 - RNA, 19 nt, Mycobacterium tuberculosis H37Rv
ggugagcagggucucgcgc

SEQ ID NO: 29358 - RNA, 22 nt, Mycobacterium tuberculosis H37Rv
ggugcagcggucagcaguccga

SEQ ID NO: 29359 - RNA, 22 nt, Mycobacterium tuberculosis H37Rv
ggugcgagccaggccggcucgg

SEQ ID NO: 29360 - RNA, 22 nt, Mycobacterium tuberculosis H37Rv
ggugcgauuccgcgucugcucg

SEQ ID NO: 29361 - RNA, 22 nt, Mycobacterium tuberculosis H37Rv
gguggagcuggcugccgcgcua

SEQ ID NO: 29362 - RNA, 22 nt, Mycobacterium tuberculosis H37Rv
gguggcagcggguccggcgacu

SEQ ID NO: 29363 - RNA, 22 nt, Mycobacterium tuberculosis H37Rv
gguggucccagcuucuguugug

SEQ ID NO: 29364 - RNA, 22 nt, Mycobacterium tuberculosis H37Rv
ggugucgagcacgcugggccga

SEQ ID NO: 29365 - RNA, 22 nt, Mycobacterium tuberculosis H37Rv
gguucgagcuggacgcgggucu

SEQ ID NO: 29366 - RNA, 22 nt, Mycobacterium tuberculosis H37Rv
gguucuccgggacuugcucgcg

SEQ ID NO: 29367 - RNA, 22 nt, Mycobacterium tuberculosis H37Rv
guaccgcuggcaugcgcaacag

SEQ ID NO: 29368 - RNA, 22 nt, Mycobacterium tuberculosis H37Rv
guacgcggagaucccggcgggg

SEQ ID NO: 29369 - RNA, 17 nt, Mycobacterium tuberculosis H37Rv
gucaccgucgccacagc

SEQ ID NO: 29370 - RNA, 22 nt, Mycobacterium tuberculosis H37Rv
gucagcuucgugcccaggugau

SEQ ID NO: 29371 - RNA, 22 nt, Mycobacterium tuberculosis H37Rv
gucaggcgccggccgcgcagug

SEQ ID NO: 29372 - RNA, 22 nt, Mycobacterium tuberculosis H37Rv
gucagggcgacuuuuugauccg

SEQ ID NO: 29373 - RNA, 22 nt, Mycobacterium tuberculosis H37Rv
gucaucgccgccgagcuuggcc

SEQ ID NO: 29374 - RNA, 22 nt, Mycobacterium tuberculosis H37Rv
guccggaugcacuucgcgcagc

SEQ ID NO: 29375 - RNA, 22 nt, Mycobacterium tuberculosis H37Rv
guccgggucagcuuguggcugu

SEQ ID NO: 29376 - RNA, 20 nt, Mycobacterium tuberculosis H37Rv
guccuuggugccgaagugac

SEQ ID NO: 29377 - RNA, 22 nt, Mycobacterium tuberculosis H37Rv
gucgacggucuccggugguuga

SEQ ID NO: 29378 - RNA, 22 nt, Mycobacterium tuberculosis H37Rv
gucgagcaggaccuuggcuuca

SEQ ID NO: 29379 - RNA, 22 nt, Mycobacterium tuberculosis H37Rv
gucgcaggauucccagucgcgg

SEQ ID NO: 29380 - RNA, 22 nt, Mycobacterium tuberculosis H37Rv
gucgccaguagccacuguuccg

SEQ ID NO: 29381 - RNA, 20 nt, Mycobacterium tuberculosis H37Rv
gucgcugcugcggcggucgc

SEQ ID NO: 29382 - RNA, 22 nt, Mycobacterium tuberculosis H37Rv
gucggccaguagcgcaccgucg

SEQ ID NO: 29383 - RNA, 22 nt, Mycobacterium tuberculosis H37Rv
gucggcgugcgggugaugccgg

SEQ ID NO: 29384 - RNA, 22 nt, Mycobacterium tuberculosis H37Rv
gucggcgugggcuuuggaaacg

SEQ ID NO: 29385 - RNA, 20 nt, Mycobacterium tuberculosis H37Rv
gucgggauccccggcggcgc

SEQ ID NO: 29386 - RNA, 22 nt, Mycobacterium tuberculosis H37Rv
gucggguaucgcggcacccacg

SEQ ID NO: 29387 - RNA, 22 nt, Mycobacterium tuberculosis H37Rv
gucggucaccgacggcgccguc

SEQ ID NO: 29388 - RNA, 22 nt, Mycobacterium tuberculosis H37Rv
gucggucugaaaaugugcggcg

SEQ ID NO: 29389 - RNA, 22 nt, Mycobacterium tuberculosis H37Rv
gucggucuucaaggcgaccacg

SEQ ID NO: 29390 - RNA, 22 nt, Mycobacterium tuberculosis H37Rv
gucggugaccgugcccggaggg

SEQ ID NO: 29391 - RNA, 22 nt, Mycobacterium tuberculosis H37Rv
gucgguucggucggccugcgaa

SEQ ID NO: 29392 - RNA, 23 nt, Mycobacterium tuberculosis H37Rv
gucgucagauucacggucgccgg

SEQ ID NO: 29393 - RNA, 22 nt, Mycobacterium tuberculosis H37Rv
gucgugagauucacagucgcag

SEQ ID NO: 29394 - RNA, 22 nt, Mycobacterium tuberculosis H37Rv
gucguggacggcacgagcgcug

SEQ ID NO: 29395 - RNA, 21 nt, Mycobacterium tuberculosis H37Rv
gucguucuccaggaucagguc

SEQ ID NO: 29396 - RNA, 22 nt, Mycobacterium tuberculosis H37Rv
gugacggcgagccgccaguuga

SEQ ID NO: 29397 - RNA, 22 nt, Mycobacterium tuberculosis H37Rv
gugagcagacgcaaaagccccc

SEQ ID NO: 29398 - RNA, 22 nt, Mycobacterium tuberculosis H37Rv
gugagccauagguugucggugg

SEQ ID NO: 29399 - RNA, 22 nt, Mycobacterium tuberculosis H37Rv
gugagcuacugagcagguaucu

SEQ ID NO: 29400 - RNA, 22 nt, Mycobacterium tuberculosis H37Rv
gugauccaucucuaugagcgug

SEQ ID NO: 29401 - RNA, 22 nt, Mycobacterium tuberculosis H37Rv
gugauccgcagcaagguguaga

SEQ ID NO: 29402 - RNA, 22 nt, Mycobacterium tuberculosis H37Rv
gugccgcagcuuucgaguugug

SEQ ID NO: 29403 - RNA, 22 nt, Mycobacterium tuberculosis H37Rv
gugccgcuggcaggugcggugc

SEQ ID NO: 29404 - RNA, 20 nt, Mycobacterium tuberculosis H37Rv
gugcgcaaccucaccgagcu

SEQ ID NO: 29405 - RNA, 22 nt, Mycobacterium tuberculosis H37Rv
guggucgagguggcgugugccg

SEQ ID NO: 29406 - RNA, 22 nt, Mycobacterium tuberculosis H37Rv
guguccgucgugggccaguugg

SEQ ID NO: 29407 - RNA, 22 nt, Mycobacterium tuberculosis H37Rv
gugucugccgcucgggucagcg

SEQ ID NO: 29408 - RNA, 22 nt, Mycobacterium tuberculosis H37Rv
gugugcgcgcggacagcuggau

SEQ ID NO: 29409 - RNA, 22 nt, Mycobacterium tuberculosis H37Rv
guucaggagagucguugcggua

SEQ ID NO: 29410 - RNA, 22 nt, Mycobacterium tuberculosis H37Rv
guucagggcaucgguccgugcc

SEQ ID NO: 29411 - RNA, 22 nt, Mycobacterium tuberculosis H37Rv
guuccgguguccgguuggucga

SEQ ID NO: 29412 - RNA, 22 nt, Mycobacterium tuberculosis H37Rv
guucgaaaaccacacugccguu

SEQ ID NO: 29413 - RNA, 22 nt, Mycobacterium tuberculosis H37Rv
guucgcaggcgaugaccgcuac

SEQ ID NO: 29414 - RNA, 22 nt, Mycobacterium tuberculosis H37Rv
guucgccgagauccuccggcug

SEQ ID NO: 29415 - RNA, 21 nt, Mycobacterium tuberculosis H37Rv
guucucguaguagccgcuagg

SEQ ID NO: 29416 - RNA, 22 nt, Mycobacterium tuberculosis H37Rv
guugcgcaucgucaccgguacc

SEQ ID NO: 29417 - RNA, 22 nt, Mycobacterium tuberculosis H37Rv
guuggcagagcgcgacgucucg

SEQ ID NO: 29418 - RNA, 22 nt, Mycobacterium tuberculosis H37Rv
guuggcuaucgaccgcgucaaa

SEQ ID NO: 29419 - RNA, 22 nt, Mycobacterium tuberculosis H37Rv
guugucaugugcauggugaccg

SEQ ID NO: 29420 - RNA, 22 nt, Mycobacterium tuberculosis H37Rv
guugucgacgaagugcacggcu

SEQ ID NO: 29421 - RNA, 22 nt, Mycobacterium tuberculosis H37Rv
guugugaacggaaccgccggga

SEQ ID NO: 29422 - RNA, 22 nt, Mycobacterium tuberculosis H37Rv
uaccagcuggccuuccggacac

SEQ ID NO: 29423 - RNA, 22 nt, Mycobacterium tuberculosis H37Rv
uaccgaaaugcaucggcgcauc

SEQ ID NO: 29424 - RNA, 22 nt, Mycobacterium tuberculosis H37Rv
uaccgcgugcguggccgccaac

SEQ ID NO: 29425 - RNA, 22 nt, Mycobacterium tuberculosis H37Rv
uaccgcucgggcgcgaggacgc

SEQ ID NO: 29426 - RNA, 22 nt, Mycobacterium tuberculosis H37Rv
uaccugggguucuugcugaucg

SEQ ID NO: 29427 - RNA, 22 nt, Mycobacterium tuberculosis H37Rv
uacgcggugaccguagccggau

SEQ ID NO: 29428 - RNA, 22 nt, Mycobacterium tuberculosis H37Rv
uagacguccauaucgccaugcc

SEQ ID NO: 29429 - RNA, 22 nt, Mycobacterium tuberculosis H37Rv
uagccaccgcagcggucgcggu

SEQ ID NO: 29430 - RNA, 22 nt, Mycobacterium tuberculosis H37Rv
uagcgcccggccacuggccaau

SEQ ID NO: 29431 - RNA, 22 nt, Mycobacterium tuberculosis H37Rv
uagcggcgaagcgggccacgcu

SEQ ID NO: 29432 - RNA, 22 nt, Mycobacterium tuberculosis H37Rv
uagcguggcggcgccggacaac

SEQ ID NO: 29433 - RNA, 22 nt, Mycobacterium tuberculosis H37Rv
uaggaacuggcuugugcccaau

SEQ ID NO: 29434 - RNA, 22 nt, Mycobacterium tuberculosis H37Rv
uaguugucgucgucggugccaa

SEQ ID NO: 29435 - RNA, 22 nt, Mycobacterium tuberculosis H37Rv
uaucugcuggccagucccgacg

SEQ ID NO: 29436 - RNA, 22 nt, Mycobacterium tuberculosis H37Rv
ucaacccgaauguguugccagc

SEQ ID NO: 29437 - RNA, 22 nt, Mycobacterium tuberculosis H37Rv
ucaaccgaucggucguccggau

SEQ ID NO: 29438 - RNA, 22 nt, Mycobacterium tuberculosis H37Rv
ucaaccgguauugguggcggcu

SEQ ID NO: 29439 - RNA, 21 nt, Mycobacterium tuberculosis H37Rv
ucaccgcgacggcuugccggg

SEQ ID NO: 29440 - RNA, 22 nt, Mycobacterium tuberculosis H37Rv
ucaccgcggcuuuguccaucgc

SEQ ID NO: 29441 - RNA, 22 nt, Mycobacterium tuberculosis H37Rv
ucaccggucuuggcgacuuggu

SEQ ID NO: 29442 - RNA, 22 nt, Mycobacterium tuberculosis H37Rv
ucaccugcccggucacaaucuc

SEQ ID NO: 29443 - RNA, 22 nt, Mycobacterium tuberculosis H37Rv
ucagcagacgcaaaagcccccg

SEQ ID NO: 29444 - RNA, 22 nt, Mycobacterium tuberculosis H37Rv
ucagcgaucccaaugccugggu

SEQ ID NO: 29445 - RNA, 18 nt, Mycobacterium tuberculosis H37Rv
ucagcgaucggggugcgg

SEQ ID NO: 29446 - RNA, 22 nt, Mycobacterium tuberculosis H37Rv
ucagcgucggcccccgaaccag

SEQ ID NO: 29447 - RNA, 19 nt, Mycobacterium tuberculosis H37Rv
ucagcuguacucgaugaau

SEQ ID NO: 29448 - RNA, 22 nt, Mycobacterium tuberculosis H37Rv
ucagcuguguccgcacaaccgg

SEQ ID NO: 29449 - RNA, 22 nt, Mycobacterium tuberculosis H37Rv
ucaggaucgacucggacuugua

SEQ ID NO: 29450 - RNA, 22 nt, Mycobacterium tuberculosis H37Rv
ucaggugguauccgaugucuuu

SEQ ID NO: 29451 - RNA, 23 nt, Mycobacterium tuberculosis H37Rv
ucauaccgaccaccuguccuagg

SEQ ID NO: 29452 - RNA, 22 nt, Mycobacterium tuberculosis H37Rv
ucaucaccggaucgccgccgac

SEQ ID NO: 29453 - RNA, 22 nt, Mycobacterium tuberculosis H37Rv
ucaucgacgccaccuccggugc

SEQ ID NO: 29454 - RNA, 22 nt, Mycobacterium tuberculosis H37Rv
ucaucgagaccgucgacgaauu

SEQ ID NO: 29455 - RNA, 22 nt, Mycobacterium tuberculosis H37Rv
ucaucgagauccauaugaugua

SEQ ID NO: 29456 - RNA, 20 nt, Mycobacterium tuberculosis H37Rv
ucaucgccgguuacgaagcc

SEQ ID NO: 29457 - RNA, 22 nt, Mycobacterium tuberculosis H37Rv
ucaucgggcacaucgucgcggu

SEQ ID NO: 29458 - RNA, 22 nt, Mycobacterium tuberculosis H37Rv
ucaugcgacucugcgucugcuc

SEQ ID NO: 29459 - RNA, 22 nt, Mycobacterium tuberculosis H37Rv
ucauggugucuagcgaggucgc

SEQ ID NO: 29460 - RNA, 22 nt, Mycobacterium tuberculosis H37Rv
ucauguucuuucgcgucuacuc

SEQ ID NO: 29461 - RNA, 22 nt, Mycobacterium tuberculosis H37Rv
uccaacuccaagaugccgcccc

SEQ ID NO: 29462 - RNA, 22 nt, Mycobacterium tuberculosis H37Rv
uccacgcaacuggccgcgacac

SEQ ID NO: 29463 - RNA, 22 nt, Mycobacterium tuberculosis H37Rv
uccacgguuuaucgugcccagc

SEQ ID NO: 29464 - RNA, 23 nt, Mycobacterium tuberculosis H37Rv
uccagcccgacucauacccgcug

SEQ ID NO: 29465 - RNA, 22 nt, Mycobacterium tuberculosis H37Rv
uccaggguggugcggaucaggu

SEQ ID NO: 29466 - RNA, 22 nt, Mycobacterium tuberculosis H37Rv
uccaucaucggaaggcgucgac

SEQ ID NO: 29467 - RNA, 22 nt, Mycobacterium tuberculosis H37Rv
ucccgacgugcgcgccgggguc

SEQ ID NO: 29468 - RNA, 22 nt, Mycobacterium tuberculosis H37Rv
ucccggcuggcugcgaccgagc

SEQ ID NO: 29469 - RNA, 22 nt, Mycobacterium tuberculosis H37Rv
uccgcaagcgcugaccaucgcu

SEQ ID NO: 29470 - RNA, 22 nt, Mycobacterium tuberculosis H37Rv
uccgccgugaguucacguucgg

SEQ ID NO: 29471 - RNA, 22 nt, Mycobacterium tuberculosis H37Rv
uccgcgcaccacgaccgaaccg

SEQ ID NO: 29472 - RNA, 22 nt, Mycobacterium tuberculosis H37Rv
uccggacgcggucaugggcguu

SEQ ID NO: 29473 - RNA, 22 nt, Mycobacterium tuberculosis H37Rv
caggguggugagaaugacgccc

SEQ ID NO: 29474 - RNA, 22 nt, Mycobacterium tuberculosis H37Rv
caggugcucgcugaucuugucg

SEQ ID NO: 29475 - RNA, 21 nt, Mycobacterium tuberculosis H37Rv
cagucgucuggcagcggccug

SEQ ID NO: 29476 - RNA, 21 nt, Mycobacterium tuberculosis H37Rv
caucaggugcauaacguugcc

SEQ ID NO: 29477 - RNA, 23 nt, Mycobacterium tuberculosis H37Rv
cauccugcuggugcggaccggca

SEQ ID NO: 29478 - RNA, 22 nt, Mycobacterium tuberculosis H37Rv
caucggugcgcacgcgucgaca

SEQ ID NO: 29479 - RNA, 20 nt, Mycobacterium tuberculosis H37Rv
caucgguucucgggccagca

SEQ ID NO: 29480 - RNA, 22 nt, Mycobacterium tuberculosis H37Rv
caucucugugucgauccgauga

SEQ ID NO: 29481 - RNA, 22 nt, Mycobacterium tuberculosis H37Rv
caucugcagcuggaccgccugg

SEQ ID NO: 29482 - RNA, 22 nt, Mycobacterium tuberculosis H37Rv
caugcaucggaagaaccggcau

SEQ ID NO: 29483 - RNA, 21 nt, Mycobacterium tuberculosis H37Rv
caugccggggcgguucaucga

SEQ ID NO: 29484 - RNA, 22 nt, Mycobacterium tuberculosis H37Rv
cauggaaaugcuuugcacggcg

SEQ ID NO: 29485 - RNA, 21 nt, Mycobacterium tuberculosis H37Rv
cauggguccgcucuuuacguu

SEQ ID NO: 29486 - RNA, 22 nt, Mycobacterium tuberculosis H37Rv
caugggugcgguaagcgcgucu

SEQ ID NO: 29487 - RNA, 22 nt, Mycobacterium tuberculosis H37Rv
cauggugggcgcgggccagcac

SEQ ID NO: 29488 - RNA, 22 nt, Mycobacterium tuberculosis H37Rv
cauugaaaccgaugaucaccgc

SEQ ID NO: 29489 - RNA, 22 nt, Mycobacterium tuberculosis H37Rv
ccacccguaugaucgcugcggc

SEQ ID NO: 29490 - RNA, 22 nt, Mycobacterium tuberculosis H37Rv
ccacgacgagcucgugcugccg

SEQ ID NO: 29491 - RNA, 22 nt, Mycobacterium tuberculosis H37Rv
ccagcgugacgccacugcgaga

SEQ ID NO: 29492 - RNA, 22 nt, Mycobacterium tuberculosis H37Rv
ccaggaacgggacgccgugugc

SEQ ID NO: 29493 - RNA, 22 nt, Mycobacterium tuberculosis H37Rv
ccaggacaggaugcugucggcc

SEQ ID NO: 29494 - RNA, 22 nt, Mycobacterium tuberculosis H37Rv
ccaggugcugcugaccgcgcac

SEQ ID NO: 29495 - RNA, 22 nt, Mycobacterium tuberculosis H37Rv
ccagugcggauagcgcggcggc

SEQ ID NO: 29496 - RNA, 22 nt, Mycobacterium tuberculosis H37Rv
ccaguucgguauguuuggcggc

SEQ ID NO: 29497 - RNA, 22 nt, Mycobacterium tuberculosis H37Rv
cccaggcugaacauccgggccg

SEQ ID NO: 29498 - RNA, 22 nt, Mycobacterium tuberculosis H37Rv
cccgacagcaccaccgauaccg

SEQ ID NO: 29499 - RNA, 22 nt, Mycobacterium tuberculosis H37Rv
cccggucaaagaugucgcuggg

SEQ ID NO: 29500 - RNA, 22 nt, Mycobacterium tuberculosis H37Rv
cccggucuacgacgucgcugua

SEQ ID NO: 29501 - RNA, 22 nt, Mycobacterium tuberculosis H37Rv
cccggugagcugaucuucguga

SEQ ID NO: 29502 - RNA, 22 nt, Mycobacterium tuberculosis H37Rv
cccgucguacggcuggaucugg

SEQ ID NO: 29503 - RNA, 22 nt, Mycobacterium tuberculosis H37Rv
cccguuaccgaucagcggacgg

SEQ ID NO: 29504 - RNA, 21 nt, Mycobacterium tuberculosis H37Rv
cccuggugcuggccaccggcu

SEQ ID NO: 29505 - RNA, 22 nt, Mycobacterium tuberculosis H37Rv
cccuggugguccgaucguucau

SEQ ID NO: 29506 - RNA, 22 nt, Mycobacterium tuberculosis H37Rv
ccgaacgcaucggugugacguu

SEQ ID NO: 29507 - RNA, 22 nt, Mycobacterium tuberculosis H37Rv
ccgacugugaaucucacgacgc

SEQ ID NO: 29508 - RNA, 22 nt, Mycobacterium tuberculosis H37Rv
ccgagacugacguuuugcagug

SEQ ID NO: 29509 - RNA, 22 nt, Mycobacterium tuberculosis H37Rv
ccgaucauuucggugauuccgg

SEQ ID NO: 29510 - RNA, 22 nt, Mycobacterium tuberculosis H37Rv
ccgauggucugccguacaccca

SEQ ID NO: 29511 - RNA, 22 nt, Mycobacterium tuberculosis H37Rv
ccgauuccgauugccgccccau

SEQ ID NO: 29512 - RNA, 22 nt, Mycobacterium tuberculosis H37Rv
ccgcaucggugucuuccgggcg

SEQ ID NO: 29513 - RNA, 22 nt, Mycobacterium tuberculosis H37Rv
ccgcgaucuccuccucgcugag

SEQ ID NO: 29514 - RNA, 22 nt, Mycobacterium tuberculosis H37Rv
ccgcuguugccguugguccagc

SEQ ID NO: 29515 - RNA, 22 nt, Mycobacterium tuberculosis H37Rv
ccgcuuggggugacacgggguu

SEQ ID NO: 29516 - RNA, 18 nt, Mycobacterium tuberculosis H37Rv
ccggcguucuggugcucg

SEQ ID NO: 29517 - RNA, 22 nt, Mycobacterium tuberculosis H37Rv
ccggugauaugggucgucucgu

SEQ ID NO: 29518 - RNA, 22 nt, Mycobacterium tuberculosis H37Rv
ccgguggacaagaucuuuaccc

SEQ ID NO: 29519 - RNA, 22 nt, Mycobacterium tuberculosis H37Rv
ccggugguggaaggccugcuga

SEQ ID NO: 29520 - RNA, 22 nt, Mycobacterium tuberculosis H37Rv
ccgguucaucguaaucgggguc

SEQ ID NO: 29521 - RNA, 22 nt, Mycobacterium tuberculosis H37Rv
ccgguuguccagauacgacgug

SEQ ID NO: 29522 - RNA, 22 nt, Mycobacterium tuberculosis H37Rv
ccguaacgcgugcacuucggcg

SEQ ID NO: 29523 - RNA, 22 nt, Mycobacterium tuberculosis H37Rv
ccguaucaccggucgcugacaa

SEQ ID NO: 29524 - RNA, 22 nt, Mycobacterium tuberculosis H37Rv
ccgucgcuuccgcuggugccag

SEQ ID NO: 29525 - RNA, 22 nt, Mycobacterium tuberculosis H37Rv
ccgucucaccgaggauuucgac

SEQ ID NO: 29526 - RNA, 22 nt, Mycobacterium tuberculosis H37Rv
ccgugagccggugcagagccgg

SEQ ID NO: 29527 - RNA, 22 nt, Mycobacterium tuberculosis H37Rv
ccguucgccgacauggguuuug

SEQ ID NO: 29528 - RNA, 21 nt, Mycobacterium tuberculosis H37Rv
ccguucgcguuugugugggcc

SEQ ID NO: 29529 - RNA, 22 nt, Mycobacterium tuberculosis H37Rv
ccguuuggucccgaggugucgg

SEQ ID NO: 29530 - RNA, 16 nt, Mycobacterium tuberculosis H37Rv
ccucaccggccaggcg

SEQ ID NO: 29531 - RNA, 22 nt, Mycobacterium tuberculosis H37Rv
ccucuagguccgaugguggcga

SEQ ID NO: 29532 - RNA, 22 nt, Mycobacterium tuberculosis H37Rv
ccugggugccgaucgagccggu

SEQ ID NO: 29533 - RNA, 22 nt, Mycobacterium tuberculosis H37Rv
cgaagaacugguugccgucgac

SEQ ID NO: 29534 - RNA, 22 nt, Mycobacterium tuberculosis H37Rv
cgaaugugcacugguggcggcg

SEQ ID NO: 29535 - RNA, 22 nt, Mycobacterium tuberculosis H37Rv
cgaccaagcgucggcccaacca

SEQ ID NO: 29536 - RNA, 22 nt, Mycobacterium tuberculosis H37Rv
cgaccguuccgucgugcagucg

SEQ ID NO: 29537 - RNA, 22 nt, Mycobacterium tuberculosis H37Rv
cgacgaggcgcaacggauuccg

SEQ ID NO: 29538 - RNA, 22 nt, Mycobacterium tuberculosis H37Rv
cgacgucccucucuauuggcaa

SEQ ID NO: 29539 - RNA, 22 nt, Mycobacterium tuberculosis H37Rv
cgagcagacgcaaaagccaccg

SEQ ID NO: 29540 - RNA, 22 nt, Mycobacterium tuberculosis H37Rv
cgagcagacgcaaaagccccca

SEQ ID NO: 29541 - RNA, 22 nt, Mycobacterium tuberculosis H37Rv
cgagcagacgcauaagcccccg

SEQ ID NO: 29542 - RNA, 22 nt, Mycobacterium tuberculosis H37Rv
cgagcagacgcgaaaucccccg

SEQ ID NO: 29543 - RNA, 22 nt, Mycobacterium tuberculosis H37Rv
cgagcagacguaaagcccccaa

SEQ ID NO: 29544 - RNA, 22 nt, Mycobacterium tuberculosis H37Rv
cgagcagucgcauaagcccccg

SEQ ID NO: 29545 - RNA, 23 nt, Mycobacterium tuberculosis H37Rv
cgagcgguauggccggcgcugac

SEQ ID NO: 29546 - RNA, 22 nt, Mycobacterium tuberculosis H37Rv
cgagcguaacgccacugcgauu

SEQ ID NO: 29547 - RNA, 22 nt, Mycobacterium tuberculosis H37Rv
cgagcguaacgucacugcgaga

SEQ ID NO: 29548 - RNA, 22 nt, Mycobacterium tuberculosis H37Rv
cgaggauuucgucgcgcggcug

SEQ ID NO: 29549 - RNA, 22 nt, Mycobacterium tuberculosis H37Rv
cgaggcauccaccgccgcaucg

SEQ ID NO: 29550 - RNA, 22 nt, Mycobacterium tuberculosis H37Rv
cgagguguggucauggagcacc

SEQ ID NO: 29551 - RNA, 22 nt, Mycobacterium tuberculosis H37Rv
cgaguagucacgugccaguuug

SEQ ID NO: 29552 - RNA, 22 nt, Mycobacterium tuberculosis H37Rv
cgaguaucgcuugcgcaccgau

SEQ ID NO: 29553 - RNA, 22 nt, Mycobacterium tuberculosis H37Rv
cgauccacugaccgaguagcgc

SEQ ID NO: 29554 - RNA, 21 nt, Mycobacterium tuberculosis H37Rv
cgauccggccgggauuuucgg

SEQ ID NO: 29555 - RNA, 22 nt, Mycobacterium tuberculosis H37Rv
cgauccucgcaccgcucgccgc

SEQ ID NO: 29556 - RNA, 22 nt, Mycobacterium tuberculosis H37Rv
cgaugacccgcaggcccagccc

SEQ ID NO: 29557 - RNA, 22 nt, Mycobacterium tuberculosis H37Rv
cgaugagaucuguuccggucgc

SEQ ID NO: 29558 - RNA, 21 nt, Mycobacterium tuberculosis H37Rv
cgaugcggcccagauugacgc

SEQ ID NO: 29559 - RNA, 20 nt, Mycobacterium tuberculosis H37Rv
cgauggucagcgcuugcgga

SEQ ID NO: 29560 - RNA, 22 nt, Mycobacterium tuberculosis H37Rv
cgaugguuaccuguucgccuuc

SEQ ID NO: 29561 - RNA, 22 nt, Mycobacterium tuberculosis H37Rv
cgauguggcacugugcaccgcc

SEQ ID NO: 29562 - RNA, 22 nt, Mycobacterium tuberculosis H37Rv
cgcaggguuuggagucgguggc

SEQ ID NO: 29563 - RNA, 22 nt, Mycobacterium tuberculosis H37Rv
cgcaggucgcgaccacgcugac

SEQ ID NO: 29564 - RNA, 22 nt, Mycobacterium tuberculosis H37Rv
cgccacgugccggugcucgacg

SEQ ID NO: 29565 - RNA, 19 nt, Mycobacterium tuberculosis H37Rv
cgccaucgcgcugugccuc

SEQ ID NO: 29566 - RNA, 22 nt, Mycobacterium tuberculosis H37Rv
cgccgagauccacgccagagcg

SEQ ID NO: 29567 - RNA, 22 nt, Mycobacterium tuberculosis H37Rv
cgccgcauuggcgaugucggcg

SEQ ID NO: 29568 - RNA, 22 nt, Mycobacterium tuberculosis H37Rv
cgccugcucccagcgcggcuau

SEQ ID NO: 29569 - RNA, 22 nt, Mycobacterium tuberculosis H37Rv
cgcgaauguaacgccacugcga

SEQ ID NO: 29570 - RNA, 22 nt, Mycobacterium tuberculosis H37Rv
cgcgagcagacacagaaucgca

SEQ ID NO: 29571 - RNA, 22 nt, Mycobacterium tuberculosis H37Rv
cgcgagcagacgcagaaucgca

SEQ ID NO: 29572 - RNA, 21 nt, Mycobacterium tuberculosis H37Rv
cgcgccauggcaacccggccc

SEQ ID NO: 29573 - RNA, 22 nt, Mycobacterium tuberculosis H37Rv
cgcgcguaucgcacgcauuggg

SEQ ID NO: 29574 - RNA, 22 nt, Mycobacterium tuberculosis H37Rv
cgcggucuugcaguacaugucc

SEQ ID NO: 29575 - RNA, 22 nt, Mycobacterium tuberculosis H37Rv
cgcuaacgucgaucucggcgca

SEQ ID NO: 29576 - RNA, 22 nt, Mycobacterium tuberculosis H37Rv
cgcuaugcugacugauuccgcg

SEQ ID NO: 29577 - RNA, 18 nt, Mycobacterium tuberculosis H37Rv
cgcugacaccaucagcau

SEQ ID NO: 29578 - RNA, 22 nt, Mycobacterium tuberculosis H37Rv
cgcugcagcggcagccuccgcc

SEQ ID NO: 29579 - RNA, 22 nt, Mycobacterium tuberculosis H37Rv
cgcugccaguucaccagccgca

SEQ ID NO: 29580 - RNA, 23 nt, Mycobacterium tuberculosis H37Rv
cgcugcgaucgaagacguccugc

SEQ ID NO: 29581 - RNA, 22 nt, Mycobacterium tuberculosis H37Rv
cggacgaaguccucggcguucu

SEQ ID NO: 29582 - RNA, 20 nt, Mycobacterium tuberculosis H37Rv
cggauacacaacguggcugc

SEQ ID NO: 29583 - RNA, 22 nt, Mycobacterium tuberculosis H37Rv
cggcacuucgguuugaccgacc

SEQ ID NO: 29584 - RNA, 22 nt, Mycobacterium tuberculosis H37Rv
cggcauuggccagaccgguguu

SEQ ID NO: 29585 - RNA, 22 nt, Mycobacterium tuberculosis H37Rv
cggccauccucgagcaccugca

SEQ ID NO: 29586 - RNA, 22 nt, Mycobacterium tuberculosis H37Rv
cggcgagacggaugccgugacg

SEQ ID NO: 29587 - RNA, 22 nt, Mycobacterium tuberculosis H37Rv
cggcuagcagcccaacaggacu

SEQ ID NO: 29588 - RNA, 22 nt, Mycobacterium tuberculosis H37Rv
cggcuucccagacuucggauuc

SEQ ID NO: 29589 - RNA, 22 nt, Mycobacterium tuberculosis H37Rv
cgggauggugaccgcggcgaug

SEQ ID NO: 29590 - RNA, 22 nt, Mycobacterium tuberculosis H37Rv
cgggcagacgcguaagcgccca

SEQ ID NO: 29591 - RNA, 22 nt, Mycobacterium tuberculosis H37Rv
cggguucgcgaucgcgccggag

SEQ ID NO: 29592 - RNA, 22 nt, Mycobacterium tuberculosis H37Rv
cgguacgguccgcaguugggug

SEQ ID NO: 29593 - RNA, 22 nt, Mycobacterium tuberculosis H37Rv
cggucaccaucucgcagacaua

SEQ ID NO: 29594 - RNA, 22 nt, Mycobacterium tuberculosis H37Rv
cggucgacguuccuagcuuucg

SEQ ID NO: 29595 - RNA, 22 nt, Mycobacterium tuberculosis H37Rv
cggucgcugaugcuggauguga

SEQ ID NO: 29596 - RNA, 22 nt, Mycobacterium tuberculosis H37Rv
cggucgcuugcguucaccgcga

SEQ ID NO: 29597 - RNA, 22 nt, Mycobacterium tuberculosis H37Rv
cggugaccgcgacccgcgcggu

SEQ ID NO: 29598 - RNA, 22 nt, Mycobacterium tuberculosis H37Rv
cggugaucacggucggcgggua

SEQ ID NO: 29599 - RNA, 22 nt, Mycobacterium tuberculosis H37Rv
cggugaucgaucugccggccuc

SEQ ID NO: 29600 - RNA, 22 nt, Mycobacterium tuberculosis H37Rv
cggugcaauggucgcaugcucu

SEQ ID NO: 29601 - RNA, 22 nt, Mycobacterium tuberculosis H37Rv
cgguggcauagguaguugcucg

SEQ ID NO: 29602 - RNA, 22 nt, Mycobacterium tuberculosis H37Rv
cggugucgaagaucgugggaca

SEQ ID NO: 29603 - RNA, 22 nt, Mycobacterium tuberculosis H37Rv
cgguuccgucguaggcguccac

SEQ ID NO: 29604 - RNA, 22 nt, Mycobacterium tuberculosis H37Rv
cgguugacgggcguccgcgccg

SEQ ID NO: 29605 - RNA, 22 nt, Mycobacterium tuberculosis H37Rv
cgguuugacgucgcgaugcguu

SEQ ID NO: 29606 - RNA, 22 nt, Mycobacterium tuberculosis H37Rv
cguagagcgugggguugccggc

SEQ ID NO: 29607 - RNA, 22 nt, Mycobacterium tuberculosis H37Rv
cgucccgaucacccaaccaggc

SEQ ID NO: 29608 - RNA, 22 nt, Mycobacterium tuberculosis H37Rv
cguccgaaggcaucggcgaguc

SEQ ID NO: 29609 - RNA, 22 nt, Mycobacterium tuberculosis H37Rv
cgucgccaucagaaggucaucg

SEQ ID NO: 29610 - RNA, 22 nt, Mycobacterium tuberculosis H37Rv
cgucgugguggucggcggcucg

SEQ ID NO: 29611 - RNA, 22 nt, Mycobacterium tuberculosis H37Rv
cgucuccgacguacuggauggu

SEQ ID NO: 29612 - RNA, 23 nt, Mycobacterium tuberculosis H37Rv
cgucucgguaugggagcugcucc

SEQ ID NO: 29613 - RNA, 22 nt, Mycobacterium tuberculosis H37Rv
cgucugccccaccuucugcuug

SEQ ID NO: 29614 - RNA, 17 nt, Mycobacterium tuberculosis H37Rv
cgucugccggcagcgca

SEQ ID NO: 29615 - RNA, 22 nt, Mycobacterium tuberculosis H37Rv
cgucuggugcagggauucuucg

SEQ ID NO: 29616 - RNA, 22 nt, Mycobacterium tuberculosis H37Rv
cgugcaccugcggaccaugcau

SEQ ID NO: 29617 - RNA, 22 nt, Mycobacterium tuberculosis H37Rv
cgugcucgauccgacgcggcuc

SEQ ID NO: 29618 - RNA, 22 nt, Mycobacterium tuberculosis H37Rv
cguucgaucaccggcccgcugc

SEQ ID NO: 29619 - RNA, 22 nt, Mycobacterium tuberculosis H37Rv
cguugacucugcguccaccgug

SEQ ID NO: 29620 - RNA, 22 nt, Mycobacterium tuberculosis H37Rv
cuacgccgcgguguucaucgac

SEQ ID NO: 29621 - RNA, 22 nt, Mycobacterium tuberculosis H37Rv
cuacuucgacgucgaaccccgu

SEQ ID NO: 29622 - RNA, 22 nt, Mycobacterium tuberculosis H37Rv
cucagcgaggaguacuacaggg

SEQ ID NO: 29623 - RNA, 22 nt, Mycobacterium tuberculosis H37Rv
cucagcugcagugcggugggcg

SEQ ID NO: 29624 - RNA, 22 nt, Mycobacterium tuberculosis H37Rv
cucagucgguccugaaggcguu

SEQ ID NO: 29625 - RNA, 22 nt, Mycobacterium tuberculosis H37Rv
cuccggugccggcaguagucgg

SEQ ID NO: 29626 - RNA, 22 nt, Mycobacterium tuberculosis H37Rv
cucgcgaucuggauggccggug

SEQ ID NO: 29627 - RNA, 18 nt, Mycobacterium tuberculosis H37Rv
cucggcgaccacguccuu

SEQ ID NO: 29628 - RNA, 22 nt, Mycobacterium tuberculosis H37Rv
cugacgguggcgacgccaugcc

SEQ ID NO: 29629 - RNA, 22 nt, Mycobacterium tuberculosis H37Rv
cugaucgcgucaucgaucgugc

SEQ ID NO: 29630 - RNA, 22 nt, Mycobacterium tuberculosis H37Rv
cugaugacagccuguguuuccg

SEQ ID NO: 29631 - RNA, 22 nt, Mycobacterium tuberculosis H37Rv
cugaugauccagcgcggcugcg

SEQ ID NO: 29632 - RNA, 22 nt, Mycobacterium tuberculosis H37Rv
cugcaacagaauugggcuacuc

SEQ ID NO: 29633 - RNA, 22 nt, Mycobacterium tuberculosis H37Rv
cugcaauucgacagcugugcgu

SEQ ID NO: 29634 - RNA, 22 nt, Mycobacterium tuberculosis H37Rv
cugcgaagaaguccauccugac

SEQ ID NO: 29635 - RNA, 22 nt, Mycobacterium tuberculosis H37Rv
cugcggaugggucagcagauug

SEQ ID NO: 29636 - RNA, 22 nt, Mycobacterium tuberculosis H37Rv
cugcuccggcacguuggucgag

SEQ ID NO: 29637 - RNA, 22 nt, Mycobacterium tuberculosis H37Rv
cugcugcuggccggccagcccg

SEQ ID NO: 29638 - RNA, 22 nt, Mycobacterium tuberculosis H37Rv
cuggccgacggugucgccggug

SEQ ID NO: 29639 - RNA, 22 nt, Mycobacterium tuberculosis H37Rv
cuggccgagcuggucaacggcg

SEQ ID NO: 29640 - RNA, 22 nt, Mycobacterium tuberculosis H37Rv
cuggcggucggugccgucgaug

SEQ ID NO: 29641 - RNA, 22 nt, Mycobacterium tuberculosis H37Rv
cuggcuugccuccugccgcgac

SEQ ID NO: 29642 - RNA, 22 nt, Mycobacterium tuberculosis H37Rv
cugggcgaugaagcgcuggguc

SEQ ID NO: 29643 - RNA, 22 nt, Mycobacterium tuberculosis H37Rv
cuggugaugaucgguuccgcgg

SEQ ID NO: 29644 - RNA, 20 nt, Mycobacterium tuberculosis H37Rv
cugguugcaugacaaucacg

SEQ ID NO: 29645 - RNA, 22 nt, Mycobacterium tuberculosis H37Rv
cuucgguaucgccuccgccuuu

SEQ ID NO: 29646 - RNA, 22 nt, Mycobacterium tuberculosis H37Rv
cuugcugguaugccgggccacc

SEQ ID NO: 29647 - RNA, 22 nt, Mycobacterium tuberculosis H37Rv
gaacgcgucggugggaucggug

SEQ ID NO: 29648 - RNA, 22 nt, Mycobacterium tuberculosis H37Rv
gaaggaucuggcgucggcgggc

SEQ ID NO: 29649 - RNA, 22 nt, Mycobacterium tuberculosis H37Rv
gaagucggucaccacagugccg

SEQ ID NO: 29650 - RNA, 22 nt, Mycobacterium tuberculosis H37Rv
gaauaccauugcccccgcggug

SEQ ID NO: 29651 - RNA, 22 nt, Mycobacterium tuberculosis H37Rv
gaaucgcgaacacggcucccgc

SEQ ID NO: 29652 - RNA, 22 nt, Mycobacterium tuberculosis H37Rv
gacaccgaacgaaacgucggga

SEQ ID NO: 29653 - RNA, 22 nt, Mycobacterium tuberculosis H37Rv
gacagacgcaaaaucgcccgaa

SEQ ID NO: 29654 - RNA, 22 nt, Mycobacterium tuberculosis H37Rv
gacaugaucgacccugccaucc

SEQ ID NO: 29655 - RNA, 22 nt, Mycobacterium tuberculosis H37Rv
gaccagguuggacagcaucgcc

SEQ ID NO: 29656 - RNA, 22 nt, Mycobacterium tuberculosis H37Rv
gaccaugucgcggcguagccgu

SEQ ID NO: 29657 - RNA, 22 nt, Mycobacterium tuberculosis H37Rv
gaccucaucggccaucgcugcg

SEQ ID NO: 29658 - RNA, 22 nt, Mycobacterium tuberculosis H37Rv
gaccugguugacaccggcgacc

SEQ ID NO: 29659 - RNA, 22 nt, Mycobacterium tuberculosis H37Rv
gacgaaugcgaaugcauccgcu

SEQ ID NO: 29660 - RNA, 22 nt, Mycobacterium tuberculosis H37Rv
gacgcgaaagaacaugaugggc

SEQ ID NO: 29661 - RNA, 22 nt, Mycobacterium tuberculosis H37Rv
gacgcucuggccacuaaguugu

SEQ ID NO: 29662 - RNA, 22 nt, Mycobacterium tuberculosis H37Rv
gacgucgucgcagccggccauc

SEQ ID NO: 29663 - RNA, 22 nt, Mycobacterium tuberculosis H37Rv
gacugguacgccgaccugccgg

SEQ ID NO: 29664 - RNA, 22 nt, Mycobacterium tuberculosis H37Rv
gagaccacagcaccgaccgacu

SEQ ID NO: 29665 - RNA, 22 nt, Mycobacterium tuberculosis H37Rv
gagaccuucgaccgauguucga

SEQ ID NO: 29666 - RNA, 22 nt, Mycobacterium tuberculosis H37Rv
gagagcuucucgccgucgauau

SEQ ID NO: 29667 - RNA, 22 nt, Mycobacterium tuberculosis H37Rv
gagaucaacauuuugcaggcaa

SEQ ID NO: 29668 - RNA, 22 nt, Mycobacterium tuberculosis H37Rv
gagcagacgcaaaagcccccau

SEQ ID NO: 29669 - RNA, 22 nt, Mycobacterium tuberculosis H37Rv
gagcagacgcaaaagcccccga

SEQ ID NO: 29670 - RNA, 22 nt, Mycobacterium tuberculosis H37Rv
gagcagacgcagaaucgcaucg

SEQ ID NO: 29671 - RNA, 22 nt, Mycobacterium tuberculosis H37Rv
gagcagacgucaaagcccccga

SEQ ID NO: 29672 - RNA, 22 nt, Mycobacterium tuberculosis H37Rv
gagcguaacgccacggcgagcu

SEQ ID NO: 29673 - RNA, 22 nt, Mycobacterium tuberculosis H37Rv
gaggaauucgcacccgcugccg

SEQ ID NO: 29674 - RNA, 23 nt, Mycobacterium tuberculosis H37Rv
gaggcgcuggcagcggcccgguu

SEQ ID NO: 29675 - RNA, 22 nt, Mycobacterium tuberculosis H37Rv
gagggacuuaugcgucugcuag

SEQ ID NO: 29676 - RNA, 22 nt, Mycobacterium tuberculosis H37Rv
gagguguccgacgaaccugguu

SEQ ID NO: 29677 - RNA, 22 nt, Mycobacterium tuberculosis H37Rv
gaguaggcgcaaaagaacauga

SEQ ID NO: 29678 - RNA, 22 nt, Mycobacterium tuberculosis H37Rv
gagucagccgcgguauggcgca

SEQ ID NO: 29679 - RNA, 22 nt, Mycobacterium tuberculosis H37Rv
gaguucuucgcgguggccaaga

SEQ ID NO: 29680 - RNA, 22 nt, Mycobacterium tuberculosis H37Rv
gaucaguccggcccgggcgaua

SEQ ID NO: 29681 - RNA, 21 nt, Mycobacterium tuberculosis H37Rv
gauccgaguccgagcucggcc

SEQ ID NO: 29682 - RNA, 22 nt, Mycobacterium tuberculosis H37Rv
gauccgcccagauuugccggaa

SEQ ID NO: 29683 - RNA, 22 nt, Mycobacterium tuberculosis H37Rv
gaucgccgauaucgacggccug

SEQ ID NO: 29684 - RNA, 22 nt, Mycobacterium tuberculosis H37Rv
gaucgcugauggcgucggccag

SEQ ID NO: 29685 - RNA, 22 nt, Mycobacterium tuberculosis H37Rv
gaucggcgccagguccgaucgc

SEQ ID NO: 29686 - RNA, 22 nt, Mycobacterium tuberculosis H37Rv
gaucgggugcuugcggugaucu

SEQ ID NO: 29687 - RNA, 22 nt, Mycobacterium tuberculosis H37Rv
gaucgucgccgacggcuaccga

SEQ ID NO: 29688 - RNA, 22 nt, Mycobacterium tuberculosis H37Rv
gaucguggugcggugcuugcca

SEQ ID NO: 29689 - RNA, 22 nt, Mycobacterium tuberculosis H37Rv
gaucguugauccagccggccag

SEQ ID NO: 29690 - RNA, 22 nt, Mycobacterium tuberculosis H37Rv
gaucuagcgaacgugggaucga

SEQ ID NO: 29691 - RNA, 22 nt, Mycobacterium tuberculosis H37Rv
gaucuugucccggcgguggcgc

SEQ ID NO: 29692 - RNA, 22 nt, Mycobacterium tuberculosis H37Rv
gaugagaucaacgacgucgucc

SEQ ID NO: 29693 - RNA, 22 nt, Mycobacterium tuberculosis H37Rv
gaugcccacgacgacgauaucg

SEQ ID NO: 29694 - RNA, 22 nt, Mycobacterium tuberculosis H37Rv
gaugccgacguggucggacugg

SEQ ID NO: 29695 - RNA, 22 nt, Mycobacterium tuberculosis H37Rv
gaugcgggugcagcacaccaac

SEQ ID NO: 29696 - RNA, 22 nt, Mycobacterium tuberculosis H37Rv
gauggcgaugcgcaccccgucg

SEQ ID NO: 29697 - RNA, 22 nt, Mycobacterium tuberculosis H37Rv
gauguugacucugguggcgacg

SEQ ID NO: 29698 - RNA, 22 nt, Mycobacterium tuberculosis H37Rv
gauuguucuggaugaucguggu

SEQ ID NO: 29699 - RNA, 22 nt, Mycobacterium tuberculosis H37Rv
gcaaccguugcucgaguccaga

SEQ ID NO: 29700 - RNA, 22 nt, Mycobacterium tuberculosis H37Rv
gcaagcugcgggcgcuuggugu

SEQ ID NO: 29701 - RNA, 23 nt, Mycobacterium tuberculosis H37Rv
gcacaucgaccacccguccgagg

SEQ ID NO: 29702 - RNA, 22 nt, Mycobacterium tuberculosis H37Rv
gcaccucgucaaacgccgucga

SEQ ID NO: 29703 - RNA, 23 nt, Mycobacterium tuberculosis H37Rv
gcacgcgacaagcucguuugugg

SEQ ID NO: 29704 - RNA, 22 nt, Mycobacterium tuberculosis H37Rv
gcacuccgcccagacccaucau

SEQ ID NO: 29705 - RNA, 22 nt, Mycobacterium tuberculosis H37Rv
gcacuugcuuuguuaggagcgu

SEQ ID NO: 29706 - RNA, 22 nt, Mycobacterium tuberculosis H37Rv
gcagacgcaaaaucgcccaaau

SEQ ID NO: 29707 - RNA, 22 nt, Mycobacterium tuberculosis H37Rv
gcagacucuuggucaugggcug

SEQ ID NO: 29708 - RNA, 22 nt, Mycobacterium tuberculosis H37Rv
gcaggcagugucaugccgccga

SEQ ID NO: 29709 - RNA, 22 nt, Mycobacterium tuberculosis H37Rv
gcagugcgauucugcgucugcu

SEQ ID NO: 29710 - RNA, 22 nt, Mycobacterium tuberculosis H37Rv
acgugggcgccucggcggguuc

SEQ ID NO: 29711 - RNA, 22 nt, Mycobacterium tuberculosis H37Rv
acguugaccgcgguggcgugcu

SEQ ID NO: 29712 - RNA, 22 nt, Mycobacterium tuberculosis H37Rv
acguugcuggacauggugcggg

SEQ ID NO: 29713 - RNA, 22 nt, Mycobacterium tuberculosis H37Rv
acuguuggccgcggagguauuc

SEQ ID NO: 29714 - RNA, 22 nt, Mycobacterium tuberculosis H37Rv
acuugccgaacugggcgguguu

SEQ ID NO: 29715 - RNA, 22 nt, Mycobacterium tuberculosis H37Rv
acuugcucgccgaccugcugcc

SEQ ID NO: 29716 - RNA, 22 nt, Mycobacterium tuberculosis H37Rv
agaccgguuacccggugaucuc

SEQ ID NO: 29717 - RNA, 22 nt, Mycobacterium tuberculosis H37Rv
agacgcauaagcccccgacacg

SEQ ID NO: 29718 - RNA, 19 nt, Mycobacterium tuberculosis H37Rv
agaguuacagccucagcga

SEQ ID NO: 29719 - RNA, 22 nt, Mycobacterium tuberculosis H37Rv
agcaccuacaugugguggaggu

SEQ ID NO: 29720 - RNA, 22 nt, Mycobacterium tuberculosis H37Rv
agcagacgcaaaaucgcccaaa

SEQ ID NO: 29721 - RNA, 22 nt, Mycobacterium tuberculosis H37Rv
agcagacgcaaaaucgcccauu

SEQ ID NO: 29722 - RNA, 22 nt, Mycobacterium tuberculosis H37Rv
agcagacgcaaaaucgcccgaa

SEQ ID NO: 29723 - RNA, 22 nt, Mycobacterium tuberculosis H37Rv
agcagacgcagaaucgcacugc

SEQ ID NO: 29724 - RNA, 22 nt, Mycobacterium tuberculosis H37Rv
agcagacguaaaagcccccauu

SEQ ID NO: 29725 - RNA, 22 nt, Mycobacterium tuberculosis H37Rv
agcagacguaaaagcccccgca

SEQ ID NO: 29726 - RNA, 22 nt, Mycobacterium tuberculosis H37Rv
agcagucgcaaaagcccccgca

SEQ ID NO: 29727 - RNA, 22 nt, Mycobacterium tuberculosis H37Rv
agcaugcgaccauugcaccgug

SEQ ID NO: 29728 - RNA, 22 nt, Mycobacterium tuberculosis H37Rv
agcauggcgcauaccuuguccg

SEQ ID NO: 29729 - RNA, 22 nt, Mycobacterium tuberculosis H37Rv
agcccaguguggcauagcggca

SEQ ID NO: 29730 - RNA, 22 nt, Mycobacterium tuberculosis H37Rv
agccgcagcuugucgauguccu

SEQ ID NO: 29731 - RNA, 17 nt, Mycobacterium tuberculosis H37Rv
agccgccuuggaccggc

SEQ ID NO: 29732 - RNA, 22 nt, Mycobacterium tuberculosis H37Rv
agccggugaaucaacgcugaua

SEQ ID NO: 29733 - RNA, 20 nt, Mycobacterium tuberculosis H37Rv
agccuuuguuccggaagcag

SEQ ID NO: 29734 - RNA, 22 nt, Mycobacterium tuberculosis H37Rv
agcggcucaaacaggaugugcc

SEQ ID NO: 29735 - RNA, 21 nt, Mycobacterium tuberculosis H37Rv
agcgguccuugaucagggacc

SEQ ID NO: 29736 - RNA, 22 nt, Mycobacterium tuberculosis H37Rv
agcguguugauguuguccagua

SEQ ID NO: 29737 - RNA, 19 nt, Mycobacterium tuberculosis H37Rv
agcucgcgcagccgggugg

SEQ ID NO: 29738 - RNA, 21 nt, Mycobacterium tuberculosis H37Rv
agcucggccaaaagcgccggc

SEQ ID NO: 29739 - RNA, 22 nt, Mycobacterium tuberculosis H37Rv
agcugcuucuccccuuggucga

SEQ ID NO: 29740 - RNA, 22 nt, Mycobacterium tuberculosis H37Rv
aggcacacgccagacggcgccc

SEQ ID NO: 29741 - RNA, 22 nt, Mycobacterium tuberculosis H37Rv
aggccgaguucgucaugcagcu

SEQ ID NO: 29742 - RNA, 22 nt, Mycobacterium tuberculosis H37Rv
aggccgugacgaucagguccgg

SEQ ID NO: 29743 - RNA, 22 nt, Mycobacterium tuberculosis H37Rv
agguaaccacacaugccgcagg

SEQ ID NO: 29744 - RNA, 20 nt, Mycobacterium tuberculosis H37Rv
agguacucgcagacgcgguc

SEQ ID NO: 29745 - RNA, 22 nt, Mycobacterium tuberculosis H37Rv
agguagacgugucccgcauggg

SEQ ID NO: 29746 - RNA, 22 nt, Mycobacterium tuberculosis H37Rv
agguccaggaauucggcgaccc

SEQ ID NO: 29747 - RNA, 22 nt, Mycobacterium tuberculosis H37Rv
aggucgugcagauagcgcgggu

SEQ ID NO: 29748 - RNA, 22 nt, Mycobacterium tuberculosis H37Rv
agguguucuucaacgaugucuu

SEQ ID NO: 29749 - RNA, 22 nt, Mycobacterium tuberculosis H37Rv
agguucagcgucgagucgagga

SEQ ID NO: 29750 - RNA, 21 nt, Mycobacterium tuberculosis H37Rv
agucccgagccgcuguugccg

SEQ ID NO: 29751 - RNA, 23 nt, Mycobacterium tuberculosis H37Rv
aguccgggccgacguugccgcgc

SEQ ID NO: 29752 - RNA, 20 nt, Mycobacterium tuberculosis H37Rv
agucgaagucggucagcuug

SEQ ID NO: 29753 - RNA, 22 nt, Mycobacterium tuberculosis H37Rv
agucgauguugucgccacggcu

SEQ ID NO: 29754 - RNA, 22 nt, Mycobacterium tuberculosis H37Rv
agucgcauaagcccccgacacg

SEQ ID NO: 29755 - RNA, 22 nt, Mycobacterium tuberculosis H37Rv
agucggcucgagcaacaccgug

SEQ ID NO: 29756 - RNA, 22 nt, Mycobacterium tuberculosis H37Rv
agugaucggcaccgcuuuggcg

SEQ ID NO: 29757 - RNA, 22 nt, Mycobacterium tuberculosis H37Rv
agugccgcguucaugucggcau

SEQ ID NO: 29758 - RNA, 22 nt, Mycobacterium tuberculosis H37Rv
agugcgacucugcgucugcuca

SEQ ID NO: 29759 - RNA, 22 nt, Mycobacterium tuberculosis H37Rv
agugcgguucauguauucggug

SEQ ID NO: 29760 - RNA, 22 nt, Mycobacterium tuberculosis H37Rv
agugcucgucguccugcucgac

SEQ ID NO: 29761 - RNA, 22 nt, Mycobacterium tuberculosis H37Rv
aguucaaccucuugucggccga

SEQ ID NO: 29762 - RNA, 22 nt, Mycobacterium tuberculosis H37Rv
aguucgugauggaggaugccgu

SEQ ID NO: 29763 - RNA, 22 nt, Mycobacterium tuberculosis H37Rv
aguugucgcgcugaggcgggca

SEQ ID NO: 29764 - RNA, 22 nt, Mycobacterium tuberculosis H37Rv
auacgcgccgacgauccggggu

SEQ ID NO: 29765 - RNA, 22 nt, Mycobacterium tuberculosis H37Rv
aucaaggcgcuacuguucgggg

SEQ ID NO: 29766 - RNA, 22 nt, Mycobacterium tuberculosis H37Rv
aucagcggggacuugguuucgg

SEQ ID NO: 29767 - RNA, 22 nt, Mycobacterium tuberculosis H37Rv
aucaucgaggccgucgggccgg

SEQ ID NO: 29768 - RNA, 22 nt, Mycobacterium tuberculosis H37Rv
aucccgagggacacaucugugc

SEQ ID NO: 29769 - RNA, 23 nt, Mycobacterium tuberculosis H37Rv
auccgccgccuugaacucccacg

SEQ ID NO: 29770 - RNA, 22 nt, Mycobacterium tuberculosis H37Rv
auccgcuagccaacguuaauaa

SEQ ID NO: 29771 - RNA, 22 nt, Mycobacterium tuberculosis H37Rv
aucgaggaaugcgccgcguacg

SEQ ID NO: 29772 - RNA, 22 nt, Mycobacterium tuberculosis H37Rv
aucgccuagccgcggcgggugg

SEQ ID NO: 29773 - RNA, 22 nt, Mycobacterium tuberculosis H37Rv
aucgccugcuggggcgccaucu

SEQ ID NO: 29774 - RNA, 19 nt, Mycobacterium tuberculosis H37Rv
aucgcggcucggccuaccg

SEQ ID NO: 29775 - RNA, 22 nt, Mycobacterium tuberculosis H37Rv
aucgcguccugcgcggaaucgg

SEQ ID NO: 29776 - RNA, 22 nt, Mycobacterium tuberculosis H37Rv
aucgcuucauccaugagcugcu

SEQ ID NO: 29777 - RNA, 22 nt, Mycobacterium tuberculosis H37Rv
aucggaucacauugcgcccgga

SEQ ID NO: 29778 - RNA, 22 nt, Mycobacterium tuberculosis H37Rv
aucggcaagcacggcgacaccg

SEQ ID NO: 29779 - RNA, 22 nt, Mycobacterium tuberculosis H37Rv
aucggcguagcagauaccgggu

SEQ ID NO: 29780 - RNA, 22 nt, Mycobacterium tuberculosis H37Rv
aucggcgugcaagcgguguccg

SEQ ID NO: 29781 - RNA, 22 nt, Mycobacterium tuberculosis H37Rv
aucggcuuucccgccgcccgag

SEQ ID NO: 29782 - RNA, 22 nt, Mycobacterium tuberculosis H37Rv
aucggugcgcaagcgauacucg

SEQ ID NO: 29783 - RNA, 22 nt, Mycobacterium tuberculosis H37Rv
aucucuguagguggugggugcg

SEQ ID NO: 29784 - RNA, 22 nt, Mycobacterium tuberculosis H37Rv
aucugcugggcuuugucgaugg

SEQ ID NO: 29785 - RNA, 22 nt, Mycobacterium tuberculosis H37Rv
aucuggacgugcacgccaacgg

SEQ ID NO: 29786 - RNA, 22 nt, Mycobacterium tuberculosis H37Rv
augacgccgagguguugcucga

SEQ ID NO: 29787 - RNA, 22 nt, Mycobacterium tuberculosis H37Rv
augaucacggugugcggggucg

SEQ ID NO: 29788 - RNA, 22 nt, Mycobacterium tuberculosis H37Rv
augaucggcggcgcgguguggu

SEQ ID NO: 29789 - RNA, 22 nt, Mycobacterium tuberculosis H37Rv
ccgacgacguugaccaagaauu

SEQ ID NO: 29790 - RNA, 22 nt, Mycobacterium tuberculosis H37Rv
ccgacgaggaaauggcuccgau

SEQ ID NO: 29791 - RNA, 22 nt, Mycobacterium tuberculosis H37Rv
ccgacugugaaccgcgcgacgu

SEQ ID NO: 29792 - RNA, 22 nt, Mycobacterium tuberculosis H37Rv
ccgagaucaacguucugcaggc

SEQ ID NO: 29793 - RNA, 22 nt, Mycobacterium tuberculosis H37Rv
ccgagcuggaagugucggccug

SEQ ID NO: 29794 - RNA, 22 nt, Mycobacterium tuberculosis H37Rv
ccgaggagcuggucgcgcugcu

SEQ ID NO: 29795 - RNA, 22 nt, Mycobacterium tuberculosis H37Rv
ccgagugaaggugggguacaug

SEQ ID NO: 29796 - RNA, 22 nt, Mycobacterium tuberculosis H37Rv
ccgaucaaugggcgcccgguca

SEQ ID NO: 29797 - RNA, 22 nt, Mycobacterium tuberculosis H37Rv
ccgcagguguucggcgaccaga

SEQ ID NO: 29798 - RNA, 22 nt, Mycobacterium tuberculosis H37Rv
ccgccgauagugaauucggcga

SEQ ID NO: 29799 - RNA, 22 nt, Mycobacterium tuberculosis H37Rv
ccgccgauagugaauucggcgc

SEQ ID NO: 29800 - RNA, 22 nt, Mycobacterium tuberculosis H37Rv
ccgcgacugggaauccugcgac

SEQ ID NO: 29801 - RNA, 22 nt, Mycobacterium tuberculosis H37Rv
ccgcgacugugagucuggcgac

SEQ ID NO: 29802 - RNA, 21 nt, Mycobacterium tuberculosis H37Rv
ccgcuauucggggcgcggcaa

SEQ ID NO: 29803 - RNA, 22 nt, Mycobacterium tuberculosis H37Rv
ccgcugcugcucgugguugggg

SEQ ID NO: 29804 - RNA, 22 nt, Mycobacterium tuberculosis H37Rv
ccggaacgcccugguggugcug

SEQ ID NO: 29805 - RNA, 22 nt, Mycobacterium tuberculosis H37Rv
ccggaagcagcuccggauucaa

SEQ ID NO: 29806 - RNA, 22 nt, Mycobacterium tuberculosis H37Rv
ccggagaaugcggaaucacgcu

SEQ ID NO: 29807 - RNA, 21 nt, Mycobacterium tuberculosis H37Rv
ccggcucaccguuggccgggu

SEQ ID NO: 29808 - RNA, 22 nt, Mycobacterium tuberculosis H37Rv
ccgggcaaccauuacacaguug

SEQ ID NO: 29809 - RNA, 22 nt, Mycobacterium tuberculosis H37Rv
ccggguaucggcugcaccccgu

SEQ ID NO: 29810 - RNA, 22 nt, Mycobacterium tuberculosis H37Rv
ccggucaaggugacgugcgugc

SEQ ID NO: 29811 - RNA, 22 nt, Mycobacterium tuberculosis H37Rv
ccggugucacggugaucacguu

SEQ ID NO: 29812 - RNA, 22 nt, Mycobacterium tuberculosis H37Rv
ccguggucacagacgaucacga

SEQ ID NO: 29813 - RNA, 22 nt, Mycobacterium tuberculosis H37Rv
ccugauggcgucgaucaccggc

SEQ ID NO: 29814 - RNA, 22 nt, Mycobacterium tuberculosis H37Rv
cgaaaucgacauuagcgcggug

SEQ ID NO: 29815 - RNA, 22 nt, Mycobacterium tuberculosis H37Rv
cgaacagacacagaaucgcacg

SEQ ID NO: 29816 - RNA, 22 nt, Mycobacterium tuberculosis H37Rv
cgaacgccuggccaccgacggc

SEQ ID NO: 29817 - RNA, 22 nt, Mycobacterium tuberculosis H37Rv
cgaacguaacggcacugcgaau

SEQ ID NO: 29818 - RNA, 22 nt, Mycobacterium tuberculosis H37Rv
cgaacuaucgugacggcgccuu

SEQ ID NO: 29819 - RNA, 22 nt, Mycobacterium tuberculosis H37Rv
cgacggcaacccgcugugugaa

SEQ ID NO: 29820 - RNA, 22 nt, Mycobacterium tuberculosis H37Rv
cgacggcucgcgugacgccguc

SEQ ID NO: 29821 - RNA, 22 nt, Mycobacterium tuberculosis H37Rv
cgacguucggguccggcgcugg

SEQ ID NO: 29822 - RNA, 22 nt, Mycobacterium tuberculosis H37Rv
cgagacgagccacggcuucgcc

SEQ ID NO: 29823 - RNA, 22 nt, Mycobacterium tuberculosis H37Rv
cgagcagacgcaaaacccccuu

SEQ ID NO: 29824 - RNA, 22 nt, Mycobacterium tuberculosis H37Rv
cgagcagacgcaaaaucgccca

SEQ ID NO: 29825 - RNA, 22 nt, Mycobacterium tuberculosis H37Rv
cgagcagacgcaaaaucgcccu

SEQ ID NO: 29826 - RNA, 22 nt, Mycobacterium tuberculosis H37Rv
cgagcagacgcagagucgcacu

SEQ ID NO: 29827 - RNA, 22 nt, Mycobacterium tuberculosis H37Rv
cgagcagacgcggaaucgcacc

SEQ ID NO: 29828 - RNA, 22 nt, Mycobacterium tuberculosis H37Rv
cgagcagacgcggaaucgcauc

SEQ ID NO: 29829 - RNA, 22 nt, Mycobacterium tuberculosis H37Rv
cgagcagacgcuaaagcccccg

SEQ ID NO: 29830 - RNA, 22 nt, Mycobacterium tuberculosis H37Rv
cgagcagucgcuaaagcccccg

SEQ ID NO: 29831 - RNA, 22 nt, Mycobacterium tuberculosis H37Rv
cgagcaucugaacgccugggug

SEQ ID NO: 29832 - RNA, 22 nt, Mycobacterium tuberculosis H37Rv
cgagcguaacgccaccgcgaaa

SEQ ID NO: 29833 - RNA, 22 nt, Mycobacterium tuberculosis H37Rv
cgagcguaacgccacugcgaaa

SEQ ID NO: 29834 - RNA, 22 nt, Mycobacterium tuberculosis H37Rv
cgagcguaacgccacugcgcua

SEQ ID NO: 29835 - RNA, 22 nt, Mycobacterium tuberculosis H37Rv
cgagcgugaacugagggcgaga

SEQ ID NO: 29836 - RNA, 22 nt, Mycobacterium tuberculosis H37Rv
cgagcgugcacugagggcgaga

SEQ ID NO: 29837 - RNA, 22 nt, Mycobacterium tuberculosis H37Rv
cgaggaguagcgcaucccacga

SEQ ID NO: 29838 - RNA, 23 nt, Mycobacterium tuberculosis H37Rv
cgagggcuuuagugucugcucgc

SEQ ID NO: 29839 - RNA, 19 nt, Mycobacterium tuberculosis H37Rv
cgaggucguaugccguccg

SEQ ID NO: 29840 - RNA, 22 nt, Mycobacterium tuberculosis H37Rv
cgaguucggcaucacccgcaug

SEQ ID NO: 29841 - RNA, 20 nt, Mycobacterium tuberculosis H37Rv
cgaucagcgucacgccuagu

SEQ ID NO: 29842 - RNA, 22 nt, Mycobacterium tuberculosis H37Rv
cgaucccgcggucgaacggcac

SEQ ID NO: 29843 - RNA, 22 nt, Mycobacterium tuberculosis H37Rv
cgaucucgccggagccgauucg

SEQ ID NO: 29844 - RNA, 22 nt, Mycobacterium tuberculosis H37Rv
cgauggugugucggcgaucacg

SEQ ID NO: 29845 - RNA, 21 nt, Mycobacterium tuberculosis H37Rv
cgauucugugucugcucggcg

SEQ ID NO: 29846 - RNA, 22 nt, Mycobacterium tuberculosis H37Rv
cgcaacguggcucuuacuggca

SEQ ID NO: 29847 - RNA, 22 nt, Mycobacterium tuberculosis H37Rv
cgcaccgaaggagaucccgccg

SEQ ID NO: 29848 - RNA, 23 nt, Mycobacterium tuberculosis H37Rv
cgcacgcuuucuggacaccgggg

SEQ ID NO: 29849 - RNA, 22 nt, Mycobacterium tuberculosis H37Rv
cgcagcgucaagguuuccgaag

SEQ ID NO: 29850 - RNA, 22 nt, Mycobacterium tuberculosis H37Rv
cgcagugacguuuguuggcugu

SEQ ID NO: 29851 - RNA, 22 nt, Mycobacterium tuberculosis H37Rv
cgcaucgagaucgacgucagcg

SEQ ID NO: 29852 - RNA, 22 nt, Mycobacterium tuberculosis H37Rv
cgcaugcucguccggccugacg

SEQ ID NO: 29853 - RNA, 22 nt, Mycobacterium tuberculosis H37Rv
cgccaacugcucaaccauaccg

SEQ ID NO: 29854 - RNA, 22 nt, Mycobacterium tuberculosis H37Rv
cgccgagauugacguuuugcag

SEQ ID NO: 29855 - RNA, 22 nt, Mycobacterium tuberculosis H37Rv
cgccgaucccgaaccggcgcuc

SEQ ID NO: 29856 - RNA, 22 nt, Mycobacterium tuberculosis H37Rv
cgccgauucgggauugucaccg

SEQ ID NO: 29857 - RNA, 23 nt, Mycobacterium tuberculosis H37Rv
cgccuagcccaccggcgccgauc

SEQ ID NO: 29858 - RNA, 22 nt, Mycobacterium tuberculosis H37Rv
cgccugguggggucgaacugug

SEQ ID NO: 29859 - RNA, 22 nt, Mycobacterium tuberculosis H37Rv
cgcgagcagacacagagucgca

SEQ ID NO: 29860 - RNA, 22 nt, Mycobacterium tuberculosis H37Rv
cgcgagcagacgcaaaaucgcc

SEQ ID NO: 29861 - RNA, 22 nt, Mycobacterium tuberculosis H37Rv
cgcgagcagacgcagagucgca

SEQ ID NO: 29862 - RNA, 22 nt, Mycobacterium tuberculosis H37Rv
cgcgaucacaccggcguaggcg

SEQ ID NO: 29863 - RNA, 22 nt, Mycobacterium tuberculosis H37Rv
cgcggucugcaugacgaugggc

SEQ ID NO: 29864 - RNA, 22 nt, Mycobacterium tuberculosis H37Rv
cgcggugauccaucucgccccg

SEQ ID NO: 29865 - RNA, 22 nt, Mycobacterium tuberculosis H37Rv
cgcucgucguaucugauggggu

SEQ ID NO: 29866 - RNA, 22 nt, Mycobacterium tuberculosis H37Rv
cgcucuggcguggaucucggcg

SEQ ID NO: 29867 - RNA, 22 nt, Mycobacterium tuberculosis H37Rv
cgcugcuaucgguggggcgccg

SEQ ID NO: 29868 - RNA, 22 nt, Mycobacterium tuberculosis H37Rv
gaaggcaccagagagaucaccu

SEQ ID NO: 29869 - RNA, 22 nt, Mycobacterium tuberculosis H37Rv
gaaggccgagcggaucugacau

SEQ ID NO: 29870 - RNA, 22 nt, Mycobacterium tuberculosis H37Rv
gacaaccguucugaugccgcgu

SEQ ID NO: 29871 - RNA, 22 nt, Mycobacterium tuberculosis H37Rv
gacaccguugccgacggccgcc

SEQ ID NO: 29872 - RNA, 22 nt, Mycobacterium tuberculosis H37Rv
gaccagcaccgcggcgaccgca

SEQ ID NO: 29873 - RNA, 22 nt, Mycobacterium tuberculosis H37Rv
gacccgauggaaguacccggca

SEQ ID NO: 29874 - RNA, 22 nt, Mycobacterium tuberculosis H37Rv
gaccggaaaccuaccagcaggc

SEQ ID NO: 29875 - RNA, 21 nt, Mycobacterium tuberculosis H37Rv
gaccgggaugaacggguacga

SEQ ID NO: 29876 - RNA, 22 nt, Mycobacterium tuberculosis H37Rv
gacgaccgaugucugggugauc

SEQ ID NO: 29877 - RNA, 22 nt, Mycobacterium tuberculosis H37Rv
gacgaggccgucgccgcguugc

SEQ ID NO: 29878 - RNA, 22 nt, Mycobacterium tuberculosis H37Rv
gacgccgaguaccgcgcgaugu

SEQ ID NO: 29879 - RNA, 22 nt, Mycobacterium tuberculosis H37Rv
gacgcgaguuggccguccuccu

SEQ ID NO: 29880 - RNA, 22 nt, Mycobacterium tuberculosis H37Rv
gacgcguccgcugucggcgacc

SEQ ID NO: 29881 - RNA, 22 nt, Mycobacterium tuberculosis H37Rv
gacggguguucccggaucggug

SEQ ID NO: 29882 - RNA, 22 nt, Mycobacterium tuberculosis H37Rv
gacgucaagacgccggcgggca

SEQ ID NO: 29883 - RNA, 22 nt, Mycobacterium tuberculosis H37Rv
gacuccagccguucacguucga

SEQ ID NO: 29884 - RNA, 22 nt, Mycobacterium tuberculosis H37Rv
gagaucgaccgggaaggugauc

SEQ ID NO: 29885 - RNA, 22 nt, Mycobacterium tuberculosis H37Rv
gagcagacacacaaucgcaucc

SEQ ID NO: 29886 - RNA, 22 nt, Mycobacterium tuberculosis H37Rv
gagcagacgcaaaagcacccca

SEQ ID NO: 29887 - RNA, 22 nt, Mycobacterium tuberculosis H37Rv
gagcagacgcaaaagcccccaa

SEQ ID NO: 29888 - RNA, 22 nt, Mycobacterium tuberculosis H37Rv
gagcagacgcaaaaucgcccaa

SEQ ID NO: 29889 - RNA, 22 nt, Mycobacterium tuberculosis H37Rv
gagcagacgcaaaaucgcccau

SEQ ID NO: 29890 - RNA, 22 nt, Mycobacterium tuberculosis H37Rv
gagcagacgcagaaguccccga

SEQ ID NO: 29891 - RNA, 22 nt, Mycobacterium tuberculosis H37Rv
gagcagacgcagaagucgccga

SEQ ID NO: 29892 - RNA, 22 nt, Mycobacterium tuberculosis H37Rv
gagcagacgcagaaucgcaugc

SEQ ID NO: 29893 - RNA, 22 nt, Mycobacterium tuberculosis H37Rv
gagcagacgcagaaucgcccau

SEQ ID NO: 29894 - RNA, 22 nt, Mycobacterium tuberculosis H37Rv
gagcagacgcauaagcgcccau

SEQ ID NO: 29895 - RNA, 22 nt, Mycobacterium tuberculosis H37Rv
gagcaugggcguggacguuguc

SEQ ID NO: 29896 - RNA, 20 nt, Mycobacterium tuberculosis H37Rv
gagccgcagcgggacccggu

SEQ ID NO: 29897 - RNA, 22 nt, Mycobacterium tuberculosis H37Rv
gagcggauuuuucgcaccggga

SEQ ID NO: 29898 - RNA, 22 nt, Mycobacterium tuberculosis H37Rv
gagcgugaacugagggcggaga

SEQ ID NO: 29899 - RNA, 22 nt, Mycobacterium tuberculosis H37Rv
gagcugacgccgagcugguuga

SEQ ID NO: 29900 - RNA, 22 nt, Mycobacterium tuberculosis H37Rv
gagcugcuugggugggcgguca

SEQ ID NO: 29901 - RNA, 22 nt, Mycobacterium tuberculosis H37Rv
gaggucgaugcgcgucggguag

SEQ ID NO: 29902 - RNA, 22 nt, Mycobacterium tuberculosis H37Rv
gaguaugccggauccuucagcu

SEQ ID NO: 29903 - RNA, 22 nt, Mycobacterium tuberculosis H37Rv
gagugugaaucccgcgacgccg

SEQ ID NO: 29904 - RNA, 22 nt, Mycobacterium tuberculosis H37Rv
gauaagaucccccgcuggcccu

SEQ ID NO: 29905 - RNA, 22 nt, Mycobacterium tuberculosis H37Rv
gaucaccgaauugguagaugac

SEQ ID NO: 29906 - RNA, 22 nt, Mycobacterium tuberculosis H37Rv
gauccgcugggacccaucauca

SEQ ID NO: 29907 - RNA, 22 nt, Mycobacterium tuberculosis H37Rv
gaucgcugcgcugaucgcgguc

SEQ ID NO: 29908 - RNA, 22 nt, Mycobacterium tuberculosis H37Rv
gaucugguguguuggcgcgccg

SEQ ID NO: 29909 - RNA, 22 nt, Mycobacterium tuberculosis H37Rv
gaugaacaucgugaccgucuac

SEQ ID NO: 29910 - RNA, 20 nt, Mycobacterium tuberculosis H37Rv
gaugaugaucguguaugcga

SEQ ID NO: 29911 - RNA, 22 nt, Mycobacterium tuberculosis H37Rv
gaugcaccggugucggugaccg

SEQ ID NO: 29912 - RNA, 22 nt, Mycobacterium tuberculosis H37Rv
gaugccgcgguuuguccgggag

SEQ ID NO: 29913 - RNA, 22 nt, Mycobacterium tuberculosis H37Rv
gaugcgauuccgcgucugcucg

SEQ ID NO: 29914 - RNA, 22 nt, Mycobacterium tuberculosis H37Rv
gaugcugugcuacuggccguua

SEQ ID NO: 29915 - RNA, 22 nt, Mycobacterium tuberculosis H37Rv
gauggacaagccggacgucgac

SEQ ID NO: 29916 - RNA, 22 nt, Mycobacterium tuberculosis H37Rv
gauggccugaugcuccgccuca

SEQ ID NO: 29917 - RNA, 22 nt, Mycobacterium tuberculosis H37Rv
gauguagguucgggcucaugga

SEQ ID NO: 29918 - RNA, 22 nt, Mycobacterium tuberculosis H37Rv
gauuggucuagagcauucccgg

SEQ ID NO: 29919 - RNA, 18 nt, Mycobacterium tuberculosis H37Rv
gcaagucccggagaaccu

SEQ ID NO: 29920 - RNA, 21 nt, Mycobacterium tuberculosis H37Rv
gcacacuggaagccagcacgc

SEQ ID NO: 29921 - RNA, 22 nt, Mycobacterium tuberculosis H37Rv
gcaccgcaucgccgaacuuccg

SEQ ID NO: 29922 - RNA, 22 nt, Mycobacterium tuberculosis H37Rv
gcacggguucguugcugugcau

SEQ ID NO: 29923 - RNA, 22 nt, Mycobacterium tuberculosis H37Rv
gcacugacaccaccggcccugg

SEQ ID NO: 29924 - RNA, 22 nt, Mycobacterium tuberculosis H37Rv
gcagacgcaaaaucgcccgaaa

SEQ ID NO: 29925 - RNA, 22 nt, Mycobacterium tuberculosis H37Rv
gcagacguaaaagcccccgaca

SEQ ID NO: 29926 - RNA, 22 nt, Mycobacterium tuberculosis H37Rv
gcagagccgaucguccuguugc

SEQ ID NO: 29927 - RNA, 22 nt, Mycobacterium tuberculosis H37Rv
gcagaucggaaucgucgucgac

SEQ ID NO: 29928 - RNA, 22 nt, Mycobacterium tuberculosis H37Rv
gcagaugauccucggcggugau

SEQ ID NO: 29929 - RNA, 22 nt, Mycobacterium tuberculosis H37Rv
gcagcaaaccugagguggcuga

SEQ ID NO: 29930 - RNA, 22 nt, Mycobacterium tuberculosis H37Rv
gcagcaccgcugcugacgcacu

SEQ ID NO: 29931 - RNA, 22 nt, Mycobacterium tuberculosis H37Rv
gcagccguccgugccggccgua

SEQ ID NO: 29932 - RNA, 22 nt, Mycobacterium tuberculosis H37Rv
gcagcuucgaugacuacgacca

SEQ ID NO: 29933 - RNA, 22 nt, Mycobacterium tuberculosis H37Rv
gcaggcgaugacugcugugguc

SEQ ID NO: 29934 - RNA, 22 nt, Mycobacterium tuberculosis H37Rv
gcaugccgacaugaacgcggca

SEQ ID NO: 29935 - RNA, 22 nt, Mycobacterium tuberculosis H37Rv
gccaaaucgagccgagaguggg

SEQ ID NO: 29936 - RNA, 22 nt, Mycobacterium tuberculosis H37Rv
gccaacuguguaaugguugccc

SEQ ID NO: 29937 - RNA, 22 nt, Mycobacterium tuberculosis H37Rv
gccagccagcgagcaugccggg

SEQ ID NO: 29938 - RNA, 22 nt, Mycobacterium tuberculosis H37Rv
gccagguugacguugguuucgg

SEQ ID NO: 29939 - RNA, 22 nt, Mycobacterium tuberculosis H37Rv
gccaugccgaccgcggcgaucg

SEQ ID NO: 29940 - RNA, 22 nt, Mycobacterium tuberculosis H37Rv
gccauugccgaugccgguguug

SEQ ID NO: 29941 - RNA, 19 nt, Mycobacterium tuberculosis H37Rv
gcccgaacccacggccggc

SEQ ID NO: 29942 - RNA, 22 nt, Mycobacterium tuberculosis H37Rv
gcccgcaacuccaugcgcguac

SEQ ID NO: 29943 - RNA, 22 nt, Mycobacterium tuberculosis H37Rv
gcccugaguucacgcucggcgc

SEQ ID NO: 29944 - RNA, 22 nt, Mycobacterium tuberculosis H37Rv
gccgaacgugaacugacggcgg

SEQ ID NO: 29945 - RNA, 22 nt, Mycobacterium tuberculosis H37Rv
gccgaacgugcaaccauggcgg

SEQ ID NO: 29946 - RNA, 20 nt, Mycobacterium tuberculosis H37Rv
gccgaauucacuaucggcgg

SEQ ID NO: 29947 - RNA, 22 nt, Mycobacterium tuberculosis H37Rv
ggcgagcagacacagacucgca

SEQ ID NO: 29948 - RNA, 22 nt, Mycobacterium tuberculosis H37Rv
ggcgagcagacacagagucgca

SEQ ID NO: 29949 - RNA, 22 nt, Mycobacterium tuberculosis H37Rv
ggcgaguagacgcaaaagcccc

SEQ ID NO: 29950 - RNA, 21 nt, Mycobacterium tuberculosis H37Rv
ggcgaugaacgaaggaucggc

SEQ ID NO: 29951 - RNA, 22 nt, Mycobacterium tuberculosis H37Rv
ggcgaugccgaguugggucagc

SEQ ID NO: 29952 - RNA, 22 nt, Mycobacterium tuberculosis H37Rv
ggcgaugcgguggaucucgucg

SEQ ID NO: 29953 - RNA, 22 nt, Mycobacterium tuberculosis H37Rv
ggcgccauuuugauauaaguca

SEQ ID NO: 29954 - RNA, 22 nt, Mycobacterium tuberculosis H37Rv
ggcggcaucgacuaucugguga

SEQ ID NO: 29955 - RNA, 22 nt, Mycobacterium tuberculosis H37Rv
ggcggcuaccugaaggacauca

SEQ ID NO: 29956 - RNA, 22 nt, Mycobacterium tuberculosis H37Rv
ggcggucaccgauugggagagg

SEQ ID NO: 29957 - RNA, 22 nt, Mycobacterium tuberculosis H37Rv
ggcgucgaucagggcugugucg

SEQ ID NO: 29958 - RNA, 22 nt, Mycobacterium tuberculosis H37Rv
ggcguucaagaucaccaccaaa

SEQ ID NO: 29959 - RNA, 22 nt, Mycobacterium tuberculosis H37Rv
ggcguuccacgaccggcgcggc

SEQ ID NO: 29960 - RNA, 22 nt, Mycobacterium tuberculosis H37Rv
ggcuccguagcagcguuggcua

SEQ ID NO: 29961 - RNA, 22 nt, Mycobacterium tuberculosis H37Rv
ggcuccugucugugcgggcaga

SEQ ID NO: 29962 - RNA, 22 nt, Mycobacterium tuberculosis H37Rv
ggcucggugaacaagaucgucg

SEQ ID NO: 29963 - RNA, 22 nt, Mycobacterium tuberculosis H37Rv
ggcugacggcguggcggugcug

SEQ ID NO: 29964 - RNA, 22 nt, Mycobacterium tuberculosis H37Rv
ggcugacgucgugguggcguau

SEQ ID NO: 29965 - RNA, 22 nt, Mycobacterium tuberculosis H37Rv
ggcugaggccgccgaguuggcg

SEQ ID NO: 29966 - RNA, 19 nt, Mycobacterium tuberculosis H37Rv
ggcugcguacucggcgguc

SEQ ID NO: 29967 - RNA, 23 nt, Mycobacterium tuberculosis H37Rv
ggcuggacuggucgacaccgcag

SEQ ID NO: 29968 - RNA, 22 nt, Mycobacterium tuberculosis H37Rv
ggcuggcagcucacgacgccuc

SEQ ID NO: 29969 - RNA, 23 nt, Mycobacterium tuberculosis H37Rv
ggcuggucguuggucugaugcuc

SEQ ID NO: 29970 - RNA, 22 nt, Mycobacterium tuberculosis H37Rv
ggcuugucggaacucggcccca

SEQ ID NO: 29971 - RNA, 22 nt, Mycobacterium tuberculosis H37Rv
gggaaugcuccuucgccggcga

SEQ ID NO: 29972 - RNA, 22 nt, Mycobacterium tuberculosis H37Rv
gggcaucgugcugggcggaucg

SEQ ID NO: 29973 - RNA, 22 nt, Mycobacterium tuberculosis H37Rv
ggucaaccaggacggccgaucc

SEQ ID NO: 29974 - RNA, 22 nt, Mycobacterium tuberculosis H37Rv
ggucaccgucacgcucgagccg

SEQ ID NO: 29975 - RNA, 22 nt, Mycobacterium tuberculosis H37Rv
ggucagcacgcaugugcggugg

SEQ ID NO: 29976 - RNA, 22 nt, Mycobacterium tuberculosis H37Rv
ggucaucgcgugauccuucgaa

SEQ ID NO: 29977 - RNA, 22 nt, Mycobacterium tuberculosis H37Rv
gguccagugucagcgcggccau

SEQ ID NO: 29978 - RNA, 22 nt, Mycobacterium tuberculosis H37Rv
ggucccuuaaacccgaaugccg

SEQ ID NO: 29979 - RNA, 22 nt, Mycobacterium tuberculosis H37Rv
ggucggucaaggucgcgugcac

SEQ ID NO: 29980 - RNA, 22 nt, Mycobacterium tuberculosis H37Rv
ggucguucguggucgcgaugau

SEQ ID NO: 29981 - RNA, 22 nt, Mycobacterium tuberculosis H37Rv
ggucucgagcuugccggccgca

SEQ ID NO: 29982 - RNA, 22 nt, Mycobacterium tuberculosis H37Rv
ggucuugcucgacguucgcgca

SEQ ID NO: 29983 - RNA, 22 nt, Mycobacterium tuberculosis H37Rv
ggugaacaccgacagcaccaac

SEQ ID NO: 29984 - RNA, 22 nt, Mycobacterium tuberculosis H37Rv
ggugaccagucgagcaccguug

SEQ ID NO: 29985 - RNA, 22 nt, Mycobacterium tuberculosis H37Rv
ggugaucacgagggccuguuca

SEQ ID NO: 29986 - RNA, 22 nt, Mycobacterium tuberculosis H37Rv
ggugccuggucggcauuuucgc

SEQ ID NO: 29987 - RNA, 22 nt, Mycobacterium tuberculosis H37Rv
ggugcgcaaccguugggcgacc

SEQ ID NO: 29988 - RNA, 22 nt, Mycobacterium tuberculosis H37Rv
ggugcgcucuggugccggagcu

SEQ ID NO: 29989 - RNA, 20 nt, Mycobacterium tuberculosis H37Rv
ggugcucgucgaguuggguu

SEQ ID NO: 29990 - RNA, 22 nt, Mycobacterium tuberculosis H37Rv
gguggacgcagagucaacagau

SEQ ID NO: 29991 - RNA, 22 nt, Mycobacterium tuberculosis H37Rv
gguggcagcccaggguccgcgg

SEQ ID NO: 29992 - RNA, 22 nt, Mycobacterium tuberculosis H37Rv
gguggccaggaucaccgacgga

SEQ ID NO: 29993 - RNA, 22 nt, Mycobacterium tuberculosis H37Rv
gguguccuccgaucgggggaag

SEQ ID NO: 29994 - RNA, 22 nt, Mycobacterium tuberculosis H37Rv
gguguucacggcgcacguagcc

SEQ ID NO: 29995 - RNA, 22 nt, Mycobacterium tuberculosis H37Rv
gguucaccucacuguucaguca

SEQ ID NO: 29996 - RNA, 21 nt, Mycobacterium tuberculosis H37Rv
gguucucgagguagcugggcu

SEQ ID NO: 29997 - RNA, 22 nt, Mycobacterium tuberculosis H37Rv
gguugccagcgaaccggaaugg

SEQ ID NO: 29998 - RNA, 22 nt, Mycobacterium tuberculosis H37Rv
guacagaucugguugugcccgu

SEQ ID NO: 29999 - RNA, 22 nt, Mycobacterium tuberculosis H37Rv
guaccgggucgagauugcggcc

SEQ ID NO: 30000 - RNA, 22 nt, Mycobacterium tuberculosis H37Rv
guacgugcugggcaccgagcgc

SEQ ID NO: 30001 - RNA, 22 nt, Mycobacterium tuberculosis H37Rv
guagugcauuucacagucggau

SEQ ID NO: 30002 - RNA, 22 nt, Mycobacterium tuberculosis H37Rv
guauccgucgaucgaccucgau

SEQ ID NO: 30003 - RNA, 22 nt, Mycobacterium tuberculosis H37Rv
guaucggugacgcgcgaccgga

SEQ ID NO: 30004 - RNA, 22 nt, Mycobacterium tuberculosis H37Rv
gucaccgaaguugcggcgcggc

SEQ ID NO: 30005 - RNA, 22 nt, Mycobacterium tuberculosis H37Rv
gucagcgcgucguuggccagcg

SEQ ID NO: 30006 - RNA, 22 nt, Mycobacterium tuberculosis H37Rv
gucauugcgucauuuccuucga

SEQ ID NO: 30007 - RNA, 22 nt, Mycobacterium tuberculosis H37Rv
guccggcaaccgugcucgacuc

SEQ ID NO: 30008 - RNA, 22 nt, Mycobacterium tuberculosis H37Rv
guccggcuacgaucaugcccgc

SEQ ID NO: 30009 - RNA, 22 nt, Mycobacterium tuberculosis H37Rv
gucgaccaugggugcggugccc

SEQ ID NO: 30010 - RNA, 22 nt, Mycobacterium tuberculosis H37Rv
gucgaucggcgcguucgagcac

SEQ ID NO: 30011 - RNA, 22 nt, Mycobacterium tuberculosis H37Rv
gucgccagauucacggucgcgc

SEQ ID NO: 30012 - RNA, 23 nt, Mycobacterium tuberculosis H37Rv
gucgccgaauucacuaucggcgg

SEQ ID NO: 30013 - RNA, 22 nt, Mycobacterium tuberculosis H37Rv
gucgcggacagucccauguuag

SEQ ID NO: 30014 - RNA, 22 nt, Mycobacterium tuberculosis H37Rv
gucgcguugcaguucgaagagc

SEQ ID NO: 30015 - RNA, 22 nt, Mycobacterium tuberculosis H37Rv
gucggacuaucugguggccgau

SEQ ID NO: 30016 - RNA, 22 nt, Mycobacterium tuberculosis H37Rv
gucgggaauacgacgaguucgu

SEQ ID NO: 30017 - RNA, 22 nt, Mycobacterium tuberculosis H37Rv
gucggucucauacguccagauc

SEQ ID NO: 30018 - RNA, 22 nt, Mycobacterium tuberculosis H37Rv
gucgugcgcgaaugccucgucg

SEQ ID NO: 30019 - RNA, 22 nt, Mycobacterium tuberculosis H37Rv
gucuaccauuugggcgaucguc

SEQ ID NO: 30020 - RNA, 22 nt, Mycobacterium tuberculosis H37Rv
gucuggacuucgacgucgcccc

SEQ ID NO: 30021 - RNA, 22 nt, Mycobacterium tuberculosis H37Rv
gugaccacgguggugcgccacg

SEQ ID NO: 30022 - RNA, 22 nt, Mycobacterium tuberculosis H37Rv
gugaccgccccggagcgagcac

SEQ ID NO: 30023 - RNA, 22 nt, Mycobacterium tuberculosis H37Rv
gugacggucggggaaaucugcc

SEQ ID NO: 30024 - RNA, 22 nt, Mycobacterium tuberculosis H37Rv
gugacguugcgaucguguccga

SEQ ID NO: 30025 - RNA, 22 nt, Mycobacterium tuberculosis H37Rv
gugcaagucgaucugccggcgc

SEQ ID NO: 30026 - RNA, 23 nt, Mycobacterium tuberculosis H37Rv
ucgagcugggacuggguggaccg

SEQ ID NO: 30027 - RNA, 22 nt, Mycobacterium tuberculosis H37Rv
ucgaucucgccgucgcccgcca

SEQ ID NO: 30028 - RNA, 22 nt, Mycobacterium tuberculosis H37Rv
ucgaugaaccaccugacaugac

SEQ ID NO: 30029 - RNA, 22 nt, Mycobacterium tuberculosis H37Rv
ucgaugagcgauuggaacaacg

SEQ ID NO: 30030 - RNA, 22 nt, Mycobacterium tuberculosis H37Rv
ucgaugccucacccagguacac

SEQ ID NO: 30031 - RNA, 22 nt, Mycobacterium tuberculosis H37Rv
ucgaugcgccggacggugccgu

SEQ ID NO: 30032 - RNA, 22 nt, Mycobacterium tuberculosis H37Rv
ucgauggugaugacgcuggcgc

SEQ ID NO: 30033 - RNA, 21 nt, Mycobacterium tuberculosis H37Rv
ucgaugugccggaaugcgccc

SEQ ID NO: 30034 - RNA, 22 nt, Mycobacterium tuberculosis H37Rv
ucgcaguccgguuacgcucgcg

SEQ ID NO: 30035 - RNA, 23 nt, Mycobacterium tuberculosis H37Rv
ucgcagugccguuacgcucgugg

SEQ ID NO: 30036 - RNA, 22 nt, Mycobacterium tuberculosis H37Rv
ucgcagugccguuacguucgug

SEQ ID NO: 30037 - RNA, 22 nt, Mycobacterium tuberculosis H37Rv
ucgcaguggcgucacgcuggcg

SEQ ID NO: 30038 - RNA, 22 nt, Mycobacterium tuberculosis H37Rv
ucgccacguacaccguugcuuc

SEQ ID NO: 30039 - RNA, 22 nt, Mycobacterium tuberculosis H37Rv
ucgccagccguuggcguggaaa

SEQ ID NO: 30040 - RNA, 22 nt, Mycobacterium tuberculosis H37Rv
ucgcccuggcuucacguucggc

SEQ ID NO: 30041 - RNA, 22 nt, Mycobacterium tuberculosis H37Rv
ucgccgaucggcguggugcccu

SEQ ID NO: 30042 - RNA, 22 nt, Mycobacterium tuberculosis H37Rv
ucgcgagcagacgcagaaucgc

SEQ ID NO: 30043 - RNA, 22 nt, Mycobacterium tuberculosis H37Rv
ucgcgauggugguggcggccug

SEQ ID NO: 30044 - RNA, 22 nt, Mycobacterium tuberculosis H37Rv
ucgcgcuggcagacccgccgcc

SEQ ID NO: 30045 - RNA, 22 nt, Mycobacterium tuberculosis H37Rv
ucgcggcaugggaucacugggu

SEQ ID NO: 30046 - RNA, 22 nt, Mycobacterium tuberculosis H37Rv
ucgcgguugacugcggccaugc

SEQ ID NO: 30047 - RNA, 22 nt, Mycobacterium tuberculosis H37Rv
ucgcgucgccagauucacaauc

SEQ ID NO: 30048 - RNA, 22 nt, Mycobacterium tuberculosis H37Rv
ucgcguggugcacaucggcgau

SEQ ID NO: 30049 - RNA, 22 nt, Mycobacterium tuberculosis H37Rv
ucgcucgcaucgcgaucuuuua

SEQ ID NO: 30050 - RNA, 22 nt, Mycobacterium tuberculosis H37Rv
ucgcugaggcuguaacucugca

SEQ ID NO: 30051 - RNA, 20 nt, Mycobacterium tuberculosis H37Rv
ucgcuguguggucaucgaca

SEQ ID NO: 30052 - RNA, 22 nt, Mycobacterium tuberculosis H37Rv
ucggagcuggggcacgguugga

SEQ ID NO: 30053 - RNA, 22 nt, Mycobacterium tuberculosis H37Rv
ucggccucccaugcggcgaucu

SEQ ID NO: 30054 - RNA, 22 nt, Mycobacterium tuberculosis H37Rv
ucggccugucgcgcgaggugau

SEQ ID NO: 30055 - RNA, 22 nt, Mycobacterium tuberculosis H37Rv
ucggcgacuucugcgucugcuc

SEQ ID NO: 30056 - RNA, 22 nt, Mycobacterium tuberculosis H37Rv
ucggcggugaucuugccuacuu

SEQ ID NO: 30057 - RNA, 22 nt, Mycobacterium tuberculosis H37Rv
ucggcgguucguuugaccguga

SEQ ID NO: 30058 - RNA, 22 nt, Mycobacterium tuberculosis H37Rv
ucggcuccguacuugccgugcu

SEQ ID NO: 30059 - RNA, 22 nt, Mycobacterium tuberculosis H37Rv
ucggcugacacguuccgcccgg

SEQ ID NO: 30060 - RNA, 22 nt, Mycobacterium tuberculosis H37Rv
ucgggaaggcucgguucucguc

SEQ ID NO: 30061 - RNA, 22 nt, Mycobacterium tuberculosis H37Rv
ucgggcaucucgcguucggcuc

SEQ ID NO: 30062 - RNA, 22 nt, Mycobacterium tuberculosis H37Rv
ucgguccaccccgcaggcgcug

SEQ ID NO: 30063 - RNA, 22 nt, Mycobacterium tuberculosis H37Rv
ucggucccugaaacguccacga

SEQ ID NO: 30064 - RNA, 22 nt, Mycobacterium tuberculosis H37Rv
ucggugagcgccugcuucaggg

SEQ ID NO: 30065 - RNA, 22 nt, Mycobacterium tuberculosis H37Rv
ucggugaucucgugggugucga

SEQ ID NO: 30066 - RNA, 22 nt, Mycobacterium tuberculosis H37Rv
ucggugcgccacggugucacca

SEQ ID NO: 30067 - RNA, 22 nt, Mycobacterium tuberculosis H37Rv
ucggugcggaaucguugugagu

SEQ ID NO: 30068 - RNA, 22 nt, Mycobacterium tuberculosis H37Rv
ucgucaccgcgggcaccggggu

SEQ ID NO: 30069 - RNA, 22 nt, Mycobacterium tuberculosis H37Rv
ucgucgacgugaucaccgauac

SEQ ID NO: 30070 - RNA, 22 nt, Mycobacterium tuberculosis H37Rv
ucgucgacgugcugcgggaguc

SEQ ID NO: 30071 - RNA, 22 nt, Mycobacterium tuberculosis H37Rv
ucgucgaggcugugccguccgg

SEQ ID NO: 30072 - RNA, 22 nt, Mycobacterium tuberculosis H37Rv
ucgucgcuggcgcgagucauag

SEQ ID NO: 30073 - RNA, 22 nt, Mycobacterium tuberculosis H37Rv
ucgucgggccgagguuuucggc

SEQ ID NO: 30074 - RNA, 22 nt, Mycobacterium tuberculosis H37Rv
ucgucgggcucuucagcgucgc

SEQ ID NO: 30075 - RNA, 19 nt, Mycobacterium tuberculosis H37Rv
ucgucgucgacgauccgac

SEQ ID NO: 30076 - RNA, 22 nt, Mycobacterium tuberculosis H37Rv
ucgucguuguguacgaggucau

SEQ ID NO: 30077 - RNA, 21 nt, Mycobacterium tuberculosis H37Rv
ucgugcgauucacugucggcg

SEQ ID NO: 30078 - RNA, 22 nt, Mycobacterium tuberculosis H37Rv
ucgugggaucaccccuaccgcg

SEQ ID NO: 30079 - RNA, 18 nt, Mycobacterium tuberculosis H37Rv
ucgugggcgcgccgccaa

SEQ ID NO: 30080 - RNA, 22 nt, Mycobacterium tuberculosis H37Rv
ucguuaccacagcauccgaucc

SEQ ID NO: 30081 - RNA, 23 nt, Mycobacterium tuberculosis H37Rv
ucguuucgaugccggacaccguu

SEQ ID NO: 30082 - RNA, 22 nt, Mycobacterium tuberculosis H37Rv
ucucccggugcaccgccaccaa

SEQ ID NO: 30083 - RNA, 22 nt, Mycobacterium tuberculosis H37Rv
ucucgcagugacguuacgcucg

SEQ ID NO: 30084 - RNA, 21 nt, Mycobacterium tuberculosis H37Rv
ucugcccagcgcguggaucac

SEQ ID NO: 30085 - RNA, 22 nt, Mycobacterium tuberculosis H37Rv
ucugggcaguagccagcaugcc

SEQ ID NO: 30086 - RNA, 22 nt, Mycobacterium tuberculosis H37Rv
ucuggucaccgacgugcaauuc

SEQ ID NO: 30087 - RNA, 23 nt, Mycobacterium tuberculosis H37Rv
ucugguccagcggucaccguccc

SEQ ID NO: 30088 - RNA, 22 nt, Mycobacterium tuberculosis H37Rv
ucuggucggggucgaucuccag

SEQ ID NO: 30089 - RNA, 22 nt, Mycobacterium tuberculosis H37Rv
ucuuuauggcgugccgucguga

SEQ ID NO: 30090 - RNA, 22 nt, Mycobacterium tuberculosis H37Rv
ugaauccgagggcguuacggca

SEQ ID NO: 30091 - RNA, 22 nt, Mycobacterium tuberculosis H37Rv
ugacagcgcugauccugguguu

SEQ ID NO: 30092 - RNA, 21 nt, Mycobacterium tuberculosis H37Rv
ugacccacugggccgagucgg

SEQ ID NO: 30093 - RNA, 23 nt, Mycobacterium tuberculosis H37Rv
ugaccgagcgggugcgcuuccac

SEQ ID NO: 30094 - RNA, 22 nt, Mycobacterium tuberculosis H37Rv
ugaccgaugagcaggcgaucac

SEQ ID NO: 30095 - RNA, 22 nt, Mycobacterium tuberculosis H37Rv
ugaccggcgcgaccggcgcuac

SEQ ID NO: 30096 - RNA, 22 nt, Mycobacterium tuberculosis H37Rv
ugaccucguugaaacgagucga

SEQ ID NO: 30097 - RNA, 22 nt, Mycobacterium tuberculosis H37Rv
ugaccugagccuugucugcgga

SEQ ID NO: 30098 - RNA, 21 nt, Mycobacterium tuberculosis H37Rv
ugacggugacgaugugcacgc

SEQ ID NO: 30099 - RNA, 22 nt, Mycobacterium tuberculosis H37Rv
ugagacccccgucgaagucuag

SEQ ID NO: 30100 - RNA, 22 nt, Mycobacterium tuberculosis H37Rv
ugagcgauccggaaaccgacua

SEQ ID NO: 30101 - RNA, 22 nt, Mycobacterium tuberculosis H37Rv
ugaucgcuaggugcucgccggc

SEQ ID NO: 30102 - RNA, 22 nt, Mycobacterium tuberculosis H37Rv
ugaucucacccgaaguuguguc

SEQ ID NO: 30103 - RNA, 22 nt, Mycobacterium tuberculosis H37Rv
ugaugaugggucccagcggauc

SEQ ID NO: 30104 - RNA, 22 nt, Mycobacterium tuberculosis H37Rv
ugauuccgcucggcucgugcac

SEQ ID NO: 30105 - RNA, 22 nt, Mycobacterium tuberculosis H37Rv
uucgggcgauuuugcgucugcu

SEQ ID NO: 30106 - RNA, 22 nt, Mycobacterium tuberculosis H37Rv
uucucgcgcucgagugagcaga

SEQ ID NO: 30107 - RNA, 22 nt, Mycobacterium tuberculosis H37Rv
uugacucugcgcucaccacgcg

SEQ ID NO: 30108 - RNA, 22 nt, Mycobacterium tuberculosis H37Rv
uugagguccagcuuguccaggu

SEQ ID NO: 30109 - RNA, 22 nt, Mycobacterium tuberculosis H37Rv
uugaugccgaacugguugauca

SEQ ID NO: 30110 - RNA, 22 nt, Mycobacterium tuberculosis H37Rv
uugaugucggcgacuacaucuu

SEQ ID NO: 30111 - RNA, 22 nt, Mycobacterium tuberculosis H37Rv
uugcccgcgguuccgccggugu

SEQ ID NO: 30112 - RNA, 22 nt, Mycobacterium tuberculosis H37Rv
uugccgauggaucguucguacg

SEQ ID NO: 30113 - RNA, 22 nt, Mycobacterium tuberculosis H37Rv
uugccggacggcagcaccagca

SEQ ID NO: 30114 - RNA, 22 nt, Mycobacterium tuberculosis H37Rv
uugccugggccuggaucucguc

SEQ ID NO: 30115 - RNA, 22 nt, Mycobacterium tuberculosis H37Rv
uugcgcagccggugauccugga

SEQ ID NO: 30116 - RNA, 22 nt, Mycobacterium tuberculosis H37Rv
uugcgcaggggcaugucagcgu

SEQ ID NO: 30117 - RNA, 22 nt, Mycobacterium tuberculosis H37Rv
uugcgggcauaguugcggcuga

SEQ ID NO: 30118 - RNA, 22 nt, Mycobacterium tuberculosis H37Rv
uugcuccgagacggaggucugc

SEQ ID NO: 30119 - RNA, 22 nt, Mycobacterium tuberculosis H37Rv
uuggccggcgacguuuccacga

SEQ ID NO: 30120 - RNA, 22 nt, Mycobacterium tuberculosis H37Rv
uuggccggguggucgagcccgc

SEQ ID NO: 30121 - RNA, 22 nt, Mycobacterium tuberculosis H37Rv
uuggcgaauccgugcgaguuga

SEQ ID NO: 30122 - RNA, 22 nt, Mycobacterium tuberculosis H37Rv
uuggcgccggacacgucggcga

SEQ ID NO: 30123 - RNA, 22 nt, Mycobacterium tuberculosis H37Rv
uugucgccgucucgguccagcu

SEQ ID NO: 30124 - RNA, 22 nt, Mycobacterium tuberculosis H37Rv
uuucgcagugccgucacgcucg

SEQ ID NO: 30125 - RNA, 22 nt, Mycobacterium tuberculosis H37Rv
uuucgccaucggguccgcgacu

SEQ ID NO: 30126 - RNA, 22 nt, Mycobacterium tuberculosis H37Rv
uuucgccgugacguuacgcugg

SEQ ID NO: 30127 - RNA, 22 nt, Mycobacterium tuberculosis H37Rv
uuucgcgugacugagcggucug

SEQ ID NO: 30128 - RNA, 22 nt, Mycobacterium tuberculosis H37Rv
uuugacuccacgcgaaacacag

SEQ ID NO: 30129 - RNA, 22 nt, Mycobacterium tuberculosis H37Rv
uuugccgaccgcggcaucagcu

SEQ ID NO: 30130 - RNA, 22 nt, Mycobacterium tuberculosis H37Rv
uuugcgucgagaucgacggcag

SEQ ID NO: 30131 - RNA, 22 nt, Mycobacterium tuberculosis H37Rv
uuuggccuggcaugcguggaac

SEQ ID NO: 30132 - RNA, 22 nt, Mycobacterium tuberculosis H37Rv
uccggcgucugguggcgguggc

SEQ ID NO: 30133 - RNA, 22 nt, Mycobacterium tuberculosis H37Rv
uccggcuacggucaccgcguau

SEQ ID NO: 30134 - RNA, 22 nt, Mycobacterium tuberculosis H37Rv
uccguccggucugaccacuaau

SEQ ID NO: 30135 - RNA, 22 nt, Mycobacterium tuberculosis H37Rv
uccguugacucugcguccacca

SEQ ID NO: 30136 - RNA, 22 nt, Mycobacterium tuberculosis H37Rv
ucgaacaucggucgaaggucuc

SEQ ID NO: 30137 - RNA, 21 nt, Mycobacterium tuberculosis H37Rv
ucgaaugugugggaucggccg

SEQ ID NO: 30138 - RNA, 22 nt, Mycobacterium tuberculosis H37Rv
ucgacaacgcgucgaaaggucg

SEQ ID NO: 30139 - RNA, 22 nt, Mycobacterium tuberculosis H37Rv
ucgaccgguacgacgcugcuga

SEQ ID NO: 30140 - RNA, 22 nt, Mycobacterium tuberculosis H37Rv
ucgacgaugaccagucgccggc

SEQ ID NO: 30141 - RNA, 22 nt, Mycobacterium tuberculosis H37Rv
ucgacgccgaacgucaacccga

SEQ ID NO: 30142 - RNA, 22 nt, Mycobacterium tuberculosis H37Rv
ucgacgcgggaacaccguuggg

SEQ ID NO: 30143 - RNA, 22 nt, Mycobacterium tuberculosis H37Rv
ucgacgguuccucguucggcac

SEQ ID NO: 30144 - RNA, 20 nt, Mycobacterium tuberculosis H37Rv
ucgacgugccccggaucacc

SEQ ID NO: 30145 - RNA, 22 nt, Mycobacterium tuberculosis H37Rv
ucgacucgaucggcgagccccg

SEQ ID NO: 30146 - RNA, 22 nt, Mycobacterium tuberculosis H37Rv
ucgacuugcccgaaccgcuggg

SEQ ID NO: 30147 - RNA, 22 nt, Mycobacterium tuberculosis H37Rv
ucgagcccggcgacuucgugau

SEQ ID NO: 30148 - RNA, 22 nt, Mycobacterium tuberculosis H37Rv
ucgagcggaucuugugacgcgg

SEQ ID NO: 30149 - RNA, 22 nt, Mycobacterium tuberculosis H37Rv
ucgagcggcauaccagccgcac

SEQ ID NO: 30150 - RNA, 22 nt, Mycobacterium tuberculosis H37Rv
ucgaucccgaccgcgagguguu

SEQ ID NO: 30151 - RNA, 22 nt, Mycobacterium tuberculosis H37Rv
ucgaugucggccuugguggccg

SEQ ID NO: 30152 - RNA, 22 nt, Mycobacterium tuberculosis H37Rv
ucgcaccgcggucauuuucacc

SEQ ID NO: 30153 - RNA, 22 nt, Mycobacterium tuberculosis H37Rv
ucgcagccacguuacgcucgcg

SEQ ID NO: 30154 - RNA, 20 nt, Mycobacterium tuberculosis H37Rv
ucgcaguggcguuacgcucg

SEQ ID NO: 30155 - RNA, 22 nt, Mycobacterium tuberculosis H37Rv
ucgcccagcgagugcgccuggu

SEQ ID NO: 30156 - RNA, 22 nt, Mycobacterium tuberculosis H37Rv
ucgcccugacgucacguucggc

SEQ ID NO: 30157 - RNA, 22 nt, Mycobacterium tuberculosis H37Rv
ucgcccugaguucacgcucggc

SEQ ID NO: 30158 - RNA, 22 nt, Mycobacterium tuberculosis H37Rv
ucgccgagcagacacagaaucg

SEQ ID NO: 30159 - RNA, 22 nt, Mycobacterium tuberculosis H37Rv
ucgccgagccuguaauuuugca

SEQ ID NO: 30160 - RNA, 21 nt, Mycobacterium tuberculosis H37Rv
ucgccguggcguuacgcucgc

SEQ ID NO: 30161 - RNA, 22 nt, Mycobacterium tuberculosis H37Rv
ucgcguaugcgaagaucacgag

SEQ ID NO: 30162 - RNA, 22 nt, Mycobacterium tuberculosis H37Rv
ucgcugauagucgcuccauccg

SEQ ID NO: 30163 - RNA, 20 nt, Mycobacterium tuberculosis H37Rv
ucggcaaagccuggacgauc

SEQ ID NO: 30164 - RNA, 22 nt, Mycobacterium tuberculosis H37Rv
ucggccaucaacuguagcuuug

SEQ ID NO: 30165 - RNA, 22 nt, Mycobacterium tuberculosis H37Rv
ucggccuguuggucgccgccgg

SEQ ID NO: 30166 - RNA, 22 nt, Mycobacterium tuberculosis H37Rv
ucggcgaaccccgcggccggca

SEQ ID NO: 30167 - RNA, 22 nt, Mycobacterium tuberculosis H37Rv
ucggcgaaggugaucucgcugg

SEQ ID NO: 30168 - RNA, 22 nt, Mycobacterium tuberculosis H37Rv
ucggcgacguaggugccggugu

SEQ ID NO: 30169 - RNA, 22 nt, Mycobacterium tuberculosis H37Rv
ucggcguaggccaaguggacgc

SEQ ID NO: 30170 - RNA, 22 nt, Mycobacterium tuberculosis H37Rv
ucggcguccggccaggcgaaca

SEQ ID NO: 30171 - RNA, 20 nt, Mycobacterium tuberculosis H37Rv
ucgggugcuacgacuuugcc

SEQ ID NO: 30172 - RNA, 22 nt, Mycobacterium tuberculosis H37Rv
ucggugacagcugcguggugcu

SEQ ID NO: 30173 - RNA, 22 nt, Mycobacterium tuberculosis H37Rv
ucggugacggacugcacagcga

SEQ ID NO: 30174 - RNA, 22 nt, Mycobacterium tuberculosis H37Rv
ucgguggcgccgacaugccggu

SEQ ID NO: 30175 - RNA, 22 nt, Mycobacterium tuberculosis H37Rv
ucgguuccaggaugugguggau

SEQ ID NO: 30176 - RNA, 22 nt, Mycobacterium tuberculosis H37Rv
ucguaaugaaugucgaaccuga

SEQ ID NO: 30177 - RNA, 22 nt, Mycobacterium tuberculosis H37Rv
ucguccaaugaaccacaacccc

SEQ ID NO: 30178 - RNA, 21 nt, Mycobacterium tuberculosis H37Rv
ucgucgagguaacgcaugcgc

SEQ ID NO: 30179 - RNA, 21 nt, Mycobacterium tuberculosis H37Rv
ucgucggcuucccgguccaau

SEQ ID NO: 30180 - RNA, 22 nt, Mycobacterium tuberculosis H37Rv
ucgucgguggacaaggcggccc

SEQ ID NO: 30181 - RNA, 22 nt, Mycobacterium tuberculosis H37Rv
ucgucgguguagggcgaacugc

SEQ ID NO: 30182 - RNA, 22 nt, Mycobacterium tuberculosis H37Rv
ucgugcugucuugcuguuguaa

SEQ ID NO: 30183 - RNA, 22 nt, Mycobacterium tuberculosis H37Rv
ucgugucgcgaguuucacucuc

SEQ ID NO: 30184 - RNA, 18 nt, Mycobacterium tuberculosis H37Rv
ucguugauacagcgacca

SEQ ID NO: 30185 - RNA, 22 nt, Mycobacterium tuberculosis H37Rv
ucugcuggucgaugcgggacug

SEQ ID NO: 30186 - RNA, 20 nt, Mycobacterium tuberculosis H37Rv
ucuggcccgagcccaugaug

SEQ ID NO: 30187 - RNA, 23 nt, Mycobacterium tuberculosis H37Rv
ucuguacgcggagccggacgugc

SEQ ID NO: 30188 - RNA, 22 nt, Mycobacterium tuberculosis H37Rv
ucugugcgcgguuugugcacag

SEQ ID NO: 30189 - RNA, 22 nt, Mycobacterium tuberculosis H37Rv
ucuucgagcuccuuggcgaugc

SEQ ID NO: 30190 - RNA, 22 nt, Mycobacterium tuberculosis H37Rv
ugaacgggugcguugaucgcau

SEQ ID NO: 30191 - RNA, 22 nt, Mycobacterium tuberculosis H37Rv
ugaaggugacccacccggcggc

SEQ ID NO: 30192 - RNA, 22 nt, Mycobacterium tuberculosis H37Rv
ugacauauaucaaagagauguu

SEQ ID NO: 30193 - RNA, 22 nt, Mycobacterium tuberculosis H37Rv
ugaccagcagugcggccacggc

SEQ ID NO: 30194 - RNA, 22 nt, Mycobacterium tuberculosis H37Rv
ugaccgagagcaugcuggaguu

SEQ ID NO: 30195 - RNA, 22 nt, Mycobacterium tuberculosis H37Rv
ugaccuugaucggugcgggucc

SEQ ID NO: 30196 - RNA, 22 nt, Mycobacterium tuberculosis H37Rv
ugacgaccgcggugagcgcagc

SEQ ID NO: 30197 - RNA, 22 nt, Mycobacterium tuberculosis H37Rv
ugacgacggacuugcggaucga

SEQ ID NO: 30198 - RNA, 21 nt, Mycobacterium tuberculosis H37Rv
ugacgccaucaaguccgccgg

SEQ ID NO: 30199 - RNA, 22 nt, Mycobacterium tuberculosis H37Rv
ugagcgcggaucauggcgccau

SEQ ID NO: 30200 - RNA, 22 nt, Mycobacterium tuberculosis H37Rv
ugaucgaacaucugcccagagg

SEQ ID NO: 30201 - RNA, 22 nt, Mycobacterium tuberculosis H37Rv
ugaucgacuucgaagacgaugg

SEQ ID NO: 30202 - RNA, 22 nt, Mycobacterium tuberculosis H37Rv
ugaucgagacggcgaagcggcu

SEQ ID NO: 30203 - RNA, 22 nt, Mycobacterium tuberculosis H37Rv
ugaucgaucaggaacuggccgc

SEQ ID NO: 30204 - RNA, 22 nt, Mycobacterium tuberculosis H37Rv
ugaucgcaugcccgugcgcggu

SEQ ID NO: 30205 - RNA, 22 nt, Mycobacterium tuberculosis H37Rv
ugaucggugccgucgcaugcgg

SEQ ID NO: 30206 - RNA, 22 nt, Mycobacterium tuberculosis H37Rv
ugaugcauuccuuucacguuca

SEQ ID NO: 30207 - RNA, 22 nt, Mycobacterium tuberculosis H37Rv
ugcaccucgaacgagguggcgu

SEQ ID NO: 30208 - RNA, 22 nt, Mycobacterium tuberculosis H37Rv
ugcagcaugguuucgucgugcu

SEQ ID NO: 30209 - RNA, 22 nt, Mycobacterium tuberculosis H37Rv
ugcagccaguugaucaugaacg

SEQ ID NO: 30210 - RNA, 22 nt, Mycobacterium tuberculosis H37Rv
ugcagcgcaaggauuuugguga

SEQ ID NO: 30211 - RNA, 22 nt, Mycobacterium tuberculosis H37Rv
uugacguggagcuuggucugaa

SEQ ID NO: 30212 - RNA, 22 nt, Mycobacterium tuberculosis H37Rv
uugagcucggugagguugcgca

SEQ ID NO: 30213 - RNA, 22 nt, Mycobacterium tuberculosis H37Rv
uugaggaucagguucagcuggc

SEQ ID NO: 30214 - RNA, 22 nt, Mycobacterium tuberculosis H37Rv
uugaugauggucggcgccgaca

SEQ ID NO: 30215 - RNA, 22 nt, Mycobacterium tuberculosis H37Rv
uugcacguagaucgacucggcg

SEQ ID NO: 30216 - RNA, 22 nt, Mycobacterium tuberculosis H37Rv
uugcagauccggcccaccuugg

SEQ ID NO: 30217 - RNA, 22 nt, Mycobacterium tuberculosis H37Rv
uugcccgcugaacuguugcccg

SEQ ID NO: 30218 - RNA, 22 nt, Mycobacterium tuberculosis H37Rv
uugcccggauugcggugcggca

SEQ ID NO: 30219 - RNA, 22 nt, Mycobacterium tuberculosis H37Rv
uugccggccaucugauagccgg

SEQ ID NO: 30220 - RNA, 22 nt, Mycobacterium tuberculosis H37Rv
uugcgaggugcgggccucggcc

SEQ ID NO: 30221 - RNA, 22 nt, Mycobacterium tuberculosis H37Rv
uugcggauccagaucgacgagc

SEQ ID NO: 30222 - RNA, 18 nt, Mycobacterium tuberculosis H37Rv
uugcgggccaucgcgucc

SEQ ID NO: 30223 - RNA, 22 nt, Mycobacterium tuberculosis H37Rv
uugcugauugccggauugugcg

SEQ ID NO: 30224 - RNA, 20 nt, Mycobacterium tuberculosis H37Rv
uuggcggaucggcgaucacc

SEQ ID NO: 30225 - RNA, 22 nt, Mycobacterium tuberculosis H37Rv
uugggaccaugccgcuggggug

SEQ ID NO: 30226 - RNA, 22 nt, Mycobacterium tuberculosis H37Rv
uugggcagcgcgccgccguuga

SEQ ID NO: 30227 - RNA, 22 nt, Mycobacterium tuberculosis H37Rv
uugguagccgaugcgugcaguu

SEQ ID NO: 30228 - RNA, 22 nt, Mycobacterium tuberculosis H37Rv
uugucaaaguuggaggcgggau

SEQ ID NO: 30229 - RNA, 22 nt, Mycobacterium tuberculosis H37Rv
uugucgccgugcaccaccugga

SEQ ID NO: 30230 - RNA, 22 nt, Mycobacterium tuberculosis H37Rv
uugucggaguaggcaccgccga

SEQ ID NO: 30231 - RNA, 22 nt, Mycobacterium tuberculosis H37Rv
uugugcgauucugcgucugcuu

SEQ ID NO: 30232 - RNA, 22 nt, Mycobacterium tuberculosis H37Rv
uuuccagcggcacgcauucggc

SEQ ID NO: 30233 - RNA, 22 nt, Mycobacterium tuberculosis H37Rv
uuuccgacaucggugucaccgu

SEQ ID NO: 30234 - RNA, 22 nt, Mycobacterium tuberculosis H37Rv
uuucgggcgauuuugcgucugc

SEQ ID NO: 30235 - RNA, 22 nt, Mycobacterium tuberculosis H37Rv
uuuggcgccgaauacgccaacg

SEQ ID NO: 30236 - RNA, 22 nt, Mycobacterium tuberculosis H37Rv
ugcagcgugucggguccgagcc

SEQ ID NO: 30237 - RNA, 18 nt, Mycobacterium tuberculosis H37Rv
ugcagguugguggcaucc

SEQ ID NO: 30238 - RNA, 22 nt, Mycobacterium tuberculosis H37Rv
ugcagucaauggugucucgucg

SEQ ID NO: 30239 - RNA, 22 nt, Mycobacterium tuberculosis H37Rv
ugccagaacgugaugcuggggc

SEQ ID NO: 30240 - RNA, 22 nt, Mycobacterium tuberculosis H37Rv
ugcccagcgauuucgaccgugc

SEQ ID NO: 30241 - RNA, 22 nt, Mycobacterium tuberculosis H37Rv
ugcccgucgcgaaguacgacug

SEQ ID NO: 30242 - RNA, 22 nt, Mycobacterium tuberculosis H37Rv
ugccggcauuggcgaccguguc

SEQ ID NO: 30243 - RNA, 22 nt, Mycobacterium tuberculosis H37Rv
ugccgguccuccgaacggaugu

SEQ ID NO: 30244 - RNA, 19 nt, Mycobacterium tuberculosis H37Rv
ugcgaaucgaagccugggc

SEQ ID NO: 30245 - RNA, 22 nt, Mycobacterium tuberculosis H37Rv
ugcgacucugugucugcucgcg

SEQ ID NO: 30246 - RNA, 22 nt, Mycobacterium tuberculosis H37Rv
ugcgagucugugucugcucgcc

SEQ ID NO: 30247 - RNA, 22 nt, Mycobacterium tuberculosis H37Rv
ugcgauaucggcaccggcuugc

SEQ ID NO: 30248 - RNA, 22 nt, Mycobacterium tuberculosis H37Rv
ugcgauucugcgucugcucgcc

SEQ ID NO: 30249 - RNA, 23 nt, Mycobacterium tuberculosis H37Rv
ugcgauucugugucugcucgcgc

SEQ ID NO: 30250 - RNA, 22 nt, Mycobacterium tuberculosis H37Rv
ugcgccgaaggcccagcgcgga

SEQ ID NO: 30251 - RNA, 22 nt, Mycobacterium tuberculosis H37Rv
ugcggcacucgucaggcccgcg

SEQ ID NO: 30252 - RNA, 22 nt, Mycobacterium tuberculosis H37Rv
ugcggcagacgcugcagcagua

SEQ ID NO: 30253 - RNA, 22 nt, Mycobacterium tuberculosis H37Rv
ugcggcucgucuacggcgggca

SEQ ID NO: 30254 - RNA, 21 nt, Mycobacterium tuberculosis H37Rv
ugcggguaccacggcggcggc

SEQ ID NO: 30255 - RNA, 22 nt, Mycobacterium tuberculosis H37Rv
ugcggugcaccgugcgauuagc

SEQ ID NO: 30256 - RNA, 22 nt, Mycobacterium tuberculosis H37Rv
ugcgugcgguugcggagcuuca

SEQ ID NO: 30257 - RNA, 22 nt, Mycobacterium tuberculosis H37Rv
ugcguuucauacccgcagccuu

SEQ ID NO: 30258 - RNA, 22 nt, Mycobacterium tuberculosis H37Rv
ugcucgaagggggaaagguguu

SEQ ID NO: 30259 - RNA, 19 nt, Mycobacterium tuberculosis H37Rv
ugcucgagugccgcaccca

SEQ ID NO: 30260 - RNA, 22 nt, Mycobacterium tuberculosis H37Rv
ugcucggcgcacccguuggcga

SEQ ID NO: 30261 - RNA, 22 nt, Mycobacterium tuberculosis H37Rv
ugcucgucggugacgccgugcu

SEQ ID NO: 30262 - RNA, 22 nt, Mycobacterium tuberculosis H37Rv
ugcugcucgucggcggcuggca

SEQ ID NO: 30263 - RNA, 19 nt, Mycobacterium tuberculosis H37Rv
ugcugcugcagcgcagaau

SEQ ID NO: 30264 - RNA, 22 nt, Mycobacterium tuberculosis H37Rv
uggaaccccaugacgcaggcgu

SEQ ID NO: 30265 - RNA, 22 nt, Mycobacterium tuberculosis H37Rv
uggaaugccggcgacgcggcgu

SEQ ID NO: 30266 - RNA, 21 nt, Mycobacterium tuberculosis H37Rv
uggacgcagagucaacgugua

SEQ ID NO: 30267 - RNA, 22 nt, Mycobacterium tuberculosis H37Rv
uggcaaugugaucgccggcaac

SEQ ID NO: 30268 - RNA, 22 nt, Mycobacterium tuberculosis H37Rv
uggcagcaaucggguauccgau

SEQ ID NO: 30269 - RNA, 22 nt, Mycobacterium tuberculosis H37Rv
uggccgaugugaugcgcaucgc

SEQ ID NO: 30270 - RNA, 22 nt, Mycobacterium tuberculosis H37Rv
uggccgcuuuucgauggugucg

SEQ ID NO: 30271 - RNA, 22 nt, Mycobacterium tuberculosis H37Rv
uggcgaucgcggugguguccac

SEQ ID NO: 30272 - RNA, 22 nt, Mycobacterium tuberculosis H37Rv
uggcggucgauccgucgggugc

SEQ ID NO: 30273 - RNA, 22 nt, Mycobacterium tuberculosis H37Rv
uggcucagcgggucaacgaggc

SEQ ID NO: 30274 - RNA, 22 nt, Mycobacterium tuberculosis H37Rv
uggcugacgacgaccgucggcg

SEQ ID NO: 30275 - RNA, 22 nt, Mycobacterium tuberculosis H37Rv
ugggacagcuggaaguuaucgg

SEQ ID NO: 30276 - RNA, 22 nt, Mycobacterium tuberculosis H37Rv
ugggaugaguccaccuggcggc

SEQ ID NO: 30277 - RNA, 22 nt, Mycobacterium tuberculosis H37Rv
ugggcgcuuaugcgucugcucg

SEQ ID NO: 30278 - RNA, 22 nt, Mycobacterium tuberculosis H37Rv
ugggcuaccgaggucagggcgc

SEQ ID NO: 30279 - RNA, 22 nt, Mycobacterium tuberculosis H37Rv
uggucacgcugauugccgggcc

SEQ ID NO: 30280 - RNA, 22 nt, Mycobacterium tuberculosis H37Rv
uggucgaugaucaaggggcgcg

SEQ ID NO: 30281 - RNA, 18 nt, Mycobacterium tuberculosis H37Rv
uggugcaccuuguuuggg

SEQ ID NO: 30282 - RNA, 22 nt, Mycobacterium tuberculosis H37Rv
uggugccgggcacaaucacggc

SEQ ID NO: 30283 - RNA, 22 nt, Mycobacterium tuberculosis H37Rv
uggugcgcagaccacgaucggc

SEQ ID NO: 30284 - RNA, 19 nt, Mycobacterium tuberculosis H37Rv
ugguggacgcagagucaac

SEQ ID NO: 30285 - RNA, 22 nt, Mycobacterium tuberculosis H37Rv
ugguggacgcagagucaacacg

SEQ ID NO: 30286 - RNA, 20 nt, Mycobacterium tuberculosis H37Rv
ugguggacgcagagucaacg

SEQ ID NO: 30287 - RNA, 20 nt, Mycobacterium tuberculosis H37Rv
ugguggacgcagagucagcg

SEQ ID NO: 30288 - RNA, 22 nt, Mycobacterium tuberculosis H37Rv
ugguuucccgugaggugaucgc

SEQ ID NO: 30289 - RNA, 22 nt, Mycobacterium tuberculosis H37Rv
ugucaucuaccaauucggugau

SEQ ID NO: 30290 - RNA, 22 nt, Mycobacterium tuberculosis H37Rv
uguccgaagacacgaaccuggc

SEQ ID NO: 30291 - RNA, 22 nt, Mycobacterium tuberculosis H37Rv
uguccgauguggcggcggcggg

SEQ ID NO: 30292 - RNA, 22 nt, Mycobacterium tuberculosis H37Rv
ugucgcgcccgugcaacaguga

SEQ ID NO: 30293 - RNA, 22 nt, Mycobacterium tuberculosis H37Rv
ugucgcgucgccagguucacgc

SEQ ID NO: 30294 - RNA, 20 nt, Mycobacterium tuberculosis H37Rv
ugucgcugcuggccacccac

SEQ ID NO: 30295 - RNA, 22 nt, Mycobacterium tuberculosis H37Rv
ugugacgccaaccucgcgguca

SEQ ID NO: 30296 - RNA, 22 nt, Mycobacterium tuberculosis H37Rv
ugugcgcgaucaguucaugguc

SEQ ID NO: 30297 - RNA, 22 nt, Mycobacterium tuberculosis H37Rv
ugugcggcugguaugccgcucg

SEQ ID NO: 30298 - RNA, 22 nt, Mycobacterium tuberculosis H37Rv
uguuaucgacugauaaccgauu

SEQ ID NO: 30299 - RNA, 22 nt, Mycobacterium tuberculosis H37Rv
uguucgaagcuguggagcaaca

SEQ ID NO: 30300 - RNA, 22 nt, Mycobacterium tuberculosis H37Rv
uguugacucugcguccaccgga

SEQ ID NO: 30301 - RNA, 22 nt, Mycobacterium tuberculosis H37Rv
uguugcaggcccucaccgguca

SEQ ID NO: 30302 - RNA, 22 nt, Mycobacterium tuberculosis H37Rv
uguugcgacgcgaccugggguu

SEQ ID NO: 30303 - RNA, 22 nt, Mycobacterium tuberculosis H37Rv
uuacgccgguugugguuggccg

SEQ ID NO: 30304 - RNA, 22 nt, Mycobacterium tuberculosis H37Rv
uuaguuaccaucguugcugaug

SEQ ID NO: 30305 - RNA, 22 nt, Mycobacterium tuberculosis H37Rv
uucaagaucgcgggcucgcagg

SEQ ID NO: 30306 - RNA, 22 nt, Mycobacterium tuberculosis H37Rv
uucacccagcgcgacgccgucg

SEQ ID NO: 30307 - RNA, 22 nt, Mycobacterium tuberculosis H37Rv
uucaugccucgcucgcgcacgc

SEQ ID NO: 30308 - RNA, 21 nt, Mycobacterium tuberculosis H37Rv
uuccacugccggcgccgguga

SEQ ID NO: 30309 - RNA, 22 nt, Mycobacterium tuberculosis H37Rv
uucgcaguggcguuacauucgc

SEQ ID NO: 30310 - RNA, 22 nt, Mycobacterium tuberculosis H37Rv
uucgccgccgagaucggugcgg

SEQ ID NO: 30311 - RNA, 22 nt, Mycobacterium tuberculosis H37Rv
uucgcgucgguggugcugaagu

SEQ ID NO: 30312 - RNA, 22 nt, Mycobacterium tuberculosis H37Rv
uucgggcgauuuugcgucuguc

SEQ ID NO: 30313 - RNA, 22 nt, Mycobacterium tuberculosis H37Rv
uucgugaucgcgagcgcaaugc

SEQ ID NO: 30314 - RNA, 22 nt, Mycobacterium tuberculosis H37Rv
uugaacagcuccagcgccauca

SEQ ID NO: 30315 - RNA, 23 nt, Mycobacterium tuberculosis H37Rv
acacuggugcuguugccggagac

SEQ ID NO: 30316 - RNA, 22 nt, Mycobacterium tuberculosis H37Rv
acagcgcgguucgcggaccgaa

SEQ ID NO: 30317 - RNA, 22 nt, Mycobacterium tuberculosis H37Rv
acagcgucaaugcaccugcgau

SEQ ID NO: 30318 - RNA, 22 nt, Mycobacterium tuberculosis H37Rv
acaggucgccccagacgcgcuc

SEQ ID NO: 30319 - RNA, 22 nt, Mycobacterium tuberculosis H37Rv
acaggucggcaccaccaucggg

SEQ ID NO: 30320 - RNA, 22 nt, Mycobacterium tuberculosis H37Rv
accagugucgcgagguccugcu

SEQ ID NO: 30321 - RNA, 22 nt, Mycobacterium tuberculosis H37Rv
accaucgucaugcgcgccggag

SEQ ID NO: 30322 - RNA, 22 nt, Mycobacterium tuberculosis H37Rv
accaucgucgggcucgagacac

SEQ ID NO: 30323 - RNA, 22 nt, Mycobacterium tuberculosis H37Rv
accaucuuggccgaaccgcugc

SEQ ID NO: 30324 - RNA, 19 nt, Mycobacterium tuberculosis H37Rv
acccaggccgucacuucga

SEQ ID NO: 30325 - RNA, 22 nt, Mycobacterium tuberculosis H37Rv
acccagguguagucaggaucgg

SEQ ID NO: 30326 - RNA, 22 nt, Mycobacterium tuberculosis H37Rv
acccggacgcgaucuuggccac

SEQ ID NO: 30327 - RNA, 22 nt, Mycobacterium tuberculosis H37Rv
acccggaugucuuucgcgccga

SEQ ID NO: 30328 - RNA, 22 nt, Mycobacterium tuberculosis H37Rv
acccgggucggcacgacccggg

SEQ ID NO: 30329 - RNA, 22 nt, Mycobacterium tuberculosis H37Rv
acccggucgagcaccccgauga

SEQ ID NO: 30330 - RNA, 22 nt, Mycobacterium tuberculosis H37Rv
acccgguguuugcgggccugau

SEQ ID NO: 30331 - RNA, 22 nt, Mycobacterium tuberculosis H37Rv
acccgguuggacaugucgaucc

SEQ ID NO: 30332 - RNA, 22 nt, Mycobacterium tuberculosis H37Rv
acccguccgguugggcggcggu

SEQ ID NO: 30333 - RNA, 22 nt, Mycobacterium tuberculosis H37Rv
acccgucgauguucgagccggu

SEQ ID NO: 30334 - RNA, 22 nt, Mycobacterium tuberculosis H37Rv
acccguuguugagugccacgau

SEQ ID NO: 30335 - RNA, 22 nt, Mycobacterium tuberculosis H37Rv
acccugaugaaaugcaugccgc

SEQ ID NO: 30336 - RNA, 22 nt, Mycobacterium tuberculosis H37Rv
accgaacgauccacgcgauggc

SEQ ID NO: 30337 - RNA, 22 nt, Mycobacterium tuberculosis H37Rv
accgaagccucgugcgcggcca

SEQ ID NO: 30338 - RNA, 22 nt, Mycobacterium tuberculosis H37Rv
accgagaagucguaugcggugc

SEQ ID NO: 30339 - RNA, 22 nt, Mycobacterium tuberculosis H37Rv
accgauggaucacgguaccgcc

SEQ ID NO: 30340 - RNA, 22 nt, Mycobacterium tuberculosis H37Rv
accgcggagccggaguuugugc

SEQ ID NO: 30341 - RNA, 22 nt, Mycobacterium tuberculosis H37Rv
accgggcuggucgacggccagc

SEQ ID NO: 30342 - RNA, 22 nt, Mycobacterium tuberculosis H37Rv
accgguccccgaucaccguguc

SEQ ID NO: 30343 - RNA, 22 nt, Mycobacterium tuberculosis H37Rv
accggugugcuggcgaagguuc

SEQ ID NO: 30344 - RNA, 22 nt, Mycobacterium tuberculosis H37Rv
accgguugcccgccguggaucg

SEQ ID NO: 30345 - RNA, 22 nt, Mycobacterium tuberculosis H37Rv
accgugggcucuucggccguca

SEQ ID NO: 30346 - RNA, 22 nt, Mycobacterium tuberculosis H37Rv
accuagcgguccaagaugcggu

SEQ ID NO: 30347 - RNA, 22 nt, Mycobacterium tuberculosis H37Rv
accucggugaacccgguggcgg

SEQ ID NO: 30348 - RNA, 22 nt, Mycobacterium tuberculosis H37Rv
accugggucgccaccgacgacg

SEQ ID NO: 30349 - RNA, 22 nt, Mycobacterium tuberculosis H37Rv
accuuggcguauugggcuucuu

SEQ ID NO: 30350 - RNA, 23 nt, Mycobacterium tuberculosis H37Rv
acgacgccggccacagccuugac

SEQ ID NO: 30351 - RNA, 22 nt, Mycobacterium tuberculosis H37Rv
acgagauugccgucauggcugu

SEQ ID NO: 30352 - RNA, 21 nt, Mycobacterium tuberculosis H37Rv
acgagcccaucgcgaacucgu

SEQ ID NO: 30353 - RNA, 21 nt, Mycobacterium tuberculosis H37Rv
acgccucucauguugugcgcc

SEQ ID NO: 30354 - RNA, 22 nt, Mycobacterium tuberculosis H37Rv
acgcgcacggggagcuggccga

SEQ ID NO: 30355 - RNA, 22 nt, Mycobacterium tuberculosis H37Rv
acgcggucagcuucaggcauug

SEQ ID NO: 30356 - RNA, 22 nt, Mycobacterium tuberculosis H37Rv
acgcggucgccgcgcuggguau

SEQ ID NO: 30357 - RNA, 22 nt, Mycobacterium tuberculosis H37Rv
acgcuggugaagcuuugcgcaa

SEQ ID NO: 30358 - RNA, 22 nt, Mycobacterium tuberculosis H37Rv
acggcaucuccaugggucauga

SEQ ID NO: 30359 - RNA, 22 nt, Mycobacterium tuberculosis H37Rv
acggcgaaaucgacagcagcgc

SEQ ID NO: 30360 - RNA, 22 nt, Mycobacterium tuberculosis H37Rv
acggcguuggagaugucggucu

SEQ ID NO: 30361 - RNA, 22 nt, Mycobacterium tuberculosis H37Rv
acggcucaacgguuauuuccgc

SEQ ID NO: 30362 - RNA, 22 nt, Mycobacterium tuberculosis H37Rv
acggguaguugcgagcgccgcg

SEQ ID NO: 30363 - RNA, 22 nt, Mycobacterium tuberculosis H37Rv
acgggugaacugcacgcggugu

SEQ ID NO: 30364 - RNA, 18 nt, Mycobacterium tuberculosis H37Rv
acggguucuccggcggca

SEQ ID NO: 30365 - RNA, 22 nt, Mycobacterium tuberculosis H37Rv
acggguugcgggugggaccgua

SEQ ID NO: 30366 - RNA, 22 nt, Mycobacterium tuberculosis H37Rv
acgguguucgguguggccgucg

SEQ ID NO: 30367 - RNA, 22 nt, Mycobacterium tuberculosis H37Rv
acguacggauauacugaacgca

SEQ ID NO: 30368 - RNA, 22 nt, Mycobacterium tuberculosis H37Rv
acguacucccauugcggaucgu

SEQ ID NO: 30369 - RNA, 23 nt, Mycobacterium tuberculosis H37Rv
acgucaugaaugugguguugcgg

SEQ ID NO: 30370 - RNA, 22 nt, Mycobacterium tuberculosis H37Rv
acgucgacauccgugcaccagg

SEQ ID NO: 30371 - RNA, 22 nt, Mycobacterium tuberculosis H37Rv
acgucgugagauucaccgucgg

SEQ ID NO: 30372 - RNA, 20 nt, Mycobacterium tuberculosis H37Rv
acgugaccagaucaccgacc

SEQ ID NO: 30373 - RNA, 22 nt, Mycobacterium tuberculosis H37Rv
acguguucggguugggcacccg

SEQ ID NO: 30374 - RNA, 20 nt, Mycobacterium tuberculosis H37Rv
acugcgacacgcucccgaau

SEQ ID NO: 30375 - RNA, 22 nt, Mycobacterium tuberculosis H37Rv
acugcgcccggcgcuggccucc

SEQ ID NO: 30376 - RNA, 22 nt, Mycobacterium tuberculosis H37Rv
acugcuuuccugucugggcggc

SEQ ID NO: 30377 - RNA, 22 nt, Mycobacterium tuberculosis H37Rv
acuggcgguagaggccgccggc

SEQ ID NO: 30378 - RNA, 22 nt, Mycobacterium tuberculosis H37Rv
acugucccgagcgcaccaggaa

SEQ ID NO: 30379 - RNA, 22 nt, Mycobacterium tuberculosis H37Rv
acuucagcaccaccgacgcgaa

SEQ ID NO: 30380 - RNA, 22 nt, Mycobacterium tuberculosis H37Rv
acuucgaucugacgcccgauga

SEQ ID NO: 30381 - RNA, 22 nt, Mycobacterium tuberculosis H37Rv
acuugccggcgccguuagcccc

SEQ ID NO: 30382 - RNA, 23 nt, Mycobacterium tuberculosis H37Rv
agaccgcucgacgcgggcgaucg

SEQ ID NO: 30383 - RNA, 22 nt, Mycobacterium tuberculosis H37Rv
agaccgucgcggccaggcagca

SEQ ID NO: 30384 - RNA, 22 nt, Mycobacterium tuberculosis H37Rv
agacgcuguugucgcgcccguu

SEQ ID NO: 30385 - RNA, 22 nt, Mycobacterium tuberculosis H37Rv
agaucgugauugccgugccggc

SEQ ID NO: 30386 - RNA, 22 nt, Mycobacterium tuberculosis H37Rv
agaugcgggcggcccuggcagc

SEQ ID NO: 30387 - RNA, 21 nt, Mycobacterium tuberculosis H37Rv
agcaaugcgcguucggucggc

SEQ ID NO: 30388 - RNA, 22 nt, Mycobacterium tuberculosis H37Rv
agcagacgcaaaagcccccuaa

SEQ ID NO: 30389 - RNA, 22 nt, Mycobacterium tuberculosis H37Rv
agcagacgcaaaaucgcccaau

SEQ ID NO: 30390 - RNA, 22 nt, Mycobacterium tuberculosis H37Rv
agcagacgcaaaaugcccccga

SEQ ID NO: 30391 - RNA, 22 nt, Mycobacterium tuberculosis H37Rv
agcagacgcagaaucgcccaau

SEQ ID NO: 30392 - RNA, 22 nt, Mycobacterium tuberculosis H37Rv
agcagacgcauaagcccccgca

SEQ ID NO: 30393 - RNA, 20 nt, Mycobacterium tuberculosis H37Rv
agcagugagccgaucgcguc

SEQ ID NO: 30394 - RNA, 22 nt, Mycobacterium tuberculosis H37Rv
auucgaagugacggccuggguc

SEQ ID NO: 30395 - RNA, 22 nt, Mycobacterium tuberculosis H37Rv
auucggcgcgcacccggucgag

SEQ ID NO: 30396 - RNA, 22 nt, Mycobacterium tuberculosis H37Rv
auucgggaguagcgcuccuuga

SEQ ID NO: 30397 - RNA, 22 nt, Mycobacterium tuberculosis H37Rv
auucgucgagcaauugcuggua

SEQ ID NO: 30398 - RNA, 20 nt, Mycobacterium tuberculosis H37Rv
auucugcgucugcucggcgg

SEQ ID NO: 30399 - RNA, 22 nt, Mycobacterium tuberculosis H37Rv
auugcucagcaucgggcuggcu

SEQ ID NO: 30400 - RNA, 22 nt, Mycobacterium tuberculosis H37Rv
auuggccaguggccgggcgcua

SEQ ID NO: 30401 - RNA, 23 nt, Mycobacterium tuberculosis H37Rv
auuggcugccgauucguccccau

SEQ ID NO: 30402 - RNA, 22 nt, Mycobacterium tuberculosis H37Rv
auugggcgauucugcgucugcu

SEQ ID NO: 30403 - RNA, 22 nt, Mycobacterium tuberculosis H37Rv
auugggcgauuuugcgucugcu

SEQ ID NO: 30404 - RNA, 22 nt, Mycobacterium tuberculosis H37Rv
auugggcgcuuaugcgucugcu

SEQ ID NO: 30405 - RNA, 22 nt, Mycobacterium tuberculosis H37Rv
auuucgugaccuuguagccgca

SEQ ID NO: 30406 - RNA, 22 nt, Mycobacterium tuberculosis H37Rv
caaaggccuuuccugcugggcu

SEQ ID NO: 30407 - RNA, 22 nt, Mycobacterium tuberculosis H37Rv
caacgccguuucggcgaucgcu

SEQ ID NO: 30408 - RNA, 22 nt, Mycobacterium tuberculosis H37Rv
caacuucauuuguagcgguuac

SEQ ID NO: 30409 - RNA, 22 nt, Mycobacterium tuberculosis H37Rv
caacuucgacgcugacggcuag

SEQ ID NO: 30410 - RNA, 22 nt, Mycobacterium tuberculosis H37Rv
caagaugacccuaccggugcua

SEQ ID NO: 30411 - RNA, 22 nt, Mycobacterium tuberculosis H37Rv
caagggcaucgaguugggcacc

SEQ ID NO: 30412 - RNA, 22 nt, Mycobacterium tuberculosis H37Rv
caagggcauggccguuuugcuc

SEQ ID NO: 30413 - RNA, 23 nt, Mycobacterium tuberculosis H37Rv
caaucgguuugucggcgaggugg

SEQ ID NO: 30414 - RNA, 22 nt, Mycobacterium tuberculosis H37Rv
caauguuucgacgggcaccaaa

SEQ ID NO: 30415 - RNA, 22 nt, Mycobacterium tuberculosis H37Rv
cacacguggccgaucgguuacu

SEQ ID NO: 30416 - RNA, 22 nt, Mycobacterium tuberculosis H37Rv
caccgagccggucaccaacgcg

SEQ ID NO: 30417 - RNA, 20 nt, Mycobacterium tuberculosis H37Rv
caccgcagucgacgcucgcg

SEQ ID NO: 30418 - RNA, 22 nt, Mycobacterium tuberculosis H37Rv
caccgcugagcgugguugcggu

SEQ ID NO: 30419 - RNA, 22 nt, Mycobacterium tuberculosis H37Rv
caccgggauggaaaccacccgc

SEQ ID NO: 30420 - RNA, 22 nt, Mycobacterium tuberculosis H37Rv
caccgguauugaaauuaccggc

SEQ ID NO: 30421 - RNA, 22 nt, Mycobacterium tuberculosis H37Rv
caccuggccguaccccgaaauc

SEQ ID NO: 30422 - RNA, 22 nt, Mycobacterium tuberculosis H37Rv
cacgucggugaccagaugaucg

SEQ ID NO: 30423 - RNA, 20 nt, Mycobacterium tuberculosis H37Rv
cacucucggcucgauuuggc

SEQ ID NO: 30424 - RNA, 22 nt, Mycobacterium tuberculosis H37Rv
cagaccggcaggaacacgucag

SEQ ID NO: 30425 - RNA, 22 nt, Mycobacterium tuberculosis H37Rv
cagacgcaaaagcccccgcacg

SEQ ID NO: 30426 - RNA, 22 nt, Mycobacterium tuberculosis H37Rv
cagacgcaaaaucgcccaauuc

SEQ ID NO: 30427 - RNA, 22 nt, Mycobacterium tuberculosis H37Rv
cagauccuucuggccgcuggca

SEQ ID NO: 30428 - RNA, 22 nt, Mycobacterium tuberculosis H37Rv
cagcggcuguggcggagucugc

SEQ ID NO: 30429 - RNA, 22 nt, Mycobacterium tuberculosis H37Rv
cagcguaugggcgggcaggcga

SEQ ID NO: 30430 - RNA, 22 nt, Mycobacterium tuberculosis H37Rv
cagcgugaacugagggcggaga

SEQ ID NO: 30431 - RNA, 22 nt, Mycobacterium tuberculosis H37Rv
caggacgguuagugcugauggg

SEQ ID NO: 30432 - RNA, 22 nt, Mycobacterium tuberculosis H37Rv
caggaggugcugcgggaggcga

SEQ ID NO: 30433 - RNA, 22 nt, Mycobacterium tuberculosis H37Rv
caggccgacacuuccagcucgg

SEQ ID NO: 30434 - RNA, 22 nt, Neisseria meningitidis MC58
aagcgguugucggcuuccugcc

SEQ ID NO: 30435 - RNA, 22 nt, Neisseria meningitidis MC58
aaugacggcagaacgguuucug

SEQ ID NO: 30436 - RNA, 22 nt, Neisseria meningitidis MC58
aaugacggcagagcgguuucug

SEQ ID NO: 30437 - RNA, 22 nt, Neisseria meningitidis MC58
aaugccguuuuucaggauauug

SEQ ID NO: 30438 - RNA, 22 nt, Neisseria meningitidis MC58
agacggcauaccgcuauguuaa

SEQ ID NO: 30439 - RNA, 22 nt, Neisseria meningitidis MC58
agacggcauuuucuguuuauuu

SEQ ID NO: 30440 - RNA, 22 nt, Neisseria meningitidis MC58
agcugcugaaucacacuguaaa

SEQ ID NO: 30441 - RNA, 22 nt, Neisseria meningitidis MC58
cagacggcauuuugauguucgg

SEQ ID NO: 30442 - RNA, 18 nt, Neisseria meningitidis MC58
ccggaaacauagauauac

SEQ ID NO: 30443 - RNA, 22 nt, Neisseria meningitidis MC58
cgggaaugacggauuuuaguuu

SEQ ID NO: 30444 - RNA, 22 nt, Neisseria meningitidis MC58
cugaaaggucuggauucccgcc

SEQ ID NO: 30445 - RNA, 22 nt, Neisseria meningitidis MC58
cugaaauguccucugaaagcgc

SEQ ID NO: 30446 - RNA, 22 nt, Neisseria meningitidis MC58
cugauuuaaaguuaauccacua

SEQ ID NO: 30447 - RNA, 22 nt, Neisseria meningitidis MC58
gaaaccgaacaagccggauucc

SEQ ID NO: 30448 - RNA, 22 nt, Neisseria meningitidis MC58
gcgggaaugacgaauuucaggu

SEQ ID NO: 30449 - RNA, 22 nt, Neisseria meningitidis MC58
gcgggauauuuuugacggacgg

SEQ ID NO: 30450 - RNA, 22 nt, Neisseria meningitidis MC58
ggaaugacggauuuuagguugg

SEQ ID NO: 30451 - RNA, 22 nt, Neisseria meningitidis MC58
ggaaugacgggauuucagguua

SEQ ID NO: 30452 - RNA, 22 nt, Neisseria meningitidis MC58
ggaaugacggguuucgagauug

SEQ ID NO: 30453 - RNA, 22 nt, Neisseria meningitidis MC58
ggccgucugaaaauaaaaucuu

SEQ ID NO: 30454 - RNA, 22 nt, Neisseria meningitidis MC58
gggaauccagguucguugaguu

SEQ ID NO: 30455 - RNA, 22 nt, Neisseria meningitidis MC58
ggucugaaacccuaacuaugca

SEQ ID NO: 30456 - RNA, 22 nt, Neisseria meningitidis MC58
gucgcccugcugcauuugcgcc

SEQ ID NO: 30457 - RNA, 22 nt, Neisseria meningitidis MC58
guuucagacgaccuuaagaugu

SEQ ID NO: 30458 - RNA, 22 nt, Neisseria meningitidis MC58
ucugauacaguaucuguccggu

SEQ ID NO: 30459 - RNA, 22 nt, Neisseria meningitidis MC58
uuucagacggcauuguuuuuga

SEQ ID NO: 30460 - RNA, 22 nt, Neisseria meningitidis MC58
aauacagcacacugccgggcag

SEQ ID NO: 30461 - RNA, 22 nt, Neisseria meningitidis MC58
aaugacgggauuaaaguuucaa

SEQ ID NO: 30462 - RNA, 20 nt, Neisseria meningitidis MC58
aaugacgggauuagaguuuc

SEQ ID NO: 30463 - RNA, 22 nt, Neisseria meningitidis MC58
augacgggauuagaguuucaaa

SEQ ID NO: 30464 - RNA, 22 nt, Neisseria meningitidis MC58
augccguccgaacgcuguccga

SEQ ID NO: 30465 - RNA, 22 nt, Neisseria meningitidis MC58
augccgucugaaagggugugga

SEQ ID NO: 30466 - RNA, 22 nt, Neisseria meningitidis MC58
augccgucugaaaugccugcga

SEQ ID NO: 30467 - RNA, 22 nt, Neisseria meningitidis MC58
augccgucugcaggaagcaggu

SEQ ID NO: 30468 - RNA, 22 nt, Neisseria meningitidis MC58
auucccgccugcgcgggaauga

SEQ ID NO: 30469 - RNA, 20 nt, Neisseria meningitidis MC58
cagacggcauuuuuugcuug

SEQ ID NO: 30470 - RNA, 22 nt, Neisseria meningitidis MC58
ccugccugcgcaucuggcggac

SEQ ID NO: 30471 - RNA, 23 nt, Neisseria meningitidis MC58
cgggaaugacggauuucgagauu

SEQ ID NO: 30472 - RNA, 22 nt, Neisseria meningitidis MC58
gaugccgccggcguggcauccu

SEQ ID NO: 30473 - RNA, 22 nt, Neisseria meningitidis MC58
gccgucugaagggaccgggcag

SEQ ID NO: 30474 - RNA, 22 nt, Neisseria meningitidis MC58
gccuucgccgagcacgguguuu

SEQ ID NO: 30475 - RNA, 22 nt, Neisseria meningitidis MC58
ggaggcuucaaacaaggcuuuc

SEQ ID NO: 30476 - RNA, 22 nt, Neisseria meningitidis MC58
gugggaaugacggcguaaaggu

SEQ ID NO: 30477 - RNA, 22 nt, Neisseria meningitidis MC58
ucagacggcauuuucccguuuu

SEQ ID NO: 30478 - RNA, 22 nt, Neisseria meningitidis MC58
ucugcgcgauacgcucaaacgg

SEQ ID NO: 30479 - RNA, 22 nt, Neisseria meningitidis MC58
uugccgucuugauaaguuuccc

SEQ ID NO: 30480 - RNA, 22 nt, Neisseria meningitidis MC58
uugccuuggaagauuuaguugc

SEQ ID NO: 30481 - RNA, 22 nt, Neisseria meningitidis MC58
uugcgcgguguuugguuuucca

SEQ ID NO: 30482 - RNA, 22 nt, Neisseria meningitidis MC58
uuucagacgguauuuugauugu

SEQ ID NO: 30483 - RNA, 22 nt, Neisseria meningitidis Z2491
aaacugccguacccacguuuuu

SEQ ID NO: 30484 - RNA, 22 nt, Neisseria meningitidis Z2491
aaagccauauccgaaauuuguu

SEQ ID NO: 30485 - RNA, 22 nt, Neisseria meningitidis Z2491
aaagcccgcguuuuucgagaag

SEQ ID NO: 30486 - RNA, 20 nt, Neisseria meningitidis Z2491
aaauccgccacuacgcaauc

SEQ ID NO: 30487 - RNA, 22 nt, Neisseria meningitidis Z2491
aacugucuauccaucaucauaa

SEQ ID NO: 30488 - RNA, 22 nt, Neisseria meningitidis Z2491
aacuuugcguuucuagauuccc

SEQ ID NO: 30489 - RNA, 22 nt, Neisseria meningitidis Z2491
aagauugauucuucagacggca

SEQ ID NO: 30490 - RNA, 22 nt, Neisseria meningitidis Z2491
aaggucgucugaaaagaugccu

SEQ ID NO: 30491 - RNA, 20 nt, Neisseria meningitidis Z2491
aagucggugccgccgacagc

SEQ ID NO: 30492 - RNA, 22 nt, Neisseria meningitidis Z2491
aaucaggcucaaaugugccgca

SEQ ID NO: 30493 - RNA, 22 nt, Neisseria meningitidis Z2491
aaugccgucuaaaauccucauc

SEQ ID NO: 30494 - RNA, 22 nt, Neisseria meningitidis Z2491
aaugccgucugaagcgguuucc

SEQ ID NO: 30495 - RNA, 22 nt, Neisseria meningitidis Z2491
aaugcucgauaccgauacgcgg

SEQ ID NO: 30496 - RNA, 22 nt, Neisseria meningitidis Z2491
acaaugauuuucggccacagca

SEQ ID NO: 30497 - RNA, 20 nt, Neisseria meningitidis Z2491
acaucacgcccaagcugacu

SEQ ID NO: 30498 - RNA, 22 nt, Neisseria meningitidis Z2491
accaaguuggaaaucaguguuu

SEQ ID NO: 30499 - RNA, 22 nt, Neisseria meningitidis Z2491
accgcuuuuuggacauucaaau

SEQ ID NO: 30500 - RNA, 22 nt, Neisseria meningitidis Z2491
acgcgcgaugauuuccuucagg

SEQ ID NO: 30501 - RNA, 22 nt, Neisseria meningitidis Z2491
acguuggaacagcgcgucgaac

SEQ ID NO: 30502 - RNA, 22 nt, Neisseria meningitidis Z2491
acuugguuuuauacagcccgau

SEQ ID NO: 30503 - RNA, 20 nt, Neisseria meningitidis Z2491
agacggcauuuucauucuca

SEQ ID NO: 30504 - RNA, 22 nt, Neisseria meningitidis Z2491
agacggcauuuuuuaaugcuua

SEQ ID NO: 30505 - RNA, 22 nt, Neisseria meningitidis Z2491
agcacuuugucuucaaaggcuu

SEQ ID NO: 30506 - RNA, 22 nt, Neisseria meningitidis Z2491
agcggauuaacaaaaaccagua

SEQ ID NO: 30507 - RNA, 22 nt, Neisseria meningitidis Z2491
aggccuuugggcgacggcaaua

SEQ ID NO: 30508 - RNA, 19 nt, Neisseria meningitidis Z2491
aggcuuggaccgcuuugcc

SEQ ID NO: 30509 - RNA, 22 nt, Neisseria meningitidis Z2491
aggcuuucagacggccuuugga

SEQ ID NO: 30510 - RNA, 22 nt, Neisseria meningitidis Z2491
aggguucggacggcauuuuuga

SEQ ID NO: 30511 - RNA, 22 nt, Neisseria meningitidis Z2491
agucauauuuccacaacugcua

SEQ ID NO: 30512 - RNA, 22 nt, Neisseria meningitidis Z2491
aguuugcccacuucggcgaugg

SEQ ID NO: 30513 - RNA, 22 nt, Neisseria meningitidis Z2491
auaguggauuaaauuuaaauaa

SEQ ID NO: 30514 - RNA, 22 nt, Neisseria meningitidis Z2491
aucacgccguccaaacccaaau

SEQ ID NO: 30515 - RNA, 22 nt, Neisseria meningitidis Z2491
ucagacggcauuuuuguauuua

SEQ ID NO: 30516 - RNA, 22 nt, Neisseria meningitidis Z2491
ucagacggcauuuuuucguaug

SEQ ID NO: 30517 - RNA, 20 nt, Neisseria meningitidis Z2491
ucagcggugucaugugcgcc

SEQ ID NO: 30518 - RNA, 22 nt, Neisseria meningitidis Z2491
ucaguugcguguagcucauggc

SEQ ID NO: 30519 - RNA, 22 nt, Neisseria meningitidis Z2491
uccgagaaaccgaugaccuugc

SEQ ID NO: 30520 - RNA, 22 nt, Neisseria meningitidis Z2491
ucgauuucguugccgcugucgg

SEQ ID NO: 30521 - RNA, 23 nt, Neisseria meningitidis Z2491
ucggauuuaagaauccgcccuac

SEQ ID NO: 30522 - RNA, 21 nt, Neisseria meningitidis Z2491
ucggcaaucgguucgaugcgu

SEQ ID NO: 30523 - RNA, 22 nt, Neisseria meningitidis Z2491
ucggcgaugcggcggguuuccu

SEQ ID NO: 30524 - RNA, 22 nt, Neisseria meningitidis Z2491
ucggcggugcggucgaugaguu

SEQ ID NO: 30525 - RNA, 22 nt, Neisseria meningitidis Z2491
ucgggaaaacgcugccgcaacu

SEQ ID NO: 30526 - RNA, 22 nt, Neisseria meningitidis Z2491
ucgggcuguuuucggaaagcga

SEQ ID NO: 30527 - RNA, 22 nt, Neisseria meningitidis Z2491
ucguugccugcgcggacuuguu

SEQ ID NO: 30528 - RNA, 22 nt, Neisseria meningitidis Z2491
ucuaaagcggcggaaaucgucg

SEQ ID NO: 30529 - RNA, 22 nt, Neisseria meningitidis Z2491
ucugauacaguaucuguccggu

SEQ ID NO: 30530 - RNA, 22 nt, Neisseria meningitidis Z2491
ucugucgucgugguuuuacccg

SEQ ID NO: 30531 - RNA, 22 nt, Neisseria meningitidis Z2491
ugaaagucaaaugccgucugaa

SEQ ID NO: 30532 - RNA, 22 nt, Neisseria meningitidis Z2491
ugacaccaagacccaagcugcu

SEQ ID NO: 30533 - RNA, 22 nt, Neisseria meningitidis Z2491
ugauaguugaguauccugcggu

SEQ ID NO: 30534 - RNA, 22 nt, Neisseria meningitidis Z2491
ugcauuauuaguguuuuagcag

SEQ ID NO: 30535 - RNA, 22 nt, Neisseria meningitidis Z2491
ugccgauuauuucuacgacuuc

SEQ ID NO: 30536 - RNA, 20 nt, Neisseria meningitidis Z2491
ugccgcuguugaggauuugu

SEQ ID NO: 30537 - RNA, 21 nt, Neisseria meningitidis Z2491
ugccggacguucagacggcau

SEQ ID NO: 30538 - RNA, 22 nt, Neisseria meningitidis Z2491
ugccgguuugagcgacaccgcc

SEQ ID NO: 30539 - RNA, 22 nt, Neisseria meningitidis Z2491
ugcgcgaugcaguuuucgaugu

SEQ ID NO: 30540 - RNA, 22 nt, Neisseria meningitidis Z2491
ugcgcguauugggcaaccuguu

SEQ ID NO: 30541 - RNA, 22 nt, Neisseria meningitidis Z2491
ugcuggcgaaauagccuugcag

SEQ ID NO: 30542 - RNA, 20 nt, Neisseria meningitidis Z2491
ugcuguauuucgccgcuucg

SEQ ID NO: 30543 - RNA, 22 nt, Neisseria meningitidis Z2491
ugcuucguccauuacaucgaug

SEQ ID NO: 30544 - RNA, 22 nt, Neisseria meningitidis Z2491
uggcaucgcccaagggggugga

SEQ ID NO: 30545 - RNA, 22 nt, Neisseria meningitidis Z2491
uggcgcaacguguuuugaaaac

SEQ ID NO: 30546 - RNA, 22 nt, Neisseria meningitidis Z2491
uggcgcacggcuugggcgacga

SEQ ID NO: 30547 - RNA, 22 nt, Neisseria meningitidis Z2491
uggcggcaucgauuuucaggcg

SEQ ID NO: 30548 - RNA, 21 nt, Neisseria meningitidis Z2491
ugggaauccagaccuuugggc

SEQ ID NO: 30549 - RNA, 22 nt, Neisseria meningitidis Z2491
ugggcauaaggcaaugccgucu

SEQ ID NO: 30550 - RNA, 23 nt, Neisseria meningitidis Z2491
ugguuuaaauuuaauccacuaua

SEQ ID NO: 30551 - RNA, 22 nt, Neisseria meningitidis Z2491
uguacggcgugucgcggcgcag

SEQ ID NO: 30552 - RNA, 22 nt, Neisseria meningitidis Z2491
ugucggcggaguagguuuccuc

SEQ ID NO: 30553 - RNA, 22 nt, Neisseria meningitidis Z2491
uuaaagaccuagauucccgccu

SEQ ID NO: 30554 - RNA, 22 nt, Neisseria meningitidis Z2491
uuauccgcgcaaaacagccguu

SEQ ID NO: 30555 - RNA, 22 nt, Neisseria meningitidis Z2491
uuaucggcagcaacaucgucaa

SEQ ID NO: 30556 - RNA, 22 nt, Neisseria meningitidis Z2491
uucaagcgcagcccgcuuugcc

SEQ ID NO: 30557 - RNA, 22 nt, Neisseria meningitidis Z2491
uugaugauugacggagaacacg

SEQ ID NO: 30558 - RNA, 17 nt, Neisseria meningitidis Z2491
uugcacgauuucgacga

SEQ ID NO: 30559 - RNA, 22 nt, Neisseria meningitidis Z2491
uugccgucuugauaaguuuccc

SEQ ID NO: 30560 - RNA, 21 nt, Neisseria meningitidis Z2491
uuggauaagcugcuugaguuc

SEQ ID NO: 30561 - RNA, 22 nt, Neisseria meningitidis Z2491
uuguccugucgguuucuuugaa

SEQ ID NO: 30562 - RNA, 21 nt, Neisseria meningitidis Z2491
uugucguaaguguugaccagc

SEQ ID NO: 30563 - RNA, 22 nt, Neisseria meningitidis Z2491
uugugcauuuucuuuucaaacg

SEQ ID NO: 30564 - RNA, 19 nt, Neisseria meningitidis Z2491
uuuaccgccgaacuguccg

SEQ ID NO: 30565 - RNA, 22 nt, Neisseria meningitidis Z2491
uuugcgcuauuuggaaagcggu

SEQ ID NO: 30566 - RNA, 22 nt, Neisseria meningitidis Z2491
uuuggcaaacgguaaaaaugga

SEQ ID NO: 30567 - RNA, 22 nt, Neisseria meningitidis Z2491
uuuggcaguuucgaugccgucg

SEQ ID NO: 30568 - RNA, 22 nt, Neisseria meningitidis Z2491
aaacuuggcuucuucuucgcga

SEQ ID NO: 30569 - RNA, 22 nt, Neisseria meningitidis Z2491
aaagccguagguuacuuugacu

SEQ ID NO: 30570 - RNA, 23 nt, Neisseria meningitidis Z2491
aaauccgccuuuucagacggcau

SEQ ID NO: 30571 - RNA, 22 nt, Neisseria meningitidis Z2491
aaaucugcaauaaaucccaguu

SEQ ID NO: 30572 - RNA, 22 nt, Neisseria meningitidis Z2491
aacacgcugaugaugcaggucg

SEQ ID NO: 30573 - RNA, 22 nt, Neisseria meningitidis Z2491
aacacuguuuuucgugguauaa

SEQ ID NO: 30574 - RNA, 22 nt, Neisseria meningitidis Z2491
aacagaauuauauucccaaaaa

SEQ ID NO: 30575 - RNA, 22 nt, Neisseria meningitidis Z2491
aagcgcaaaagcggauuggacg

SEQ ID NO: 30576 - RNA, 22 nt, Neisseria meningitidis Z2491
aaucuagaaucucggacuuuca

SEQ ID NO: 30577 - RNA, 18 nt, Neisseria meningitidis Z2491
aaucugaacuuugauguc

SEQ ID NO: 30578 - RNA, 22 nt, Neisseria meningitidis Z2491
aaugccguccugguugagaucc

SEQ ID NO: 30579 - RNA, 22 nt, Neisseria meningitidis Z2491
aaugccguuuuucaggauauug

SEQ ID NO: 30580 - RNA, 22 nt, Neisseria meningitidis Z2491
aauggcgugguguucaucgacg

SEQ ID NO: 30581 - RNA, 22 nt, Neisseria meningitidis Z2491
acaucguugccgcacaagccaa

SEQ ID NO: 30582 - RNA, 22 nt, Neisseria meningitidis Z2491
acccgugauuuucggcacuuuu

SEQ ID NO: 30583 - RNA, 22 nt, Neisseria meningitidis Z2491
accgccuguuggauuuccagcc

SEQ ID NO: 30584 - RNA, 22 nt, Neisseria meningitidis Z2491
acgcugauguaucuuugcugcu

SEQ ID NO: 30585 - RNA, 22 nt, Neisseria meningitidis Z2491
acggcauuuuguauccaaacgg

SEQ ID NO: 30586 - RNA, 22 nt, Neisseria meningitidis Z2491
acgguuuccgucagauugagua

SEQ ID NO: 30587 - RNA, 22 nt, Neisseria meningitidis Z2491
acgucgcccgcuucgacgcguu

SEQ ID NO: 30588 - RNA, 22 nt, Neisseria meningitidis Z2491
acugggauuuauugcagauuug

SEQ ID NO: 30589 - RNA, 22 nt, Neisseria meningitidis Z2491
acuguuguugggcagugccgcc

SEQ ID NO: 30590 - RNA, 22 nt, Neisseria meningitidis Z2491
agacggcauuuucuguuuauuu

SEQ ID NO: 30591 - RNA, 22 nt, Neisseria meningitidis Z2491
agacggccuuuuguauuuaggc

SEQ ID NO: 30592 - RNA, 22 nt, Neisseria meningitidis Z2491
agaguuugccguccaagccguc

SEQ ID NO: 30593 - RNA, 22 nt, Neisseria meningitidis Z2491
agccaucguugcugccgaacag

SEQ ID NO: 30594 - RNA, 22 nt, Neisseria meningitidis Z2491
agccgaauggacaaaugccguc

SEQ ID NO: 30595 - RNA, 22 nt, Neisseria meningitidis Z2491
agccgacaacggcaggaauacc

SEQ ID NO: 30596 - RNA, 22 nt, Neisseria meningitidis Z2491
agccgcacgguuuugguaaacc

SEQ ID NO: 30597 - RNA, 22 nt, Neisseria meningitidis Z2491
agcgcgauggguaucuuuauga

SEQ ID NO: 30598 - RNA, 22 nt, Neisseria meningitidis Z2491
aggcgguugucggcgugaugac

SEQ ID NO: 30599 - RNA, 22 nt, Neisseria meningitidis Z2491
ugaaacucuaaucgcgucauuc

SEQ ID NO: 30600 - RNA, 22 nt, Neisseria meningitidis Z2491
ugaacggcaucgaaccuuuggc

SEQ ID NO: 30601 - RNA, 22 nt, Neisseria meningitidis Z2491
ugaagcagcaucaggcggcauc

SEQ ID NO: 30602 - RNA, 22 nt, Neisseria meningitidis Z2491
ugaauacgacgcagauuuauac

SEQ ID NO: 30603 - RNA, 21 nt, Neisseria meningitidis Z2491
ugaggauuuuagacggcauug

SEQ ID NO: 30604 - RNA, 22 nt, Neisseria meningitidis Z2491
ugauuucgaugucguagccuuc

SEQ ID NO: 30605 - RNA, 20 nt, Neisseria meningitidis Z2491
ugcagcacauaggcggcguu

SEQ ID NO: 30606 - RNA, 22 nt, Neisseria meningitidis Z2491
ugccgaagacggaagcugugcc

SEQ ID NO: 30607 - RNA, 22 nt, Neisseria meningitidis Z2491
ugccgucugaaacuggcccugc

SEQ ID NO: 30608 - RNA, 19 nt, Neisseria meningitidis Z2491
ugccugauaauguuuuggc

SEQ ID NO: 30609 - RNA, 19 nt, Neisseria meningitidis Z2491
uggcaaugcuuugaccgug

SEQ ID NO: 30610 - RNA, 22 nt, Neisseria meningitidis Z2491
uggcaccguauccaccugcuga

SEQ ID NO: 30611 - RNA, 22 nt, Neisseria meningitidis Z2491
uggcacgugugggcggucgcua

SEQ ID NO: 30612 - RNA, 22 nt, Neisseria meningitidis Z2491
ugggcagcauuucuuucgggcu

SEQ ID NO: 30613 - RNA, 20 nt, Neisseria meningitidis Z2491
ugucaggcgcgaugacggcg

SEQ ID NO: 30614 - RNA, 22 nt, Neisseria meningitidis Z2491
ugucgaagaguucuuucggcag

SEQ ID NO: 30615 - RNA, 22 nt, Neisseria meningitidis Z2491
ugugggaaaagcugcuugccgc

SEQ ID NO: 30616 - RNA, 22 nt, Neisseria meningitidis Z2491
uguuucagacgaccuuaagaug

SEQ ID NO: 30617 - RNA, 22 nt, Neisseria meningitidis Z2491
uguuuccaaaucguucggcgac

SEQ ID NO: 30618 - RNA, 22 nt, Neisseria meningitidis Z2491
uucaggaaaaauucgacaaaua

SEQ ID NO: 30619 - RNA, 22 nt, Neisseria meningitidis Z2491
uucgacaaaggucgucugaaaa

SEQ ID NO: 30620 - RNA, 22 nt, Neisseria meningitidis Z2491
uucgcguuggaacgguuggcgg

SEQ ID NO: 30621 - RNA, 22 nt, Neisseria meningitidis Z2491
uucggcuugggcgaagaagugg

SEQ ID NO: 30622 - RNA, 22 nt, Neisseria meningitidis Z2491
uugacgguuucgggacgggcuu

SEQ ID NO: 30623 - RNA, 22 nt, Neisseria meningitidis Z2491
uugagauuuugcauccuggauu

SEQ ID NO: 30624 - RNA, 22 nt, Neisseria meningitidis Z2491
uugccgccaauguguuauggac

SEQ ID NO: 30625 - RNA, 20 nt, Neisseria meningitidis Z2491
uugccgcuuucagacggcau

SEQ ID NO: 30626 - RNA, 22 nt, Neisseria meningitidis Z2491
uugcugccaaaguuggcguugu

SEQ ID NO: 30627 - RNA, 22 nt, Neisseria meningitidis Z2491
uuggcggcugcugccggugagu

SEQ ID NO: 30628 - RNA, 23 nt, Neisseria meningitidis Z2491
uuggucgacuucuucacgagucc

SEQ ID NO: 30629 - RNA, 22 nt, Neisseria meningitidis Z2491
uuuaggaauuuaucgggagcaa

SEQ ID NO: 30630 - RNA, 22 nt, Neisseria meningitidis Z2491
uuucagacggccuuuguucuag

SEQ ID NO: 30631 - RNA, 22 nt, Neisseria meningitidis Z2491
uuucagguagccugaaugguag

SEQ ID NO: 30632 - RNA, 22 nt, Neisseria meningitidis Z2491
uuugccuguccgcgcaccgugc

SEQ ID NO: 30633 - RNA, 22 nt, Neisseria meningitidis Z2491
uuugcggaacgcugcgaccagc

SEQ ID NO: 30634 - RNA, 22 nt, Neisseria meningitidis Z2491
aggcgugcccagaaucgucggg

SEQ ID NO: 30635 - RNA, 22 nt, Neisseria meningitidis Z2491
agucggauucccgcgcgggcgg

SEQ ID NO: 30636 - RNA, 22 nt, Neisseria meningitidis Z2491
auccaagagcuucaguuucccg

SEQ ID NO: 30637 - RNA, 22 nt, Neisseria meningitidis Z2491
aucgcgcccugcccuacgucua

SEQ ID NO: 30638 - RNA, 22 nt, Neisseria meningitidis Z2491
aucgggaagagcagcucggcgg

SEQ ID NO: 30639 - RNA, 22 nt, Neisseria meningitidis Z2491
aucgguuuggcgugggcaucgc

SEQ ID NO: 30640 - RNA, 22 nt, Neisseria meningitidis Z2491
augaaauccgccaugcucgccg

SEQ ID NO: 30641 - RNA, 22 nt, Neisseria meningitidis Z2491
augccguccgaagcgguuuccc

SEQ ID NO: 30642 - RNA, 22 nt, Neisseria meningitidis Z2491
augccgucugaaagcggcaagg

SEQ ID NO: 30643 - RNA, 22 nt, Neisseria meningitidis Z2491
augccgucugaacguccggcag

SEQ ID NO: 30644 - RNA, 22 nt, Neisseria meningitidis Z2491
augccgucugcaggaagcaggu

SEQ ID NO: 30645 - RNA, 22 nt, Neisseria meningitidis Z2491
augcugaaauguuuucagacga

SEQ ID NO: 30646 - RNA, 22 nt, Neisseria meningitidis Z2491
auggaugguuacaaaggcggua

SEQ ID NO: 30647 - RNA, 22 nt, Neisseria meningitidis Z2491
auggcaggcagagcgcgccgca

SEQ ID NO: 30648 - RNA, 22 nt, Neisseria meningitidis Z2491
auucccgccugcgcgggaauga

SEQ ID NO: 30649 - RNA, 22 nt, Neisseria meningitidis Z2491
auuggauaaagaugcugccuau

SEQ ID NO: 30650 - RNA, 22 nt, Neisseria meningitidis Z2491
auuguguacgcauaaaugccgg

SEQ ID NO: 30651 - RNA, 22 nt, Neisseria meningitidis Z2491
auuuggaaauuuccugucagau

SEQ ID NO: 30652 - RNA, 22 nt, Neisseria meningitidis Z2491
auuugucgaauuuuuccugaac

SEQ ID NO: 30653 - RNA, 22 nt, Neisseria meningitidis Z2491
caaugccgucugaaaccccaaa

SEQ ID NO: 30654 - RNA, 22 nt, Neisseria meningitidis Z2491
cacagcgguaaacgucauuuug

SEQ ID NO: 30655 - RNA, 22 nt, Neisseria meningitidis Z2491
cacggauaaggaugucguauug

SEQ ID NO: 30656 - RNA, 21 nt, Neisseria meningitidis Z2491
cauccggcaauacuuccccaa

SEQ ID NO: 30657 - RNA, 21 nt, Neisseria meningitidis Z2491
ccaguuugaccuugugcgcuu

SEQ ID NO: 30658 - RNA, 22 nt, Neisseria meningitidis Z2491
ccgcaaagucuguuucagauga

SEQ ID NO: 30659 - RNA, 22 nt, Neisseria meningitidis Z2491
ccggcauuugacccgcaacaau

SEQ ID NO: 30660 - RNA, 23 nt, Neisseria meningitidis Z2491
ccgucugaaaaccauuucacuug

SEQ ID NO: 30661 - RNA, 22 nt, Neisseria meningitidis Z2491
ccgugaagaaguguugcgcagc

SEQ ID NO: 30662 - RNA, 22 nt, Neisseria meningitidis Z2491
ccuugccguacugguuuuuguu

SEQ ID NO: 30663 - RNA, 22 nt, Neisseria meningitidis Z2491
cgauuugucaaaagcgaugccg

SEQ ID NO: 30664 - RNA, 19 nt, Neisseria meningitidis Z2491
cgcaucgaucacgguuugg

SEQ ID NO: 30665 - RNA, 22 nt, Neisseria meningitidis Z2491
cgccgcauuugucauuacccgu

SEQ ID NO: 30666 - RNA, 22 nt, Neisseria meningitidis Z2491
cgccgucuucgcggcugacgag

SEQ ID NO: 30667 - RNA, 22 nt, Neisseria meningitidis Z2491
cgcggauaaagccguugugcaa

SEQ ID NO: 30668 - RNA, 22 nt, Neisseria meningitidis Z2491
cgcggcuuguuugacgggcggg

SEQ ID NO: 30669 - RNA, 22 nt, Neisseria meningitidis Z2491
cggauauuucgaugauuuugcu

SEQ ID NO: 30670 - RNA, 22 nt, Neisseria meningitidis Z2491
cggcaaagcgguuuggacaucu

SEQ ID NO: 30671 - RNA, 21 nt, Neisseria meningitidis Z2491
cggcaacagcauuuugggcgu

SEQ ID NO: 30672 - RNA, 22 nt, Neisseria meningitidis Z2491
cggcguguugguugaugccgug

SEQ ID NO: 30673 - RNA, 22 nt, Neisseria meningitidis Z2491
cgggaaugacgaauuuuagguu

SEQ ID NO: 30674 - RNA, 22 nt, Neisseria meningitidis Z2491
cgguacgaaaauaccgucugaa

SEQ ID NO: 30675 - RNA, 22 nt, Neisseria meningitidis Z2491
cggugucgcucaaaccggcaua

SEQ ID NO: 30676 - RNA, 22 nt, Neisseria meningitidis Z2491
cguugauguagcgggcggagag

SEQ ID NO: 30677 - RNA, 22 nt, Neisseria meningitidis Z2491
cguuugccccguucagacggca

SEQ ID NO: 30678 - RNA, 22 nt, Neisseria meningitidis Z2491
cucgccguuaugccuuuauggu

SEQ ID NO: 30679 - RNA, 22 nt, Neisseria meningitidis Z2491
cuuaaaguugaaacccgcacau

SEQ ID NO: 30680 - RNA, 22 nt, Neisseria meningitidis Z2491
gaacgcauccggcuuauucaua

SEQ ID NO: 30681 - RNA, 22 nt, Neisseria meningitidis Z2491
gaauccaguuuuuugaguuuca

SEQ ID NO: 30682 - RNA, 23 nt, Neisseria meningitidis Z2491
gaaucgacggcaucgaaacugcc

SEQ ID NO: 30683 - RNA, 22 nt, Neisseria meningitidis Z2491
gacgauaugcagggcggagggu

SEQ ID NO: 30684 - RNA, 22 nt, Neisseria meningitidis Z2491
gacggcauugccguuugcaugc

SEQ ID NO: 30685 - RNA, 22 nt, Neisseria meningitidis Z2491
gacguugccaugaaugucgccg

SEQ ID NO: 30686 - RNA, 22 nt, Neisseria meningitidis Z2491
gauauugcgcgccugcauccgu

SEQ ID NO: 30687 - RNA, 22 nt, Neisseria meningitidis Z2491
gaucccgaaacgcaauuggucg

SEQ ID NO: 30688 - RNA, 22 nt, Neisseria meningitidis Z2491
gaugugcaggacgaaaucgacg

SEQ ID NO: 30689 - RNA, 22 nt, Neisseria meningitidis Z2491
gcacuucuuuggcagcggcacu

SEQ ID NO: 30690 - RNA, 21 nt, Neisseria meningitidis Z2491
gcagggauguucaaauguucg

SEQ ID NO: 30691 - RNA, 22 nt, Neisseria meningitidis Z2491
gcauuugaaguaaaggcugcaa

SEQ ID NO: 30692 - RNA, 22 nt, Neisseria meningitidis Z2491
gccgcgaugguagaggguuuug

SEQ ID NO: 30693 - RNA, 22 nt, Neisseria meningitidis Z2491
gccguaugcuaccgcauacugg

SEQ ID NO: 30694 - RNA, 22 nt, Neisseria meningitidis Z2491
gccgucgugucuucgcuugccg

SEQ ID NO: 30695 - RNA, 22 nt, Neisseria meningitidis Z2491
gccguuauccgcuggaguaucg

SEQ ID NO: 30696 - RNA, 22 nt, Neisseria meningitidis Z2491
gcgaauucaaaaccaagcugac

SEQ ID NO: 30697 - RNA, 22 nt, Neisseria meningitidis Z2491
gcgcaaggcgguuuuuuccaac

SEQ ID NO: 30698 - RNA, 22 nt, Neisseria meningitidis Z2491
gcgcacaggaugauuugcgccg

SEQ ID NO: 30699 - RNA, 22 nt, Neisseria meningitidis Z2491
gcgcucaaacaaauggucgaag

SEQ ID NO: 30700 - RNA, 23 nt, Neisseria meningitidis Z2491
gcggacuugcucaaaaucggaug

SEQ ID NO: 30701 - RNA, 22 nt, Neisseria meningitidis Z2491
gcgggaauccagaccuugauuu

SEQ ID NO: 30702 - RNA, 22 nt, Neisseria meningitidis Z2491
gcgggaaugacgaauuucaggu

SEQ ID NO: 30703 - RNA, 22 nt, Neisseria meningitidis Z2491
gcggucuggauaaugguggcau

SEQ ID NO: 30704 - RNA, 22 nt, Neisseria meningitidis Z2491
gcgugcagcggcaggguuugac

SEQ ID NO: 30705 - RNA, 22 nt, Neisseria meningitidis Z2491
ggaaaucuugcugcgguaacgc

SEQ ID NO: 30706 - RNA, 22 nt, Neisseria meningitidis Z2491
ggacggauucggacggaugccg

SEQ ID NO: 30707 - RNA, 22 nt, Neisseria meningitidis Z2491
ggcaggcagcuugacgaccuga

SEQ ID NO: 30708 - RNA, 19 nt, Neisseria meningitidis Z2491
ggcauaacguucguugaaa

SEQ ID NO: 30709 - RNA, 22 nt, Neisseria meningitidis Z2491
ggcgaguuucacgcggcaaugu

SEQ ID NO: 30710 - RNA, 22 nt, Neisseria meningitidis Z2491
ggcgauaugcccaagaccauca

SEQ ID NO: 30711 - RNA, 22 nt, Neisseria meningitidis Z2491
ggcggcaaguacggcaucggcu

SEQ ID NO: 30712 - RNA, 22 nt, Neisseria meningitidis Z2491
ggcggcaucaucaaacacgcca

SEQ ID NO: 30713 - RNA, 22 nt, Neisseria meningitidis Z2491
ggcuuucguaugaaagcggauc

SEQ ID NO: 30714 - RNA, 22 nt, Neisseria meningitidis Z2491
gggaauccagguucguugaguu

SEQ ID NO: 30715 - RNA, 22 nt, Neisseria meningitidis Z2491
ggguuucagacggcauuuuguu

SEQ ID NO: 30716 - RNA, 21 nt, Neisseria meningitidis Z2491
gguugaagccgcuuuggaagc

SEQ ID NO: 30717 - RNA, 22 nt, Neisseria meningitidis Z2491
auccacagauuuuuccauaugg

SEQ ID NO: 30718 - RNA, 22 nt, Neisseria meningitidis Z2491
auccgcacgaagccgccgucga

SEQ ID NO: 30719 - RNA, 22 nt, Neisseria meningitidis Z2491
auccgccgucagcgacaauuuu

SEQ ID NO: 30720 - RNA, 22 nt, Neisseria meningitidis Z2491
auccgcuacgguucgccccaaa

SEQ ID NO: 30721 - RNA, 22 nt, Neisseria meningitidis Z2491
aucgggcugcacgcuuccguau

SEQ ID NO: 30722 - RNA, 21 nt, Neisseria meningitidis Z2491
aucggguugaaauagcgcaac

SEQ ID NO: 30723 - RNA, 20 nt, Neisseria meningitidis Z2491
aucguuaagcggcuuaagcc

SEQ ID NO: 30724 - RNA, 22 nt, Neisseria meningitidis Z2491
aucuagaaucucggacuuucag

SEQ ID NO: 30725 - RNA, 22 nt, Neisseria meningitidis Z2491
augacggcuucggcaggauugu

SEQ ID NO: 30726 - RNA, 22 nt, Neisseria meningitidis Z2491
augccgccgaguacgaauuuuu

SEQ ID NO: 30727 - RNA, 22 nt, Neisseria meningitidis Z2491
augccgucugaaaugccugcga

SEQ ID NO: 30728 - RNA, 22 nt, Neisseria meningitidis Z2491
augccgucugaacggcggcuuu

SEQ ID NO: 30729 - RNA, 20 nt, Neisseria meningitidis Z2491
augccgucugaagaaucaau

SEQ ID NO: 30730 - RNA, 22 nt, Neisseria meningitidis Z2491
augcgguagccgugcugacgau

SEQ ID NO: 30731 - RNA, 22 nt, Neisseria meningitidis Z2491
augcuuucucuauuuuuaggcc

SEQ ID NO: 30732 - RNA, 22 nt, Neisseria meningitidis Z2491
auguugaugcccaauacgccac

SEQ ID NO: 30733 - RNA, 22 nt, Neisseria meningitidis Z2491
auuccaagauaugaaggcgcac

SEQ ID NO: 30734 - RNA, 22 nt, Neisseria meningitidis Z2491
auugaaugaguaaaggccaucu

SEQ ID NO: 30735 - RNA, 22 nt, Neisseria meningitidis Z2491
auuugucguaacggccgccgag

SEQ ID NO: 30736 - RNA, 22 nt, Neisseria meningitidis Z2491
caacgcuuggauuugccgugca

SEQ ID NO: 30737 - RNA, 23 nt, Neisseria meningitidis Z2491
caacgguguggcugccguugagc

SEQ ID NO: 30738 - RNA, 19 nt, Neisseria meningitidis Z2491
cagacggcauuggguuuug

SEQ ID NO: 30739 - RNA, 22 nt, Neisseria meningitidis Z2491
cagaugaggguuuugcagccga

SEQ ID NO: 30740 - RNA, 22 nt, Neisseria meningitidis Z2491
cagcggauuguaugugaacgag

SEQ ID NO: 30741 - RNA, 22 nt, Neisseria meningitidis Z2491
caggcaggccgccgccuuugug

SEQ ID NO: 30742 - RNA, 22 nt, Neisseria meningitidis Z2491
caguucgcucaaaucgacgccg

SEQ ID NO: 30743 - RNA, 22 nt, Neisseria meningitidis Z2491
ccgaagaagauaauaucgccgu

SEQ ID NO: 30744 - RNA, 22 nt, Neisseria meningitidis Z2491
ccgcacuuuguuauagaauggc

SEQ ID NO: 30745 - RNA, 22 nt, Neisseria meningitidis Z2491
ccgccguagcugauuuuuucgc

SEQ ID NO: 30746 - RNA, 22 nt, Neisseria meningitidis Z2491
ccggcauuuaugcguacacaau

SEQ ID NO: 30747 - RNA, 22 nt, Neisseria meningitidis Z2491
ccguacugguuuaaauuuaauc

SEQ ID NO: 30748 - RNA, 20 nt, Neisseria meningitidis Z2491
ccgucaguacggaaucgcgg

SEQ ID NO: 30749 - RNA, 22 nt, Neisseria meningitidis Z2491
ccgucguuuccuuauccagcau

SEQ ID NO: 30750 - RNA, 20 nt, Neisseria meningitidis Z2491
ccugacgaacuugccuucca

SEQ ID NO: 30751 - RNA, 21 nt, Neisseria meningitidis Z2491
cgaaagauuuugaccugugca

SEQ ID NO: 30752 - RNA, 22 nt, Neisseria meningitidis Z2491
cgacauccugcauuuguuugcg

SEQ ID NO: 30753 - RNA, 22 nt, Neisseria meningitidis Z2491
cgaugcggcgauuguccgcccg

SEQ ID NO: 30754 - RNA, 22 nt, Neisseria meningitidis Z2491
cgauguguugcgguuuugggac

SEQ ID NO: 30755 - RNA, 22 nt, Neisseria meningitidis Z2491
cggaaaucugcucugcgguaaa

SEQ ID NO: 30756 - RNA, 22 nt, Neisseria meningitidis Z2491
cggcaaucaaaaugccgucuga

SEQ ID NO: 30757 - RNA, 22 nt, Neisseria meningitidis Z2491
cggcaaucaggcugucggugcg

SEQ ID NO: 30758 - RNA, 22 nt, Neisseria meningitidis Z2491
cggcgguauccaaacagccgag

SEQ ID NO: 30759 - RNA, 22 nt, Neisseria meningitidis Z2491
cggucggaauaaagccugcgcc

SEQ ID NO: 30760 - RNA, 22 nt, Neisseria meningitidis Z2491
cguucguuucccaauauaucga

SEQ ID NO: 30761 - RNA, 22 nt, Neisseria meningitidis Z2491
cuaugccguuaucgaaugcgaa

SEQ ID NO: 30762 - RNA, 22 nt, Neisseria meningitidis Z2491
cucaaagaagacgagucggaaa

SEQ ID NO: 30763 - RNA, 22 nt, Neisseria meningitidis Z2491
cugcaggcgcgccaguucgucg

SEQ ID NO: 30764 - RNA, 22 nt, Neisseria meningitidis Z2491
cugcgcgauuuucggugccgua

SEQ ID NO: 30765 - RNA, 22 nt, Neisseria meningitidis Z2491
cugcgguuucggcggcggacgc

SEQ ID NO: 30766 - RNA, 22 nt, Neisseria meningitidis Z2491
cugcuggccgguaccgcguucg

SEQ ID NO: 30767 - RNA, 22 nt, Neisseria meningitidis Z2491
gaaaucgaggguuucuucgaug

SEQ ID NO: 30768 - RNA, 22 nt, Neisseria meningitidis Z2491
gacggcauacgaaacggguucu

SEQ ID NO: 30769 - RNA, 22 nt, Neisseria meningitidis Z2491
gacggcgaggauuuccugccaa

SEQ ID NO: 30770 - RNA, 22 nt, Neisseria meningitidis Z2491
gcaagcugucccgcaagcuggu

SEQ ID NO: 30771 - RNA, 22 nt, Neisseria meningitidis Z2491
gccgcugaugauucugauuccc

SEQ ID NO: 30772 - RNA, 21 nt, Neisseria meningitidis Z2491
gccgucugaaaaaucaauuuu

SEQ ID NO: 30773 - RNA, 22 nt, Neisseria meningitidis Z2491
gccguuugaggccgaagucuuc

SEQ ID NO: 30774 - RNA, 22 nt, Neisseria meningitidis Z2491
gcgcaucgaugacggggucgag

SEQ ID NO: 30775 - RNA, 21 nt, Neisseria meningitidis Z2491
gcggaauguccugcacuugga

SEQ ID NO: 30776 - RNA, 22 nt, Neisseria meningitidis Z2491
gcggauaaccuugucgauaaac

SEQ ID NO: 30777 - RNA, 22 nt, Neisseria meningitidis Z2491
gcgggauauuuuugacggacgg

SEQ ID NO: 30778 - RNA, 22 nt, Neisseria meningitidis Z2491
gcguucggaguuugccggauua

SEQ ID NO: 30779 - RNA, 22 nt, Neisseria meningitidis Z2491
gcguuggaaguuuuuggcggcg

SEQ ID NO: 30780 - RNA, 20 nt, Neisseria meningitidis Z2491
gcuguauaaaaccaagucca

SEQ ID NO: 30781 - RNA, 18 nt, Neisseria meningitidis Z2491
gcuguucugccgacugga

SEQ ID NO: 30782 - RNA, 22 nt, Neisseria meningitidis Z2491
ggaauccaguuuuuugaguuuc

SEQ ID NO: 30783 - RNA, 22 nt, Neisseria meningitidis Z2491
ggccgucugaaggggucgggcg

SEQ ID NO: 30784 - RNA, 22 nt, Neisseria meningitidis Z2491
ggcgaagcgcaaccaagcuuug

SEQ ID NO: 30785 - RNA, 22 nt, Neisseria meningitidis Z2491
gguaacggguuucuuuaugucg

SEQ ID NO: 30786 - RNA, 22 nt, Neisseria meningitidis Z2491
ggucugaaacccuaacuaugca

SEQ ID NO: 30787 - RNA, 22 nt, Neisseria meningitidis Z2491
guaaaccaaggcaagcgacaua

SEQ ID NO: 30788 - RNA, 22 nt, Neisseria meningitidis Z2491
gucgggcagguucaaaaucaga

SEQ ID NO: 30789 - RNA, 22 nt, Neisseria meningitidis Z2491
gugccgaauacgucgacgguua

SEQ ID NO: 30790 - RNA, 22 nt, Neisseria meningitidis Z2491
gugccgucgaggucgaagagua

SEQ ID NO: 30791 - RNA, 17 nt, Neisseria meningitidis Z2491
uaacgucgucugaaaua

SEQ ID NO: 30792 - RNA, 22 nt, Neisseria meningitidis Z2491
uacggcuucggcgaauccgucg

SEQ ID NO: 30793 - RNA, 22 nt, Neisseria meningitidis Z2491
uagaaagcacaggcguugcuac

SEQ ID NO: 30794 - RNA, 22 nt, Neisseria meningitidis Z2491
uagcugccguuuuucgcccacu

SEQ ID NO: 30795 - RNA, 22 nt, Neisseria meningitidis Z2491
uaugccgucugaaaaggcggau

SEQ ID NO: 30796 - RNA, 22 nt, Neisseria meningitidis Z2491
uaugggaaaagugugccgcuuc

SEQ ID NO: 30797 - RNA, 22 nt, Neisseria meningitidis Z2491
uauuggcggcggaagaacgggu

SEQ ID NO: 30798 - RNA, 22 nt, Neisseria meningitidis Z2491
ucaaacucggcuucaaaccgcc

SEQ ID NO: 30799 - RNA, 21 nt, Neisseria meningitidis Z2491
ucagacggcauuuuuaugccc

SEQ ID NO: 30800 - RNA, 22 nt, Neisseria meningitidis Z2491
guaacgggggcuuugucgaaau

SEQ ID NO: 30801 - RNA, 22 nt, Neisseria meningitidis Z2491
gucauucccgcgcaggcgggaa

SEQ ID NO: 30802 - RNA, 22 nt, Neisseria meningitidis Z2491
gucggcaagccagucgaugggg

SEQ ID NO: 30803 - RNA, 22 nt, Neisseria meningitidis Z2491
gucugcaauaguguucaugagu

SEQ ID NO: 30804 - RNA, 22 nt, Neisseria meningitidis Z2491
gugaugcagugcuucgcguggg

SEQ ID NO: 30805 - RNA, 22 nt, Neisseria meningitidis Z2491
guggauuaaauuuaaaccagua

SEQ ID NO: 30806 - RNA, 22 nt, Neisseria meningitidis Z2491
guugaugccuucaaaguuuugg

SEQ ID NO: 30807 - RNA, 22 nt, Neisseria meningitidis Z2491
guuggacgaaccguccucuuuc

SEQ ID NO: 30808 - RNA, 22 nt, Neisseria meningitidis Z2491
guuguaucggcguaccgcuucu

SEQ ID NO: 30809 - RNA, 22 nt, Neisseria meningitidis Z2491
guuuagagguucuagauucccg

SEQ ID NO: 30810 - RNA, 23 nt, Neisseria meningitidis Z2491
guuuaugcaauggcggacaaaga

SEQ ID NO: 30811 - RNA, 22 nt, Neisseria meningitidis Z2491
guuugaaagacagacaagauaa

SEQ ID NO: 30812 - RNA, 22 nt, Neisseria meningitidis Z2491
guuugccaaagaccuucaagcg

SEQ ID NO: 30813 - RNA, 22 nt, Neisseria meningitidis Z2491
guuugccagcaccgccgccgcu

SEQ ID NO: 30814 - RNA, 22 nt, Neisseria meningitidis Z2491
uaacgguaucgaagaagaccuu

SEQ ID NO: 30815 - RNA, 22 nt, Neisseria meningitidis Z2491
uaaggcaucuguugcggcaaau

SEQ ID NO: 30816 - RNA, 22 nt, Neisseria meningitidis Z2491
uacaacguuacuaugcugguuu

SEQ ID NO: 30817 - RNA, 22 nt, Neisseria meningitidis Z2491
uacggaaaacacccuaugccgu

SEQ ID NO: 30818 - RNA, 22 nt, Neisseria meningitidis Z2491
uacgguaucgacuaagauuuug

SEQ ID NO: 30819 - RNA, 22 nt, Neisseria meningitidis Z2491
uacugguuaaauuuaauccacu

SEQ ID NO: 30820 - RNA, 22 nt, Neisseria meningitidis Z2491
uacugguuuuuguuaauccacu

SEQ ID NO: 30821 - RNA, 15 nt, Neisseria meningitidis Z2491
uaguuucagacggca

SEQ ID NO: 30822 - RNA, 22 nt, Neisseria meningitidis Z2491
uauccagaaugaugacgauuau

SEQ ID NO: 30823 - RNA, 18 nt, Neisseria meningitidis Z2491
uauccgccccccggagga

SEQ ID NO: 30824 - RNA, 22 nt, Neisseria meningitidis Z2491
uaucugaaaguuuagagguucu

SEQ ID NO: 30825 - RNA, 21 nt, Neisseria meningitidis Z2491
uauucgccggcuucgguuugc

SEQ ID NO: 30826 - RNA, 22 nt, Neisseria meningitidis Z2491
uauuugucgcucguuuccugcc

SEQ ID NO: 30827 - RNA, 19 nt, Neisseria meningitidis Z2491
ucacgucguaaaugcccgc

SEQ ID NO: 30828 - RNA, 22 nt, Neisseria meningitidis Z2491
ucagacggcauuucgcguuuuc

SEQ ID NO: 30829 - RNA, 22 nt, Neisseria meningitidis Z2491
ucagccugaaagagauguuugc

SEQ ID NO: 30830 - RNA, 22 nt, Neisseria meningitidis Z2491
ucagggcguuuauggcuuuuug

SEQ ID NO: 30831 - RNA, 22 nt, Neisseria meningitidis Z2491
uccgccaucaucgccgccugca

SEQ ID NO: 30832 - RNA, 22 nt, Neisseria meningitidis Z2491
ucgccguuuuggucgauaagga

SEQ ID NO: 30833 - RNA, 20 nt, Neisseria meningitidis Z2491
ucggcgagcgguuugcggau

SEQ ID NO: 30834 - RNA, 22 nt, Neisseria meningitidis Z2491
ucgucgaaaacaacguccaaau

SEQ ID NO: 30835 - RNA, 21 nt, Neisseria meningitidis Z2491
ucgucugaacguuucacguga

SEQ ID NO: 30836 - RNA, 22 nt, Neisseria meningitidis Z2491
ucuaaggucuggauucccgccu

SEQ ID NO: 30837 - RNA, 22 nt, Pseudomonas aeruginosa PA01
aucugccgcgcgcggagagacu

SEQ ID NO: 30838 - RNA, 23 nt, Pseudomonas aeruginosa PA01
aucugcucccaguacugguuggc

SEQ ID NO: 30839 - RNA, 22 nt, Pseudomonas aeruginosa PA01
aucuggagcgggccagcgacgc

SEQ ID NO: 30840 - RNA, 22 nt, Pseudomonas aeruginosa PA01
aucuggucgaugaauucgcgga

SEQ ID NO: 30841 - RNA, 22 nt, Pseudomonas aeruginosa PA01
aucuggugcccuucggcuucca

SEQ ID NO: 30842 - RNA, 22 nt, Pseudomonas aeruginosa PA01
augaacaccuuguccaugcggc

SEQ ID NO: 30843 - RNA, 22 nt, Pseudomonas aeruginosa PA01
augaagcgcaugucgcgauccu

SEQ ID NO: 30844 - RNA, 22 nt, Pseudomonas aeruginosa PA01
augaccggagcggccgccaggg

SEQ ID NO: 30845 - RNA, 22 nt, Pseudomonas aeruginosa PA01
augccgagaagcacgugguugc

SEQ ID NO: 30846 - RNA, 22 nt, Pseudomonas aeruginosa PA01
augccgagcugggcggcgcugg

SEQ ID NO: 30847 - RNA, 22 nt, Pseudomonas aeruginosa PA01
augccggccaccggagccggcg

SEQ ID NO: 30848 - RNA, 22 nt, Pseudomonas aeruginosa PA01
augccggcgaugggcgacuucg

SEQ ID NO: 30849 - RNA, 22 nt, Pseudomonas aeruginosa PA01
augccguucguccucagugccc

SEQ ID NO: 30850 - RNA, 22 nt, Pseudomonas aeruginosa PA01
augccguugccggccaggagcg

SEQ ID NO: 30851 - RNA, 22 nt, Pseudomonas aeruginosa PA01
augccuggagcaugcucuaugg

SEQ ID NO: 30852 - RNA, 22 nt, Pseudomonas aeruginosa PA01
augcgcgguaggcgcaucuucg

SEQ ID NO: 30853 - RNA, 22 nt, Pseudomonas aeruginosa PA01
augcgguucugcuggucggacu

SEQ ID NO: 30854 - RNA, 22 nt, Pseudomonas aeruginosa PA01
augcgguuguguucgguggcgu

SEQ ID NO: 30855 - RNA, 22 nt, Pseudomonas aeruginosa PA01
augcuggaagagucguacgugu

SEQ ID NO: 30856 - RNA, 22 nt, Pseudomonas aeruginosa PA01
augcugguggaggacugguuga

SEQ ID NO: 30857 - RNA, 22 nt, Pseudomonas aeruginosa PA01
auggaucgggcgcuggucgaug

SEQ ID NO: 30858 - RNA, 22 nt, Pseudomonas aeruginosa PA01
auggcaggaaagagcgggcggu

SEQ ID NO: 30859 - RNA, 22 nt, Pseudomonas aeruginosa PA01
auggcccgugcccaggggguca

SEQ ID NO: 30860 - RNA, 22 nt, Pseudomonas aeruginosa PA01
auggcgaccugagccguccgcg

SEQ ID NO: 30861 - RNA, 22 nt, Pseudomonas aeruginosa PA01
auggcgacugacgaagaacacc

SEQ ID NO: 30862 - RNA, 22 nt, Pseudomonas aeruginosa PA01
auggcgaucuccgccggcagcu

SEQ ID NO: 30863 - RNA, 22 nt, Pseudomonas aeruginosa PA01
auggcgccuccucuccuagugg

SEQ ID NO: 30864 - RNA, 22 nt, Pseudomonas aeruginosa PA01
auggcguguccgccggccugga

SEQ ID NO: 30865 - RNA, 22 nt, Pseudomonas aeruginosa PA01
augggccacuccuacgacggca

SEQ ID NO: 30866 - RNA, 22 nt, Pseudomonas aeruginosa PA01
augggcgaagagcacggcacag

SEQ ID NO: 30867 - RNA, 22 nt, Pseudomonas aeruginosa PA01
augggcgauaacgccguuguuc

SEQ ID NO: 30868 - RNA, 22 nt, Pseudomonas aeruginosa PA01
auggugguggagcacgacaugg

SEQ ID NO: 30869 - RNA, 22 nt, Pseudomonas aeruginosa PA01
auguugcugccauucugccuga

SEQ ID NO: 30870 - RNA, 22 nt, Pseudomonas aeruginosa PA01
auugaaagugauccgcgccugc

SEQ ID NO: 30871 - RNA, 22 nt, Pseudomonas aeruginosa PA01
acgggggccucgcgguagcaug

SEQ ID NO: 30872 - RNA, 22 nt, Pseudomonas aeruginosa PA01
acggucgagcagcacgucgagg

SEQ ID NO: 30873 - RNA, 22 nt, Pseudomonas aeruginosa PA01
acgguggaacuggugguggccg

SEQ ID NO: 30874 - RNA, 22 nt, Pseudomonas aeruginosa PA01
acgguggugccggugagcuggc

SEQ ID NO: 30875 - RNA, 22 nt, Pseudomonas aeruginosa PA01
acgucagccuggcccaggccga

SEQ ID NO: 30876 - RNA, 22 nt, Pseudomonas aeruginosa PA01
acgugcugaaucgggaaagcgg

SEQ ID NO: 30877 - RNA, 22 nt, Pseudomonas aeruginosa PA01
acuaccugggugccgagccggg

SEQ ID NO: 30878 - RNA, 22 nt, Pseudomonas aeruginosa PA01
acucggcgauggcuucguggcc

SEQ ID NO: 30879 - RNA, 22 nt, Pseudomonas aeruginosa PA01
acugacgcgggaguuugccugc

SEQ ID NO: 30880 - RNA, 22 nt, Pseudomonas aeruginosa PA01
acugcgcgccacggccgaggaa

SEQ ID NO: 30881 - RNA, 22 nt, Pseudomonas aeruginosa PA01
acugcuuucgaaauauacgaau

SEQ ID NO: 30882 - RNA, 22 nt, Pseudomonas aeruginosa PA01
acuggccaacaucgccgaggcg

SEQ ID NO: 30883 - RNA, 22 nt, Pseudomonas aeruginosa PA01
acuggcccuggcuacgcgccug

SEQ ID NO: 30884 - RNA, 22 nt, Pseudomonas aeruginosa PA01
acuggcgaagcggucggcggua

SEQ ID NO: 30885 - RNA, 22 nt, Pseudomonas aeruginosa PA01
acuggcucuggccgaucucggc

SEQ ID NO: 30886 - RNA, 22 nt, Pseudomonas aeruginosa PA01
acugguggaugccggugaucca

SEQ ID NO: 30887 - RNA, 22 nt, Pseudomonas aeruginosa PA01
acugucgcgcuggcucggcccg

SEQ ID NO: 30888 - RNA, 22 nt, Pseudomonas aeruginosa PA01
agaacuuccgccaggucgucuu

SEQ ID NO: 30889 - RNA, 22 nt, Pseudomonas aeruginosa PA01
agaagcacgacgcucgccggcg

SEQ ID NO: 30890 - RNA, 22 nt, Pseudomonas aeruginosa PA01
agaccaugcggguuuccggggu

SEQ ID NO: 30891 - RNA, 22 nt, Pseudomonas aeruginosa PA01
agaccgaucuucucggcaaagg

SEQ ID NO: 30892 - RNA, 22 nt, Pseudomonas aeruginosa PA01
agaccuccugcaccgagcugau

SEQ ID NO: 30893 - RNA, 22 nt, Pseudomonas aeruginosa PA01
agacggauuuccaggcgaaggg

SEQ ID NO: 30894 - RNA, 22 nt, Pseudomonas aeruginosa PA01
agagcuaucgagucacgcauga

SEQ ID NO: 30895 - RNA, 22 nt, Pseudomonas aeruginosa PA01
agaggaaagugcccggguccug

SEQ ID NO: 30896 - RNA, 22 nt, Pseudomonas aeruginosa PA01
agaggaaccuuccggcugcguc

SEQ ID NO: 30897 - RNA, 22 nt, Pseudomonas aeruginosa PA01
agaggggcuggaauggcaggcc

SEQ ID NO: 30898 - RNA, 22 nt, Pseudomonas aeruginosa PA01
agaucagcggccgcuggcugcc

SEQ ID NO: 30899 - RNA, 22 nt, Pseudomonas aeruginosa PA01
agaucaugggcgucgccgccgg

SEQ ID NO: 30900 - RNA, 22 nt, Pseudomonas aeruginosa PA01
agaugcugcgccagggcgugca

SEQ ID NO: 30901 - RNA, 22 nt, Pseudomonas aeruginosa PA01
agcaacccggcgguggucaagc

SEQ ID NO: 30902 - RNA, 22 nt, Pseudomonas aeruginosa PA01
agcaccagguaggacagcgccu

SEQ ID NO: 30903 - RNA, 22 nt, Pseudomonas aeruginosa PA01
agcaccccgccgaccagcauca

SEQ ID NO: 30904 - RNA, 22 nt, Pseudomonas aeruginosa PA01
agcaccgcacgguauugcggcu

SEQ ID NO: 30905 - RNA, 22 nt, Pseudomonas aeruginosa PA01
agcacgaacuggcgcagaugaa

SEQ ID NO: 30906 - RNA, 22 nt, Pseudomonas aeruginosa PA01
agcagcggguggccaugggccg

SEQ ID NO: 30907 - RNA, 22 nt, Pseudomonas aeruginosa PA01
aggucguccacgccgacccggc

SEQ ID NO: 30908 - RNA, 22 nt, Pseudomonas aeruginosa PA01
aggucuaccgucaguucgccga

SEQ ID NO: 30909 - RNA, 22 nt, Pseudomonas aeruginosa PA01
aggugaucguagucgccguuga

SEQ ID NO: 30910 - RNA, 21 nt, Pseudomonas aeruginosa PA01
aggugcucgaccaggugcgcc

SEQ ID NO: 30911 - RNA, 22 nt, Pseudomonas aeruginosa PA01
aggugucguccggucucgagua

SEQ ID NO: 30912 - RNA, 22 nt, Pseudomonas aeruginosa PA01
agguguggcugccuucgccgcc

SEQ ID NO: 30913 - RNA, 22 nt, Pseudomonas aeruginosa PA01
aguaccggcgccagcgcccugc

SEQ ID NO: 30914 - RNA, 20 nt, Pseudomonas aeruginosa PA01
aguaccugaacuccccggag

SEQ ID NO: 30915 - RNA, 20 nt, Pseudomonas aeruginosa PA01
agucgccgaucgccauccgu

SEQ ID NO: 30916 - RNA, 22 nt, Pseudomonas aeruginosa PA01
agucgcugaugaaguucaccgc

SEQ ID NO: 30917 - RNA, 22 nt, Pseudomonas aeruginosa PA01
agucggcguuccucgccggcaa

SEQ ID NO: 30918 - RNA, 22 nt, Pseudomonas aeruginosa PA01
agucuggcuuuugaaguucugu

SEQ ID NO: 30919 - RNA, 22 nt, Pseudomonas aeruginosa PA01
aguucgcguucgcggcucaucg

SEQ ID NO: 30920 - RNA, 22 nt, Pseudomonas aeruginosa PA01
aguucgucaacgccagcgcgca

SEQ ID NO: 30921 - RNA, 22 nt, Pseudomonas aeruginosa PA01
aguugccgccggccuuccgcga

SEQ ID NO: 30922 - RNA, 22 nt, Pseudomonas aeruginosa PA01
aguugcgcgaggcguucgucga

SEQ ID NO: 30923 - RNA, 22 nt, Pseudomonas aeruginosa PA01
auaaccgagcaggggcaggcug

SEQ ID NO: 30924 - RNA, 22 nt, Pseudomonas aeruginosa PA01
auaccggccaguucggcgccga

SEQ ID NO: 30925 - RNA, 22 nt, Pseudomonas aeruginosa PA01
auaggagaaguccgaggcgauu

SEQ ID NO: 30926 - RNA, 22 nt, Pseudomonas aeruginosa PA01
aucagcagcgacuggcagaccu

SEQ ID NO: 30927 - RNA, 19 nt, Pseudomonas aeruginosa PA01
aucagcccgcccagugcuu

SEQ ID NO: 30928 - RNA, 19 nt, Pseudomonas aeruginosa PA01
aucaucugcgcgcuguuuc

SEQ ID NO: 30929 - RNA, 22 nt, Pseudomonas aeruginosa PA01
aucccgaccagggcgccgagcg

SEQ ID NO: 30930 - RNA, 22 nt, Pseudomonas aeruginosa PA01
auccgcguggugacguucgacu

SEQ ID NO: 30931 - RNA, 22 nt, Pseudomonas aeruginosa PA01
auccgcuccacucaacggggcg

SEQ ID NO: 30932 - RNA, 22 nt, Pseudomonas aeruginosa PA01
auccggccguugguggugaaca

SEQ ID NO: 30933 - RNA, 22 nt, Pseudomonas aeruginosa PA01
auccggggcgguuucgcagaca

SEQ ID NO: 30934 - RNA, 22 nt, Pseudomonas aeruginosa PA01
aucgagaucgaggucggcuggg

SEQ ID NO: 30935 - RNA, 22 nt, Pseudomonas aeruginosa PA01
aucgagcaugacaugggcaugg

SEQ ID NO: 30936 - RNA, 22 nt, Pseudomonas aeruginosa PA01
aucgccaucgaccagccgagau

SEQ ID NO: 30937 - RNA, 22 nt, Pseudomonas aeruginosa PA01
aucgccauucccaguuaccaga

SEQ ID NO: 30938 - RNA, 23 nt, Pseudomonas aeruginosa PA01
aucgccccguucgagcuuggcga

SEQ ID NO: 30939 - RNA, 22 nt, Pseudomonas aeruginosa PA01
aucgcccugcgccuggacgccg

SEQ ID NO: 30940 - RNA, 22 nt, Pseudomonas aeruginosa PA01
aucgcccugucccuggccggca

SEQ ID NO: 30941 - RNA, 22 nt, Pseudomonas aeruginosa PA01
aucgccucgggcggcagcagca

SEQ ID NO: 30942 - RNA, 22 nt, Pseudomonas aeruginosa PA01
aucgccuggccgcgcgggcccu

SEQ ID NO: 30943 - RNA, 22 nt, Pseudomonas aeruginosa PA01
aucgcgauggugguggccgggc

SEQ ID NO: 30944 - RNA, 22 nt, Pseudomonas aeruginosa PA01
aucgcgugguggacaucgacgg

SEQ ID NO: 30945 - RNA, 22 nt, Pseudomonas aeruginosa PA01
aucggcagcgggucgucggcgu

SEQ ID NO: 30946 - RNA, 22 nt, Pseudomonas aeruginosa PA01
aucggccgacacccauugcagg

SEQ ID NO: 30947 - RNA, 22 nt, Pseudomonas aeruginosa PA01
aucggccgcagcauguccucca

SEQ ID NO: 30948 - RNA, 22 nt, Pseudomonas aeruginosa PA01
aucggcgaacaggaucgcgcag

SEQ ID NO: 30949 - RNA, 22 nt, Pseudomonas aeruginosa PA01
aucggcgaggaucgccagcucg

SEQ ID NO: 30950 - RNA, 22 nt, Pseudomonas aeruginosa PA01
aucggcggcgaggaccaacugc

SEQ ID NO: 30951 - RNA, 21 nt, Pseudomonas aeruginosa PA01
aucggcugaccguccggcggc

SEQ ID NO: 30952 - RNA, 22 nt, Pseudomonas aeruginosa PA01
aucggugaugcggcggcgcugg

SEQ ID NO: 30953 - RNA, 22 nt, Pseudomonas aeruginosa PA01
aucggugccggaguugugcucg

SEQ ID NO: 30954 - RNA, 22 nt, Pseudomonas aeruginosa PA01
aucguauccguauugagagagu

SEQ ID NO: 30955 - RNA, 22 nt, Pseudomonas aeruginosa PA01
aucucgccgcuguccggcuggu

SEQ ID NO: 30956 - RNA, 22 nt, Pseudomonas aeruginosa PA01
cuuccacgcguugggccugucc

SEQ ID NO: 30957 - RNA, 22 nt, Pseudomonas aeruginosa PA01
cuuccagcgcucgcugcgcacc

SEQ ID NO: 30958 - RNA, 22 nt, Pseudomonas aeruginosa PA01
cuuccugggucugcggcaugac

SEQ ID NO: 30959 - RNA, 22 nt, Pseudomonas aeruginosa PA01
cuucgccugaccucuucgugga

SEQ ID NO: 30960 - RNA, 22 nt, Pseudomonas aeruginosa PA01
cuucggcgaggaaacgccgcgc

SEQ ID NO: 30961 - RNA, 22 nt, Pseudomonas aeruginosa PA01
cuugaccaccgccggguugcuc

SEQ ID NO: 30962 - RNA, 22 nt, Pseudomonas aeruginosa PA01
cuugccgcccugagcaacagcc

SEQ ID NO: 30963 - RNA, 22 nt, Pseudomonas aeruginosa PA01
cuugccgguaccggcgcuggcc

SEQ ID NO: 30964 - RNA, 22 nt, Pseudomonas aeruginosa PA01
cuuguguuuuuacugucgaaau

SEQ ID NO: 30965 - RNA, 22 nt, Pseudomonas aeruginosa PA01
cuuguuggugaagucgaccgaa

SEQ ID NO: 30966 - RNA, 22 nt, Pseudomonas aeruginosa PA01
gaaggcaugaucuugaggcaca

SEQ ID NO: 30967 - RNA, 22 nt, Pseudomonas aeruginosa PA01
gaaggcggcgaaggcggcaucg

SEQ ID NO: 30968 - RNA, 22 nt, Pseudomonas aeruginosa PA01
gaagugccccggggcgaccgcg

SEQ ID NO: 30969 - RNA, 22 nt, Pseudomonas aeruginosa PA01
gaaugccgaggagccgcugcgc

SEQ ID NO: 30970 - RNA, 22 nt, Pseudomonas aeruginosa PA01
gacagcagcagcaucaucugcu

SEQ ID NO: 30971 - RNA, 22 nt, Pseudomonas aeruginosa PA01
gacaggucgaggucguugcgcg

SEQ ID NO: 30972 - RNA, 22 nt, Pseudomonas aeruginosa PA01
gacaugauccccgccgacaucc

SEQ ID NO: 30973 - RNA, 22 nt, Pseudomonas aeruginosa PA01
gaccaccuccuuguacugacug

SEQ ID NO: 30974 - RNA, 22 nt, Pseudomonas aeruginosa PA01
gaccagguccagggacggagcg

SEQ ID NO: 30975 - RNA, 22 nt, Pseudomonas aeruginosa PA01
gaccaucgacgaagaccgcugc

SEQ ID NO: 30976 - RNA, 22 nt, Pseudomonas aeruginosa PA01
gaccggcguugaugucgccuuc

SEQ ID NO: 30977 - RNA, 22 nt, Pseudomonas aeruginosa PA01
gaccgucuugcuggcggguugu

SEQ ID NO: 30978 - RNA, 22 nt, Pseudomonas aeruginosa PA01
gaccucauggaacagguucaug

SEQ ID NO: 30979 - RNA, 22 nt, Pseudomonas aeruginosa PA01
gaccugaucguggacgggggcu

SEQ ID NO: 30980 - RNA, 22 nt, Pseudomonas aeruginosa PA01
gaccuggacguacugcccggca

SEQ ID NO: 30981 - RNA, 22 nt, Pseudomonas aeruginosa PA01
gaccuggccugcgaacugggua

SEQ ID NO: 30982 - RNA, 22 nt, Pseudomonas aeruginosa PA01
gaccuugucgaacggcaguuuc

SEQ ID NO: 30983 - RNA, 22 nt, Pseudomonas aeruginosa PA01
gaccuugucguuguaggccuug

SEQ ID NO: 30984 - RNA, 22 nt, Pseudomonas aeruginosa PA01
gacgaggaccgcaucgccgccc

SEQ ID NO: 30985 - RNA, 22 nt, Pseudomonas aeruginosa PA01
gacgaggacgaggaugucgagg

SEQ ID NO: 30986 - RNA, 22 nt, Pseudomonas aeruginosa PA01
gacgaggcgaacugcucgaaca

SEQ ID NO: 30987 - RNA, 22 nt, Pseudomonas aeruginosa PA01
gacgccaugcucggcgcgcuga

SEQ ID NO: 30988 - RNA, 22 nt, Pseudomonas aeruginosa PA01
gacggcgggaugguggugaaca

SEQ ID NO: 30989 - RNA, 22 nt, Pseudomonas aeruginosa PA01
gacggguugccgccgcuggccg

SEQ ID NO: 30990 - RNA, 22 nt, Pseudomonas aeruginosa PA01
gacguugauccucggcgucucc

SEQ ID NO: 30991 - RNA, 22 nt, Pseudomonas aeruginosa PA01
gacuggcgaagccgcaggccag

SEQ ID NO: 30992 - RNA, 22 nt, Pseudomonas aeruginosa PA01
gagagcgugucggacaugucuu

SEQ ID NO: 30993 - RNA, 22 nt, Pseudomonas aeruginosa PA01
gagcacuacacgaagcggcgcc

SEQ ID NO: 30994 - RNA, 18 nt, Pseudomonas aeruginosa PA01
gagcagacccucgaguuc

SEQ ID NO: 30995 - RNA, 22 nt, Pseudomonas aeruginosa PA01
gagcagcuggaucgggcgccgc

SEQ ID NO: 30996 - RNA, 22 nt, Pseudomonas aeruginosa PA01
gagcaggugauaggcgaugcgc

SEQ ID NO: 30997 - RNA, 22 nt, Pseudomonas aeruginosa PA01
gagcauggucgguugaucgugc

SEQ ID NO: 30998 - RNA, 22 nt, Pseudomonas aeruginosa PA01
gagccuggccgagcgcuucugc

SEQ ID NO: 30999 - RNA, 22 nt, Pseudomonas aeruginosa PA01
gagcgauccuccaguucuuccu

SEQ ID NO: 31000 - RNA, 22 nt, Pseudomonas aeruginosa PA01
gagcgcgaguuccaggcacugg

SEQ ID NO: 31001 - RNA, 22 nt, Pseudomonas aeruginosa PA01
gagcggccggacuucggcgaga

SEQ ID NO: 31002 - RNA, 22 nt, Pseudomonas aeruginosa PA01
gagcggcugaugcggcggcuga

SEQ ID NO: 31003 - RNA, 22 nt, Pseudomonas aeruginosa PA01
gagcucgcucuggaugcgcguc

SEQ ID NO: 31004 - RNA, 22 nt, Pseudomonas aeruginosa PA01
gagcuggaagcugcgcuggucg

SEQ ID NO: 31005 - RNA, 22 nt, Pseudomonas aeruginosa PA01
gagcuggaguugcggauuggca

SEQ ID NO: 31006 - RNA, 22 nt, Pseudomonas aeruginosa PA01
gagcuguuucucguggcccugc

SEQ ID NO: 31007 - RNA, 22 nt, Pseudomonas aeruginosa PA01
gaggacggcgaaacgccugcca

SEQ ID NO: 31008 - RNA, 22 nt, Pseudomonas aeruginosa PA01
gaggaugucguugaucaccagg

SEQ ID NO: 31009 - RNA, 22 nt, Pseudomonas aeruginosa PA01
gaggccaagcgccccucgggca

SEQ ID NO: 31010 - RNA, 20 nt, Pseudomonas aeruginosa PA01
gaggccaucgcgcccgccga

SEQ ID NO: 31011 - RNA, 23 nt, Pseudomonas aeruginosa PA01
gaggccgcgcgacgucuuugucg

SEQ ID NO: 31012 - RNA, 22 nt, Pseudomonas aeruginosa PA01
gaggcgacgaucgacuagacug

SEQ ID NO: 31013 - RNA, 22 nt, Pseudomonas aeruginosa PA01
gaggcgacugcccaguugcggc

SEQ ID NO: 31014 - RNA, 22 nt, Pseudomonas aeruginosa PA01
gaggcgcucgguuacgaccuuu

SEQ ID NO: 31015 - RNA, 22 nt, Pseudomonas aeruginosa PA01
gaggcgucgcgcaggucgagca

SEQ ID NO: 31016 - RNA, 22 nt, Pseudomonas aeruginosa PA01
gaggcuggccugcggccugucg

SEQ ID NO: 31017 - RNA, 22 nt, Pseudomonas aeruginosa PA01
gagggccuccggaagcccggcc

SEQ ID NO: 31018 - RNA, 22 nt, Pseudomonas aeruginosa PA01
gagggccuuuuccaagccggcc

SEQ ID NO: 31019 - RNA, 22 nt, Pseudomonas aeruginosa PA01
gagggcguaccgccgauggcgc

SEQ ID NO: 31020 - RNA, 22 nt, Pseudomonas aeruginosa PA01
gagggcuuguuccggcaacugg

SEQ ID NO: 31021 - RNA, 22 nt, Pseudomonas aeruginosa PA01
gagggugccauccacggaccgc

SEQ ID NO: 31022 - RNA, 22 nt, Pseudomonas aeruginosa PA01
gaggucgagcgugcccuggcgc

SEQ ID NO: 31023 - RNA, 22 nt, Pseudomonas aeruginosa PA01
gaggugacacuucuccagcauu

SEQ ID NO: 31024 - RNA, 22 nt, Pseudomonas aeruginosa PA01
gaggugaugaucaggaacagca

SEQ ID NO: 31025 - RNA, 22 nt, Pseudomonas aeruginosa PA01
gaggugcugcugguggacggcg

SEQ ID NO: 31026 - RNA, 22 nt, Pseudomonas aeruginosa PA01
gagucaacgacaugaccccgcg

SEQ ID NO: 31027 - RNA, 22 nt, Pseudomonas aeruginosa PA01
gagucgcaaagccgcgcguugc

SEQ ID NO: 31028 - RNA, 22 nt, Pseudomonas aeruginosa PA01
gaguggcaguugaucaugcgcg

SEQ ID NO: 31029 - RNA, 22 nt, Pseudomonas aeruginosa PA01
gaguucgccgugcugcugcccg

SEQ ID NO: 31030 - RNA, 22 nt, Pseudomonas aeruginosa PA01
gaucaucacguaggucagccag

SEQ ID NO: 31031 - RNA, 23 nt, Pseudomonas aeruginosa PA01
gaucccggcgacgaugccggcgg

SEQ ID NO: 31032 - RNA, 22 nt, Pseudomonas aeruginosa PA01
gaucgacgccaggcacgccgag

SEQ ID NO: 31033 - RNA, 22 nt, Pseudomonas aeruginosa PA01
gaucggcgaggagagcggccug

SEQ ID NO: 31034 - RNA, 22 nt, Pseudomonas aeruginosa PA01
gaugaugcucuuccaggucucc

SEQ ID NO: 31035 - RNA, 21 nt, Pseudomonas aeruginosa PA01
gaugccgaucuucaggucguc

SEQ ID NO: 31036 - RNA, 22 nt, Pseudomonas aeruginosa PA01
gaugccgccaugccgcagcagg

SEQ ID NO: 31037 - RNA, 20 nt, Pseudomonas aeruginosa PA01
gaugccuuccagcagccagu

SEQ ID NO: 31038 - RNA, 22 nt, Pseudomonas aeruginosa PA01
gaugcgauggaagcccugaucg

SEQ ID NO: 31039 - RNA, 22 nt, Pseudomonas aeruginosa PA01
gcaccgcuucgccgaucucguc

SEQ ID NO: 31040 - RNA, 22 nt, Pseudomonas aeruginosa PA01
gcaccggcgacuucugcugccc

SEQ ID NO: 31041 - RNA, 20 nt, Pseudomonas aeruginosa PA01
gcaccgucugcgucgagguc

SEQ ID NO: 31042 - RNA, 22 nt, Pseudomonas aeruginosa PA01
gcacgccuaccgaguagaguug

SEQ ID NO: 31043 - RNA, 22 nt, Pseudomonas aeruginosa PA01
gcacgcuggcguaggucauggu

SEQ ID NO: 31044 - RNA, 22 nt, Pseudomonas aeruginosa PA01
gcacggacucguccuuggcgcc

SEQ ID NO: 31045 - RNA, 22 nt, Pseudomonas aeruginosa PA01
gcacggagcgauacggugcgcg

SEQ ID NO: 31046 - RNA, 22 nt, Pseudomonas aeruginosa PA01
gcacgggagugccggagguauu

SEQ ID NO: 31047 - RNA, 22 nt, Pseudomonas aeruginosa PA01
gcacgucgagcuugguggcgaa

SEQ ID NO: 31048 - RNA, 22 nt, Pseudomonas aeruginosa PA01
gcacgugcuggagcgcccgcug

SEQ ID NO: 31049 - RNA, 22 nt, Pseudomonas aeruginosa PA01
gcagcagcuugccguccggguu

SEQ ID NO: 31050 - RNA, 22 nt, Pseudomonas aeruginosa PA01
gcagcgccaguugcuggacacc

SEQ ID NO: 31051 - RNA, 23 nt, Pseudomonas aeruginosa PA01
gcagcgccggccccauggggauc

SEQ ID NO: 31052 - RNA, 22 nt, Pseudomonas aeruginosa PA01
gcagcgcugcgcgagcagggug

SEQ ID NO: 31053 - RNA, 22 nt, Pseudomonas aeruginosa PA01
gcagcggcaacggguggucgac

SEQ ID NO: 31054 - RNA, 22 nt, Pseudomonas aeruginosa PA01
gcagcggcuccucggcauucuc

SEQ ID NO: 31055 - RNA, 22 nt, Pseudomonas aeruginosa PA01
gcagcgggaucagcgucgacga

SEQ ID NO: 31056 - RNA, 22 nt, Pseudomonas aeruginosa PA01
gcagcgguacgcaggccucgca

SEQ ID NO: 31057 - RNA, 22 nt, Pseudomonas aeruginosa PA01
gcaggaagccgaggaugguagc

SEQ ID NO: 31058 - RNA, 17 nt, Pseudomonas aeruginosa PA01
gcaggccucgccgccgu

SEQ ID NO: 31059 - RNA, 22 nt, Pseudomonas aeruginosa PA01
gcagggcgugcgcccggcgaau

SEQ ID NO: 31060 - RNA, 22 nt, Pseudomonas aeruginosa PA01
gcaggguggccuccuugagcuu

SEQ ID NO: 31061 - RNA, 22 nt, Pseudomonas aeruginosa PA01
gcaggucgaaacccuucgccag

SEQ ID NO: 31062 - RNA, 22 nt, Pseudomonas aeruginosa PA01
gcagguugcacgccgcccuggc

SEQ ID NO: 31063 - RNA, 22 nt, Pseudomonas aeruginosa PA01
gcagucgaccagcgccgccugg

SEQ ID NO: 31064 - RNA, 22 nt, Pseudomonas aeruginosa PA01
gcagucuucagcaugccgcguc

SEQ ID NO: 31065 - RNA, 19 nt, Pseudomonas aeruginosa PA01
gcaguucagcgacaacccg

SEQ ID NO: 31066 - RNA, 22 nt, Pseudomonas aeruginosa PA01
gcaguuccuccacgcgguuucc

SEQ ID NO: 31067 - RNA, 22 nt, Pseudomonas aeruginosa PA01
gcaguucgacccgccgcuggac

SEQ ID NO: 31068 - RNA, 21 nt, Pseudomonas aeruginosa PA01
gcaucgccguggauggaaauc

SEQ ID NO: 31069 - RNA, 18 nt, Pseudomonas aeruginosa PA01
gcaucggcgugaacagcc

SEQ ID NO: 31070 - RNA, 22 nt, Pseudomonas aeruginosa PA01
gcaugccgaccagcauccgggc

SEQ ID NO: 31071 - RNA, 22 nt, Pseudomonas aeruginosa PA01
gcaugguggcguucgacgugau

SEQ ID NO: 31072 - RNA, 22 nt, Pseudomonas aeruginosa PA01
gcaugucgcucaugucgacgaa

SEQ ID NO: 31073 - RNA, 22 nt, Pseudomonas aeruginosa PA01
gccaaagggcgccucgcgaugc

SEQ ID NO: 31074 - RNA, 22 nt, Pseudomonas aeruginosa PA01
gccacuccucguuccaggcuga

SEQ ID NO: 31075 - RNA, 18 nt, Pseudomonas aeruginosa PA01
gccagccaggcagaaacc

SEQ ID NO: 31076 - RNA, 21 nt, Pseudomonas aeruginosa PA01
gccagcucggccaggcccugg

SEQ ID NO: 31077 - RNA, 22 nt, Pseudomonas aeruginosa PA01
gccaggacccgggcacuuuccu

SEQ ID NO: 31078 - RNA, 22 nt, Pseudomonas aeruginosa PA01
gccaggccugcucguguuccgg

SEQ ID NO: 31079 - RNA, 22 nt, Pseudomonas aeruginosa PA01
gccagggcacgcucgaccucgc

SEQ ID NO: 31080 - RNA, 22 nt, Pseudomonas aeruginosa PA01
gccagguugacgcuggccgacu

SEQ ID NO: 31081 - RNA, 22 nt, Pseudomonas aeruginosa PA01
gccaucgagaaccagaucaagc

SEQ ID NO: 31082 - RNA, 22 nt, Pseudomonas aeruginosa PA01
gccaucgucauccucggugccg

SEQ ID NO: 31083 - RNA, 22 nt, Pseudomonas aeruginosa PA01
gccauucgccgggcgugcucgg

SEQ ID NO: 31084 - RNA, 22 nt, Pseudomonas aeruginosa PA01
gcccacggcgcugccacagaag

SEQ ID NO: 31085 - RNA, 22 nt, Pseudomonas aeruginosa PA01
gcccagaugcauucgcgcuuga

SEQ ID NO: 31086 - RNA, 22 nt, Pseudomonas aeruginosa PA01
gcccagggucuuuugcgggugg

SEQ ID NO: 31087 - RNA, 22 nt, Pseudomonas aeruginosa PA01
gcccaugucaugcucgaucagc

SEQ ID NO: 31088 - RNA, 22 nt, Pseudomonas aeruginosa PA01
gccccgguaacugccauuacca

SEQ ID NO: 31089 - RNA, 22 nt, Pseudomonas aeruginosa PA01
gccccucgcggaucucggcgau

SEQ ID NO: 31090 - RNA, 22 nt, Pseudomonas aeruginosa PA01
gcccucgacgggcucuucgaga

SEQ ID NO: 31091 - RNA, 22 nt, Pseudomonas aeruginosa PA01
gcccucgggcaguucguaggug

SEQ ID NO: 31092 - RNA, 22 nt, Pseudomonas aeruginosa PA01
gcccuucgaccuacggacggau

SEQ ID NO: 31093 - RNA, 22 nt, Pseudomonas aeruginosa PA01
gcccuucguagaaugcuggcga

SEQ ID NO: 31094 - RNA, 22 nt, Pseudomonas aeruginosa PA01
gcccuugagggcggcggcgaac

SEQ ID NO: 31095 - RNA, 20 nt, Pseudomonas aeruginosa PA01
gccgacgauugagccggcga

SEQ ID NO: 31096 - RNA, 21 nt, Pseudomonas aeruginosa PA01
gccgagcgauucggcgggagg

SEQ ID NO: 31097 - RNA, 22 nt, Pseudomonas aeruginosa PA01
gccgaggaauuuccccgcgaac

SEQ ID NO: 31098 - RNA, 22 nt, Pseudomonas aeruginosa PA01
gccgaucaugaguucgucgggc

SEQ ID NO: 31099 - RNA, 22 nt, Pseudomonas aeruginosa PA01
gccgauccggaucgggcgccuu

SEQ ID NO: 31100 - RNA, 22 nt, Pseudomonas aeruginosa PA01
gccgauccugcgcggcacccug

SEQ ID NO: 31101 - RNA, 22 nt, Pseudomonas aeruginosa PA01
gccgaucgccaccgggaucagc

SEQ ID NO: 31102 - RNA, 22 nt, Pseudomonas aeruginosa PA01
gccgauguacggguucagcgcg

SEQ ID NO: 31103 - RNA, 21 nt, Pseudomonas aeruginosa PA01
gccgcacgcugcccuccaggc

SEQ ID NO: 31104 - RNA, 22 nt, Pseudomonas aeruginosa PA01
gccgccaccgccgauugaucca

SEQ ID NO: 31105 - RNA, 22 nt, Pseudomonas aeruginosa PA01
gccgccaucaacuggccgacgg

SEQ ID NO: 31106 - RNA, 22 nt, Pseudomonas aeruginosa PA01
gccgccgagucccuggagcgug

SEQ ID NO: 31107 - RNA, 23 nt, Pseudomonas aeruginosa PA01
gccgccuucgucggcgaugcccu

SEQ ID NO: 31108 - RNA, 22 nt, Pseudomonas aeruginosa PA01
gccgcgcugcuggcgaagcuga

SEQ ID NO: 31109 - RNA, 22 nt, Pseudomonas aeruginosa PA01
gccgcgcuggccuucgaggagc

SEQ ID NO: 31110 - RNA, 22 nt, Pseudomonas aeruginosa PA01
gccgcgguucaggcggcgccag

SEQ ID NO: 31111 - RNA, 22 nt, Pseudomonas aeruginosa PA01
gccgcguucguccgcgaggacg

SEQ ID NO: 31112 - RNA, 22 nt, Pseudomonas aeruginosa PA01
gccggagcugccggccgaccug

SEQ ID NO: 31113 - RNA, 22 nt, Pseudomonas aeruginosa PA01
gccggcauagggcuuggcgucg

SEQ ID NO: 31114 - RNA, 22 nt, Pseudomonas aeruginosa PA01
gccggccaguucaccggcgcgc

SEQ ID NO: 31115 - RNA, 22 nt, Pseudomonas aeruginosa PA01
gccggccauuguugaaaacagu

SEQ ID NO: 31116 - RNA, 22 nt, Pseudomonas aeruginosa PA01
gccggccguagggaaucgaacg

SEQ ID NO: 31117 - RNA, 22 nt, Pseudomonas aeruginosa PA01
gccggccguugcaauggcugua

SEQ ID NO: 31118 - RNA, 22 nt, Pseudomonas aeruginosa PA01
gccggcgagcaguuggcgaugu

SEQ ID NO: 31119 - RNA, 22 nt, Pseudomonas aeruginosa PA01
gccggcgccgauggcgaauucc

SEQ ID NO: 31120 - RNA, 22 nt, Pseudomonas aeruginosa PA01
gccggcggaauacuucgggucc

SEQ ID NO: 31121 - RNA, 22 nt, Pseudomonas aeruginosa PA01
gccgggcgucggcaccgaggug

SEQ ID NO: 31122 - RNA, 22 nt, Pseudomonas aeruginosa PA01
gccgggcuccggcggacgcagg

SEQ ID NO: 31123 - RNA, 22 nt, Pseudomonas aeruginosa PA01
gccggggcgcucgaccuggagg

SEQ ID NO: 31124 - RNA, 22 nt, Pseudomonas aeruginosa PA01
cgcccgguccuguccgugacgu

SEQ ID NO: 31125 - RNA, 22 nt, Pseudomonas aeruginosa PA01
cgccgaaggauggcccgagcgc

SEQ ID NO: 31126 - RNA, 20 nt, Pseudomonas aeruginosa PA01
cgccgacgaggauccugacg

SEQ ID NO: 31127 - RNA, 22 nt, Pseudomonas aeruginosa PA01
cgccgauuccuuggcccaggua

SEQ ID NO: 31128 - RNA, 22 nt, Pseudomonas aeruginosa PA01
cgccgcggccgccuugguuucc

SEQ ID NO: 31129 - RNA, 22 nt, Pseudomonas aeruginosa PA01
cgccggaccgcugccacaccua

SEQ ID NO: 31130 - RNA, 22 nt, Pseudomonas aeruginosa PA01
cgccggacuugaccggauuccg

SEQ ID NO: 31131 - RNA, 22 nt, Pseudomonas aeruginosa PA01
cgccggagaaaucguguuauga

SEQ ID NO: 31132 - RNA, 22 nt, Pseudomonas aeruginosa PA01
cgccggccgccgaggucgccaa

SEQ ID NO: 31133 - RNA, 20 nt, Pseudomonas aeruginosa PA01
cgccggcgucuacugcaugc

SEQ ID NO: 31134 - RNA, 22 nt, Pseudomonas aeruginosa PA01
cgccgggcuggauguguugcgg

SEQ ID NO: 31135 - RNA, 22 nt, Pseudomonas aeruginosa PA01
cgccggguuucgucaugucgcu

SEQ ID NO: 31136 - RNA, 22 nt, Pseudomonas aeruginosa PA01
cgccgugggcuccggaagggga

SEQ ID NO: 31137 - RNA, 22 nt, Pseudomonas aeruginosa PA01
cgccgugguggaagaggccgau

SEQ ID NO: 31138 - RNA, 22 nt, Pseudomonas aeruginosa PA01
cgccuggagccuucgcgcgacg

SEQ ID NO: 31139 - RNA, 22 nt, Pseudomonas aeruginosa PA01
cgcgaggugcgagccuucgccg

SEQ ID NO: 31140 - RNA, 22 nt, Pseudomonas aeruginosa PA01
cgcgaucaguuggcugcuggcc

SEQ ID NO: 31141 - RNA, 22 nt, Pseudomonas aeruginosa PA01
cgcgcacauaguggaagaaccc

SEQ ID NO: 31142 - RNA, 22 nt, Pseudomonas aeruginosa PA01
cgcgcagcgccaaggauggccu

SEQ ID NO: 31143 - RNA, 22 nt, Pseudomonas aeruginosa PA01
cgcgcaggucggcgaucccgua

SEQ ID NO: 31144 - RNA, 20 nt, Pseudomonas aeruginosa PA01
cgcgccuccagugcuccagg

SEQ ID NO: 31145 - RNA, 23 nt, Pseudomonas aeruginosa PA01
cgcgcuccagcaggucggccaug

SEQ ID NO: 31146 - RNA, 22 nt, Pseudomonas aeruginosa PA01
cgcgcucggaacccgguuuggc

SEQ ID NO: 31147 - RNA, 22 nt, Pseudomonas aeruginosa PA01
cgcgcuguuucugcccgccgga

SEQ ID NO: 31148 - RNA, 22 nt, Pseudomonas aeruginosa PA01
cgcggcacaagccuggaucacc

SEQ ID NO: 31149 - RNA, 22 nt, Pseudomonas aeruginosa PA01
cgcggccaucgaggcggcccgu

SEQ ID NO: 31150 - RNA, 19 nt, Pseudomonas aeruginosa PA01
cgcggccgggauccucggc

SEQ ID NO: 31151 - RNA, 22 nt, Pseudomonas aeruginosa PA01
cgcgggcacucauguuggccug

SEQ ID NO: 31152 - RNA, 22 nt, Pseudomonas aeruginosa PA01
cgcggggucuuuccaucgcugc

SEQ ID NO: 31153 - RNA, 22 nt, Pseudomonas aeruginosa PA01
cgcgguaucgucggcccgcucg

SEQ ID NO: 31154 - RNA, 21 nt, Pseudomonas aeruginosa PA01
cgcgguguagugcagguggug

SEQ ID NO: 31155 - RNA, 22 nt, Pseudomonas aeruginosa PA01
cgcucagcccggugccgaaaua

SEQ ID NO: 31156 - RNA, 22 nt, Pseudomonas aeruginosa PA01
cgcucgccuucgcggaguccgg

SEQ ID NO: 31157 - RNA, 22 nt, Pseudomonas aeruginosa PA01
cgcucggcggagaagccggccg

SEQ ID NO: 31158 - RNA, 22 nt, Pseudomonas aeruginosa PA01
cgcugagggccggccgauggaa

SEQ ID NO: 31159 - RNA, 22 nt, Pseudomonas aeruginosa PA01
cgcugcggauguucggcgaaug

SEQ ID NO: 31160 - RNA, 20 nt, Pseudomonas aeruginosa PA01
cgcugcuccgcugugggguc

SEQ ID NO: 31161 - RNA, 22 nt, Pseudomonas aeruginosa PA01
cgcuggcgcugacguuggcgau

SEQ ID NO: 31162 - RNA, 22 nt, Pseudomonas aeruginosa PA01
cgcuggucguaguauucgaagu

SEQ ID NO: 31163 - RNA, 22 nt, Pseudomonas aeruginosa PA01
cgcuucaacguguaauccccuu

SEQ ID NO: 31164 - RNA, 22 nt, Pseudomonas aeruginosa PA01
cgcuuggcauuggcauccaggc

SEQ ID NO: 31165 - RNA, 22 nt, Pseudomonas aeruginosa PA01
cgcuuggccacgucuuccucgg

SEQ ID NO: 31166 - RNA, 22 nt, Pseudomonas aeruginosa PA01
cgcuuucuaucgagcgaucgac

SEQ ID NO: 31167 - RNA, 22 nt, Pseudomonas aeruginosa PA01
cggaccagguuucuucccucca

SEQ ID NO: 31168 - RNA, 22 nt, Pseudomonas aeruginosa PA01
cggacugcugcggaugggcguc

SEQ ID NO: 31169 - RNA, 22 nt, Pseudomonas aeruginosa PA01
cggagguaggcgcgcugcgcug

SEQ ID NO: 31170 - RNA, 22 nt, Pseudomonas aeruginosa PA01
cggaucgccugcagaagccggu

SEQ ID NO: 31171 - RNA, 20 nt, Pseudomonas aeruginosa PA01
cggcaacugcugaccgccuu

SEQ ID NO: 31172 - RNA, 22 nt, Pseudomonas aeruginosa PA01
cggcaagggcggcaacaccuuc

SEQ ID NO: 31173 - RNA, 22 nt, Pseudomonas aeruginosa PA01
cggcaccgcugaagccggcgac

SEQ ID NO: 31174 - RNA, 21 nt, Pseudomonas aeruginosa PA01
cggcaucagggucaggucggc

SEQ ID NO: 31175 - RNA, 22 nt, Pseudomonas aeruginosa PA01
cggcauugcggcgguucagcga

SEQ ID NO: 31176 - RNA, 22 nt, Pseudomonas aeruginosa PA01
cggccagccaggcccgcaccag

SEQ ID NO: 31177 - RNA, 20 nt, Pseudomonas aeruginosa PA01
cggccagcgccugcugcucg

SEQ ID NO: 31178 - RNA, 22 nt, Pseudomonas aeruginosa PA01
cggccaguuuggaggccucggc

SEQ ID NO: 31179 - RNA, 22 nt, Pseudomonas aeruginosa PA01
cggccauggucucgcugaccca

SEQ ID NO: 31180 - RNA, 22 nt, Pseudomonas aeruginosa PA01
cggcccaaggucuaccuguucg

SEQ ID NO: 31181 - RNA, 22 nt, Pseudomonas aeruginosa PA01
cggccgcuggaggagucgccac

SEQ ID NO: 31182 - RNA, 22 nt, Pseudomonas aeruginosa PA01
cggccggccucgaucuccuugg

SEQ ID NO: 31183 - RNA, 22 nt, Pseudomonas aeruginosa PA01
cggccuccgucguuucgucgcc

SEQ ID NO: 31184 - RNA, 22 nt, Pseudomonas aeruginosa PA01
cggccucgacguugaacuugcg

SEQ ID NO: 31185 - RNA, 22 nt, Pseudomonas aeruginosa PA01
cggccucggccccaugagcgag

SEQ ID NO: 31186 - RNA, 22 nt, Pseudomonas aeruginosa PA01
cggccucuggcuggaccccagc

SEQ ID NO: 31187 - RNA, 22 nt, Pseudomonas aeruginosa PA01
cggcgaaaacaccagccuuuca

SEQ ID NO: 31188 - RNA, 22 nt, Pseudomonas aeruginosa PA01
cggcgaagacgaacagcgcgcc

SEQ ID NO: 31189 - RNA, 22 nt, Pseudomonas aeruginosa PA01
cggcgaccacguugggguucuc

SEQ ID NO: 31190 - RNA, 22 nt, Pseudomonas aeruginosa PA01
cggcgacgaucaucuucggcuu

SEQ ID NO: 31191 - RNA, 22 nt, Pseudomonas aeruginosa PA01
cggcgauuggccggccgucgac

SEQ ID NO: 31192 - RNA, 22 nt, Pseudomonas aeruginosa PA01
cggcgcaucgucgaaacgcugg

SEQ ID NO: 31193 - RNA, 22 nt, Pseudomonas aeruginosa PA01
cggcgccgacgagcuuaucuuc

SEQ ID NO: 31194 - RNA, 20 nt, Pseudomonas aeruginosa PA01
cggcgcgcuggcuaccggcc

SEQ ID NO: 31195 - RNA, 22 nt, Pseudomonas aeruginosa PA01
cggcgcuuucuucagcaccacc

SEQ ID NO: 31196 - RNA, 22 nt, Pseudomonas aeruginosa PA01
cggcggaugcaguuggccgccg

SEQ ID NO: 31197 - RNA, 22 nt, Pseudomonas aeruginosa PA01
cggcggcaucgcccauagcaac

SEQ ID NO: 31198 - RNA, 22 nt, Pseudomonas aeruginosa PA01
cggcggccuugccgcucugcuc

SEQ ID NO: 31199 - RNA, 22 nt, Pseudomonas aeruginosa PA01
cggcggcgaacugcaacgcgug

SEQ ID NO: 31200 - RNA, 22 nt, Pseudomonas aeruginosa PA01
cggcggcgaucagguugucgag

SEQ ID NO: 31201 - RNA, 22 nt, Pseudomonas aeruginosa PA01
cggcgggaaugauguugcgcuu

SEQ ID NO: 31202 - RNA, 19 nt, Pseudomonas aeruginosa PA01
cggcgggcggaucagcucg

SEQ ID NO: 31203 - RNA, 22 nt, Pseudomonas aeruginosa PA01
cggcggucucgaucuucagcuc

SEQ ID NO: 31204 - RNA, 22 nt, Pseudomonas aeruginosa PA01
cggcgguuguucauguagggcu

SEQ ID NO: 31205 - RNA, 22 nt, Pseudomonas aeruginosa PA01
cggcguccuggaucagcgccug

SEQ ID NO: 31206 - RNA, 22 nt, Pseudomonas aeruginosa PA01
cggcguccuggucccggugcuc

SEQ ID NO: 31207 - RNA, 22 nt, Pseudomonas aeruginosa PA01
cggcguugcugguggcccaggg

SEQ ID NO: 31208 - RNA, 22 nt, Pseudomonas aeruginosa PA01
cggcuacagcaaccaguggcgc

SEQ ID NO: 31209 - RNA, 22 nt, Pseudomonas aeruginosa PA01
cggcugaggccaguuguggaag

SEQ ID NO: 31210 - RNA, 22 nt, Pseudomonas aeruginosa PA01
cggcuguugcaguagacgccgc

SEQ ID NO: 31211 - RNA, 22 nt, Pseudomonas aeruginosa PA01
cggcuucuucgacuacgugcuc

SEQ ID NO: 31212 - RNA, 22 nt, Pseudomonas aeruginosa PA01
cgggaagacuucgaagguugcg

SEQ ID NO: 31213 - RNA, 22 nt, Pseudomonas aeruginosa PA01
cgggaucgagcaaauugccgca

SEQ ID NO: 31214 - RNA, 22 nt, Pseudomonas aeruginosa PA01
cgggccaagcacaugggguugu

SEQ ID NO: 31215 - RNA, 22 nt, Pseudomonas aeruginosa PA01
cgggccagagcggucgccuuuc

SEQ ID NO: 31216 - RNA, 22 nt, Pseudomonas aeruginosa PA01
cgggcgaggguaccgggagcua

SEQ ID NO: 31217 - RNA, 22 nt, Pseudomonas aeruginosa PA01
cgggcgcaucgcucucaguucc

SEQ ID NO: 31218 - RNA, 22 nt, Pseudomonas aeruginosa PA01
cgggcgccgcgagaacaggcug

SEQ ID NO: 31219 - RNA, 22 nt, Pseudomonas aeruginosa PA01
cgggcugacguaauggaugcug

SEQ ID NO: 31220 - RNA, 22 nt, Pseudomonas aeruginosa PA01
cggggccacgugccagcaggag

SEQ ID NO: 31221 - RNA, 22 nt, Pseudomonas aeruginosa PA01
cggggcuggucucgacccuguu

SEQ ID NO: 31222 - RNA, 22 nt, Pseudomonas aeruginosa PA01
cggggugcuguuccgcaucggc

SEQ ID NO: 31223 - RNA, 22 nt, Pseudomonas aeruginosa PA01
cggguacgagugcaguccgcug

SEQ ID NO: 31224 - RNA, 22 nt, Pseudomonas aeruginosa PA01
cggguaggccagcgguauccau

SEQ ID NO: 31225 - RNA, 21 nt, Pseudomonas aeruginosa PA01
cgggucgaugccaucggcccg

SEQ ID NO: 31226 - RNA, 22 nt, Pseudomonas aeruginosa PA01
cgggucggcagccugcucggca

SEQ ID NO: 31227 - RNA, 22 nt, Pseudomonas aeruginosa PA01
cgggugaucgucgcccgccgcc

SEQ ID NO: 31228 - RNA, 21 nt, Pseudomonas aeruginosa PA01
cgggugcauguuucagcgagg

SEQ ID NO: 31229 - RNA, 22 nt, Pseudomonas aeruginosa PA01
cgggugccauaggcugcgcaga

SEQ ID NO: 31230 - RNA, 22 nt, Pseudomonas aeruginosa PA01
cggguugugcuggagcugcugu

SEQ ID NO: 31231 - RNA, 22 nt, Pseudomonas aeruginosa PA01
cgguagcagaccaggucgauga

SEQ ID NO: 31232 - RNA, 23 nt, Pseudomonas aeruginosa PA01
cggucgaagaugaucaggcgaac

SEQ ID NO: 31233 - RNA, 22 nt, Pseudomonas aeruginosa PA01
cggucgaggagcagcccggcac

SEQ ID NO: 31234 - RNA, 22 nt, Pseudomonas aeruginosa PA01
cggucgcaguagaagcaguagu

SEQ ID NO: 31235 - RNA, 22 nt, Pseudomonas aeruginosa PA01
cggucgguacgcucuggcgcug

SEQ ID NO: 31236 - RNA, 22 nt, Pseudomonas aeruginosa PA01
cggucggugaccacgccgguca

SEQ ID NO: 31237 - RNA, 22 nt, Pseudomonas aeruginosa PA01
cggugaagaagcugaucgcaga

SEQ ID NO: 31238 - RNA, 23 nt, Pseudomonas aeruginosa PA01
cggugagcaccgcguugccggcg

SEQ ID NO: 31239 - RNA, 21 nt, Pseudomonas aeruginosa PA01
cggugaucgacgccuaccacc

SEQ ID NO: 31240 - RNA, 22 nt, Pseudomonas aeruginosa PA01
cggugcgccugccguuccugau

SEQ ID NO: 31241 - RNA, 22 nt, Pseudomonas aeruginosa PA01
cggugcggaugaaauuguccgg

SEQ ID NO: 31242 - RNA, 22 nt, Pseudomonas aeruginosa PA01
cggugcuggagaugaacuucga

SEQ ID NO: 31243 - RNA, 22 nt, Pseudomonas aeruginosa PA01
cgguggucgauucgcugaacau

SEQ ID NO: 31244 - RNA, 22 nt, Pseudomonas aeruginosa PA01
cgguuggccgagaugcugcugg

SEQ ID NO: 31245 - RNA, 22 nt, Pseudomonas aeruginosa PA01
cgguuguccaguugcucgcggg

SEQ ID NO: 31246 - RNA, 23 nt, Pseudomonas aeruginosa PA01
cgguuuccagauucccagccaua

SEQ ID NO: 31247 - RNA, 22 nt, Pseudomonas aeruginosa PA01
cguaacgcuggaucaguugcuc

SEQ ID NO: 31248 - RNA, 22 nt, Pseudomonas aeruginosa PA01
cguaggaaaccuggaucucgca

SEQ ID NO: 31249 - RNA, 22 nt, Pseudomonas aeruginosa PA01
cguccaggccggccuguggcgc

SEQ ID NO: 31250 - RNA, 22 nt, Pseudomonas aeruginosa PA01
cgucgagaucguccuuguccca

SEQ ID NO: 31251 - RNA, 22 nt, Pseudomonas aeruginosa PA01
cgucgcgcucgcccgauaccac

SEQ ID NO: 31252 - RNA, 22 nt, Pseudomonas aeruginosa PA01
cgucggccaggaggugguacgc

SEQ ID NO: 31253 - RNA, 22 nt, Pseudomonas aeruginosa PA01
cgucggccuguggaucgccgcc

SEQ ID NO: 31254 - RNA, 22 nt, Pseudomonas aeruginosa PA01
cgucgggcugcgcucaccugga

SEQ ID NO: 31255 - RNA, 22 nt, Pseudomonas aeruginosa PA01
cgucgguaucgcccuggcgacc

SEQ ID NO: 31256 - RNA, 22 nt, Pseudomonas aeruginosa PA01
cgucguggucggcaccgagcuu

SEQ ID NO: 31257 - RNA, 22 nt, Pseudomonas aeruginosa PA01
cgucuggaaagcgucgacgcgc

SEQ ID NO: 31258 - RNA, 22 nt, Pseudomonas aeruginosa PA01
cgugaucggcgcgcugauggcg

SEQ ID NO: 31259 - RNA, 22 nt, Pseudomonas aeruginosa PA01
cgugcaggacuccaccgacgag

SEQ ID NO: 31260 - RNA, 22 nt, Pseudomonas aeruginosa PA01
cgugcagggcggcgauguccug

SEQ ID NO: 31261 - RNA, 21 nt, Pseudomonas aeruginosa PA01
cgugccguucaaggaagaggc

SEQ ID NO: 31262 - RNA, 22 nt, Pseudomonas aeruginosa PA01
cguggaguggaucagguacgcc

SEQ ID NO: 31263 - RNA, 22 nt, Pseudomonas aeruginosa PA01
cgugggccuggauggcgaaggg

SEQ ID NO: 31264 - RNA, 22 nt, Pseudomonas aeruginosa PA01
cguggucgagggugucgacuau

SEQ ID NO: 31265 - RNA, 22 nt, Pseudomonas aeruginosa PA01
cguggugauccaggugccgucg

SEQ ID NO: 31266 - RNA, 22 nt, Pseudomonas aeruginosa PA01
cguguucaccgauugccgcgac

SEQ ID NO: 31267 - RNA, 22 nt, Pseudomonas aeruginosa PA01
cguucgccucgaccuggcggaa

SEQ ID NO: 31268 - RNA, 22 nt, Pseudomonas aeruginosa PA01
cguugcacggucuuugcggggu

SEQ ID NO: 31269 - RNA, 22 nt, Pseudomonas aeruginosa PA01
cguugcgcgcgaccauggcgaa

SEQ ID NO: 31270 - RNA, 22 nt, Pseudomonas aeruginosa PA01
cuaccgccugcgccaggcaggc

SEQ ID NO: 31271 - RNA, 22 nt, Pseudomonas aeruginosa PA01
cuacgccauggcccucgaggag

SEQ ID NO: 31272 - RNA, 22 nt, Pseudomonas aeruginosa PA01
cuacgucggcuucuacgcggua

SEQ ID NO: 31273 - RNA, 22 nt, Pseudomonas aeruginosa PA01
cuccaggcgcuggcggaggaaa

SEQ ID NO: 31274 - RNA, 22 nt, Pseudomonas aeruginosa PA01
cuccaguucggugcggguuugg

SEQ ID NO: 31275 - RNA, 22 nt, Pseudomonas aeruginosa PA01
cuccggcgaacucaggugcgcc

SEQ ID NO: 31276 - RNA, 19 nt, Pseudomonas aeruginosa PA01
cuccuccuggggcgugguc

SEQ ID NO: 31277 - RNA, 22 nt, Pseudomonas aeruginosa PA01
cuccugggagagaauccguaaa

SEQ ID NO: 31278 - RNA, 22 nt, Pseudomonas aeruginosa PA01
cuccugggucucccuggucacc

SEQ ID NO: 31279 - RNA, 22 nt, Pseudomonas aeruginosa PA01
cuccuuggaacuauggguauug

SEQ ID NO: 31280 - RNA, 22 nt, Pseudomonas aeruginosa PA01
cucgaccgucuccagcaacggc

SEQ ID NO: 31281 - RNA, 22 nt, Pseudomonas aeruginosa PA01
cucgauguacaggcugcgggug

SEQ ID NO: 31282 - RNA, 22 nt, Pseudomonas aeruginosa PA01
cucgcagcgccaggcacuguug

SEQ ID NO: 31283 - RNA, 22 nt, Pseudomonas aeruginosa PA01
cucgcggaggaauucgggguug

SEQ ID NO: 31284 - RNA, 22 nt, Pseudomonas aeruginosa PA01
cucgcugaccagcuugcuguug

SEQ ID NO: 31285 - RNA, 22 nt, Pseudomonas aeruginosa PA01
cucggcagcaagcuguucgaac

SEQ ID NO: 31286 - RNA, 22 nt, Pseudomonas aeruginosa PA01
cucggcuggacccucuggcagc

SEQ ID NO: 31287 - RNA, 22 nt, Pseudomonas aeruginosa PA01
cucgggauaggugguccaggug

SEQ ID NO: 31288 - RNA, 22 nt, Pseudomonas aeruginosa PA01
cucgucggcaaagggaucggaa

SEQ ID NO: 31289 - RNA, 22 nt, Pseudomonas aeruginosa PA01
cucugcgccugcagcgcggcau

SEQ ID NO: 31290 - RNA, 22 nt, Pseudomonas aeruginosa PA01
cucugguaucgccgccugggcc

SEQ ID NO: 31291 - RNA, 21 nt, Pseudomonas aeruginosa PA01
cugaccaugcgcaccaucucc

SEQ ID NO: 31292 - RNA, 21 nt, Pseudomonas aeruginosa PA01
cugaccggccgggucggcggc

SEQ ID NO: 31293 - RNA, 22 nt, Pseudomonas aeruginosa PA01
cugaccgucgucggggucaacc

SEQ ID NO: 31294 - RNA, 22 nt, Pseudomonas aeruginosa PA01
cugaccucgcaacugccgcccg

SEQ ID NO: 31295 - RNA, 22 nt, Pseudomonas aeruginosa PA01
cugacgaacacgauggucuugu

SEQ ID NO: 31296 - RNA, 22 nt, Pseudomonas aeruginosa PA01
cugacgcuguacagcaggcgcu

SEQ ID NO: 31297 - RNA, 22 nt, Pseudomonas aeruginosa PA01
cugagccucggcggcagccgca

SEQ ID NO: 31298 - RNA, 22 nt, Pseudomonas aeruginosa PA01
cugaggacgcugagcaggcccu

SEQ ID NO: 31299 - RNA, 22 nt, Pseudomonas aeruginosa PA01
cugaggcgagaaugaaaaaggc

SEQ ID NO: 31300 - RNA, 22 nt, Pseudomonas aeruginosa PA01
cugcaacggcgcgccguccugg

SEQ ID NO: 31301 - RNA, 20 nt, Pseudomonas aeruginosa PA01
cugcagcagaacgguggcgc

SEQ ID NO: 31302 - RNA, 22 nt, Pseudomonas aeruginosa PA01
cugcaucggcucgucauucgcc

SEQ ID NO: 31303 - RNA, 22 nt, Pseudomonas aeruginosa PA01
cugcccucggcacaggggcugc

SEQ ID NO: 31304 - RNA, 22 nt, Pseudomonas aeruginosa PA01
cugccgggccagcgaccgguug

SEQ ID NO: 31305 - RNA, 22 nt, Pseudomonas aeruginosa PA01
cugccggugucucggcguccgu

SEQ ID NO: 31306 - RNA, 22 nt, Pseudomonas aeruginosa PA01
cugcgccgaggcucaggcgcca

SEQ ID NO: 31307 - RNA, 22 nt, Pseudomonas aeruginosa PA01
cugcgccugcgccgcgaacugg

SEQ ID NO: 31308 - RNA, 22 nt, Pseudomonas aeruginosa PA01
cugcgcgccguaggccagcucg

SEQ ID NO: 31309 - RNA, 22 nt, Pseudomonas aeruginosa PA01
cugcggagacugucaggcucau

SEQ ID NO: 31310 - RNA, 22 nt, Pseudomonas aeruginosa PA01
cugcggauuggaagaugucugg

SEQ ID NO: 31311 - RNA, 22 nt, Pseudomonas aeruginosa PA01
cugcggcuggugcaccagcgcg

SEQ ID NO: 31312 - RNA, 22 nt, Pseudomonas aeruginosa PA01
cugcguuucguaaagcaagccc

SEQ ID NO: 31313 - RNA, 22 nt, Pseudomonas aeruginosa PA01
cugcucgaccaucaugagcgug

SEQ ID NO: 31314 - RNA, 22 nt, Pseudomonas aeruginosa PA01
cugcuggagcgcggcgagacca

SEQ ID NO: 31315 - RNA, 22 nt, Pseudomonas aeruginosa PA01
cugcugggacgaaugggaguuc

SEQ ID NO: 31316 - RNA, 22 nt, Pseudomonas aeruginosa PA01
cugcugucgcggauccugcgca

SEQ ID NO: 31317 - RNA, 22 nt, Pseudomonas aeruginosa PA01
cugcugugcguggagggggucg

SEQ ID NO: 31318 - RNA, 22 nt, Pseudomonas aeruginosa PA01
cugcuguugcgcgaggacgugc

SEQ ID NO: 31319 - RNA, 22 nt, Pseudomonas aeruginosa PA01
cuggaagaaauugucgcugacg

SEQ ID NO: 31320 - RNA, 22 nt, Pseudomonas aeruginosa PA01
cuggaaggcgagcaucuucaug

SEQ ID NO: 31321 - RNA, 22 nt, Pseudomonas aeruginosa PA01
cuggacagcaggcggcgggcga

SEQ ID NO: 31322 - RNA, 22 nt, Pseudomonas aeruginosa PA01
cuggaccgacggcccguucggc

SEQ ID NO: 31323 - RNA, 22 nt, Pseudomonas aeruginosa PA01
cuggaucugcuccuggucgauc

SEQ ID NO: 31324 - RNA, 22 nt, Pseudomonas aeruginosa PA01
cuggauuuuuugccggaaagcc

SEQ ID NO: 31325 - RNA, 22 nt, Pseudomonas aeruginosa PA01
cuggccgaccucaacgccgccc

SEQ ID NO: 31326 - RNA, 22 nt, Pseudomonas aeruginosa PA01
cuggccuuccagcgugccgccu

SEQ ID NO: 31327 - RNA, 22 nt, Pseudomonas aeruginosa PA01
cuggcugguguuggcggcgcgc

SEQ ID NO: 31328 - RNA, 22 nt, Pseudomonas aeruginosa PA01
cugggaaacgucgccucgaccu

SEQ ID NO: 31329 - RNA, 22 nt, Pseudomonas aeruginosa PA01
cugggcguagcuccgacuggcc

SEQ ID NO: 31330 - RNA, 22 nt, Pseudomonas aeruginosa PA01
cuggggcaguucgaucagcgcg

SEQ ID NO: 31331 - RNA, 19 nt, Pseudomonas aeruginosa PA01
cugguaugaugcgcgccuu

SEQ ID NO: 31332 - RNA, 22 nt, Pseudomonas aeruginosa PA01
cuggucaccgggccccugggca

SEQ ID NO: 31333 - RNA, 22 nt, Pseudomonas aeruginosa PA01
cuggugaacaucgucucggccg

SEQ ID NO: 31334 - RNA, 22 nt, Pseudomonas aeruginosa PA01
cugguggcgcggcugcaggagu

SEQ ID NO: 31335 - RNA, 22 nt, Pseudomonas aeruginosa PA01
cugguggucggcgacaucgugc

SEQ ID NO: 31336 - RNA, 22 nt, Pseudomonas aeruginosa PA01
cugguggugcucggucgcgaca

SEQ ID NO: 31337 - RNA, 22 nt, Pseudomonas aeruginosa PA01
cugguuguaguuggcggaaccg

SEQ ID NO: 31338 - RNA, 22 nt, Pseudomonas aeruginosa PA01
cugucuaucugcguaacguuac

SEQ ID NO: 31339 - RNA, 22 nt, Pseudomonas aeruginosa PA01
cugugacagggggugaggcuua

SEQ ID NO: 31340 - RNA, 22 nt, Pseudomonas aeruginosa PA01
cugugccuguuccagggcgugc

SEQ ID NO: 31341 - RNA, 19 nt, Pseudomonas aeruginosa PA01
cuguucgaucugcugaagc

SEQ ID NO: 31342 - RNA, 22 nt, Pseudomonas aeruginosa PA01
cuucaacggcaucgaugccagc

SEQ ID NO: 31343 - RNA, 22 nt, Pseudomonas aeruginosa PA01
ucccgaccuucaugcgccugcc

SEQ ID NO: 31344 - RNA, 22 nt, Pseudomonas aeruginosa PA01
ucccgcugaccgucugcccgcu

SEQ ID NO: 31345 - RNA, 22 nt, Pseudomonas aeruginosa PA01
uccgccacuuccugcucaugag

SEQ ID NO: 31346 - RNA, 22 nt, Pseudomonas aeruginosa PA01
uccgccgccuucuccacguaga

SEQ ID NO: 31347 - RNA, 22 nt, Pseudomonas aeruginosa PA01
uccgcgccuucagcucgcccug

SEQ ID NO: 31348 - RNA, 22 nt, Pseudomonas aeruginosa PA01
uccgcuggucgaucuccagcga

SEQ ID NO: 31349 - RNA, 22 nt, Pseudomonas aeruginosa PA01
uccggccaaccgcugccggagg

SEQ ID NO: 31350 - RNA, 22 nt, Pseudomonas aeruginosa PA01
uccggcccggcucuggaaccgu

SEQ ID NO: 31351 - RNA, 22 nt, Pseudomonas aeruginosa PA01
uccggcucgacgccggcgaggu

SEQ ID NO: 31352 - RNA, 22 nt, Pseudomonas aeruginosa PA01
uccgggccguugcggaacaccg

SEQ ID NO: 31353 - RNA, 22 nt, Pseudomonas aeruginosa PA01
uccgggugcuuguugcgcaugu

SEQ ID NO: 31354 - RNA, 22 nt, Pseudomonas aeruginosa PA01
uccgugccaugcaguugcugcg

SEQ ID NO: 31355 - RNA, 22 nt, Pseudomonas aeruginosa PA01
uccucgacggcuggagcguggc

SEQ ID NO: 31356 - RNA, 22 nt, Pseudomonas aeruginosa PA01
uccucgcugucggccaaggaca

SEQ ID NO: 31357 - RNA, 22 nt, Pseudomonas aeruginosa PA01
uccucgucgaaaaaggcgugga

SEQ ID NO: 31358 - RNA, 22 nt, Pseudomonas aeruginosa PA01
uccucucggcccuuggcggguu

SEQ ID NO: 31359 - RNA, 22 nt, Pseudomonas aeruginosa PA01
uccucugucgguucgcauaggu

SEQ ID NO: 31360 - RNA, 22 nt, Pseudomonas aeruginosa PA01
uccugcucgaucacggccuggu

SEQ ID NO: 31361 - RNA, 22 nt, Pseudomonas aeruginosa PA01
uccuugagguugaucguccagu

SEQ ID NO: 31362 - RNA, 22 nt, Pseudomonas aeruginosa PA01
ucgaacugaagcgugucgcucu

SEQ ID NO: 31363 - RNA, 22 nt, Pseudomonas aeruginosa PA01
ucgaaggccgaggccucgaccu

SEQ ID NO: 31364 - RNA, 22 nt, Pseudomonas aeruginosa PA01
ucgaccacgccgccgaucucgu

SEQ ID NO: 31365 - RNA, 22 nt, Pseudomonas aeruginosa PA01
ucgacccguucguacgcuaccc

SEQ ID NO: 31366 - RNA, 22 nt, Pseudomonas aeruginosa PA01
ucgacgaagcgccgcuggccgg

SEQ ID NO: 31367 - RNA, 22 nt, Pseudomonas aeruginosa PA01
ucgacgagaagcucgacgccgc

SEQ ID NO: 31368 - RNA, 22 nt, Pseudomonas aeruginosa PA01
ucgacgcccaggggcugcugaa

SEQ ID NO: 31369 - RNA, 22 nt, Pseudomonas aeruginosa PA01
ucugaugggacugcguccgagc

SEQ ID NO: 31370 - RNA, 22 nt, Pseudomonas aeruginosa PA01
ucugcaccgccuguacgcccgc

SEQ ID NO: 31371 - RNA, 22 nt, Pseudomonas aeruginosa PA01
ucugccugcuuggcaugaacga

SEQ ID NO: 31372 - RNA, 22 nt, Pseudomonas aeruginosa PA01
ucugcgccagcaucgccagggc

SEQ ID NO: 31373 - RNA, 22 nt, Pseudomonas aeruginosa PA01
ucugcgccucgacgaugcgauc

SEQ ID NO: 31374 - RNA, 22 nt, Pseudomonas aeruginosa PA01
ucugcgcgacagcgucggcgaa

SEQ ID NO: 31375 - RNA, 23 nt, Pseudomonas aeruginosa PA01
ucugcggcagcaggucgacgccg

SEQ ID NO: 31376 - RNA, 22 nt, Pseudomonas aeruginosa PA01
ucugcgucucggugcugucgcu

SEQ ID NO: 31377 - RNA, 23 nt, Pseudomonas aeruginosa PA01
ucugcucgccgcgaccggcgacc

SEQ ID NO: 31378 - RNA, 22 nt, Pseudomonas aeruginosa PA01
ucuggcacucgccggccuugag

SEQ ID NO: 31379 - RNA, 22 nt, Pseudomonas aeruginosa PA01
ucuggcucgccaccggccgggu

SEQ ID NO: 31380 - RNA, 21 nt, Pseudomonas aeruginosa PA01
ucuggguggcggggaagcgcu

SEQ ID NO: 31381 - RNA, 22 nt, Pseudomonas aeruginosa PA01
ucuggucgcuggcgcugguagu

SEQ ID NO: 31382 - RNA, 22 nt, Pseudomonas aeruginosa PA01
ucuggucggcacgcuggaucga

SEQ ID NO: 31383 - RNA, 22 nt, Pseudomonas aeruginosa PA01
ucuucgacuaccugccgcaaga

SEQ ID NO: 31384 - RNA, 22 nt, Pseudomonas aeruginosa PA01
ucuucggcgggccuuuuucaug

SEQ ID NO: 31385 - RNA, 22 nt, Pseudomonas aeruginosa PA01
ucuugcgcgaccuugccgcucg

SEQ ID NO: 31386 - RNA, 22 nt, Pseudomonas aeruginosa PA01
ugaaacugccguucgacaaggu

SEQ ID NO: 31387 - RNA, 22 nt, Pseudomonas aeruginosa PA01
ugaccagguugugcccguccag

SEQ ID NO: 31388 - RNA, 22 nt, Pseudomonas aeruginosa PA01
ugacccaggcaccgauccgcgu

SEQ ID NO: 31389 - RNA, 22 nt, Pseudomonas aeruginosa PA01
ugaccugccagccggugaugaa

SEQ ID NO: 31390 - RNA, 22 nt, Pseudomonas aeruginosa PA01
ugacggccagggccuggagacu

SEQ ID NO: 31391 - RNA, 22 nt, Pseudomonas aeruginosa PA01
ugacugaaggcggcauauucga

SEQ ID NO: 31392 - RNA, 19 nt, Pseudomonas aeruginosa PA01
ugagcagccccaggacgau

SEQ ID NO: 31393 - RNA, 22 nt, Pseudomonas aeruginosa PA01
ugagcaggaccacgucgcucgg

SEQ ID NO: 31394 - RNA, 22 nt, Pseudomonas aeruginosa PA01
ugaggucgaugcguggggugcu

SEQ ID NO: 31395 - RNA, 22 nt, Pseudomonas aeruginosa PA01
ugauccaguucaguccggccac

SEQ ID NO: 31396 - RNA, 22 nt, Pseudomonas aeruginosa PA01
ugauccgcggcaggcgcugcag

SEQ ID NO: 31397 - RNA, 22 nt, Pseudomonas aeruginosa PA01
ugauccugcucggcauggccau

SEQ ID NO: 31398 - RNA, 22 nt, Pseudomonas aeruginosa PA01
ugaugccgacgucgaugacgau

SEQ ID NO: 31399 - RNA, 22 nt, Pseudomonas aeruginosa PA01
ugaugcggguuccgguagggga

SEQ ID NO: 31400 - RNA, 22 nt, Pseudomonas aeruginosa PA01
ugaugcugaucuuguucggcac

SEQ ID NO: 31401 - RNA, 22 nt, Pseudomonas aeruginosa PA01
ugaugcuggucggcggggugcu

SEQ ID NO: 31402 - RNA, 22 nt, Pseudomonas aeruginosa PA01
ugauucgccguucgaccuggaa

SEQ ID NO: 31403 - RNA, 22 nt, Pseudomonas aeruginosa PA01
ugcaccagcgccugcgcgagga

SEQ ID NO: 31404 - RNA, 22 nt, Pseudomonas aeruginosa PA01
ugcacgccgaugcgcuugccgg

SEQ ID NO: 31405 - RNA, 22 nt, Pseudomonas aeruginosa PA01
ugcacgcggaacuucaggccgc

SEQ ID NO: 31406 - RNA, 21 nt, Pseudomonas aeruginosa PA01
ugcacggcgcugguuucggcg

SEQ ID NO: 31407 - RNA, 22 nt, Pseudomonas aeruginosa PA01
ugcacgguagccaucgguuucu

SEQ ID NO: 31408 - RNA, 22 nt, Pseudomonas aeruginosa PA01
ugcagcgaggugaucgucgccg

SEQ ID NO: 31409 - RNA, 19 nt, Pseudomonas aeruginosa PA01
ugcagcggcgggugguggc

SEQ ID NO: 31410 - RNA, 22 nt, Pseudomonas aeruginosa PA01
ugcagcggucuucgucgauggu

SEQ ID NO: 31411 - RNA, 22 nt, Pseudomonas aeruginosa PA01
ugcagggccuguucgcuggcga

SEQ ID NO: 31412 - RNA, 22 nt, Pseudomonas aeruginosa PA01
ugccauagccguugcagggcuu

SEQ ID NO: 31413 - RNA, 22 nt, Pseudomonas aeruginosa PA01
ugccaucgaucaggcgcaucgc

SEQ ID NO: 31414 - RNA, 20 nt, Pseudomonas aeruginosa PA01
ugccccuggauaaauggagc

SEQ ID NO: 31415 - RNA, 22 nt, Pseudomonas aeruginosa PA01
ugcccgggcccuguacgaaagc

SEQ ID NO: 31416 - RNA, 20 nt, Pseudomonas aeruginosa PA01
ugccgaaguggugguucaug

SEQ ID NO: 31417 - RNA, 22 nt, Pseudomonas aeruginosa PA01
ugccgaaucgccgugcaucgcc

SEQ ID NO: 31418 - RNA, 22 nt, Pseudomonas aeruginosa PA01
ugccgaccaucguggugguggu

SEQ ID NO: 31419 - RNA, 22 nt, Pseudomonas aeruginosa PA01
ugccgaugaacaggucgcgcag

SEQ ID NO: 31420 - RNA, 22 nt, Pseudomonas aeruginosa PA01
ugccgauggcgccgccgagguu

SEQ ID NO: 31421 - RNA, 22 nt, Pseudomonas aeruginosa PA01
ugccgccagcaggccggugacc

SEQ ID NO: 31422 - RNA, 22 nt, Pseudomonas aeruginosa PA01
ugccgccggacggucagccgau

SEQ ID NO: 31423 - RNA, 22 nt, Pseudomonas aeruginosa PA01
ugccgcgcgggguaucgaggaa

SEQ ID NO: 31424 - RNA, 22 nt, Pseudomonas aeruginosa PA01
ugccgcucggucugcaacgcau

SEQ ID NO: 31425 - RNA, 22 nt, Pseudomonas aeruginosa PA01
ugccggccauggccuccacguc

SEQ ID NO: 31426 - RNA, 22 nt, Pseudomonas aeruginosa PA01
ugccggccugacugucugccgg

SEQ ID NO: 31427 - RNA, 22 nt, Pseudomonas aeruginosa PA01
ugccggcgaggucggccaugac

SEQ ID NO: 31428 - RNA, 20 nt, Pseudomonas aeruginosa PA01
gccggguccgcaggaacgcc

SEQ ID NO: 31429 - RNA, 22 nt, Pseudomonas aeruginosa PA01
gccgggugccagcgaggucuuc

SEQ ID NO: 31430 - RNA, 22 nt, Pseudomonas aeruginosa PA01
gccgguaauguagacgccaccg

SEQ ID NO: 31431 - RNA, 22 nt, Pseudomonas aeruginosa PA01
gccggucggcacaucguugacg

SEQ ID NO: 31432 - RNA, 22 nt, Pseudomonas aeruginosa PA01
gccggugaagcugcaauggacc

SEQ ID NO: 31433 - RNA, 22 nt, Pseudomonas aeruginosa PA01
gccgguuuccacuccgcgcgcc

SEQ ID NO: 31434 - RNA, 22 nt, Pseudomonas aeruginosa PA01
gccguccagcucaucuucucgg

SEQ ID NO: 31435 - RNA, 22 nt, Pseudomonas aeruginosa PA01
gccgucgcggccgacgacaaag

SEQ ID NO: 31436 - RNA, 22 nt, Pseudomonas aeruginosa PA01
gccguggaagcucgccacgccg

SEQ ID NO: 31437 - RNA, 22 nt, Pseudomonas aeruginosa PA01
gccguguagcgagccgaugguu

SEQ ID NO: 31438 - RNA, 22 nt, Pseudomonas aeruginosa PA01
gccuaugugaagaccggccgca

SEQ ID NO: 31439 - RNA, 22 nt, Pseudomonas aeruginosa PA01
gccucgacguacucgcggagau

SEQ ID NO: 31440 - RNA, 22 nt, Pseudomonas aeruginosa PA01
gccucgauguaguuguucaggu

SEQ ID NO: 31441 - RNA, 22 nt, Pseudomonas aeruginosa PA01
gccucgcugucgauggccgggu

SEQ ID NO: 31442 - RNA, 22 nt, Pseudomonas aeruginosa PA01
gccugcaacacgugccgcugag

SEQ ID NO: 31443 - RNA, 22 nt, Pseudomonas aeruginosa PA01
gccuggcgggccaguucggcgc

SEQ ID NO: 31444 - RNA, 22 nt, Pseudomonas aeruginosa PA01
gccugggcugcaccaccagcgg

SEQ ID NO: 31445 - RNA, 22 nt, Pseudomonas aeruginosa PA01
gccuggugaguaccggcgacag

SEQ ID NO: 31446 - RNA, 22 nt, Pseudomonas aeruginosa PA01
gccugguggaagacggccaggc

SEQ ID NO: 31447 - RNA, 22 nt, Pseudomonas aeruginosa PA01
gccuguucuggagccgccggcg

SEQ ID NO: 31448 - RNA, 22 nt, Pseudomonas aeruginosa PA01
gccuucaggcccuggcggaaua

SEQ ID NO: 31449 - RNA, 22 nt, Pseudomonas aeruginosa PA01
gcgaacagcagaugcucgccau

SEQ ID NO: 31450 - RNA, 20 nt, Pseudomonas aeruginosa PA01
gcgaaccugccggcugucga

SEQ ID NO: 31451 - RNA, 22 nt, Pseudomonas aeruginosa PA01
gcgaaccuggaucucguccucg

SEQ ID NO: 31452 - RNA, 22 nt, Pseudomonas aeruginosa PA01
gcgacggagucaacgacguacc

SEQ ID NO: 31453 - RNA, 22 nt, Pseudomonas aeruginosa PA01
gcgacugaguacccguugcgga

SEQ ID NO: 31454 - RNA, 22 nt, Pseudomonas aeruginosa PA01
gcgaggaccugccgggcgcucu

SEQ ID NO: 31455 - RNA, 22 nt, Pseudomonas aeruginosa PA01
gcgagguugccgcacggcaggg

SEQ ID NO: 31456 - RNA, 22 nt, Pseudomonas aeruginosa PA01
gcgcaaccacgugcuucucggc

SEQ ID NO: 31457 - RNA, 22 nt, Pseudomonas aeruginosa PA01
ggucgugcuggugggcggcaag

SEQ ID NO: 31458 - RNA, 22 nt, Pseudomonas aeruginosa PA01
ggucguggaucagcugggcgaa

SEQ ID NO: 31459 - RNA, 22 nt, Pseudomonas aeruginosa PA01
ggugaaugcuucgcggaugcgg

SEQ ID NO: 31460 - RNA, 22 nt, Pseudomonas aeruginosa PA01
ggugaucaugguggcgccgaga

SEQ ID NO: 31461 - RNA, 22 nt, Pseudomonas aeruginosa PA01
ggugauccaggcuugugccgcg

SEQ ID NO: 31462 - RNA, 22 nt, Pseudomonas aeruginosa PA01
ggugccgacaucagcgucgcca

SEQ ID NO: 31463 - RNA, 22 nt, Pseudomonas aeruginosa PA01
ggugccgaggaucgacagcccg

SEQ ID NO: 31464 - RNA, 22 nt, Pseudomonas aeruginosa PA01
ggugcugaucggcuucuacggc

SEQ ID NO: 31465 - RNA, 22 nt, Pseudomonas aeruginosa PA01
ggugcugguggcggcgauccug

SEQ ID NO: 31466 - RNA, 22 nt, Pseudomonas aeruginosa PA01
gguggaagacucggggcagggu

SEQ ID NO: 31467 - RNA, 22 nt, Pseudomonas aeruginosa PA01
gguggcgcuggcuuccuugacc

SEQ ID NO: 31468 - RNA, 22 nt, Pseudomonas aeruginosa PA01
ggugggguucuccggcacgcug

SEQ ID NO: 31469 - RNA, 22 nt, Pseudomonas aeruginosa PA01
gguggucaucaguacuggccgc

SEQ ID NO: 31470 - RNA, 21 nt, Pseudomonas aeruginosa PA01
gguucccgagcaguugcugcg

SEQ ID NO: 31471 - RNA, 22 nt, Pseudomonas aeruginosa PA01
gguucggagugccgccggugag

SEQ ID NO: 31472 - RNA, 22 nt, Pseudomonas aeruginosa PA01
gguugcgcuuguccuggcgcga

SEQ ID NO: 31473 - RNA, 22 nt, Pseudomonas aeruginosa PA01
gguugguggcggugugcgccgg

SEQ ID NO: 31474 - RNA, 22 nt, Pseudomonas aeruginosa PA01
gguugucaucgacgcuacucca

SEQ ID NO: 31475 - RNA, 22 nt, Pseudomonas aeruginosa PA01
gguuucccgcgacagcgcgccg

SEQ ID NO: 31476 - RNA, 22 nt, Pseudomonas aeruginosa PA01
gguuucucuggcucggcagauc

SEQ ID NO: 31477 - RNA, 22 nt, Pseudomonas aeruginosa PA01
guaacguuacgcagauagaggc

SEQ ID NO: 31478 - RNA, 22 nt, Pseudomonas aeruginosa PA01
guacccuggccuguccggccag

SEQ ID NO: 31479 - RNA, 22 nt, Pseudomonas aeruginosa PA01
guacucacccuugguguggccc

SEQ ID NO: 31480 - RNA, 22 nt, Pseudomonas aeruginosa PA01
guagcccuggccgagguccggg

SEQ ID NO: 31481 - RNA, 22 nt, Pseudomonas aeruginosa PA01
guagcguuccgggcagcggcgc

SEQ ID NO: 31482 - RNA, 22 nt, Pseudomonas aeruginosa PA01
guaggccuggaagcuggccauc

SEQ ID NO: 31483 - RNA, 22 nt, Pseudomonas aeruginosa PA01
guagggcagcagcccguacagc

SEQ ID NO: 31484 - RNA, 22 nt, Pseudomonas aeruginosa PA01
guauugccgaacgagcuggcca

SEQ ID NO: 31485 - RNA, 22 nt, Pseudomonas aeruginosa PA01
guauugcggauccgccgguagg

SEQ ID NO: 31486 - RNA, 22 nt, Pseudomonas aeruginosa PA01
gucagccucugguccgaggugg

SEQ ID NO: 31487 - RNA, 22 nt, Pseudomonas aeruginosa PA01
gucaggaacggaugcacgcgcc

SEQ ID NO: 31488 - RNA, 22 nt, Pseudomonas aeruginosa PA01
gucaggguguugcggcugucgg

SEQ ID NO: 31489 - RNA, 17 nt, Pseudomonas aeruginosa PA01
gucagguacggauaacu

SEQ ID NO: 31490 - RNA, 22 nt, Pseudomonas aeruginosa PA01
gucaucacccagcaccauaucg

SEQ ID NO: 31491 - RNA, 22 nt, Pseudomonas aeruginosa PA01
guccacgacgcaaagcgauggu

SEQ ID NO: 31492 - RNA, 22 nt, Pseudomonas aeruginosa PA01
guccagccauucgcgguagacc

SEQ ID NO: 31493 - RNA, 22 nt, Pseudomonas aeruginosa PA01
guccagcgcagcaccagcucgc

SEQ ID NO: 31494 - RNA, 22 nt, Pseudomonas aeruginosa PA01
guccaggaacagcacuuccagg

SEQ ID NO: 31495 - RNA, 22 nt, Pseudomonas aeruginosa PA01
guccgacgaaaccgugauggug

SEQ ID NO: 31496 - RNA, 22 nt, Pseudomonas aeruginosa PA01
guccggcuuguacugguggugg

SEQ ID NO: 31497 - RNA, 22 nt, Pseudomonas aeruginosa PA01
gucgacgaacaacugcugguag

SEQ ID NO: 31498 - RNA, 22 nt, Pseudomonas aeruginosa PA01
gucgacguugacgcccagcuug

SEQ ID NO: 31499 - RNA, 22 nt, Pseudomonas aeruginosa PA01
gucgagggcagccgcggcgguu

SEQ ID NO: 31500 - RNA, 22 nt, Pseudomonas aeruginosa PA01
gucgauauccacauccacggug

SEQ ID NO: 31501 - RNA, 22 nt, Pseudomonas aeruginosa PA01
gucgaucaaggacguggcugcc

SEQ ID NO: 31502 - RNA, 22 nt, Pseudomonas aeruginosa PA01
gucgauccucaaggucaggcug

SEQ ID NO: 31503 - RNA, 22 nt, Pseudomonas aeruginosa PA01
gucgaugaggugcuuggcgaca

SEQ ID NO: 31504 - RNA, 22 nt, Pseudomonas aeruginosa PA01
gucgccaugccauccucgcgcu

SEQ ID NO: 31505 - RNA, 22 nt, Pseudomonas aeruginosa PA01
gucgccauucccuaccugggcg

SEQ ID NO: 31506 - RNA, 22 nt, Pseudomonas aeruginosa PA01
gucgccgaccaggcggccgucg

SEQ ID NO: 31507 - RNA, 22 nt, Pseudomonas aeruginosa PA01
gucgccgcccagcucgcgggcc

SEQ ID NO: 31508 - RNA, 22 nt, Pseudomonas aeruginosa PA01
gucgcgcaguucgaaggcggga

SEQ ID NO: 31509 - RNA, 22 nt, Pseudomonas aeruginosa PA01
gucgcgcugcgaggccagcgag

SEQ ID NO: 31510 - RNA, 22 nt, Pseudomonas aeruginosa PA01
gucgcgcuugaccucggcgcgg

SEQ ID NO: 31511 - RNA, 22 nt, Pseudomonas aeruginosa PA01
gucgcgggagaauaacaucaua

SEQ ID NO: 31512 - RNA, 22 nt, Pseudomonas aeruginosa PA01
gucgcgguccaggccgaucagc

SEQ ID NO: 31513 - RNA, 22 nt, Pseudomonas aeruginosa PA01
gucgcguagcgccaggucggcc

SEQ ID NO: 31514 - RNA, 22 nt, Pseudomonas aeruginosa PA01
gucgcguggaauugcugguagc

SEQ ID NO: 31515 - RNA, 22 nt, Pseudomonas aeruginosa PA01
gucggccagagccucggccagg

SEQ ID NO: 31516 - RNA, 22 nt, Pseudomonas aeruginosa PA01
gucggccgcgaccaccaggauc

SEQ ID NO: 31517 - RNA, 22 nt, Pseudomonas aeruginosa PA01
gucggcggccaguucgaagugc

SEQ ID NO: 31518 - RNA, 22 nt, Pseudomonas aeruginosa PA01
gucggcguaaagcgcuuuggcu

SEQ ID NO: 31519 - RNA, 22 nt, Pseudomonas aeruginosa PA01
gucggcucauggcuucagcucc

SEQ ID NO: 31520 - RNA, 22 nt, Pseudomonas aeruginosa PA01
gucggcuuccugaccauggagg

SEQ ID NO: 31521 - RNA, 22 nt, Pseudomonas aeruginosa PA01
gucggggcgaacguagcggccg

SEQ ID NO: 31522 - RNA, 22 nt, Pseudomonas aeruginosa PA01
gucggugaucacggugcaggug

SEQ ID NO: 31523 - RNA, 22 nt, Pseudomonas aeruginosa PA01
gucguucggugaucaaccugau

SEQ ID NO: 31524 - RNA, 22 nt, Pseudomonas aeruginosa PA01
gucuccuggaggcuucgcucgg

SEQ ID NO: 31525 - RNA, 22 nt, Pseudomonas aeruginosa PA01
gucugccuggaggccggccagg

SEQ ID NO: 31526 - RNA, 22 nt, Pseudomonas aeruginosa PA01
gucuggauguauucgcccaggu

SEQ ID NO: 31527 - RNA, 22 nt, Pseudomonas aeruginosa PA01
gucuucgaugcgccgcagguug

SEQ ID NO: 31528 - RNA, 22 nt, Pseudomonas aeruginosa PA01
gucuuucccggauggauggaga

SEQ ID NO: 31529 - RNA, 22 nt, Pseudomonas aeruginosa PA01
gugaccgugcuggcggcgauca

SEQ ID NO: 31530 - RNA, 22 nt, Pseudomonas aeruginosa PA01
gugaggcgccggacagcgcccg

SEQ ID NO: 31531 - RNA, 22 nt, Pseudomonas aeruginosa PA01
gugcaccgacaacugcggcaau

SEQ ID NO: 31532 - RNA, 22 nt, Pseudomonas aeruginosa PA01
gugccgaacagcgccaggcgca

SEQ ID NO: 31533 - RNA, 22 nt, Pseudomonas aeruginosa PA01
gugcuccaggcauucgucgagg

SEQ ID NO: 31534 - RNA, 22 nt, Pseudomonas aeruginosa PA01
gugcuguucagcuaccgccgca

SEQ ID NO: 31535 - RNA, 22 nt, Pseudomonas aeruginosa PA01
guggaaguggacggguacugcu

SEQ ID NO: 31536 - RNA, 22 nt, Pseudomonas aeruginosa PA01
guggaaguggucgaggccccgg

SEQ ID NO: 31537 - RNA, 22 nt, Pseudomonas aeruginosa PA01
guggcacucgugggcgauggcu

SEQ ID NO: 31538 - RNA, 22 nt, Pseudomonas aeruginosa PA01
guggcaggccuggcagugcugg

SEQ ID NO: 31539 - RNA, 22 nt, Pseudomonas aeruginosa PA01
guggcccaucuucagggucuug

SEQ ID NO: 31540 - RNA, 22 nt, Pseudomonas aeruginosa PA01
ugcucgaagucggcgccgucuc

SEQ ID NO: 31541 - RNA, 22 nt, Pseudomonas aeruginosa PA01
ugcucgaguggcuggccgaacc

SEQ ID NO: 31542 - RNA, 20 nt, Pseudomonas aeruginosa PA01
ugcucgccggcuugccgccg

SEQ ID NO: 31543 - RNA, 21 nt, Pseudomonas aeruginosa PA01
ugcucggcgauaucgagcuug

SEQ ID NO: 31544 - RNA, 22 nt, Pseudomonas aeruginosa PA01
ugcugacauagucgucggcgcc

SEQ ID NO: 31545 - RNA, 22 nt, Pseudomonas aeruginosa PA01
ugcugauggucaacguggugcu

SEQ ID NO: 31546 - RNA, 22 nt, Pseudomonas aeruginosa PA01
ugcugcggauguacucggugag

SEQ ID NO: 31547 - RNA, 22 nt, Pseudomonas aeruginosa PA01
ugcugcggggccggacgcgacu

SEQ ID NO: 31548 - RNA, 22 nt, Pseudomonas aeruginosa PA01
ugcugcuggacgucggccagcc

SEQ ID NO: 31549 - RNA, 22 nt, Pseudomonas aeruginosa PA01
ugcuggagaaugucgcggcugc

SEQ ID NO: 31550 - RNA, 20 nt, Pseudomonas aeruginosa PA01
ugcuggcaccucgccuagcc

SEQ ID NO: 31551 - RNA, 22 nt, Pseudomonas aeruginosa PA01
ugcuggcguugcucugaucagg

SEQ ID NO: 31552 - RNA, 22 nt, Pseudomonas aeruginosa PA01
ugcugguccuggacgaggagcg

SEQ ID NO: 31553 - RNA, 23 nt, Pseudomonas aeruginosa PA01
ugcuggucgaauaccgcgcccgc

SEQ ID NO: 31554 - RNA, 22 nt, Pseudomonas aeruginosa PA01
ugcuggugaccuucaggcgcuu

SEQ ID NO: 31555 - RNA, 22 nt, Pseudomonas aeruginosa PA01
ugcuguuccucggccaggucga

SEQ ID NO: 31556 - RNA, 19 nt, Pseudomonas aeruginosa PA01
ugcuugaccagcucgggac

SEQ ID NO: 31557 - RNA, 19 nt, Pseudomonas aeruginosa PA01
ugcuugcagccaacugagc

SEQ ID NO: 31558 - RNA, 22 nt, Pseudomonas aeruginosa PA01
uggaaacguucucgcccuucca

SEQ ID NO: 31559 - RNA, 22 nt, Pseudomonas aeruginosa PA01
uggaaauggucgacgcggugcu

SEQ ID NO: 31560 - RNA, 22 nt, Pseudomonas aeruginosa PA01
uggaacaggucaacggugcgcu

SEQ ID NO: 31561 - RNA, 22 nt, Pseudomonas aeruginosa PA01
uggagacguaguagucgccacu

SEQ ID NO: 31562 - RNA, 22 nt, Pseudomonas aeruginosa PA01
uggagauccaugucgacgccga

SEQ ID NO: 31563 - RNA, 22 nt, Pseudomonas aeruginosa PA01
uggagcguucccgcgagguagc

SEQ ID NO: 31564 - RNA, 22 nt, Pseudomonas aeruginosa PA01
uggaggguuuccuugaucgccg

SEQ ID NO: 31565 - RNA, 22 nt, Pseudomonas aeruginosa PA01
uggagugaugggcuggccuguc

SEQ ID NO: 31566 - RNA, 21 nt, Pseudomonas aeruginosa PA01
uggauaccaagguccgccagc

SEQ ID NO: 31567 - RNA, 22 nt, Pseudomonas aeruginosa PA01
uggauggcacccucgccgaaca

SEQ ID NO: 31568 - RNA, 22 nt, Pseudomonas aeruginosa PA01
uggcacggccgcugcacgggca

SEQ ID NO: 31569 - RNA, 22 nt, Pseudomonas aeruginosa PA01
uggcagacgaucagcaggcugc

SEQ ID NO: 31570 - RNA, 22 nt, Pseudomonas aeruginosa PA01
uggccagccgaaaauucuaugg

SEQ ID NO: 31571 - RNA, 22 nt, Pseudomonas aeruginosa PA01
uggccaugauguucaccgccac

SEQ ID NO: 31572 - RNA, 22 nt, Pseudomonas aeruginosa PA01
uggccgaugcgcgguucgucuu

SEQ ID NO: 31573 - RNA, 22 nt, Pseudomonas aeruginosa PA01
uggccgccgguauugccggccg

SEQ ID NO: 31574 - RNA, 22 nt, Pseudomonas aeruginosa PA01
uggccgcgcaccagaucgccau

SEQ ID NO: 31575 - RNA, 22 nt, Pseudomonas aeruginosa PA01
uggccgcggaggagggcagcuc

SEQ ID NO: 31576 - RNA, 22 nt, Pseudomonas aeruginosa PA01
uggccgucggggacguccacgu

SEQ ID NO: 31577 - RNA, 22 nt, Pseudomonas aeruginosa PA01
uggccugauagucgaacagcuu

SEQ ID NO: 31578 - RNA, 22 nt, Pseudomonas aeruginosa PA01
uggccuugaacgcaucgacgua

SEQ ID NO: 31579 - RNA, 22 nt, Pseudomonas aeruginosa PA01
uggcgagcuugaacagguggcg

SEQ ID NO: 31580 - RNA, 22 nt, Pseudomonas aeruginosa PA01
uggcgcggaccacgacggucgg

SEQ ID NO: 31581 - RNA, 22 nt, Pseudomonas aeruginosa PA01
uggcgcuggaucgccaggccug

SEQ ID NO: 31582 - RNA, 19 nt, Pseudomonas aeruginosa PA01
uggcgcuggugagcccggc

SEQ ID NO: 31583 - RNA, 22 nt, Pseudomonas aeruginosa PA01
uggcggaagaaggcggcauggu

SEQ ID NO: 31584 - RNA, 22 nt, Pseudomonas aeruginosa PA01
uggcggaguucgucaccccgcu

SEQ ID NO: 31585 - RNA, 23 nt, Pseudomonas aeruginosa PA01
uggcguccgucuaggccuuccag

SEQ ID NO: 31586 - RNA, 22 nt, Pseudomonas aeruginosa PA01
uggcgucgaggcuuucggcgac

SEQ ID NO: 31587 - RNA, 22 nt, Pseudomonas aeruginosa PA01
uggcugccgagggugaugcucu

SEQ ID NO: 31588 - RNA, 22 nt, Pseudomonas aeruginosa PA01
uggcuggcguagugcaccaggg

SEQ ID NO: 31589 - RNA, 22 nt, Pseudomonas aeruginosa PA01
uggcuuccgccuggcacggccg

SEQ ID NO: 31590 - RNA, 22 nt, Pseudomonas aeruginosa PA01
ugggaacgccugcgcaagcuca

SEQ ID NO: 31591 - RNA, 22 nt, Pseudomonas aeruginosa PA01
ugggaucacgcggccaacgaca

SEQ ID NO: 31592 - RNA, 22 nt, Pseudomonas aeruginosa PA01
ugggcagaaugcuaucgaugcu

SEQ ID NO: 31593 - RNA, 22 nt, Pseudomonas aeruginosa PA01
ugggccugcuucaucagggcau

SEQ ID NO: 31594 - RNA, 22 nt, Pseudomonas aeruginosa PA01
ugggcgaagugcgcguagcugc

SEQ ID NO: 31595 - RNA, 22 nt, Pseudomonas aeruginosa PA01
ugggcgccgagaccuucgacga

SEQ ID NO: 31596 - RNA, 22 nt, Pseudomonas aeruginosa PA01
ugggcggcaagccugcgcgaca

SEQ ID NO: 31597 - RNA, 22 nt, Pseudomonas aeruginosa PA01
ugggcguggaaaaacccagcga

SEQ ID NO: 31598 - RNA, 22 nt, Pseudomonas aeruginosa PA01
ugggcguucgccuguuggugcu

SEQ ID NO: 31599 - RNA, 22 nt, Pseudomonas aeruginosa PA01
ugggcuaugguuucgcucucga

SEQ ID NO: 31600 - RNA, 22 nt, Pseudomonas aeruginosa PA01
uggggccgucgcccacgcgcuu

SEQ ID NO: 31601 - RNA, 22 nt, Pseudomonas aeruginosa PA01
ugggucuucucguugaggguga

SEQ ID NO: 31602 - RNA, 22 nt, Pseudomonas aeruginosa PA01
uggguucggaccgugaggugga

SEQ ID NO: 31603 - RNA, 22 nt, Pseudomonas aeruginosa PA01
uggucaccgccgacuggcuguu

SEQ ID NO: 31604 - RNA, 22 nt, Pseudomonas aeruginosa PA01
uggucagccugacccugggcgg

SEQ ID NO: 31605 - RNA, 22 nt, Pseudomonas aeruginosa PA01
uggucagcgcgagauuguucag

SEQ ID NO: 31606 - RNA, 22 nt, Pseudomonas aeruginosa PA01
ugguccagcggcgggucgaacu

SEQ ID NO: 31607 - RNA, 22 nt, Pseudomonas aeruginosa PA01
uggugaacggugugagcaugcc

SEQ ID NO: 31608 - RNA, 23 nt, Pseudomonas aeruginosa PA01
uggugcagucgucgaugccggug

SEQ ID NO: 31609 - RNA, 23 nt, Pseudomonas aeruginosa PA01
uggugcggagauuuccgacucga

SEQ ID NO: 31610 - RNA, 22 nt, Pseudomonas aeruginosa PA01
uggugcuggcgcaacuggcguc

SEQ ID NO: 31611 - RNA, 22 nt, Pseudomonas aeruginosa PA01
ugguggacggccagcggaucuc

SEQ ID NO: 31612 - RNA, 22 nt, Pseudomonas aeruginosa PA01
ugguggcgaaagcgacgacagc

SEQ ID NO: 31613 - RNA, 20 nt, Pseudomonas aeruginosa PA01
ugguggcgucaucggcgcgc

SEQ ID NO: 31614 - RNA, 22 nt, Pseudomonas aeruginosa PA01
ugguggucggcgaucaccaggg

SEQ ID NO: 31615 - RNA, 22 nt, Pseudomonas aeruginosa PA01
ugguggugggaagcgaugccga

SEQ ID NO: 31616 - RNA, 22 nt, Pseudomonas aeruginosa PA01
uguccggcgcggccuuguucaa

SEQ ID NO: 31617 - RNA, 22 nt, Pseudomonas aeruginosa PA01
ugucgcaaugcaccucgaccug

SEQ ID NO: 31618 - RNA, 22 nt, Pseudomonas aeruginosa PA01
ugucgccuucacgcccggcgcg

SEQ ID NO: 31619 - RNA, 22 nt, Pseudomonas aeruginosa PA01
ugucggucaggcuggcgucguc

SEQ ID NO: 31620 - RNA, 22 nt, Pseudomonas aeruginosa PA01
ugucguugggcagaccgcgcag

SEQ ID NO: 31621 - RNA, 23 nt, Pseudomonas aeruginosa PA01
ugucuccagcgucuucgggcugu

SEQ ID NO: 31622 - RNA, 20 nt, Pseudomonas aeruginosa PA01
ugucugcgaaaccgccccgg

SEQ ID NO: 31623 - RNA, 22 nt, Pseudomonas aeruginosa PA01
ugugaacuaucgcccguacgaa

SEQ ID NO: 31624 - RNA, 23 nt, Pseudomonas aeruginosa PA01
ugugcagcagcucggccggcagc

SEQ ID NO: 31625 - RNA, 22 nt, Pseudomonas aeruginosa PA01
uguggcaagucaccgacgaugc

SEQ ID NO: 31626 - RNA, 23 nt, Pseudomonas aeruginosa PA01
uguggccaauugauggccuugug

SEQ ID NO: 31627 - RNA, 22 nt, Pseudomonas aeruginosa PA01
uguggccguccucgugcugcag

SEQ ID NO: 31628 - RNA, 22 nt, Pseudomonas aeruginosa PA01
uguggcgcaggcgcaguugcgc

SEQ ID NO: 31629 - RNA, 22 nt, Pseudomonas aeruginosa PA01
uguggcugcgcggaccgcugcc

SEQ ID NO: 31630 - RNA, 22 nt, Pseudomonas aeruginosa PA01
uguguucgcccugggcgccggc

SEQ ID NO: 31631 - RNA, 22 nt, Pseudomonas aeruginosa PA01
uguucaccagcgccuugcagga

SEQ ID NO: 31632 - RNA, 22 nt, Pseudomonas aeruginosa PA01
uguucggccggcugcacgccau

SEQ ID NO: 31633 - RNA, 22 nt, Pseudomonas aeruginosa PA01
uguucugcucgaucuugcgcac

SEQ ID NO: 31634 - RNA, 22 nt, Pseudomonas aeruginosa PA01
uguugcgagugaucgaagacgg

SEQ ID NO: 31635 - RNA, 22 nt, Pseudomonas aeruginosa PA01
uguugcgggucucgaccgugug

SEQ ID NO: 31636 - RNA, 22 nt, Pseudomonas aeruginosa PA01
uucaagcagcgcacuucgcugg

SEQ ID NO: 31637 - RNA, 22 nt, Pseudomonas aeruginosa PA01
uucagcucguacagccgcaggc

SEQ ID NO: 31638 - RNA, 22 nt, Pseudomonas aeruginosa PA01
uucagcuucaaggacgcgaugg

SEQ ID NO: 31639 - RNA, 22 nt, Pseudomonas aeruginosa PA01
uucagcuuguuuuuccgggcug

SEQ ID NO: 31640 - RNA, 22 nt, Pseudomonas aeruginosa PA01
uuccaccgccauugccaucgcc

SEQ ID NO: 31641 - RNA, 22 nt, Pseudomonas aeruginosa PA01
uuccaccugcgggugcgacgcg

SEQ ID NO: 31642 - RNA, 22 nt, Pseudomonas aeruginosa PA01
uuccacggucagcaccgccggc

SEQ ID NO: 31643 - RNA, 22 nt, Pseudomonas aeruginosa PA01
uuccagaucaccguggcgcugg

SEQ ID NO: 31644 - RNA, 21 nt, Pseudomonas aeruginosa PA01
uuccagcgccugcugaccuuc

SEQ ID NO: 31645 - RNA, 20 nt, Pseudomonas aeruginosa PA01
uuccaucacguagcugccgu

SEQ ID NO: 31646 - RNA, 22 nt, Pseudomonas aeruginosa PA01
uucccgcuggcagauggcccug

SEQ ID NO: 31647 - RNA, 22 nt, Pseudomonas aeruginosa PA01
uucccgucgaugcggagcggau

SEQ ID NO: 31648 - RNA, 22 nt, Pseudomonas aeruginosa PA01
uuccgaccucgaucuccccgag

SEQ ID NO: 31649 - RNA, 22 nt, Pseudomonas aeruginosa PA01
uuccgggcacgccggucuugac

SEQ ID NO: 31650 - RNA, 22 nt, Pseudomonas aeruginosa PA01
uuccuugagcuucagcgcgccu

SEQ ID NO: 31651 - RNA, 22 nt, Pseudomonas aeruginosa PA01
uucgacgucggcgcccuggcgc

SEQ ID NO: 31652 - RNA, 22 nt, Pseudomonas aeruginosa PA01
uucgccauguaccagcacgucc

SEQ ID NO: 31653 - RNA, 22 nt, Pseudomonas aeruginosa PA01
uucgccuucgagacgcggauga

SEQ ID NO: 31654 - RNA, 22 nt, Pseudomonas aeruginosa PA01
uucgcgccaggacaagcgcaac

SEQ ID NO: 31655 - RNA, 22 nt, Pseudomonas aeruginosa PA01
uucggcauguggacggugaccc

SEQ ID NO: 31656 - RNA, 22 nt, Pseudomonas aeruginosa PA01
uucguagaucuucagcauggug

SEQ ID NO: 31657 - RNA, 19 nt, Pseudomonas aeruginosa PA01
uucgucauccaccgccucg

SEQ ID NO: 31658 - RNA, 17 nt, Pseudomonas aeruginosa PA01
uucguccagcgccagca

SEQ ID NO: 31659 - RNA, 18 nt, Pseudomonas aeruginosa PA01
uucgugcugccgccuggc

SEQ ID NO: 31660 - RNA, 22 nt, Pseudomonas aeruginosa PA01
uucucgcuguaggcgguggcgc

SEQ ID NO: 31661 - RNA, 22 nt, Pseudomonas aeruginosa PA01
uucucggcuguuacccaagcgc

SEQ ID NO: 31662 - RNA, 21 nt, Pseudomonas aeruginosa PA01
uucugccuuugcucugugcuc

SEQ ID NO: 31663 - RNA, 22 nt, Pseudomonas aeruginosa PA01
uucuggcgcagggugcccauca

SEQ ID NO: 31664 - RNA, 21 nt, Pseudomonas aeruginosa PA01
uucuucagccugcgcgccgug

SEQ ID NO: 31665 - RNA, 22 nt, Pseudomonas aeruginosa PA01
uucuucgcggcgaccuugguca

SEQ ID NO: 31666 - RNA, 22 nt, Pseudomonas aeruginosa PA01
uucuucucgucgggcuggugca

SEQ ID NO: 31667 - RNA, 22 nt, Pseudomonas aeruginosa PA01
uugaucgccagcggcuucgcgg

SEQ ID NO: 31668 - RNA, 22 nt, Pseudomonas aeruginosa PA01
uugccagcucgauucaucgcag

SEQ ID NO: 31669 - RNA, 22 nt, Pseudomonas aeruginosa PA01
uugcccaggccgaucucuucca

SEQ ID NO: 31670 - RNA, 22 nt, Pseudomonas aeruginosa PA01
uugcccggaucgaccaccagcg

SEQ ID NO: 31671 - RNA, 22 nt, Pseudomonas aeruginosa PA01
uugcccgguugcagcggcacca

SEQ ID NO: 31672 - RNA, 22 nt, Pseudomonas aeruginosa PA01
uugcccguucggcgacggcagg

SEQ ID NO: 31673 - RNA, 22 nt, Pseudomonas aeruginosa PA01
uugcccucggcgaacgcuucuc

SEQ ID NO: 31674 - RNA, 22 nt, Pseudomonas aeruginosa PA01
uugccgaucagcgacgagcugg

SEQ ID NO: 31675 - RNA, 22 nt, Pseudomonas aeruginosa PA01
uugccgcgcucaagcgcuggcu

SEQ ID NO: 31676 - RNA, 22 nt, Pseudomonas aeruginosa PA01
uugccugcuguuccuugccugc

SEQ ID NO: 31677 - RNA, 22 nt, Pseudomonas aeruginosa PA01
uugcgcgggcagacgcugggcg

SEQ ID NO: 31678 - RNA, 22 nt, Pseudomonas aeruginosa PA01
uugcgcugccgcgccaguucga

SEQ ID NO: 31679 - RNA, 22 nt, Pseudomonas aeruginosa PA01
uugcggcggucguaguggucgg

SEQ ID NO: 31680 - RNA, 22 nt, Pseudomonas aeruginosa PA01
uugcucaagcugccggauggca

SEQ ID NO: 31681 - RNA, 22 nt, Pseudomonas aeruginosa PA01
uugcucggccagcucgggcugc

SEQ ID NO: 31682 - RNA, 22 nt, Pseudomonas aeruginosa PA01
uugcuggcggcgguccguucgg

SEQ ID NO: 31683 - RNA, 22 nt, Pseudomonas aeruginosa PA01
uugcuguucugcccgggcugga

SEQ ID NO: 31684 - RNA, 22 nt, Pseudomonas aeruginosa PA01
uugcuugagcgcauggcggagg

SEQ ID NO: 31685 - RNA, 22 nt, Pseudomonas aeruginosa PA01
uuggccggguugagcuuggccu

SEQ ID NO: 31686 - RNA, 22 nt, Pseudomonas aeruginosa PA01
uuggcgaaugacggcggcggcc

SEQ ID NO: 31687 - RNA, 22 nt, Pseudomonas aeruginosa PA01
uuggcggccgucgcgcaccacc

SEQ ID NO: 31688 - RNA, 22 nt, Pseudomonas aeruginosa PA01
uuggcggcgccaucucccuguu

SEQ ID NO: 31689 - RNA, 22 nt, Pseudomonas aeruginosa PA01
uuggcgucgaagccacuggcga

SEQ ID NO: 31690 - RNA, 22 nt, Pseudomonas aeruginosa PA01
uuggcguuaugcgcccuacggc

SEQ ID NO: 31691 - RNA, 22 nt, Pseudomonas aeruginosa PA01
uugguguucagcaaaggccggu

SEQ ID NO: 31692 - RNA, 22 nt, Pseudomonas aeruginosa PA01
uuguccugggaugccgcggcgc

SEQ ID NO: 31693 - RNA, 21 nt, Pseudomonas aeruginosa PA01
uugucgaugcgauagccgacg

SEQ ID NO: 31694 - RNA, 20 nt, Pseudomonas aeruginosa PA01
uuguucucuuccgcgauggc

SEQ ID NO: 31695 - RNA, 22 nt, Pseudomonas aeruginosa PA01
uuuaucugcaggacccggucgc

SEQ ID NO: 31696 - RNA, 23 nt, Pseudomonas aeruginosa PA01
uuuccgcgacguugguggacagc

SEQ ID NO: 31697 - RNA, 22 nt, Pseudomonas aeruginosa PA01
uuuccuacgccacgcugcgugc

SEQ ID NO: 31698 - RNA, 22 nt, Pseudomonas aeruginosa PA01
uuucgccagccauggucggucc

SEQ ID NO: 31699 - RNA, 22 nt, Pseudomonas aeruginosa PA01
uuucgcggacgaacuggcggau

SEQ ID NO: 31700 - RNA, 21 nt, Pseudomonas aeruginosa PA01
uuucggcguccuggaaggguu

SEQ ID NO: 31701 - RNA, 22 nt, Pseudomonas aeruginosa PA01
uuuuccgagagcagcaggucga

SEQ ID NO: 31702 - RNA, 20 nt, Pseudomonas aeruginosa PA01
uuuucguagagcgcccggca

SEQ ID NO: 31703 - RNA, 22 nt, Pseudomonas aeruginosa PA01
uuuucgucgaccuguucguuga

SEQ ID NO: 31704 - RNA, 22 nt, Pseudomonas aeruginosa PA01
caggcgcucugggaugaucacg

SEQ ID NO: 31705 - RNA, 22 nt, Pseudomonas aeruginosa PA01
caggcggcaacuccagcuuccu

SEQ ID NO: 31706 - RNA, 22 nt, Pseudomonas aeruginosa PA01
caggcugaugcaugguaucggg

SEQ ID NO: 31707 - RNA, 22 nt, Pseudomonas aeruginosa PA01
caggcugucgggguaguccugg

SEQ ID NO: 31708 - RNA, 22 nt, Pseudomonas aeruginosa PA01
cagggcaucgauggccacuugg

SEQ ID NO: 31709 - RNA, 22 nt, Pseudomonas aeruginosa PA01
cagggccacauggagauggaac

SEQ ID NO: 31710 - RNA, 22 nt, Pseudomonas aeruginosa PA01
cagggcggcgaccccguucagc

SEQ ID NO: 31711 - RNA, 22 nt, Pseudomonas aeruginosa PA01
cagggcguggacucggucuacg

SEQ ID NO: 31712 - RNA, 22 nt, Pseudomonas aeruginosa PA01
cagggcuucaccaucggcgggg

SEQ ID NO: 31713 - RNA, 22 nt, Pseudomonas aeruginosa PA01
cagggucgaucacggaagcggc

SEQ ID NO: 31714 - RNA, 22 nt, Pseudomonas aeruginosa PA01
cagggugguaucggccugcgcc

SEQ ID NO: 31715 - RNA, 22 nt, Pseudomonas aeruginosa PA01
caggucgaggucgguguugucg

SEQ ID NO: 31716 - RNA, 22 nt, Pseudomonas aeruginosa PA01
caggugcucggcccaguggauc

SEQ ID NO: 31717 - RNA, 22 nt, Pseudomonas aeruginosa PA01
cagucguugcaguucgccgccg

SEQ ID NO: 31718 - RNA, 22 nt, Pseudomonas aeruginosa PA01
caguugcgcggucagcgcggua

SEQ ID NO: 31719 - RNA, 22 nt, Pseudomonas aeruginosa PA01
caguugcuugaccugggccagc

SEQ ID NO: 31720 - RNA, 22 nt, Pseudomonas aeruginosa PA01
cauccggagugucgcuugaccg

SEQ ID NO: 31721 - RNA, 22 nt, Pseudomonas aeruginosa PA01
cauccuuacguggcaccagugu

SEQ ID NO: 31722 - RNA, 22 nt, Pseudomonas aeruginosa PA01
caucgacggcuacggccaggcu

SEQ ID NO: 31723 - RNA, 22 nt, Pseudomonas aeruginosa PA01
caucgauuggugaucccgccgc

SEQ ID NO: 31724 - RNA, 22 nt, Pseudomonas aeruginosa PA01
caucgccuugaucccgcgcacc

SEQ ID NO: 31725 - RNA, 22 nt, Pseudomonas aeruginosa PA01
caugcucagcgcccugcgccgc

SEQ ID NO: 31726 - RNA, 22 nt, Pseudomonas aeruginosa PA01
caugcuugccgguuuguugcag

SEQ ID NO: 31727 - RNA, 22 nt, Pseudomonas aeruginosa PA01
cauggaguggguguccuuggug

SEQ ID NO: 31728 - RNA, 22 nt, Pseudomonas aeruginosa PA01
cauggcgacuggccugccauug

SEQ ID NO: 31729 - RNA, 22 nt, Pseudomonas aeruginosa PA01
cauugggugaugccggcggcga

SEQ ID NO: 31730 - RNA, 22 nt, Pseudomonas aeruginosa PA01
ccacgcauuucucgguggagga

SEQ ID NO: 31731 - RNA, 22 nt, Pseudomonas aeruginosa PA01
ccacuuccagacgcucggcgcg

SEQ ID NO: 31732 - RNA, 22 nt, Pseudomonas aeruginosa PA01
ccagcacuccgaccugaugauc

SEQ ID NO: 31733 - RNA, 22 nt, Pseudomonas aeruginosa PA01
ccagccgcgaccugacccuggg

SEQ ID NO: 31734 - RNA, 22 nt, Pseudomonas aeruginosa PA01
ccagccgcucgcggccgaucug

SEQ ID NO: 31735 - RNA, 23 nt, Pseudomonas aeruginosa PA01
ccagccggacguccucgaccugg

SEQ ID NO: 31736 - RNA, 22 nt, Pseudomonas aeruginosa PA01
ccagccugaccagccuggccac

SEQ ID NO: 31737 - RNA, 22 nt, Pseudomonas aeruginosa PA01
ccagcgaucagacggcuguagg

SEQ ID NO: 31738 - RNA, 22 nt, Pseudomonas aeruginosa PA01
ccagcgcagccucgaccucgaa

SEQ ID NO: 31739 - RNA, 22 nt, Pseudomonas aeruginosa PA01
ccagcgcgccgacgucgcccau

SEQ ID NO: 31740 - RNA, 22 nt, Pseudomonas aeruginosa PA01
ccagcgcggcggccaccaggcg

SEQ ID NO: 31741 - RNA, 23 nt, Pseudomonas aeruginosa PA01
ccaggcagcuguucuucaggcug

SEQ ID NO: 31742 - RNA, 22 nt, Pseudomonas aeruginosa PA01
ccaggccgucgacggcgcucug

SEQ ID NO: 31743 - RNA, 22 nt, Pseudomonas aeruginosa PA01
ccaggcguucggcauucuggcu

SEQ ID NO: 31744 - RNA, 22 nt, Pseudomonas aeruginosa PA01
ccaguuccagggucagcuggcg

SEQ ID NO: 31745 - RNA, 22 nt, Pseudomonas aeruginosa PA01
ccaucaccgccagcuggugcgc

SEQ ID NO: 31746 - RNA, 22 nt, Pseudomonas aeruginosa PA01
ccaugaucagguuguggucgcc

SEQ ID NO: 31747 - RNA, 22 nt, Pseudomonas aeruginosa PA01
ccauggccgcgcuguucgccaa

SEQ ID NO: 31748 - RNA, 22 nt, Pseudomonas aeruginosa PA01
ccauggccugggucggcgacgc

SEQ ID NO: 31749 - RNA, 22 nt, Pseudomonas aeruginosa PA01
ccaugggcguggcccggcgcgu

SEQ ID NO: 31750 - RNA, 19 nt, Pseudomonas aeruginosa PA01
ccauggucgccagcuugcc

SEQ ID NO: 31751 - RNA, 22 nt, Pseudomonas aeruginosa PA01
cccagcaggucgagggccugaa

SEQ ID NO: 31752 - RNA, 22 nt, Pseudomonas aeruginosa PA01
cccagcgcgaucaacuggaugu

SEQ ID NO: 31753 - RNA, 23 nt, Pseudomonas aeruginosa PA01
cccaggcgaccaaggacaucgcc

SEQ ID NO: 31754 - RNA, 22 nt, Pseudomonas aeruginosa PA01
cccaggucggugccgcagugcg

SEQ ID NO: 31755 - RNA, 22 nt, Pseudomonas aeruginosa PA01
ccccugggagagaauccguaaa

SEQ ID NO: 31756 - RNA, 22 nt, Pseudomonas aeruginosa PA01
cccgacauucugcgccuaaguu

SEQ ID NO: 31757 - RNA, 22 nt, Pseudomonas aeruginosa PA01
cccgaccugaagcaccgggcug

SEQ ID NO: 31758 - RNA, 20 nt, Pseudomonas aeruginosa PA01
cccgacgaccugcaggcggc

SEQ ID NO: 31759 - RNA, 22 nt, Pseudomonas aeruginosa PA01
cccgauacccugcgucccuggg

SEQ ID NO: 31760 - RNA, 22 nt, Pseudomonas aeruginosa PA01
cccgccagcucaugcuggaugc

SEQ ID NO: 31761 - RNA, 22 nt, Pseudomonas aeruginosa PA01
cccgccgccuucgaaggcugua

SEQ ID NO: 31762 - RNA, 22 nt, Pseudomonas aeruginosa PA01
cccgcggcaauugcugcaucuc

SEQ ID NO: 31763 - RNA, 22 nt, Pseudomonas aeruginosa PA01
cccgcuccguuggggccgagga

SEQ ID NO: 31764 - RNA, 22 nt, Pseudomonas aeruginosa PA01
cccgcugacgcugcauuuccgc

SEQ ID NO: 31765 - RNA, 22 nt, Pseudomonas aeruginosa PA01
cccgcugaguccaccagaaccc

SEQ ID NO: 31766 - RNA, 22 nt, Pseudomonas aeruginosa PA01
cccggaagcgcggguccucgac

SEQ ID NO: 31767 - RNA, 21 nt, Pseudomonas aeruginosa PA01
cccggccgagagcgggcagga

SEQ ID NO: 31768 - RNA, 22 nt, Pseudomonas aeruginosa PA01
cccggcgagguccugcaaggcc

SEQ ID NO: 31769 - RNA, 22 nt, Pseudomonas aeruginosa PA01
cccggcgggcaccuguguggcc

SEQ ID NO: 31770 - RNA, 22 nt, Pseudomonas aeruginosa PA01
cccguugccccagaccugggag

SEQ ID NO: 31771 - RNA, 22 nt, Pseudomonas aeruginosa PA01
cccucgaagauccucauggccu

SEQ ID NO: 31772 - RNA, 22 nt, Pseudomonas aeruginosa PA01
cccucgacguuggcgcucuucg

SEQ ID NO: 31773 - RNA, 22 nt, Pseudomonas aeruginosa PA01
cccugcagccggucagggucgg

SEQ ID NO: 31774 - RNA, 22 nt, Pseudomonas aeruginosa PA01
cccugcugcgcugccugauggg

SEQ ID NO: 31775 - RNA, 22 nt, Pseudomonas aeruginosa PA01
cccugggggaaccacugcuugc

SEQ ID NO: 31776 - RNA, 22 nt, Pseudomonas aeruginosa PA01
ccgacaaucaccgccagggucg

SEQ ID NO: 31777 - RNA, 22 nt, Pseudomonas aeruginosa PA01
ccgaccauggagaucgccgaca

SEQ ID NO: 31778 - RNA, 22 nt, Pseudomonas aeruginosa PA01
ccgaccuguuccccgugcagca

SEQ ID NO: 31779 - RNA, 22 nt, Pseudomonas aeruginosa PA01
ccgacgacuucauggucaagcc

SEQ ID NO: 31780 - RNA, 22 nt, Pseudomonas aeruginosa PA01
ccgacuugaggaugacguugau

SEQ ID NO: 31781 - RNA, 17 nt, Pseudomonas aeruginosa PA01
ccgagcaacagacccug

SEQ ID NO: 31782 - RNA, 21 nt, Pseudomonas aeruginosa PA01
ccgagcaguuucucgaggcgc

SEQ ID NO: 31783 - RNA, 22 nt, Pseudomonas aeruginosa PA01
ccgagcggcccagcggauggau

SEQ ID NO: 31784 - RNA, 22 nt, Pseudomonas aeruginosa PA01
ccgaggguaacgaugucggcgc

SEQ ID NO: 31785 - RNA, 22 nt, Pseudomonas aeruginosa PA01
ccgaguucaucaaggcgcacuu

SEQ ID NO: 31786 - RNA, 22 nt, Pseudomonas aeruginosa PA01
ccgaugugcuucaccaacggca

SEQ ID NO: 31787 - RNA, 22 nt, Pseudomonas aeruginosa PA01
ccgccaggucgauggacaacug

SEQ ID NO: 31788 - RNA, 22 nt, Pseudomonas aeruginosa PA01
acaggcgcggguacuggugcag

SEQ ID NO: 31789 - RNA, 22 nt, Pseudomonas aeruginosa PA01
acaucgagaauggcgcggcccu

SEQ ID NO: 31790 - RNA, 22 nt, Pseudomonas aeruginosa PA01
acauggcguccuugccguuggc

SEQ ID NO: 31791 - RNA, 22 nt, Pseudomonas aeruginosa PA01
accaccggcuugcugcuggucg

SEQ ID NO: 31792 - RNA, 22 nt, Pseudomonas aeruginosa PA01
accagcacgggcgaaccguaga

SEQ ID NO: 31793 - RNA, 22 nt, Pseudomonas aeruginosa PA01
accaggugcuggugcucggugc

SEQ ID NO: 31794 - RNA, 22 nt, Pseudomonas aeruginosa PA01
accaugcagccggcgaucgcgc

SEQ ID NO: 31795 - RNA, 22 nt, Pseudomonas aeruginosa PA01
accauggccgccuucgagucca

SEQ ID NO: 31796 - RNA, 22 nt, Pseudomonas aeruginosa PA01
acccugcucggcggcgguuucg

SEQ ID NO: 31797 - RNA, 22 nt, Pseudomonas aeruginosa PA01
accgaucugaucgagccgcuuu

SEQ ID NO: 31798 - RNA, 22 nt, Pseudomonas aeruginosa PA01
accgccaggcgguuauccgccc

SEQ ID NO: 31799 - RNA, 22 nt, Pseudomonas aeruginosa PA01
accgccgugguagcggcgcagc

SEQ ID NO: 31800 - RNA, 22 nt, Pseudomonas aeruginosa PA01
accgcgauggugcccagcgcgg

SEQ ID NO: 31801 - RNA, 22 nt, Pseudomonas aeruginosa PA01
accgggaaggacauggucgggg

SEQ ID NO: 31802 - RNA, 22 nt, Pseudomonas aeruginosa PA01
accggugggcaacuggccggcg

SEQ ID NO: 31803 - RNA, 17 nt, Pseudomonas aeruginosa PA01
accucgcgcucgcuggc

SEQ ID NO: 31804 - RNA, 22 nt, Pseudomonas aeruginosa PA01
accugcaccagcaccagccggu

SEQ ID NO: 31805 - RNA, 20 nt, Pseudomonas aeruginosa PA01
accugcugcaacaggcucgc

SEQ ID NO: 31806 - RNA, 22 nt, Pseudomonas aeruginosa PA01
accuggcccucuuucaccgccu

SEQ ID NO: 31807 - RNA, 23 nt, Pseudomonas aeruginosa PA01
accugggcauccagcucggccug

SEQ ID NO: 31808 - RNA, 22 nt, Pseudomonas aeruginosa PA01
accuggucguccauggcgaagg

SEQ ID NO: 31809 - RNA, 22 nt, Pseudomonas aeruginosa PA01
accuucacccgccguugcgcca

SEQ ID NO: 31810 - RNA, 22 nt, Pseudomonas aeruginosa PA01
accuugacacugccgaucaggu

SEQ ID NO: 31811 - RNA, 21 nt, Pseudomonas aeruginosa PA01
acgaucccgcgcaucgggcug

SEQ ID NO: 31812 - RNA, 22 nt, Pseudomonas aeruginosa PA01
acgaucgauauauggaugcgag

SEQ ID NO: 31813 - RNA, 22 nt, Pseudomonas aeruginosa PA01
acgaucggcccgggcaucggca

SEQ ID NO: 31814 - RNA, 22 nt, Pseudomonas aeruginosa PA01
acgcaugcuaccgguguucgac

SEQ ID NO: 31815 - RNA, 21 nt, Pseudomonas aeruginosa PA01
acgccaugcccucggucggcc

SEQ ID NO: 31816 - RNA, 22 nt, Pseudomonas aeruginosa PA01
acgcccaggccagcgauggcga

SEQ ID NO: 31817 - RNA, 22 nt, Pseudomonas aeruginosa PA01
acgccgaccucgaucaccgugg

SEQ ID NO: 31818 - RNA, 22 nt, Pseudomonas aeruginosa PA01
acgccggccugcuggacggcau

SEQ ID NO: 31819 - RNA, 22 nt, Pseudomonas aeruginosa PA01
acgccggcggcugguugccgag

SEQ ID NO: 31820 - RNA, 22 nt, Pseudomonas aeruginosa PA01
acgccuccuccaucuucggcuu

SEQ ID NO: 31821 - RNA, 22 nt, Pseudomonas aeruginosa PA01
acgcgccugaccgguggcgcgg

SEQ ID NO: 31822 - RNA, 22 nt, Pseudomonas aeruginosa PA01
acgcgcgcaaccgacggcaggg

SEQ ID NO: 31823 - RNA, 22 nt, Pseudomonas aeruginosa PA01
acgcgcuaccuaaccugaccgg

SEQ ID NO: 31824 - RNA, 22 nt, Pseudomonas aeruginosa PA01
acgcggauagcuuuucuucgcu

SEQ ID NO: 31825 - RNA, 22 nt, Pseudomonas aeruginosa PA01
acgcggcaggucgcgggacagg

SEQ ID NO: 31826 - RNA, 22 nt, Pseudomonas aeruginosa PA01
acgcucuccaggcuggccggcg

SEQ ID NO: 31827 - RNA, 22 nt, Pseudomonas aeruginosa PA01
acgcuggcgagcaacugcucgg

SEQ ID NO: 31828 - RNA, 22 nt, Pseudomonas aeruginosa PA01
acggcacgcuugaucgccucgg

SEQ ID NO: 31829 - RNA, 22 nt, Pseudomonas aeruginosa PA01
acggccagguggugcagaucga

SEQ ID NO: 31830 - RNA, 22 nt, Pseudomonas aeruginosa PA01
acggcgaagccugccucggcga

SEQ ID NO: 31831 - RNA, 22 nt, Pseudomonas aeruginosa PA01
acggcggacaugcggacuggaa

SEQ ID NO: 31832 - RNA, 22 nt, Pseudomonas aeruginosa PA01
acggcguugaccaggucgcugg

SEQ ID NO: 31833 - RNA, 22 nt, Pseudomonas aeruginosa PA01
acgggcgucgagcgcccggcug

SEQ ID NO: 31834 - RNA, 22 nt, Pseudomonas aeruginosa PA01
acgucggagacaaggcgguggc

SEQ ID NO: 31835 - RNA, 23 nt, Pseudomonas aeruginosa PA01
acgucggcugggagcguucgcgc

SEQ ID NO: 31836 - RNA, 22 nt, Pseudomonas aeruginosa PA01
acgucuggucgcugcacauccg

SEQ ID NO: 31837 - RNA, 22 nt, Pseudomonas aeruginosa PA01
acgugcggcaagggcggcgcaa

SEQ ID NO: 31838 - RNA, 22 nt, Pseudomonas aeruginosa PA01
acguggcuuugcgguggucgcc

SEQ ID NO: 31839 - RNA, 20 nt, Pseudomonas aeruginosa PA01
acuaccugggccaauugcug

SEQ ID NO: 31840 - RNA, 22 nt, Pseudomonas aeruginosa PA01
acuccgccggaucuuccgccgc

SEQ ID NO: 31841 - RNA, 20 nt, Pseudomonas aeruginosa PA01
acucgaccacgaacgcguga

SEQ ID NO: 31842 - RNA, 22 nt, Pseudomonas aeruginosa PA01
acucgccggcauuggcacccug

SEQ ID NO: 31843 - RNA, 22 nt, Pseudomonas aeruginosa PA01
acucggccuggccugcggcgac

SEQ ID NO: 31844 - RNA, 22 nt, Pseudomonas aeruginosa PA01
acucggccugggccgagaaggc

SEQ ID NO: 31845 - RNA, 22 nt, Pseudomonas aeruginosa PA01
acugcgucuaccuggacaucag

SEQ ID NO: 31846 - RNA, 22 nt, Pseudomonas aeruginosa PA01
acuggcggcauugccgaggacc

SEQ ID NO: 31847 - RNA, 22 nt, Pseudomonas aeruginosa PA01
acugggugaaggaguuggcgau

SEQ ID NO: 31848 - RNA, 22 nt, Pseudomonas aeruginosa PA01
acuucgaaguuaccgcguuggc

SEQ ID NO: 31849 - RNA, 22 nt, Pseudomonas aeruginosa PA01
agaagugcgaaauagagcgcuu

SEQ ID NO: 31850 - RNA, 22 nt, Pseudomonas aeruginosa PA01
agaccucgacgcagacggugca

SEQ ID NO: 31851 - RNA, 22 nt, Pseudomonas aeruginosa PA01
agagccaucgucgcugccgccc

SEQ ID NO: 31852 - RNA, 22 nt, Pseudomonas aeruginosa PA01
agagcggccugcgcuucggcga

SEQ ID NO: 31853 - RNA, 22 nt, Pseudomonas aeruginosa PA01
agagcggcuugcuggucggcgc

SEQ ID NO: 31854 - RNA, 22 nt, Pseudomonas aeruginosa PA01
agaggcgcugcgcaguugcgug

SEQ ID NO: 31855 - RNA, 22 nt, Pseudomonas aeruginosa PA01
agaucgacgaugcggccgaggu

SEQ ID NO: 31856 - RNA, 22 nt, Pseudomonas aeruginosa PA01
agauugucgaagcggcgcugga

SEQ ID NO: 31857 - RNA, 22 nt, Pseudomonas aeruginosa PA01
agcaagcuguggcuggugaucu

SEQ ID NO: 31858 - RNA, 22 nt, Pseudomonas aeruginosa PA01
agcaccgucgagcuggagcagg

SEQ ID NO: 31859 - RNA, 22 nt, Pseudomonas aeruginosa PA01
agcagcgccugaaggaagucga

SEQ ID NO: 31860 - RNA, 22 nt, Pseudomonas aeruginosa PA01
agcaguggucgcaggaaauccg

SEQ ID NO: 31861 - RNA, 22 nt, Pseudomonas aeruginosa PA01
agcaucuguuguacgucgcucg

SEQ ID NO: 31862 - RNA, 22 nt, Pseudomonas aeruginosa PA01
agcaugccguugcucaggacga

SEQ ID NO: 31863 - RNA, 22 nt, Pseudomonas aeruginosa PA01
agccagcccugggcgucgcuca

SEQ ID NO: 31864 - RNA, 22 nt, Pseudomonas aeruginosa PA01
agccagccggccaguugcuccg

SEQ ID NO: 31865 - RNA, 22 nt, Pseudomonas aeruginosa PA01
agcccguggagaaggcccggag

SEQ ID NO: 31866 - RNA, 22 nt, Pseudomonas aeruginosa PA01
agccgauggcgugcggaucggc

SEQ ID NO: 31867 - RNA, 22 nt, Pseudomonas aeruginosa PA01
agccgcucguaguccgggucgg

SEQ ID NO: 31868 - RNA, 22 nt, Pseudomonas aeruginosa PA01
agccggugaagcugaccaucgc

SEQ ID NO: 31869 - RNA, 22 nt, Pseudomonas aeruginosa PA01
agccgugcgguggccgaccugc

SEQ ID NO: 31870 - RNA, 22 nt, Pseudomonas aeruginosa PA01
agccugaagaacagcugccugg

SEQ ID NO: 31871 - RNA, 22 nt, Pseudomonas aeruginosa PA01
cacuggagcagcgccuggaucg

SEQ ID NO: 31872 - RNA, 22 nt, Pseudomonas aeruginosa PA01
cacuucgccggcgaggucuucc

SEQ ID NO: 31873 - RNA, 22 nt, Pseudomonas aeruginosa PA01
cagaacggcgucugccagaccu

SEQ ID NO: 31874 - RNA, 22 nt, Pseudomonas aeruginosa PA01
cagaccucugccugccguguau

SEQ ID NO: 31875 - RNA, 22 nt, Pseudomonas aeruginosa PA01
cagcaccucggcuucuacgacc

SEQ ID NO: 31876 - RNA, 22 nt, Pseudomonas aeruginosa PA01
cagcagccuggccggcaguuuu

SEQ ID NO: 31877 - RNA, 22 nt, Pseudomonas aeruginosa PA01
cagcagcgccucggcgccgaac

SEQ ID NO: 31878 - RNA, 22 nt, Pseudomonas aeruginosa PA01
cagcaggagauugccguccagc

SEQ ID NO: 31879 - RNA, 22 nt, Pseudomonas aeruginosa PA01
cagccccaccgccagcucgucg

SEQ ID NO: 31880 - RNA, 22 nt, Pseudomonas aeruginosa PA01
cagccgaaaagagcuggggcuu

SEQ ID NO: 31881 - RNA, 22 nt, Pseudomonas aeruginosa PA01
cagccgggugaugccgcaggug

SEQ ID NO: 31882 - RNA, 22 nt, Pseudomonas aeruginosa PA01
cagcgagggucgguccgaaggu

SEQ ID NO: 31883 - RNA, 22 nt, Pseudomonas aeruginosa PA01
cagcgccuggucggcccacugg

SEQ ID NO: 31884 - RNA, 22 nt, Pseudomonas aeruginosa PA01
cagcgcugagagacuggcgcgc

SEQ ID NO: 31885 - RNA, 22 nt, Pseudomonas aeruginosa PA01
cagcggguggcuucccggcgca

SEQ ID NO: 31886 - RNA, 21 nt, Pseudomonas aeruginosa PA01
cagcgucacccgccaggugga

SEQ ID NO: 31887 - RNA, 22 nt, Pseudomonas aeruginosa PA01
cagcuucaggcuggcgucgucg

SEQ ID NO: 31888 - RNA, 22 nt, Pseudomonas aeruginosa PA01
cagcuuggugcgauagccguug

SEQ ID NO: 31889 - RNA, 22 nt, Pseudomonas aeruginosa PA01
caggaaauggcccggggaggcu

SEQ ID NO: 31890 - RNA, 22 nt, Pseudomonas aeruginosa PA01
caggaguucggcggcgcgcucg

SEQ ID NO: 31891 - RNA, 22 nt, Pseudomonas aeruginosa PA01
caggcccagcugggucgcgguc

SEQ ID NO: 31892 - RNA, 22 nt, Pseudomonas aeruginosa PA01
caggcccugccagccggggaug

SEQ ID NO: 31893 - RNA, 22 nt, Pseudomonas aeruginosa PA01
caggccgugcagguaggugccc

SEQ ID NO: 31894 - RNA, 22 nt, Pseudomonas aeruginosa PA01
caggcgaucacgaucggcaccc

SEQ ID NO: 31895 - RNA, 22 nt, Pseudomonas aeruginosa PA01
caggcgcgcuucgucgcacugc

SEQ ID NO: 31896 - RNA, 22 nt, Pseudomonas aeruginosa PA01
caggcgcggaucacuuucaauu

SEQ ID NO: 31897 - RNA, 22 nt, Pseudomonas aeruginosa PA01
caggcgcggcguuuuccccgag

SEQ ID NO: 31898 - RNA, 22 nt, Pseudomonas aeruginosa PA01
caggcgcugcaugauccacagu

SEQ ID NO: 31899 - RNA, 22 nt, Pseudomonas aeruginosa PA01
caggcgcugggcgucugguucg

SEQ ID NO: 31900 - RNA, 22 nt, Pseudomonas aeruginosa PA01
caggcggaaguuaucgagcccg

SEQ ID NO: 31901 - RNA, 22 nt, Pseudomonas aeruginosa PA01
caggcgguacgcagcggucgcu

SEQ ID NO: 31902 - RNA, 22 nt, Pseudomonas aeruginosa PA01
caggcgguagucgcggccgauc

SEQ ID NO: 31903 - RNA, 22 nt, Pseudomonas aeruginosa PA01
caggcucgcucguucagcuuuc

SEQ ID NO: 31904 - RNA, 22 nt, Pseudomonas aeruginosa PA01
cagggccagcaacugauggccg

SEQ ID NO: 31905 - RNA, 22 nt, Pseudomonas aeruginosa PA01
cagggcguugucgccggccgag

SEQ ID NO: 31906 - RNA, 22 nt, Pseudomonas aeruginosa PA01
cagggcuacggcgagcguaccg

SEQ ID NO: 31907 - RNA, 22 nt, Pseudomonas aeruginosa PA01
caggggugccuugccaaggugu

SEQ ID NO: 31908 - RNA, 22 nt, Pseudomonas aeruginosa PA01
caggucgaugcgcgcauugugg

SEQ ID NO: 31909 - RNA, 22 nt, Pseudomonas aeruginosa PA01
caggugauccucaacguggugg

SEQ ID NO: 31910 - RNA, 22 nt, Pseudomonas aeruginosa PA01
caggugcaccgccugcgcgaua

SEQ ID NO: 31911 - RNA, 22 nt, Pseudomonas aeruginosa PA01
caggugcuguucagcggcaggu

SEQ ID NO: 31912 - RNA, 21 nt, Pseudomonas aeruginosa PA01
cagguucauggugugcuggcg

SEQ ID NO: 31913 - RNA, 22 nt, Pseudomonas aeruginosa PA01
cagguugugcaggugccacuug

SEQ ID NO: 31914 - RNA, 22 nt, Pseudomonas aeruginosa PA01
caguccuggcggguuucggcgg

SEQ ID NO: 31915 - RNA, 22 nt, Pseudomonas aeruginosa PA01
cagucgacgcuguccagccggc

SEQ ID NO: 31916 - RNA, 22 nt, Pseudomonas aeruginosa PA01
cagucgagucgccgccucgaac

SEQ ID NO: 31917 - RNA, 22 nt, Pseudomonas aeruginosa PA01
cagucgguggccaccgccaccg

SEQ ID NO: 31918 - RNA, 22 nt, Pseudomonas aeruginosa PA01
caucacuucgauguuggucagg

SEQ ID NO: 31919 - RNA, 22 nt, Pseudomonas aeruginosa PA01
cauccggcggacagcccgcccc

SEQ ID NO: 31920 - RNA, 22 nt, Pseudomonas aeruginosa PA01
caucgccgaaggggcgaagaag

SEQ ID NO: 31921 - RNA, 22 nt, Pseudomonas aeruginosa PA01
caucuucaauacugaaaccagc

SEQ ID NO: 31922 - RNA, 22 nt, Pseudomonas aeruginosa PA01
cauucgcaccucgugcucgacg

SEQ ID NO: 31923 - RNA, 22 nt, Pseudomonas aeruginosa PA01
ccaccuacaucggccugcgccu

SEQ ID NO: 31924 - RNA, 22 nt, Pseudomonas aeruginosa PA01
ccacgcuuccuccucgcugcca

SEQ ID NO: 31925 - RNA, 22 nt, Pseudomonas aeruginosa PA01
ccacguggguugggaugugcca

SEQ ID NO: 31926 - RNA, 22 nt, Pseudomonas aeruginosa PA01
ccagaacugcuuggagaucucg

SEQ ID NO: 31927 - RNA, 22 nt, Pseudomonas aeruginosa PA01
ccagcgccuggaccuccaggcc

SEQ ID NO: 31928 - RNA, 22 nt, Pseudomonas aeruginosa PA01
ccagcgcugccaggccuggcgc

SEQ ID NO: 31929 - RNA, 22 nt, Pseudomonas aeruginosa PA01
ccagcucgcccaugcgggucau

SEQ ID NO: 31930 - RNA, 22 nt, Pseudomonas aeruginosa PA01
ccaggcacuguuggcgugguaa

SEQ ID NO: 31931 - RNA, 22 nt, Pseudomonas aeruginosa PA01
ccaggccgccagccguucggcc

SEQ ID NO: 31932 - RNA, 22 nt, Pseudomonas aeruginosa PA01
ccaggcggauguucagcggccg

SEQ ID NO: 31933 - RNA, 22 nt, Pseudomonas aeruginosa PA01
ccagggugccgcgcaucugcaa

SEQ ID NO: 31934 - RNA, 22 nt, Pseudomonas aeruginosa PA01
ccaguuggagcgcgccggcgac

SEQ ID NO: 31935 - RNA, 20 nt, Pseudomonas aeruginosa PA01
ccauaugagugagcuggcca

SEQ ID NO: 31936 - RNA, 22 nt, Pseudomonas aeruginosa PA01
ccaucaccaccaggaucacgaa

SEQ ID NO: 31937 - RNA, 19 nt, Pseudomonas aeruginosa PA01
ccauccauccgagagagac

SEQ ID NO: 31938 - RNA, 23 nt, Pseudomonas aeruginosa PA01
ccaugcccggcugaucgccgaga

SEQ ID NO: 31939 - RNA, 22 nt, Pseudomonas aeruginosa PA01
ccaugcucuuguguugcagcga

SEQ ID NO: 31940 - RNA, 22 nt, Pseudomonas aeruginosa PA01
ccaugucgugcuccaccaccau

SEQ ID NO: 31941 - RNA, 22 nt, Pseudomonas aeruginosa PA01
cccacccuggaagcgcugaucg

SEQ ID NO: 31942 - RNA, 22 nt, Pseudomonas aeruginosa PA01
cccacgggugaucuucgccucg

SEQ ID NO: 31943 - RNA, 21 nt, Pseudomonas aeruginosa PA01
cccaggggcccggugaccagc

SEQ ID NO: 31944 - RNA, 22 nt, Pseudomonas aeruginosa PA01
cccaugacguucgagcgccugu

SEQ ID NO: 31945 - RNA, 22 nt, Pseudomonas aeruginosa PA01
cccauuccuugcugucgugccc

SEQ ID NO: 31946 - RNA, 22 nt, Pseudomonas aeruginosa PA01
ccccagguguucggcaucggcc

SEQ ID NO: 31947 - RNA, 22 nt, Pseudomonas aeruginosa PA01
cccgaagacccagagcgcuggc

SEQ ID NO: 31948 - RNA, 22 nt, Pseudomonas aeruginosa PA01
cccgcgccacgaggaacgcgug

SEQ ID NO: 31949 - RNA, 22 nt, Pseudomonas aeruginosa PA01
cccggccauguccuccagcgac

SEQ ID NO: 31950 - RNA, 22 nt, Pseudomonas aeruginosa PA01
cccggccugccuggacgcgcug

SEQ ID NO: 31951 - RNA, 22 nt, Pseudomonas aeruginosa PA01
cccggccuucggcgcuucuggc

SEQ ID NO: 31952 - RNA, 22 nt, Pseudomonas aeruginosa PA01
cccggcgcagaugcgcgucgau

SEQ ID NO: 31953 - RNA, 22 nt, Pseudomonas aeruginosa PA01
cccggcgucuacguggucgccg

SEQ ID NO: 31954 - RNA, 22 nt, Pseudomonas aeruginosa PA01
ccucggccgcaucgucgaucuc

SEQ ID NO: 31955 - RNA, 22 nt, Pseudomonas aeruginosa PA01
ccucuccggcgacgaggccaag

SEQ ID NO: 31956 - RNA, 22 nt, Pseudomonas aeruginosa PA01
ccugagcguuucgugggagaua

SEQ ID NO: 31957 - RNA, 22 nt, Pseudomonas aeruginosa PA01
ccugccgccgguggacgugcug

SEQ ID NO: 31958 - RNA, 20 nt, Pseudomonas aeruginosa PA01
ccugccgcgcaucuucgauc

SEQ ID NO: 31959 - RNA, 23 nt, Pseudomonas aeruginosa PA01
ccugcuccgcgauugccugggcg

SEQ ID NO: 31960 - RNA, 22 nt, Pseudomonas aeruginosa PA01
ccugcugagcagccuggacgcc

SEQ ID NO: 31961 - RNA, 22 nt, Pseudomonas aeruginosa PA01
ccugcugccggacucuuucgaa

SEQ ID NO: 31962 - RNA, 22 nt, Pseudomonas aeruginosa PA01
ccugcuggcacguggccccggu

SEQ ID NO: 31963 - RNA, 22 nt, Pseudomonas aeruginosa PA01
ccugcuguugucgcgccagggc

SEQ ID NO: 31964 - RNA, 22 nt, Pseudomonas aeruginosa PA01
ccugcuugucgaugucgagggu

SEQ ID NO: 31965 - RNA, 22 nt, Pseudomonas aeruginosa PA01
ccuggacuuccugcucggcgac

SEQ ID NO: 31966 - RNA, 22 nt, Pseudomonas aeruginosa PA01
ccuggagagcaucgggcgucgc

SEQ ID NO: 31967 - RNA, 22 nt, Pseudomonas aeruginosa PA01
ccuggcccaggugcugcagcca

SEQ ID NO: 31968 - RNA, 22 nt, Pseudomonas aeruginosa PA01
ccuggccgaggcgcggcggguc

SEQ ID NO: 31969 - RNA, 22 nt, Pseudomonas aeruginosa PA01
ccuggcgccguucgucgccaac

SEQ ID NO: 31970 - RNA, 18 nt, Pseudomonas aeruginosa PA01
ccuggcgcggguccgcuu

SEQ ID NO: 31971 - RNA, 22 nt, Pseudomonas aeruginosa PA01
ccuggcggugcuggagcuggcg

SEQ ID NO: 31972 - RNA, 22 nt, Pseudomonas aeruginosa PA01
ccugggcccguuccuggagggc

SEQ ID NO: 31973 - RNA, 22 nt, Pseudomonas aeruginosa PA01
ccuggucgacgucggcaagacc

SEQ ID NO: 31974 - RNA, 22 nt, Pseudomonas aeruginosa PA01
ccuggugcugcuggccggcaug

SEQ ID NO: 31975 - RNA, 19 nt, Pseudomonas aeruginosa PA01
ccugguucagcuccggccu

SEQ ID NO: 31976 - RNA, 22 nt, Pseudomonas aeruginosa PA01
ccuguccuucggcggcgacgaa

SEQ ID NO: 31977 - RNA, 22 nt, Pseudomonas aeruginosa PA01
ccuuccaggccccagaccgagu

SEQ ID NO: 31978 - RNA, 22 nt, Pseudomonas aeruginosa PA01
ccuucggaccgacccucgcugc

SEQ ID NO: 31979 - RNA, 22 nt, Pseudomonas aeruginosa PA01
ccuuguggucacugccuggagc

SEQ ID NO: 31980 - RNA, 22 nt, Pseudomonas aeruginosa PA01
cgaagagcccgaacgcuuccgg

SEQ ID NO: 31981 - RNA, 22 nt, Pseudomonas aeruginosa PA01
cgaagcgcugguucagggaggc

SEQ ID NO: 31982 - RNA, 22 nt, Pseudomonas aeruginosa PA01
cgaaggucacgucgacgcaggg

SEQ ID NO: 31983 - RNA, 22 nt, Pseudomonas aeruginosa PA01
cgaaggucgcgcauaccgugcg

SEQ ID NO: 31984 - RNA, 22 nt, Pseudomonas aeruginosa PA01
cgaagugcuggaacagguccgc

SEQ ID NO: 31985 - RNA, 22 nt, Pseudomonas aeruginosa PA01
cgacaagggcagcguguccguc

SEQ ID NO: 31986 - RNA, 16 nt, Pseudomonas aeruginosa PA01
cgacaccucuggccgc

SEQ ID NO: 31987 - RNA, 22 nt, Pseudomonas aeruginosa PA01
cgacagagcgugcucgggccgc

SEQ ID NO: 31988 - RNA, 22 nt, Pseudomonas aeruginosa PA01
cgaccccggccuucuugcccga

SEQ ID NO: 31989 - RNA, 22 nt, Pseudomonas aeruginosa PA01
cgacccgccaggcgcugggcga

SEQ ID NO: 31990 - RNA, 22 nt, Pseudomonas aeruginosa PA01
cgacgaagacgccacgggccuc

SEQ ID NO: 31991 - RNA, 22 nt, Pseudomonas aeruginosa PA01
cgacgacagcgccgaucagccg

SEQ ID NO: 31992 - RNA, 22 nt, Pseudomonas aeruginosa PA01
cgacgaugcuggccggguugaa

SEQ ID NO: 31993 - RNA, 20 nt, Pseudomonas aeruginosa PA01
cgacgcucagcucguugggc

SEQ ID NO: 31994 - RNA, 20 nt, Pseudomonas aeruginosa PA01
cgacggcaaggccggccucg

SEQ ID NO: 31995 - RNA, 19 nt, Pseudomonas aeruginosa PA01
cgacggcaccuggaucacc

SEQ ID NO: 31996 - RNA, 22 nt, Pseudomonas aeruginosa PA01
cgacggugaaaccggguuugcg

SEQ ID NO: 31997 - RNA, 22 nt, Pseudomonas aeruginosa PA01
cgacuaccccguggucgccggc

SEQ ID NO: 31998 - RNA, 22 nt, Pseudomonas aeruginosa PA01
cgagauggaaguucgcgaucug

SEQ ID NO: 31999 - RNA, 22 nt, Pseudomonas aeruginosa PA01
cgagcaccaucgacaggaccug

SEQ ID NO: 32000 - RNA, 22 nt, Pseudomonas aeruginosa PA01
cgagcgcuuccugaggcgcgua

SEQ ID NO: 32001 - RNA, 22 nt, Pseudomonas aeruginosa PA01
cgagcgucagcccgcuggucag

SEQ ID NO: 32002 - RNA, 22 nt, Pseudomonas aeruginosa PA01
cgaggccggcguggcgaaguag

SEQ ID NO: 32003 - RNA, 17 nt, Pseudomonas aeruginosa PA01
cgaggcgcuggugaaca

SEQ ID NO: 32004 - RNA, 22 nt, Pseudomonas aeruginosa PA01
cgagggaagacgcgaccggggu

SEQ ID NO: 32005 - RNA, 22 nt, Pseudomonas aeruginosa PA01
cgagucgaagaucggcagcagg

SEQ ID NO: 32006 - RNA, 22 nt, Pseudomonas aeruginosa PA01
cgaguugcgucucgucgucgag

SEQ ID NO: 32007 - RNA, 22 nt, Pseudomonas aeruginosa PA01
cgaucacccgcggcagccgcug

SEQ ID NO: 32008 - RNA, 22 nt, Pseudomonas aeruginosa PA01
cgaucgauacggccuucgaggu

SEQ ID NO: 32009 - RNA, 22 nt, Pseudomonas aeruginosa PA01
cgaucggcaccacgaucaucuu

SEQ ID NO: 32010 - RNA, 22 nt, Pseudomonas aeruginosa PA01
cgaucugcgacauuuccugcgc

SEQ ID NO: 32011 - RNA, 22 nt, Pseudomonas aeruginosa PA01
cgaugagcaggaagguggugcg

SEQ ID NO: 32012 - RNA, 22 nt, Pseudomonas aeruginosa PA01
cgaugcccagugccagcaggca

SEQ ID NO: 32013 - RNA, 22 nt, Pseudomonas aeruginosa PA01
cgaugcccugcacggccuggua

SEQ ID NO: 32014 - RNA, 22 nt, Pseudomonas aeruginosa PA01
cgauggucgcgaucagccccag

SEQ ID NO: 32015 - RNA, 22 nt, Pseudomonas aeruginosa PA01
cgcaagcuguucgccgggcgcc

SEQ ID NO: 32016 - RNA, 22 nt, Pseudomonas aeruginosa PA01
cgcaaggcuuuucggaaaaauu

SEQ ID NO: 32017 - RNA, 22 nt, Pseudomonas aeruginosa PA01
cgcacccagccccaggcgcgac

SEQ ID NO: 32018 - RNA, 22 nt, Pseudomonas aeruginosa PA01
cgcaccucaaaggggaucacgg

SEQ ID NO: 32019 - RNA, 22 nt, Pseudomonas aeruginosa PA01
cgcacgccgcggagacggccuu

SEQ ID NO: 32020 - RNA, 22 nt, Pseudomonas aeruginosa PA01
cgcacgccguugccgaugcuga

SEQ ID NO: 32021 - RNA, 19 nt, Pseudomonas aeruginosa PA01
cgcagcggcgagaucggcc

SEQ ID NO: 32022 - RNA, 22 nt, Pseudomonas aeruginosa PA01
cgcaggaaugucguuggucuca

SEQ ID NO: 32023 - RNA, 20 nt, Pseudomonas aeruginosa PA01
cgcaggucggccuuggcgca

SEQ ID NO: 32024 - RNA, 22 nt, Pseudomonas aeruginosa PA01
cgcagguugaggaugguggcga

SEQ ID NO: 32025 - RNA, 21 nt, Pseudomonas aeruginosa PA01
cgcaguggaaaucaucgaugg

SEQ ID NO: 32026 - RNA, 22 nt, Pseudomonas aeruginosa PA01
cgcauuaucuggaacucgcgga

SEQ ID NO: 32027 - RNA, 22 nt, Pseudomonas aeruginosa PA01
cgccaaggagggagugagcgac

SEQ ID NO: 32028 - RNA, 21 nt, Pseudomonas aeruginosa PA01
cgccaccaguuguucgugacc

SEQ ID NO: 32029 - RNA, 22 nt, Pseudomonas aeruginosa PA01
cgccaccaugaucaagccuucc

SEQ ID NO: 32030 - RNA, 22 nt, Pseudomonas aeruginosa PA01
cgccaccuggcuggugccgcgc

SEQ ID NO: 32031 - RNA, 22 nt, Pseudomonas aeruginosa PA01
cgccacgguguccggcagcaug

SEQ ID NO: 32032 - RNA, 22 nt, Pseudomonas aeruginosa PA01
cgccagcuguagcgcaggcguu

SEQ ID NO: 32033 - RNA, 22 nt, Pseudomonas aeruginosa PA01
cgccaggccgaccagagcacca

SEQ ID NO: 32034 - RNA, 22 nt, Pseudomonas aeruginosa PA01
cgccagggcgccgaucagcucg

SEQ ID NO: 32035 - RNA, 19 nt, Pseudomonas aeruginosa PA01
cgccaucagcgcgggcauc

SEQ ID NO: 32036 - RNA, 22 nt, Pseudomonas aeruginosa PA01
cgccaucggugccucggccggc

SEQ ID NO: 32037 - RNA, 22 nt, Pseudomonas aeruginosa PA01
cgccaugagcgugccggaggcg

SEQ ID NO: 32038 - RNA, 22 nt, Pseudomonas aeruginosa PA01
cggcgugcaccaccggaucggu

SEQ ID NO: 32039 - RNA, 23 nt, Pseudomonas aeruginosa PA01
cggcuacggccuggagaucgacc

SEQ ID NO: 32040 - RNA, 22 nt, Pseudomonas aeruginosa PA01
cggcuccaucacguucaguugc

SEQ ID NO: 32041 - RNA, 22 nt, Pseudomonas aeruginosa PA01
cggcuucgcgcagguauucggu

SEQ ID NO: 32042 - RNA, 22 nt, Pseudomonas aeruginosa PA01
cggcuuguccagcagggucagc

SEQ ID NO: 32043 - RNA, 22 nt, Pseudomonas aeruginosa PA01
cgggagcaacgcuaugcccggc

SEQ ID NO: 32044 - RNA, 22 nt, Pseudomonas aeruginosa PA01
cgggaugugcaggugcucggcg

SEQ ID NO: 32045 - RNA, 22 nt, Pseudomonas aeruginosa PA01
cgggccagaccaggacgucgcc

SEQ ID NO: 32046 - RNA, 22 nt, Pseudomonas aeruginosa PA01
cgggccgcgacggccgcccagg

SEQ ID NO: 32047 - RNA, 22 nt, Pseudomonas aeruginosa PA01
cgggccugcggaugccugagca

SEQ ID NO: 32048 - RNA, 22 nt, Pseudomonas aeruginosa PA01
cgggcgacgacacuccgaucau

SEQ ID NO: 32049 - RNA, 22 nt, Pseudomonas aeruginosa PA01
cgggcggccgaacagauagccu

SEQ ID NO: 32050 - RNA, 22 nt, Pseudomonas aeruginosa PA01
cgggcguggugaccaggaugug

SEQ ID NO: 32051 - RNA, 22 nt, Pseudomonas aeruginosa PA01
cggggagccucgucgacgaggc

SEQ ID NO: 32052 - RNA, 22 nt, Pseudomonas aeruginosa PA01
cgggguccugcgccuggcugac

SEQ ID NO: 32053 - RNA, 22 nt, Pseudomonas aeruginosa PA01
cgggguguacaccacggugguc

SEQ ID NO: 32054 - RNA, 20 nt, Pseudomonas aeruginosa PA01
cgggucaagcaacucgacga

SEQ ID NO: 32055 - RNA, 22 nt, Pseudomonas aeruginosa PA01
cggguccugucgauccauggcg

SEQ ID NO: 32056 - RNA, 22 nt, Pseudomonas aeruginosa PA01
cgggucgacggccacgaccgcc

SEQ ID NO: 32057 - RNA, 22 nt, Pseudomonas aeruginosa PA01
cgggucgucgaacagcgugcgc

SEQ ID NO: 32058 - RNA, 21 nt, Pseudomonas aeruginosa PA01
cgggucgucgcuguccggcag

SEQ ID NO: 32059 - RNA, 22 nt, Pseudomonas aeruginosa PA01
cgggugcugaugagccggcgga

SEQ ID NO: 32060 - RNA, 22 nt, Pseudomonas aeruginosa PA01
cggguggaagucgcugaccgcc

SEQ ID NO: 32061 - RNA, 22 nt, Pseudomonas aeruginosa PA01
cggguggucuucgagcguccgc

SEQ ID NO: 32062 - RNA, 22 nt, Pseudomonas aeruginosa PA01
cggguucauggucuucagcgcc

SEQ ID NO: 32063 - RNA, 22 nt, Pseudomonas aeruginosa PA01
cgguacuguuccucggcgaggc

SEQ ID NO: 32064 - RNA, 22 nt, Pseudomonas aeruginosa PA01
cgguaggcguggccaccagccu

SEQ ID NO: 32065 - RNA, 22 nt, Pseudomonas aeruginosa PA01
cggucaacuaccaauucuggaa

SEQ ID NO: 32066 - RNA, 22 nt, Pseudomonas aeruginosa PA01
cggucgguguaggugcucuuga

SEQ ID NO: 32067 - RNA, 22 nt, Pseudomonas aeruginosa PA01
cggugccgaaaucguuuccuuc

SEQ ID NO: 32068 - RNA, 22 nt, Pseudomonas aeruginosa PA01
cgguggacuggcacuggcuggc

SEQ ID NO: 32069 - RNA, 22 nt, Pseudomonas aeruginosa PA01
cggugggaagccgacuucgucg

SEQ ID NO: 32070 - RNA, 23 nt, Pseudomonas aeruginosa PA01
cggugggcgccggccauggccuc

SEQ ID NO: 32071 - RNA, 22 nt, Pseudomonas aeruginosa PA01
cgguggucggcuauccggcgcg

SEQ ID NO: 32072 - RNA, 22 nt, Pseudomonas aeruginosa PA01
cgguguagcccucuacgaucac

SEQ ID NO: 32073 - RNA, 22 nt, Pseudomonas aeruginosa PA01
cgguucagaaacuggccggcgc

SEQ ID NO: 32074 - RNA, 22 nt, Pseudomonas aeruginosa PA01
cgguuggucgaugcaggugaug

SEQ ID NO: 32075 - RNA, 22 nt, Pseudomonas aeruginosa PA01
cguacgcacauggaauggacuc

SEQ ID NO: 32076 - RNA, 22 nt, Pseudomonas aeruginosa PA01
cguagcaaucccgguugaucag

SEQ ID NO: 32077 - RNA, 22 nt, Pseudomonas aeruginosa PA01
cguaucgacgcucugcagguuc

SEQ ID NO: 32078 - RNA, 22 nt, Pseudomonas aeruginosa PA01
cgucauccagcaggcaggcguc

SEQ ID NO: 32079 - RNA, 23 nt, Pseudomonas aeruginosa PA01
cguccggacgacgacccggcguu

SEQ ID NO: 32080 - RNA, 23 nt, Pseudomonas aeruginosa PA01
cguccuucugcucggccagcagg

SEQ ID NO: 32081 - RNA, 22 nt, Pseudomonas aeruginosa PA01
cgucgccggugaacugggcgac

SEQ ID NO: 32082 - RNA, 22 nt, Pseudomonas aeruginosa PA01
cgucgcggaggauguacuggaa

SEQ ID NO: 32083 - RNA, 22 nt, Pseudomonas aeruginosa PA01
cgucgcuguugcucucgugggu

SEQ ID NO: 32084 - RNA, 22 nt, Pseudomonas aeruginosa PA01
cgucguccaucucgcagcgguc

SEQ ID NO: 32085 - RNA, 22 nt, Pseudomonas aeruginosa PA01
cgucuagccgcccgccggccag

SEQ ID NO: 32086 - RNA, 22 nt, Pseudomonas aeruginosa PA01
cgugaccaagccgcuggcgcug

SEQ ID NO: 32087 - RNA, 22 nt, Pseudomonas aeruginosa PA01
cgugaccuacauccugaccuuc

SEQ ID NO: 32088 - RNA, 22 nt, Pseudomonas aeruginosa PA01
cguggacuggcgcggaucgcga

SEQ ID NO: 32089 - RNA, 22 nt, Pseudomonas aeruginosa PA01
cguggaggagauccggggcggu

SEQ ID NO: 32090 - RNA, 22 nt, Pseudomonas aeruginosa PA01
cguggcaucguugccgacgauc

SEQ ID NO: 32091 - RNA, 22 nt, Pseudomonas aeruginosa PA01
cguggcgaugucggcguggccg

SEQ ID NO: 32092 - RNA, 22 nt, Pseudomonas aeruginosa PA01
cguguucgauccacagcaggcc

SEQ ID NO: 32093 - RNA, 19 nt, Pseudomonas aeruginosa PA01
cguuccggcgcuguucguc

SEQ ID NO: 32094 - RNA, 22 nt, Pseudomonas aeruginosa PA01
cguucggaccucagcgucggca

SEQ ID NO: 32095 - RNA, 22 nt, Pseudomonas aeruginosa PA01
cuaccggagccaggccgaaauc

SEQ ID NO: 32096 - RNA, 21 nt, Pseudomonas aeruginosa PA01
cucaccugccugucggucggc

SEQ ID NO: 32097 - RNA, 20 nt, Pseudomonas aeruginosa PA01
cucacgcgggugcgccgcag

SEQ ID NO: 32098 - RNA, 22 nt, Pseudomonas aeruginosa PA01
cucagcaguaccuggucgagga

SEQ ID NO: 32099 - RNA, 22 nt, Pseudomonas aeruginosa PA01
cuccagccuggccauccagugg

SEQ ID NO: 32100 - RNA, 20 nt, Pseudomonas aeruginosa PA01
cuccccgggccauuuccugc

SEQ ID NO: 32101 - RNA, 22 nt, Pseudomonas aeruginosa PA01
cuccggcgugaucagggucucg

SEQ ID NO: 32102 - RNA, 22 nt, Pseudomonas aeruginosa PA01
cuccugcggcaugggugcguuc

SEQ ID NO: 32103 - RNA, 22 nt, Pseudomonas aeruginosa PA01
cuccuuggcuucgcccggaccg

SEQ ID NO: 32104 - RNA, 22 nt, Pseudomonas aeruginosa PA01
cucgaugauguucggcgagucc

SEQ ID NO: 32105 - RNA, 18 nt, Pseudomonas aeruginosa PA01
cucgcccugcagucgggu

SEQ ID NO: 32106 - RNA, 22 nt, Pseudomonas aeruginosa PA01
cucgccggcgccaugcagcagc

SEQ ID NO: 32107 - RNA, 20 nt, Pseudomonas aeruginosa PA01
cucgccuacgaacaccgcgu

SEQ ID NO: 32108 - RNA, 22 nt, Pseudomonas aeruginosa PA01
cucggccugauccguacacgcu

SEQ ID NO: 32109 - RNA, 22 nt, Pseudomonas aeruginosa PA01
cucggccugcugccgggccggg

SEQ ID NO: 32110 - RNA, 22 nt, Pseudomonas aeruginosa PA01
cucggccuggucgucguagugg

SEQ ID NO: 32111 - RNA, 22 nt, Pseudomonas aeruginosa PA01
cucggcgucgagaucgccggcc

SEQ ID NO: 32112 - RNA, 22 nt, Pseudomonas aeruginosa PA01
cucgguagccgcgcucugcgug

SEQ ID NO: 32113 - RNA, 22 nt, Pseudomonas aeruginosa PA01
cucggucucgucgccguggcgg

SEQ ID NO: 32114 - RNA, 22 nt, Pseudomonas aeruginosa PA01
cucggugccaccgccggugcga

SEQ ID NO: 32115 - RNA, 20 nt, Pseudomonas aeruginosa PA01
cucuacaucgccuucggcgc

SEQ ID NO: 32116 - RNA, 23 nt, Pseudomonas aeruginosa PA01
cucugcuucggcuucuggcccgg

SEQ ID NO: 32117 - RNA, 22 nt, Pseudomonas aeruginosa PA01
cugaaagcugucccaagaccuu

SEQ ID NO: 32118 - RNA, 22 nt, Pseudomonas aeruginosa PA01
cugaccagguucagguagcgcg

SEQ ID NO: 32119 - RNA, 22 nt, Pseudomonas aeruginosa PA01
cugaucgucgcgcugaucgagg

SEQ ID NO: 32120 - RNA, 22 nt, Pseudomonas aeruginosa PA01
cugcaucacccgcucguggucc

SEQ ID NO: 32121 - RNA, 22 nt, Pseudomonas aeruginosa PA01
gacgcugcugccguccggcgcc

SEQ ID NO: 32122 - RNA, 22 nt, Pseudomonas aeruginosa PA01
gacgcugcuggcgccagaggaa

SEQ ID NO: 32123 - RNA, 22 nt, Pseudomonas aeruginosa PA01
gacggccgguugcugcagacgg

SEQ ID NO: 32124 - RNA, 22 nt, Pseudomonas aeruginosa PA01
gacguguugcagcaggcuggca

SEQ ID NO: 32125 - RNA, 22 nt, Pseudomonas aeruginosa PA01
gacuggcgguagccgcccuccu

SEQ ID NO: 32126 - RNA, 22 nt, Pseudomonas aeruginosa PA01
gagagcugcucgggauagcggu

SEQ ID NO: 32127 - RNA, 22 nt, Pseudomonas aeruginosa PA01
gagaucaggucgaucuugcuga

SEQ ID NO: 32128 - RNA, 22 nt, Pseudomonas aeruginosa PA01
gagaucuggaagagcgugcuga

SEQ ID NO: 32129 - RNA, 21 nt, Pseudomonas aeruginosa PA01
gagcagcucgggcggcgcgac

SEQ ID NO: 32130 - RNA, 22 nt, Pseudomonas aeruginosa PA01
gagccgcuggcguucgucgcgg

SEQ ID NO: 32131 - RNA, 22 nt, Pseudomonas aeruginosa PA01
gagcgacguacaacagaugcug

SEQ ID NO: 32132 - RNA, 22 nt, Pseudomonas aeruginosa PA01
gagcgccaggugauccucggca

SEQ ID NO: 32133 - RNA, 22 nt, Pseudomonas aeruginosa PA01
gagcgcgacgaguugcagcucu

SEQ ID NO: 32134 - RNA, 22 nt, Pseudomonas aeruginosa PA01
gagcggcugaaccucggucugc

SEQ ID NO: 32135 - RNA, 22 nt, Pseudomonas aeruginosa PA01
gagcggugcgcuuggucuuacc

SEQ ID NO: 32136 - RNA, 22 nt, Pseudomonas aeruginosa PA01
gagcgucucaugcagguggucg

SEQ ID NO: 32137 - RNA, 22 nt, Pseudomonas aeruginosa PA01
gagcugcgcgaagcgcuggacg

SEQ ID NO: 32138 - RNA, 22 nt, Pseudomonas aeruginosa PA01
gagcuggaagugcucgcggugc

SEQ ID NO: 32139 - RNA, 22 nt, Pseudomonas aeruginosa PA01
gagcugucgaaggucuccuggg

SEQ ID NO: 32140 - RNA, 22 nt, Pseudomonas aeruginosa PA01
gaggccaggaucgaggaggccg

SEQ ID NO: 32141 - RNA, 22 nt, Pseudomonas aeruginosa PA01
gaggccgagguagucgagggcg

SEQ ID NO: 32142 - RNA, 22 nt, Pseudomonas aeruginosa PA01
gaggcgccggaaugggucgccg

SEQ ID NO: 32143 - RNA, 22 nt, Pseudomonas aeruginosa PA01
gaggcgcgcgggcugcucaacc

SEQ ID NO: 32144 - RNA, 22 nt, Pseudomonas aeruginosa PA01
gaggcggcgcgacgggugaugg

SEQ ID NO: 32145 - RNA, 22 nt, Pseudomonas aeruginosa PA01
gaggcgggaguauccggauggc

SEQ ID NO: 32146 - RNA, 22 nt, Pseudomonas aeruginosa PA01
gaggcguugaccaucaccgaag

SEQ ID NO: 32147 - RNA, 22 nt, Pseudomonas aeruginosa PA01
gaggcguugcccgacgaugucc

SEQ ID NO: 32148 - RNA, 22 nt, Pseudomonas aeruginosa PA01
gaggguaagugucgcuaaaggu

SEQ ID NO: 32149 - RNA, 22 nt, Pseudomonas aeruginosa PA01
gaggucgaucuggcccuugacc

SEQ ID NO: 32150 - RNA, 22 nt, Pseudomonas aeruginosa PA01
gagguggagagauagccggcgu

SEQ ID NO: 32151 - RNA, 22 nt, Pseudomonas aeruginosa PA01
gagucgcuccugcagccggugg

SEQ ID NO: 32152 - RNA, 22 nt, Pseudomonas aeruginosa PA01
gagugccucgcgcugaaaagga

SEQ ID NO: 32153 - RNA, 22 nt, Pseudomonas aeruginosa PA01
gaguugcucggugcuggcgcgg

SEQ ID NO: 32154 - RNA, 22 nt, Pseudomonas aeruginosa PA01
gaucaacgggcagaaggugugg

SEQ ID NO: 32155 - RNA, 22 nt, Pseudomonas aeruginosa PA01
gaucaaugccguacgcuacgcc

SEQ ID NO: 32156 - RNA, 22 nt, Pseudomonas aeruginosa PA01
gaucagucuuccuggcgcaggu

SEQ ID NO: 32157 - RNA, 22 nt, Pseudomonas aeruginosa PA01
gauccaguucggcgcgcagcga

SEQ ID NO: 32158 - RNA, 22 nt, Pseudomonas aeruginosa PA01
gauccccugggcgucguugcgg

SEQ ID NO: 32159 - RNA, 22 nt, Pseudomonas aeruginosa PA01
gaucgaggcggcggccacgcuc

SEQ ID NO: 32160 - RNA, 22 nt, Pseudomonas aeruginosa PA01
gaucgccccgcgcugucuugca

SEQ ID NO: 32161 - RNA, 22 nt, Pseudomonas aeruginosa PA01
gaucgcucggcgggguuucgcu

SEQ ID NO: 32162 - RNA, 22 nt, Pseudomonas aeruginosa PA01
gaucggcggugugcucgagacc

SEQ ID NO: 32163 - RNA, 22 nt, Pseudomonas aeruginosa PA01
gaugaucaggcggucggcaucg

SEQ ID NO: 32164 - RNA, 22 nt, Pseudomonas aeruginosa PA01
gaugauccgcuccugcucgccg

SEQ ID NO: 32165 - RNA, 22 nt, Pseudomonas aeruginosa PA01
gaugaucucgaccaggucuggc

SEQ ID NO: 32166 - RNA, 22 nt, Pseudomonas aeruginosa PA01
gaugccuacuacgugucgccgg

SEQ ID NO: 32167 - RNA, 22 nt, Pseudomonas aeruginosa PA01
gaugcggcgcugacgauacagg

SEQ ID NO: 32168 - RNA, 22 nt, Pseudomonas aeruginosa PA01
gauggacgugcauggccgggcc

SEQ ID NO: 32169 - RNA, 22 nt, Pseudomonas aeruginosa PA01
gauggcgaagauguucgcaucg

SEQ ID NO: 32170 - RNA, 22 nt, Pseudomonas aeruginosa PA01
gauggucucguuggcgcccacc

SEQ ID NO: 32171 - RNA, 22 nt, Pseudomonas aeruginosa PA01
gaugucgagaaaggcaugagcc

SEQ ID NO: 32172 - RNA, 22 nt, Pseudomonas aeruginosa PA01
gaugugcagcggcuccagggcc

SEQ ID NO: 32173 - RNA, 22 nt, Pseudomonas aeruginosa PA01
gauucccuggcuggcgcugagc

SEQ ID NO: 32174 - RNA, 18 nt, Pseudomonas aeruginosa PA01
gcaccacggaagaugaag

SEQ ID NO: 32175 - RNA, 22 nt, Pseudomonas aeruginosa PA01
gcaccugaaggccuccggcaac

SEQ ID NO: 32176 - RNA, 22 nt, Pseudomonas aeruginosa PA01
gcacuggaauggccggccgcgc

SEQ ID NO: 32177 - RNA, 22 nt, Pseudomonas aeruginosa PA01
gcacuucgaacuggccgccgac

SEQ ID NO: 32178 - RNA, 22 nt, Pseudomonas aeruginosa PA01
gcagaaguccucguggaccagg

SEQ ID NO: 32179 - RNA, 23 nt, Pseudomonas aeruginosa PA01
gcagcaccagcaguucguccugc

SEQ ID NO: 32180 - RNA, 22 nt, Pseudomonas aeruginosa PA01
gcagcagugcggccggaccgag

SEQ ID NO: 32181 - RNA, 22 nt, Pseudomonas aeruginosa PA01
gcagccgcgcacugaucgucgg

SEQ ID NO: 32182 - RNA, 22 nt, Pseudomonas aeruginosa PA01
gcagcgaguagccgauccccgg

SEQ ID NO: 32183 - RNA, 22 nt, Pseudomonas aeruginosa PA01
gcagcgcauacagaacuugcga

SEQ ID NO: 32184 - RNA, 22 nt, Pseudomonas aeruginosa PA01
gcagcuggaaguugucaacgaa

SEQ ID NO: 32185 - RNA, 22 nt, Pseudomonas aeruginosa PA01
gcagcuugucgugcugggcgag

SEQ ID NO: 32186 - RNA, 22 nt, Pseudomonas aeruginosa PA01
gcaggcgcagcaguucgucggc

SEQ ID NO: 32187 - RNA, 22 nt, Pseudomonas aeruginosa PA01
gcaggcgcgccaggugcagcga

SEQ ID NO: 32188 - RNA, 22 nt, Pseudomonas aeruginosa PA01
gcaggcuuucaugcacauggug

SEQ ID NO: 32189 - RNA, 22 nt, Pseudomonas aeruginosa PA01
gcagggccuugucggucagggg

SEQ ID NO: 32190 - RNA, 22 nt, Pseudomonas aeruginosa PA01
gcaggucgagcaguaccgcgcu

SEQ ID NO: 32191 - RNA, 22 nt, Pseudomonas aeruginosa PA01
gcaguggugcuggugcagcaug

SEQ ID NO: 32192 - RNA, 22 nt, Pseudomonas aeruginosa PA01
gcagugguucugggucucgcug

SEQ ID NO: 32193 - RNA, 22 nt, Pseudomonas aeruginosa PA01
gcaguucgaacagcgccggcag

SEQ ID NO: 32194 - RNA, 22 nt, Pseudomonas aeruginosa PA01
gcaguugcugaagaccgggcag

SEQ ID NO: 32195 - RNA, 22 nt, Pseudomonas aeruginosa PA01
gcaguugucauagcggcaguau

SEQ ID NO: 32196 - RNA, 22 nt, Pseudomonas aeruginosa PA01
gcaucagucacccugcgccucc

SEQ ID NO: 32197 - RNA, 22 nt, Pseudomonas aeruginosa PA01
gcauccgcgauguguucgaggg

SEQ ID NO: 32198 - RNA, 22 nt, Pseudomonas aeruginosa PA01
gcaucgagaugaauugcgccag

SEQ ID NO: 32199 - RNA, 22 nt, Pseudomonas aeruginosa PA01
gcaucgugcggcaugucuucca

SEQ ID NO: 32200 - RNA, 22 nt, Pseudomonas aeruginosa PA01
gccaaucgcccuuugcggcgug

SEQ ID NO: 32201 - RNA, 22 nt, Pseudomonas aeruginosa PA01
gccaccacccgggugcgcucca

SEQ ID NO: 32202 - RNA, 23 nt, Pseudomonas aeruginosa PA01
gccaccccauaugccuggcgugc

SEQ ID NO: 32203 - RNA, 22 nt, Pseudomonas aeruginosa PA01
gccagcaguucgcgggcacggg

SEQ ID NO: 32204 - RNA, 22 nt, Pseudomonas aeruginosa PA01
gcgccagggucacccguggcuc

SEQ ID NO: 32205 - RNA, 22 nt, Pseudomonas aeruginosa PA01
gcgccccgccaggagccuacgg

SEQ ID NO: 32206 - RNA, 22 nt, Pseudomonas aeruginosa PA01
gcgccccggugccgccguggaa

SEQ ID NO: 32207 - RNA, 22 nt, Pseudomonas aeruginosa PA01
gcgcccggugugccggcuggcg

SEQ ID NO: 32208 - RNA, 22 nt, Pseudomonas aeruginosa PA01
gcgcccugcucgaccaggcgcu

SEQ ID NO: 32209 - RNA, 22 nt, Pseudomonas aeruginosa PA01
gcgccgacagcggcaccccggc

SEQ ID NO: 32210 - RNA, 22 nt, Pseudomonas aeruginosa PA01
gcgccgaggcaggcguggaccu

SEQ ID NO: 32211 - RNA, 22 nt, Pseudomonas aeruginosa PA01
gcgccuuguucgccuggcgucg

SEQ ID NO: 32212 - RNA, 22 nt, Pseudomonas aeruginosa PA01
gcgcgacgcggggauggacgug

SEQ ID NO: 32213 - RNA, 22 nt, Pseudomonas aeruginosa PA01
gcgcgacgcuguugcuggcggg

SEQ ID NO: 32214 - RNA, 22 nt, Pseudomonas aeruginosa PA01
gcgcgccucuuccagcagccag

SEQ ID NO: 32215 - RNA, 22 nt, Pseudomonas aeruginosa PA01
gcgcggaucccgcgacuagcag

SEQ ID NO: 32216 - RNA, 19 nt, Pseudomonas aeruginosa PA01
gcgcggggugcggaugcug

SEQ ID NO: 32217 - RNA, 21 nt, Pseudomonas aeruginosa PA01
gcgcggugucgccaucgcgac

SEQ ID NO: 32218 - RNA, 22 nt, Pseudomonas aeruginosa PA01
gcgcugaagccgauccgcccgg

SEQ ID NO: 32219 - RNA, 22 nt, Pseudomonas aeruginosa PA01
gcgcugaucgacugguccagca

SEQ ID NO: 32220 - RNA, 22 nt, Pseudomonas aeruginosa PA01
gcgcuggccguagcccugguac

SEQ ID NO: 32221 - RNA, 22 nt, Pseudomonas aeruginosa PA01
gcggaauggcugucgccccaac

SEQ ID NO: 32222 - RNA, 22 nt, Pseudomonas aeruginosa PA01
gcggaccugcucggccagcacc

SEQ ID NO: 32223 - RNA, 22 nt, Pseudomonas aeruginosa PA01
gcggacgcucuucggugaagcg

SEQ ID NO: 32224 - RNA, 22 nt, Pseudomonas aeruginosa PA01
gcggacgggccuucuucgccgg

SEQ ID NO: 32225 - RNA, 22 nt, Pseudomonas aeruginosa PA01
gcggaucaccgcgauguugcag

SEQ ID NO: 32226 - RNA, 22 nt, Pseudomonas aeruginosa PA01
gcggaucgcucucgccggccaa

SEQ ID NO: 32227 - RNA, 22 nt, Pseudomonas aeruginosa PA01
gcggaucggacgguugcggugc

SEQ ID NO: 32228 - RNA, 22 nt, Pseudomonas aeruginosa PA01
gcggaugcugauggugccgucc

SEQ ID NO: 32229 - RNA, 22 nt, Pseudomonas aeruginosa PA01
gcggcccagcgguucgccggcc

SEQ ID NO: 32230 - RNA, 22 nt, Pseudomonas aeruginosa PA01
gcggccgcugaacauccgccug

SEQ ID NO: 32231 - RNA, 22 nt, Pseudomonas aeruginosa PA01
gcggccuaccgcaaguuguggg

SEQ ID NO: 32232 - RNA, 22 nt, Pseudomonas aeruginosa PA01
gcggccugguguuccaggccuu

SEQ ID NO: 32233 - RNA, 22 nt, Pseudomonas aeruginosa PA01
gcggccuucgaccggguacgca

SEQ ID NO: 32234 - RNA, 20 nt, Pseudomonas aeruginosa PA01
gcggccuugcgcagcuugcc

SEQ ID NO: 32235 - RNA, 18 nt, Pseudomonas aeruginosa PA01
gcggcgccgggccagcag

SEQ ID NO: 32236 - RNA, 22 nt, Pseudomonas aeruginosa PA01
gcggcgcgggucuggcugagca

SEQ ID NO: 32237 - RNA, 22 nt, Pseudomonas aeruginosa PA01
gcggcgucggcaagaccaaugu

SEQ ID NO: 32238 - RNA, 22 nt, Pseudomonas aeruginosa PA01
gcgggacaaugacacuggccuc

SEQ ID NO: 32239 - RNA, 22 nt, Pseudomonas aeruginosa PA01
gcgggccuggagaggcaguucg

SEQ ID NO: 32240 - RNA, 22 nt, Pseudomonas aeruginosa PA01
gcgggcgcgucccgguugcccg

SEQ ID NO: 32241 - RNA, 20 nt, Pseudomonas aeruginosa PA01
gcgggcgggcucuaccuggc

SEQ ID NO: 32242 - RNA, 21 nt, Pseudomonas aeruginosa PA01
gcgggcguccaacugcgccug

SEQ ID NO: 32243 - RNA, 22 nt, Pseudomonas aeruginosa PA01
gcgggcguuggccgaacgccuc

SEQ ID NO: 32244 - RNA, 22 nt, Pseudomonas aeruginosa PA01
gcgggcugcgccaggguguugc

SEQ ID NO: 32245 - RNA, 22 nt, Pseudomonas aeruginosa PA01
gcgggucagccugcgcuugcca

SEQ ID NO: 32246 - RNA, 22 nt, Pseudomonas aeruginosa PA01
gcgggucagcggcggcaucagg

SEQ ID NO: 32247 - RNA, 22 nt, Pseudomonas aeruginosa PA01
gcgguagggcgaauaaccgcuu

SEQ ID NO: 32248 - RNA, 22 nt, Pseudomonas aeruginosa PA01
gcggucguugauguacuugaag

SEQ ID NO: 32249 - RNA, 22 nt, Pseudomonas aeruginosa PA01
gcggugacgaucuccuugauuc

SEQ ID NO: 32250 - RNA, 22 nt, Pseudomonas aeruginosa PA01
gcggugaguacuacgaaguuga

SEQ ID NO: 32251 - RNA, 22 nt, Pseudomonas aeruginosa PA01
gcggugaucgcccacaugaucg

SEQ ID NO: 32252 - RNA, 22 nt, Pseudomonas aeruginosa PA01
gcgguucagcgaagcggugaug

SEQ ID NO: 32253 - RNA, 22 nt, Pseudomonas aeruginosa PA01
gcgguucagggugaugccggag

SEQ ID NO: 32254 - RNA, 22 nt, Pseudomonas aeruginosa PA01
gcguccaguugcgaucggagcg

SEQ ID NO: 32255 - RNA, 22 nt, Pseudomonas aeruginosa PA01
gcgucgcacccgcagguggaag

SEQ ID NO: 32256 - RNA, 22 nt, Pseudomonas aeruginosa PA01
gcgugcacuuacuccgaaggcu

SEQ ID NO: 32257 - RNA, 22 nt, Pseudomonas aeruginosa PA01
gcgugcccucaggcaaugcuca

SEQ ID NO: 32258 - RNA, 22 nt, Pseudomonas aeruginosa PA01
gcgugccgucuuccagggugcc

SEQ ID NO: 32259 - RNA, 22 nt, Pseudomonas aeruginosa PA01
gcguucggcaaaggugccuacg

SEQ ID NO: 32260 - RNA, 22 nt, Pseudomonas aeruginosa PA01
gcuacgccgagcgugccgaaga

SEQ ID NO: 32261 - RNA, 21 nt, Pseudomonas aeruginosa PA01
gcucacgccccagcgcaucgc

SEQ ID NO: 32262 - RNA, 22 nt, Pseudomonas aeruginosa PA01
gcuccauuuauccaggggcaga

SEQ ID NO: 32263 - RNA, 22 nt, Pseudomonas aeruginosa PA01
gcucgaccuugaugucuuccag

SEQ ID NO: 32264 - RNA, 22 nt, Pseudomonas aeruginosa PA01
gcucgccgacgucgccagcgac

SEQ ID NO: 32265 - RNA, 22 nt, Pseudomonas aeruginosa PA01
gcucgcggucgcccuggccauu

SEQ ID NO: 32266 - RNA, 22 nt, Pseudomonas aeruginosa PA01
gcucgcugaagacgcuacgggu

SEQ ID NO: 32267 - RNA, 22 nt, Pseudomonas aeruginosa PA01
gcucggggaucuucgcccagac

SEQ ID NO: 32268 - RNA, 22 nt, Pseudomonas aeruginosa PA01
gcucgggucgagggccuugaga

SEQ ID NO: 32269 - RNA, 22 nt, Pseudomonas aeruginosa PA01
gcucggugccgagguggcccug

SEQ ID NO: 32270 - RNA, 22 nt, Pseudomonas aeruginosa PA01
gcucgucggugaccggcgagac

SEQ ID NO: 32271 - RNA, 22 nt, Pseudomonas aeruginosa PA01
gcugaccuguugcucgacgucg

SEQ ID NO: 32272 - RNA, 22 nt, Pseudomonas aeruginosa PA01
gcugaccuucgaguuguucucc

SEQ ID NO: 32273 - RNA, 22 nt, Pseudomonas aeruginosa PA01
gcugagcauugccugagggcac

SEQ ID NO: 32274 - RNA, 22 nt, Pseudomonas aeruginosa PA01
gcugagccgcaauagccgcagc

SEQ ID NO: 32275 - RNA, 22 nt, Pseudomonas aeruginosa PA01
gcugaucaaccgggauugcuac

SEQ ID NO: 32276 - RNA, 22 nt, Pseudomonas aeruginosa PA01
gcugcaggucggggagggcgag

SEQ ID NO: 32277 - RNA, 20 nt, Pseudomonas aeruginosa PA01
gcugcccugggacaaggccc

SEQ ID NO: 32278 - RNA, 20 nt, Pseudomonas aeruginosa PA01
gcugccguuauccguccugc

SEQ ID NO: 32279 - RNA, 22 nt, Pseudomonas aeruginosa PA01
gcugcgcaucggcaccgaaggc

SEQ ID NO: 32280 - RNA, 22 nt, Pseudomonas aeruginosa PA01
gcugcgcgagcguggcugggac

SEQ ID NO: 32281 - RNA, 22 nt, Pseudomonas aeruginosa PA01
gcugcuccacauagcgcgcgug

SEQ ID NO: 32282 - RNA, 22 nt, Pseudomonas aeruginosa PA01
gcugcuguugcuggugaucauc

SEQ ID NO: 32283 - RNA, 22 nt, Pseudomonas aeruginosa PA01
gcuggagcuucgccggaagcgg

SEQ ID NO: 32284 - RNA, 22 nt, Pseudomonas aeruginosa PA01
gcuggccucgggccacgccuuc

SEQ ID NO: 32285 - RNA, 22 nt, Pseudomonas aeruginosa PA01
gcuggcggagaagugcggguug

SEQ ID NO: 32286 - RNA, 22 nt, Pseudomonas aeruginosa PA01
gcuggcgucgcuccugcuggcc

SEQ ID NO: 32287 - RNA, 22 nt, Pseudomonas aeruginosa PA01
ggcgggaucgccuuggucgggu

SEQ ID NO: 32288 - RNA, 22 nt, Pseudomonas aeruginosa PA01
ggcgggugcucggagcgcuugc

SEQ ID NO: 32289 - RNA, 22 nt, Pseudomonas aeruginosa PA01
ggcggucguggccgucgacccg

SEQ ID NO: 32290 - RNA, 22 nt, Pseudomonas aeruginosa PA01
ggcggucucggacaggccggca

SEQ ID NO: 32291 - RNA, 22 nt, Pseudomonas aeruginosa PA01
ggcggugaugugcguggaugau

SEQ ID NO: 32292 - RNA, 22 nt, Pseudomonas aeruginosa PA01
ggcggugucgaagcagauccau

SEQ ID NO: 32293 - RNA, 22 nt, Pseudomonas aeruginosa PA01
ggcgguucaccugcaccugcug

SEQ ID NO: 32294 - RNA, 22 nt, Pseudomonas aeruginosa PA01
ggcgucacgcgcuuccggcugg

SEQ ID NO: 32295 - RNA, 22 nt, Pseudomonas aeruginosa PA01
ggcgucgaguucggucagguug

SEQ ID NO: 32296 - RNA, 22 nt, Pseudomonas aeruginosa PA01
ggcgugguggucaugcagguga

SEQ ID NO: 32297 - RNA, 22 nt, Pseudomonas aeruginosa PA01
ggcguucaucgccaggugcagc

SEQ ID NO: 32298 - RNA, 22 nt, Pseudomonas aeruginosa PA01
ggcguuccgccuaccugguguu

SEQ ID NO: 32299 - RNA, 22 nt, Pseudomonas aeruginosa PA01
ggcguucuccacuuccuggcgc

SEQ ID NO: 32300 - RNA, 22 nt, Pseudomonas aeruginosa PA01
ggcuccugguugccgggagcgg

SEQ ID NO: 32301 - RNA, 22 nt, Pseudomonas aeruginosa PA01
ggcucgcgagcgccagggcaac

SEQ ID NO: 32302 - RNA, 22 nt, Pseudomonas aeruginosa PA01
ggcugccgggccggcaagagac

SEQ ID NO: 32303 - RNA, 22 nt, Pseudomonas aeruginosa PA01
ggcuggcgauugcuguuaccau

SEQ ID NO: 32304 - RNA, 22 nt, Pseudomonas aeruginosa PA01
ggcuggucgguagccugcaggc

SEQ ID NO: 32305 - RNA, 22 nt, Pseudomonas aeruginosa PA01
ggcuucgacgccgcuguagccg

SEQ ID NO: 32306 - RNA, 22 nt, Pseudomonas aeruginosa PA01
ggcuucggcuccccagccggac

SEQ ID NO: 32307 - RNA, 22 nt, Pseudomonas aeruginosa PA01
ggcuucgucaguggucagguug

SEQ ID NO: 32308 - RNA, 22 nt, Pseudomonas aeruginosa PA01
ggcuugcccguaggugucgugg

SEQ ID NO: 32309 - RNA, 22 nt, Pseudomonas aeruginosa PA01
gggagauggucgaggacaugau

SEQ ID NO: 32310 - RNA, 22 nt, Pseudomonas aeruginosa PA01
gggagcuggccgaugaucucgg

SEQ ID NO: 32311 - RNA, 22 nt, Pseudomonas aeruginosa PA01
gggcaccauccgcgcggccauc

SEQ ID NO: 32312 - RNA, 22 nt, Pseudomonas aeruginosa PA01
gggcagagcgaagacccgccgu

SEQ ID NO: 32313 - RNA, 22 nt, Pseudomonas aeruginosa PA01
gggcagcucgaggucuucgucg

SEQ ID NO: 32314 - RNA, 22 nt, Pseudomonas aeruginosa PA01
gggccagcucuucggcgauggu

SEQ ID NO: 32315 - RNA, 23 nt, Pseudomonas aeruginosa PA01
gggccaggcgcugcugcacgccg

SEQ ID NO: 32316 - RNA, 22 nt, Pseudomonas aeruginosa PA01
gggcccgguucgucgggcuuga

SEQ ID NO: 32317 - RNA, 22 nt, Pseudomonas aeruginosa PA01
gggccgauggcaucgacccgcu

SEQ ID NO: 32318 - RNA, 22 nt, Pseudomonas aeruginosa PA01
gggccgcccggcgggaucuugc

SEQ ID NO: 32319 - RNA, 22 nt, Pseudomonas aeruginosa PA01
gggccgggcuucagcaucgacg

SEQ ID NO: 32320 - RNA, 22 nt, Pseudomonas aeruginosa PA01
gggcgaggaagccgccggcguc

SEQ ID NO: 32321 - RNA, 22 nt, Pseudomonas aeruginosa PA01
gggcgauccgcucgcugcgcca

SEQ ID NO: 32322 - RNA, 22 nt, Pseudomonas aeruginosa PA01
gggcgcaguccgguggccuucc

SEQ ID NO: 32323 - RNA, 22 nt, Pseudomonas aeruginosa PA01
gggcgcgggugcgguagaacga

SEQ ID NO: 32324 - RNA, 22 nt, Pseudomonas aeruginosa PA01
gggcgcucgucguuggcgcugu

SEQ ID NO: 32325 - RNA, 22 nt, Pseudomonas aeruginosa PA01
gggcgcuggcguuguugauggc

SEQ ID NO: 32326 - RNA, 22 nt, Pseudomonas aeruginosa PA01
gggcggauaacgccccuggcgu

SEQ ID NO: 32327 - RNA, 22 nt, Pseudomonas aeruginosa PA01
gggcggucggcagcgcucaugu

SEQ ID NO: 32328 - RNA, 22 nt, Pseudomonas aeruginosa PA01
gggcuuguucagcgccagguag

SEQ ID NO: 32329 - RNA, 22 nt, Pseudomonas aeruginosa PA01
ggggccgaucagcaccaguucg

SEQ ID NO: 32330 - RNA, 22 nt, Pseudomonas aeruginosa PA01
ggggcuggcguugcugccgucg

SEQ ID NO: 32331 - RNA, 22 nt, Pseudomonas aeruginosa PA01
ggggcugguggagcugcguuuc

SEQ ID NO: 32332 - RNA, 22 nt, Pseudomonas aeruginosa PA01
gggguaccggccaguugugcgg

SEQ ID NO: 32333 - RNA, 22 nt, Pseudomonas aeruginosa PA01
ggggugcugaucggcgucgugc

SEQ ID NO: 32334 - RNA, 20 nt, Pseudomonas aeruginosa PA01
ggguacgugcgcgcugggcg

SEQ ID NO: 32335 - RNA, 22 nt, Pseudomonas aeruginosa PA01
ggguccgaggagguguugcugg

SEQ ID NO: 32336 - RNA, 22 nt, Pseudomonas aeruginosa PA01
gguagcggcgggcgaacgacuc

SEQ ID NO: 32337 - RNA, 22 nt, Pseudomonas aeruginosa PA01
gguaggcgcguuccagguccug

SEQ ID NO: 32338 - RNA, 22 nt, Pseudomonas aeruginosa PA01
gguagguggcguugucgcgcug

SEQ ID NO: 32339 - RNA, 22 nt, Pseudomonas aeruginosa PA01
gguauugcggaagucgccgagg

SEQ ID NO: 32340 - RNA, 22 nt, Pseudomonas aeruginosa PA01
gguccucggcgaggaguucggc

SEQ ID NO: 32341 - RNA, 22 nt, Pseudomonas aeruginosa PA01
gguccugagccaggcgggcgua

SEQ ID NO: 32342 - RNA, 22 nt, Pseudomonas aeruginosa PA01
ggucgccgagguacuccgccag

SEQ ID NO: 32343 - RNA, 19 nt, Pseudomonas aeruginosa PA01
ggucgcgccgaacaccgcg

SEQ ID NO: 32344 - RNA, 22 nt, Pseudomonas aeruginosa PA01
ggucgcgguucucgaucagggc

SEQ ID NO: 32345 - RNA, 22 nt, Pseudomonas aeruginosa PA01
ggucggcgaccuggcggaccuc

SEQ ID NO: 32346 - RNA, 23 nt, Pseudomonas aeruginosa PA01
ggucggcggccucugguugcugc

SEQ ID NO: 32347 - RNA, 22 nt, Pseudomonas aeruginosa PA01
ggucgggccgaucugcgcgccc

SEQ ID NO: 32348 - RNA, 21 nt, Pseudomonas aeruginosa PA01
ggucgggccggugaaaccgac

SEQ ID NO: 32349 - RNA, 22 nt, Pseudomonas aeruginosa PA01
ggucuacgggaugaccgagaac

SEQ ID NO: 32350 - RNA, 22 nt, Pseudomonas aeruginosa PA01
ggugaaggacgccagcaccgcc

(The sequence listing continues in the following parts.)

The invention claimed is:

1. An isolated nucleic acid, wherein the sequence of the nucleic acid is selected from the group consisting of:
   (a) a sequence consisting of SEQ ID NO: 348;
   (b) a sequence consisting of nucleotides 14-34 of SEQ ID NO: 4233864;
   (c) a sequence consisting of nucleotides 14-36 of SEQ ID NO: 4233864;
   (d) a sequence consisting of nucleotides 14-37 of SEQ ID NO: 4233864;
   (e) a DNA encoding the nucleic acid of any one of (a)-(d), wherein the DNA is identical in length to (a)-(d), respectively; and
   (f) the complement of any one of (a)-(e), wherein the complement is identical in length to (a)-(e), respectively.

2. An isolated nucleic acid, wherein the sequence of the nucleic acid is selected from the group consisting of:
   (a) SEQ ID NO: 4233864;
   (b) a DNA encoding the nucleic acid of (a), wherein the DNA is identical in length to (a); and
   (c) the complement of (a) or (b), wherein the complement is identical in length to (a) or (b).

3. A vector comprising a human insert, wherein the human insert consists of the sequence of the nucleic acid of claim 1, and wherein the vector comprises no other inserts but the nucleic acid of claim 1.

4. A vector comprising a human insert, wherein the human insert consists of the sequence of the nucleic acid of claim 2, and wherein the vector comprises no other inserts but the nucleic acid of claim 2.

5. A probe consisting of a human insert, wherein the human insert consists of the sequence of the nucleic acid of claim 1.

6. A probe consisting of a human insert, wherein the human insert consists of the sequence of the nucleic acid of claim 2.

* * * * *